United States Patent 11,913,074 (METHODS FOR ASSESSING RISK OF DEVELOPING A VIRAL DISEASE USING A GENETIC TEST) - sequence listing, part 8

SEQ ID NO: 245 - DNA, 1048733 bp, Homo sapiens
  source 1..1048733: mol_type = genomic DNA
tgtgaaatcagaagtttaatatgacacaattaaatatatttgtatatctcacaccggaggtttctcttcaaacataaggagttagaaattacaagtaggcatatgcttcctatattcagataaattcatttcgattaattaaattccagatagagagaagtaattttggaaaagaaatgatagctatattaaagcagatattcattacaataccatgtagagacataagcaatattttggcatcattctgtccgctcagtaggccgtgttccctctggtagggcctttggagagtaccatctatctaagatggaggaatgctgtgggaagggcgggatggaggtgcgttttctacgctgaaccccacacaggaaatctgcagcccacacagctgcctctgtgccgccttccatgtgatcatcttggtcaatgaagtgaattgtcctatttctggggtagggggtgatggcgaatcggatactcaaatgttattttgtcaaatccgaatcatctctacgtgcttaggtttacatgatgtcaaaacacgtggttcattaagtgatcccgggaagaggggcagggccggtcggctggtttctcacttcccttccaggctctacgcagtgcgtgcaggtcgccctgatctcctctcccgggagggaaatgctcgcagccctctccgagttgccctgatctccttctctcccaggagggaaatgtcccctctctggggccccacaggtccgggacgtgcctggaggagccagcgggggcctggcagggttcgtgtgctcccggggaccctcatagcttgctcaatgcccagatttgttcttcctggttgtggttatctcacaggtaagcattcacgggggcatctgttttcataacgtagaaatcaatattttaacattaaaaacacatctcaatgttggggtgcatctgtaactttgcaaaggtgaggtcaggggagtgccagcctcaagtgggcactactcatggggtgcacaggtgtctgcccccggggagcccctgaatcactctgcttgggctgacaggtgtggctgacggggccgtccatggtacccggcgcagtgttgatggagacgcagcgaggagctgtgattgtctcacttgccccgaagctgcaggacgttcagttctgtccctgcggcttctcccaatgataaactctctcaaagagaaatgccaaacgtgccttgtgtgccgggcggcctcactgagtgctgccagcttccccggccactcctgcacagtggatccaccctcccgaaagtggcagatgacaagcacactcttcctggaaaccgcctcgaacgtgctggctactgcattgttaacacaacttcaaccaagaaggtgaacgggtgctttaagaaaaagtattttttttaagcaagtgaaaattgatgaaccgattcccctccacccgtaactggatttttccacaaatctctctttattattgtttgattaaacaaaaatacacttttaactgctaaactgcgctgactacgggagagctaagggccctattactatgcagttataatagaagacacacaattaaagtcagatcatgattcctgacaacatccgtggggtgggggctcccctgaggcccctgaggctgccgctcactggggaagggccttgaggatggcgttcacctcctcagccacggctgtcagcgcgaactcaaactgctcctgcagggcgagaaacgagagaagtgccaatgagagcggcgtccccccgactcctgccacagcgtcggctccctgcagatgaaagcggcgtccccccttcccaacgcagcatcagctccccgggccatttcgcagaaagaaattgtttagcaaaaaaaagcaaaaggctcagatttccttagaaaggacagtgtacccttcggtttgggagacacaacagtgacacatgtttgagcttctctcgcactagaaaagcctcatctttccccctgcggggagaagctgcccacagaagcagcgagaaggcaacggttcctgcgtactgccctgtccttctgaccctacgactccacgattcctcctcacagccacccgccttggtggacggtgtgaggggcaggtgcagacactacaaagacgtggccattaaaactcacaatgagggccatgcttgggcgtttcctgtcctcggaagtgtggtgttatcatcgcttttgaaatccacctgttactcagaccaaacccactccgttccacatgctgagaaacctccccttgtccacacccctcctggctcagggcatgcgcgtccacagccacttgggcaggcacacctgaggggcacccctccctccacggacagcctgccgagagcatccagtgggcacgagggacgggttcacgatgccaggactattcgctcctccaaagaccagggcttagcgccggagagcgtatctgcctcctctcccacagatgaggtggataaatgctcatttcctcttgctcttcagtttccacctcaaaacactgctatggaaaactccaaagcaggccagcagcactccagctacagctgagaacgcgtggacggaaacaacactgttacccagctaacaacttctggaaggaaagccctgttgacagctccaatacttgatcatttaaggaacagggcagccccaagccaaaaacgatgattaatttccagttttgaatgtttagtgcataacagaaagatggaaaatagcttgaaccgagacatcagaaagtcaaaataacgtgatgctcattctgagacaaaagacagtttctcctttcatattcttctgccctgatgctgacggaatggtctgctggactctacctgcctttggtagtgtggccacgcggcctcttagtgtacgtgttagaacctattattaaaggagtcaactgagcctggcggccacctcagggtgggacccggggagatgtgtctgcctgcgccccgtctctctcccctctgcactgccagagggcacctttctgctcctcgaaattacgtgggagctgcccctgtgggggcaggggctcaggtcgggctgtgccgggaaggtccgcaaacgttctgtctaaatgctgactcctgcccctcccacaccaagtgtgttcgatgaaggtgctgtttaggggatccaggctaaatacacaacagccattcagaccatttcttccccagtgctgggctgccagtgccctgaggctctgtgagggcttggagatgccaaaaattaagcgtggctttttgggaagcgaaatgcaagtgtcatctatctatttacatcttccgacacactggaaatctagcctgagaaatgatctttaaagggaagaatagagaagcgctgccgccccgcagccccatcatgcagtggaggctggaaagcgctccacccccagggccagtgctaatcctgcagagctgcccagcggcctctcaggcagccacttgcggcatccaacaggaaagcccaatatccatgctatgggggaggggacgggcagggggaactccaccagggtctggatcataactgtttccaacactgcacagtcaccggacagagcagcaggaagggaaccgggccacagagacaggtgctctactcactggccatgtttggcaattgttaccgcactgtttagctcaaaggagaagctccaccgggcgtgtgggctggtgtgtgccgtgcaccttactcagagcccactgggccctgtgggcgtcggctggcaggaggagggggtgcttcccggaggggtgctgtgagcctcagagctggcgtttgaggggacaggggcttgtggatcatcttgtcctttatcgtgaagtgtcagctgcatgcggcgccgggatgtagcacccaagccctgtgggtcctcgaaggtctgtggccacgttctgagcagaatccgctgagcaagtatcacctagaaccatgctctagatcccgggtaggctgggaaaaccccagcatttggataacttttatgataggagtttatttcaaaggagtaaaatacaacagcaacagatgaccagatgaccatcttagcctaaactgcatctgagtgccagcagtctgaacaggaggggtgcaaagcctcctgggtttgcaaagacaggacattcgagaggccgagtcaggacattctaagcaagaaagcatttttgaacacatactacaataaaatttgaggcctgttggagaaagatcccacggcttcttccagtagaactgcacccggtggagaagtggctgaggtgggacggccgagccaggctcaggccaggtcaggctgtctggtcaccacccctgggtccacgctggacagcgagtgggaacgccccttctcaggctgtcctgggacaaccacggggtgcccacatagttggtggagggatggaggctgcaggagctgccatggctctcggacacccgctgctggggtaagggtcagccagggctggaagccgtggagctttgtggaggctgcttggatttctatttgtgcttatgtttatatttgtaatccttcaggtgtaaacaaaggcctgggtggagatgtacaaataggaaccttaaagaggacctcagtgatcgtgtctctgagccacctgtgccctccaggaggctgcacacataactgcggggcagcttcccccagcacctctcaaaagggggtgaggatgacacaccttcctgtgtctgtcaccttcagcttctcttttcacaaaagtagacaagctccaagccacaccgtgagagttgagccctgcccaagttagggactaggcattgtgtgtgtgtacaccagggcggagggacagagacggagatggagagagatgggagacagatggagagagacagagagaggtggagagagatggagagcggtggagagagacagagagaggtggagagagacggagagaggtggagagagacggagagaggtggagagagacggagagaggtgaagagaggcggagagaggtggagagagatggagagaggcggagagaggcggagagagacggagagaggtggagagagacggagagaggtggagagagatggagagctacggaaatgaacagtttcaatggcacgggaggccttgggagaagtgggctgcgggcctggagctgatgtgtgagcgtggactgcgctacgcgtgacagaatccgtgtctgtcactccggtgctgtgctgggttgggaagataggagcatgtctgggcaacgccctgcttctgggacggaggacaacaccgggtacgtctgaggaggaggctgaggtcaggctttaggacaaggggctggtgcagaagaaaatggggaagaaactaaaatgcagatgtgagacggcaggttggggagagtgacgcacgggcagcacgtggacatgcgaggggcctcccgtccagtgaggagggggcggggcctcccgtccagtgaggagggcatggggcttcttgggtgtgggacacactcatcactggctctacttctggaactgacagatgtaaaagaggaaacaccattgtgggcaggaaagtgttaaggtccttggtgaaatgggaaactcttgagacgtgtggagggaaggaagggaagaacccatcatctaccacagaggcatggacgggagagaggggtgatttcagccttgtctggcatcccttgtgtctgctgagggtgtgtgcacacgggaatgtgtgcgggtgtgtgtgcgtgcatgcagctgtgtgtggatgtgcatcgtgtgtgggtgtgtaggtgtgtgtgggtgtgtgcagcagtgcaggtgtgcatgggtgtgtacaggtgggtgtgtggatgtgtgtgggggtgtgcacagctgtgcaggtgtgtgggtgtgcagggtccatgactgtgtgtgggtgtgcactgtgtgtacacctgtggaggtgtgtgggtgtgtgcagtgtgcatgggtgtgtgtgtgggtgtgcaccccgtgggtgggtgtgtaggtgtgtgtggggtgtatgcatgggtgtgtgcaggtgtgtgggtgtgtgcagtgtgtggctgagtggtgtttgtgggtgtctgtgggtgtgtgtgcaatgtgtgggtgtgcgcagtgtccgtggctgtgtgtaggtgtgcactgtgtgcaggtgtgtgcgtgtgagcagtgtgcacggctgtatgtgggtgtgtaccacatgcgtgggtgtgtaggtgtgtgtggggggtgtgcctgggtgtgtgcatggggatgcgcagtgtgtggctgagtgtgggtgtgcactgcgtgagtgggtgtgtaggtgtgtgtggatgtatgcatgggtgtgtgcaggtgtgtgggtgtgcagtgtccctggctgcgtgtgggtgtgcgcagtgtgcaggtgtgtgggtgtacacagtgtgtgtggctgagtgtgccgcctctctggcggctcgtgtggtgtcaaagcccgcactgccgttcagcccctgggtgcctggacttctcttctaagatgatggagtttgtggtcggggactgagttgccaaatgctcaggtgggcgctggtgaaacattttctattcgacccaaattccagggaggaaacagctctcctgaggggcatcttttttaccacaacgatgatgttttgctgtcagggcctgcggtcatcctggtcatggtctccgggtgctcaccctcgacggctcgctctttccttgtcttcagttccaaaccaggcgacgtgacttcctccgttcaaaggagctgcaggcgcctcctcttggcttcgtagaagcaagcattcagattggacagcagcattttgcccaaataatttttctatctttgtgaaactgaacttgtaggggaagtttagtctcggggcgatgttgggcagcgcagtcacggattaagatgtgatggtgactttcgcatggttccatttccttatgccttgaagttccaggagctgaatttatgtgcatgctccaagacagctcctgaacacacaccctgaggaagagggtgaactcctccggacgcccagtccaagaaggaagcagctaggaagctgactctgttatctggagtgcagaaaacggagcttcgggtcaccaagtgatctgggcaacagggctggggtgtgtatgtgttatcatcttgctatttatttatttatttatatttaagttctgggatacatgtgcaggacgggcagctttgttacataggtaaacgtatgccatggtggtttgccgcacccatgaatccatcaccgaggaattaagctccgcatgcattagctatcatcctgatgctccccatcccccttccccactgacaggccccagtgtgtgctattcccctcccagtgtccatgtgttctcattgttcagctgtcatttataagtgggaacaggcagtgtttggttttctgttcctgtgtttgtttgctgaggatgatggcttccagccccatccatgtcgctgtaaaggacatgatctcattcctttttatggctgcatagtcttccatggtgtatatgtgccacattttctttatccagtctatcattgatgggcatttgcgttggttccatgtctttgctgccatcttgccatttaaaaatggagtagaacggaagacctggcatgtaatgattgtgactgtggcttcctctttctctgatgagtcccaaagcacctcacttcacgaagggtcctgggaccaccgttgtgcacctcagccatctgtgtgccaggaagggcttgttctggcgaacaggatacatacaatgggaggcttggagggtttgctccttgtgatttttttcacttttggcaaagatatccccttgcgatgattttgcccagacccatcctaaagccagtgtgtgttctgggcaaactcacctgtctggagggaagaggctgcctgacaggcaggtgttctgggtgaactcacccgtctggagggagaggctgcctgagaggcaggcagaggtgtggggaggaaactactttgaatttagatttcctggggcttatcccagagtgggcctcactgtggagtcacgaacacacctgcctgaggtggctctcgctgaccattcctggtaatgtgtgccccgttctcccagcctccatggcctcctctgtccagttcagagccacctgaagctcacgggatgcagggccagccagaaggtggtatgtgccagccttgacaaggccacctcttttactgctaggcagccagtacaggaggatggtcagtgcggcaagatggacccttccaaggttggacccttccatggcacaaaacctggaactccttggtacagagaggccagacacacgtcaacctcacgtccagttcctgttgagccaaagctcatgagaacttttttgttttgatggctgttgctgctggaacagcagctgtcccgtgtcacctcctctctcgacagcctcgcaacacatgccgaatgctgttgtgaacaagcagaaggaaagacagacatgtgcacagtcccagcttctccccgcgggacactgagtaaccacacagggaaaaatcatcacgcagccacgcagaagcctccagacacacacgcctcagtgggtgtagatgtgccgctccctcgtgagggacagtcctgccccctgccctgaccatgggggacgtgggacacgcctagacaagagacgttccacaaagagcaaggccgctggcgctctagaagacctcacagccgtgaagcgtcccggacagcagaggaaccatgatgcccctcgcgtggccgccctgggcgtgtcctgctccaggggaagctccctgggggggcgcgtagggcatcgctgggcctgttggtcagtggtttgcatcggtgctgacttcctgggtttggtcactgcgctgtggttatgtgaggtgttcacatttggggaaacttggtggagggttggtggattatttctgcattttatttatattttttgcttgggaggctgaggcaggagaatcgctttaacctgggaggtggaggttgcagtgagctgagatcgtgccactgcactccagcctgggtgacagagtgagactctgtctcagaaagcaacaacaacaacaaacaaacaacaacaacaacaaaaaccgaataaaatatagtgtcccaagacttacaaagaactttcacaaaatcacgtgatggtcctaccagttgcacagagagggcgaaatgaaaccaaggagcagagaggccaaaggcacaccaaccccagcctcagggccagagagaccagacacacgtcaacctcacgtccagttcttgttgagccaaagctcaccagaattttttttgttttgacctctgttgctgcaaactgggcctcttcagcaagcatgagggattttgggtgctcaaggatgctgtgccctgggggcctccacaaagcgcaggccccggagaggccgggcagcgctcagagagctcagaacatcctcctgagggttctgggatttatcgtcaacctctttctacaaaaatgcagcgttctccccccacccccaaatctagtgaatggaaagagccagtggatcgagttcctaggacttgagatgtggctgcatctggaggtgttgcaggaaacgccagtggacctttgggggcccagaagtgaccccgcccatgcaaggccggcatggacgaggccggtcagagcagagcaatcggtgtgcggctcacattaaaccaggccctccccgtgctcctctcaggaacacggccgcagagaggcaccttgaatgggtctgcgtcccggaggagagactgacagtaccttcgtctggaccatgccgggtctctggtccctcaagtgctccagggtcgctgcgatatcaatctctttagcacctgcaacaaaccacaaattgggctgagttcagagcacaagataatccatgccacatctgtcaatctcctgctagccacgttccctctgggctgagaggccaattgaaaattattacgctcatccctcagccggctggcaggcggctgcaatttcagtgttcatgtagaagacgaaggcaggggcagctttcattagcattaattccagaaagctgggctgaaaaattgttataagatgcttaccaacagcaggccgtcaccgtcagaaaccaaagctgtactggttttcttttctttcttttctttttttttttttttgtgacacttcagggaatgtagtacctcatagggagccatatacgaactttaactttgattgcataggattacttttttatttaaagaaataaaaaatcagattaatttagattaatggactcaaccttaatattggcttttaactgtagagttttctgctttttaaactcaaatgttccacattttgggactgggtaaaggtgcccgtagctactcccagctcagtggttcaccaaaagctccatcctcctgtagacagcaccgatctcacggcaggtgatgctggctgcactcaaatcatgctacttaagttttaaattttaagctaataattaattcagcacatattgttatttttccattttgctaggttctttagtagacagataatgagcaagacagggtcccgacctctccagcgtgttgcagttgagaggggcagacaggacacagccgccaggatgagaaacacagagaagtgtgggatgaggagcaggaggcagctccgaagcgggtcagaatcccacagggaaacccacatgggtgccaggcacttcatgtcacctctaccgaacacggtgaactgagaactgtggtcacccgagtcgcagatgaggaaatagagacgcggccaatggcatgtccaagccacagacaggaagaagccgcagccattggaaccccaactaccgtgggcaggacagcgctggccgaagacctgaggaggcccgggtggcccagagtcaggtggtccccaggcctttctctccggccgcaacctgagtgcacaccacattcctcgcccagcgaatcaggagagaagctttaaaattcccgaggttcctcaatttcctttccctgtggttctgtggcttcatggggtggcaactgtgaagccagtgggggctcaggctccaggaggatcatcccagcagggtagcaggtgcctgcgaagcacctccaagtcacagcaggtgcctgcgaagcacctccaagtcagaactgcgggcagctaggagggaacggcaggggtggcggggaggcctggggaggacacacgttggaaccaaatgtcatgtttgcatgaagggagaacaaagcaggtggtgtggagaatctggctgtcaggacagccccacagcggctccaccagggaggccgggcgcgagatgaccaccccacctgccctgcctggctggtgggtctccccacctttgagcacagaagatggagacactggcatttcctggcaggaacagggctcgtggtgatgggagccactgtcggggctaagctggccgtccctccagctcccatcccctggttaaaggaccccattctcctgggcagggaacaccatgagggccaccaccttttaagccagagcctctgcaggcataaaaggcggctttcttttgcggcagcccgtgagctcggccaccagggaactagctggcagctcacgcgggtggaaggcggggtcaggtgcacgggtttgcttaattgctccttttgggtctccaaaggcctaaaaagtcgacaaggctacagtaaatacaatcttgttttaaaagaaatccataaatttaaaacagcctgacacaaacgggtgagtttgtgaaatggtagagaggaagggaggaagccaaaggacccctcctgcggccatgactgtggcggccaaggaagccgcttcctctcctcctcctcctcccacggacactcctgcagttggtgcctacacagcagaatcatggcagaaacgacgcaggggaactggcctctctgagacaagcttgtcttatgaaagtcaagtccctgcatggagagcgccaggttagtctcagtgtcactgcacaaacattcgtgcttgagccaaaacaactcagaaatgcccatattgtctgttgcacccgtgactgtacctttggtaggagctgtggcttctggacacattgaacccagaactgtgctgcaatttaaatgtgaaaaataccacaactgtaggcagaaggataaataagctgcaattcacagcatctttcaagcatctcaagttggtatagaggctcaagctaaacacagaccccagctggggctcacccaaaggaaggccgctggccaccatgtaccccacagacactgtgcagcccacagccagcatgcaccccacacaccccactatcacacaccccacacaccccacagccaccacacaccccacgcaccccacagccatcacacaccccacagccaccacacaacccacagccaccacgcatcccacagccaccacgcaccccacacaccccacagccatcacacaccccacgggcaccacacaccccacagccaccacacaccccacagccaccacacaccccacagccaccacacaacccacagccaccacacaacccacagccaccatgcaccccacagccagcacgcaccccacagccaccacgcaccccacagccagcacgcatcccacagccaccacacaccccacagccagcacgcaccccatgggcaccacgcaccccacagccaccacacaccccacagccagcatgcaccccatgggcaccacgcaccccacagccaccacacaacccacagccaccacgcaccccacagccaccacacaacccacggccaccacacaccccacagccagcacccaacccacagctggcacacaccccatgaccaccacacactccacagccaccacataccctacaggaaccatgcactctatggccactgcacaccctgtggtcactgaccacacaccccacagccaccgtgtaccccacggccaccacgcaccacattctgcttgattggctctttagaaatcatccagaagaaatggcaagacgtttgctgtttaattaccacgtgtaaaaaacaataacataactaaatagcttcccgataaaaataattctatgtatttttacatatttctatgtacagggaaacctgccctctcatttagaagggaagtcatcgtgcaaagcggctggccgtgtgaataatagctcagaaacggggaaatgtacaggctccatctaacactgggtctcgtaactcctcacacaccccaactgctgacctcagcgagatgctgacctggaccacgtggggaggggatgggccgaggtgcaggatgagggaggctccatgtgctggggcctcacacccacgtttagagcacgctatttgtctttggccatacgctgctgggtttggaaaccgggttctaatacacaaaatgtattacaaccagtcttgtgtaattaaaaacgtaagatgtctattggcttttaagaaattttcccaaaaccaaaaaaggtgagttaaaggcaggagtgctggggttgccgacagacgtcgagttgtgtcacatgacgtggggaagctcgggctacagtgctgaggtgtgggtttccgctccgcgtgcctatgctgggcctggccgggaagctggatgggccagcctcacctctggaggggctttcctcccgtttccagggtccagtgagggtccagtgagatgacgcatgattacgtgtaatttacaaaacacatttgatgctcaggcaacctcacagatctcgtgagcaaactcttctgggagacagtgaaatccaatcagttatgttctctgaagccttccaggcacgaggacagcagcggcttctacggggacccctcagctttctgtctcaggagtcatgaacctcaggagaagcaagtgtggtataaatagtctgactcaagagacggggagctctcagccctcctgagacatcacgttgagggttcatctgggccacagagttaaagcctctctccgttaggtggctttagggtacttgctttcagtccctgaaacttcttttttaaaacgactgtcaacagcaatgtcatctgaagggctgtgtgtatgatggtgctagtgggaatcctgggagactgtccctcactggcaaccgccctcccgaattctggccggagccatgaagccgtcaggagctgtagcaggtgtgggcgaggaaggggctctccctccgcgtgcactgatctctggagatggctgttgctggcggctgtctcccagagtggcgtcgtcgtcctcacataaaatgtgatggataaagtctctcttatttcatgacatcgtggctccctctcaggctgtggtttgtgaggaaaagtgaaaaaagggaaggagaaagacttgccgggccatccccagacaacatggggagaaccgggcggaaatacaaaatgacacgggagcgtgcctccgagtcgcgctgagcccgagaccaaaactgaagagcggaggaaacggagttaacgcttaaaaagtgtgcagcaccagcattaggtccataatgatgtagcaggaaaatcaactgtctgctgtggacggctcctgcttcttgcatgccaggattaagactaactccttacttcaagtgtggtggagacagaagctttcatagagcccatgcatgagatctttcataagggacagaccctggatagccaggctcaggctgggcgccgtatcctgcccgctctggtgccctcctgagcatgggtacggccaggccgggcgccggatcctgcccgctctcgtgccctcctgggcatgggtgcggccaggccgggcgccggatcctgcccgctcgcgtgccctcctgggcatgggtgcggccaggccgggcgccggatcctgcccgctctcgtgccctcctgggcatgggtgcggccaggccgggcgccggatcctgcccgctctcgtgccctcctgggcatgggtgcggccaggccgggcgccggatcctgcccgctctcgtgccctcctgggcatgggtgcggccaggccgggcgccggatcctgcccgctctcgtgccctcctgggcatgggtgcggccaggccgggcgccggatcctgcccgctctcgtgccctcctgggcatgggtgcggccaggccgggcgctggatcctgcccgctcttgtgccctcctgagcatgggtgtggccaggccgggcaggggcacaacgttggcattgataaagcacctgctgggtgggtagggtgggatagggtgggcgtgtgtcccccttcacttgataaaaggcttttcttagtgtcaaaggattcatttaaagcctccactgcatagaaagctccctctagtgcatttaaaatagaattctctcttgaaaaatccaattttgctgacaaggtgaaggagcagctaacgaaagttaaattccagggaaacagaaaggcccagtggtgtgacgctgacatcgaaaagcctgcaaacagtcgaggagtcagcgcacacacaaagaaaatccagatggaaggaaagaaaggaaccttaacgatgtctaccggggacagagcgtggggtccacggagaagtcccaggcgttttccacctaagaagcatcatggtgattcaaacaccagggaaatgaatggactcagtggagccactttctgctacttgaccaggtttaattcgagttgtccatgtcgggaatctacagggaagtgacgcaggctgccatcttgctcagcaccccagtgtggcgggcgccccagtgtggcgggcgtcccagtgtggtgagcaccggccaagtcagtttgggttgggctgcaccctcgtgcctgggacacccaggaagacccacctctctcgtgttagtggaccagggaggcagccacagacaccaggctctgcgtgctccgctggcacccgaatggccactgggtaccatcccgtgccaagctcagcaaatgtaaatcgctctcattgttattttctaattcactcagggctcattgggttaaaagtttatacattggttaaatacatttgtaagacaacagagggtttttttttagctttagataaaaaatgttaaccattaaacaaaagccattaaaagaatattagtattaaagtattaaaactatctgtcacaatgaaagaatccatttgaagttaaagaaaaccaagcaaatatgccaccggtgtctctttccaaggcttgtttgatttctcctggactctggctcttggctgaccgagctgtgtgattcagctcatggccctagaccacatcctcccagtaaacagtgaacacggacggatggggtgtgccgggagggccatcgtcgccgtctcctgaccgtcattcttccgcatggcttccggcagcctgttcatggataatgactgcatgagcgcaggtaagttttattacaattttactcagaggttttgcaaactgcagggatgcaatgtattctttttttcttgaaagtaaaaacgacaatgtgtgccaagtgttcaagagagagaggcctttacttgcaggagaaaattttctcaactctaccctctggaagaactgaagaaaagcttggtcctaactaaatgcattcaaatacatgacgaatggtgattattaagaatccagataaggaacgaagtggaacagttcccgtgccccaggagcgcagagctcctcactcacccaggctgcgatgtttctgctttgtctggagctcacgctgtgggaggactgggctctgaagggcacagacaccccatctttctagctctccatgtcagccgaggtgaccccagaactggactgggtgcagaggtcaagctagagcccctcacgtctggcagagcaaaactcggctcaaggtaactgtggttggggatgctctgggtgccccacacggttcaagccctccccagacctgggtctcagggatgccacttggcactgactacacactacacgcatgcagatacatgtacatgggtacacaggcatgcacacaccacacaacactcacccacactcacatcatacatatgcacatgcacacacacagaggcatgcacacacccaaacaacacacacacccacactcacactcacgtcatacatatgcacatgtgcacacacacaggcatgcacacaccacacaacactcacccacactcacatcatacatacgcacatgcacacacacacaggcatgcacacatcacacaacactcacacccacactcatgtcatacatacacagatgcacacacatacacacacaggcatgcacacaccacacaacactcgcatccaccctcacgtcatacatatgtacatgcacacacatacacattcatgcacacatccaaacacacacaccccacacatcatacatatgcacatgcacacacacacattcacacaaacatgcacaccccacactcacatgtcacatacacacatgcccacacacatatacacatgtgtgcacatgcccacactacactcacaccccacactcatacatatgcacatgcacacacacatgcacacgcccacaacatgcacatcccacactcatgtcatacatatgcacacacaaatatacacacagccatgcacacactcacacaacatacatatccatgctcacatgtcatacatatgcatgcacacacatatacacaggaatgcacatgcccacatgacatgcacaccctacgctcatgtcatatgcacacacatgcacacacaatgtcatacatatgcacatgcatgcacacacatatatacaggcatgcacacatccacacaagatgcacaccccacactcatgtatcatacatacacacacacacacagatatacacacaggcatgcacatgctcacacaacatgcacacccacactcatatatactcacatgcatgcacacatatatacacaggcatgcacacaccacacaacacacacaccccacttacataggtcatacatatgcacacacacacacaggcatgcacacaccacacaacactcacatcctacatcacatgtgcacacaaacacccacacttcacactctcacacaatacaccccacatcacacatgcacatcctttatacctacattcaggatcacacacatacatcatacacatgcatacacacagaacactcacagctcacactgcacacaaacattccacacccatatcacacactcatacaccacacacatgcacacacctatgtgcatgcacacacaggtacacacggcatgcataggcccacacaacacccacacccatcacacacactcccacacacacacacacacacactctcctgggccttcagtgctgagtttttacttcacacctttcctggatgatcttaactaaagacttatgaaaattataagcaggtttttttttgctgaccttctagataaattatattgtctatgttgtaacatattgctgggatcaaaggaggcaaatctgcatcttattcacttgaaaatcaagtagatcagaatcataacaaactagctatttcttatgtttttttttcctttgaacaaattctaaatccttcttttggagaaactgaaatgcctccagatccttattaaaaatataagttaaagaaaatgtagaagtgtatgaatgagtactgtcattttaaagtcaccatccccaatactccaggaggacagggaattgtgcaaaatatcctggtaagtttctatcgactgctggaccatcccataatactgttgaggtgctggcagcatcaacgcggagacaccggacctctgcacccctgtgcaggcgagcacagcttcacaattcaaggggggattgttaaaagggaaagacgaatacgatggctccacaattccgagtcctatctgtgtgtgaacacgtgcacattggtgcgacgcggtgcccaccgcagtttgctgccatcccacctacctgccctgcacaaccagtgccagggcaccggggcaggaccgagatgcaaacgcagcgtctgtgctgacagaagaggtttgggagcagcacgagagccccaaggcaggggactgctgaggtacatcctggagcatccgtgtgatggggcacacgcagtcattcccagatcagtgcagagcacacacacccacatgggggcctccacgatgtggctaggtcctcaacacctatgtcagaatcaacaagcatgtgcggtcaatggcgttcaggaggccgtctgcagctgagtaacaatcacaccaaattgtgaatattgaacaggtggaggagaacaggagctgggctcacccagggcaaaccttctcatgctgcctggaacacgcacacaccacttgcaccttttacccaaaaggtgctcatgcactggtccagcggggatgcgtgaagcatgcagccagctcccctcccaggccgcactgactgctggtactgctgcttccgggggcctggcctttacgggggtctggcaggatccctcctgcaggtgcacagcccaggctctcctcccccttgctcctgtagggccggcagctgcctcggtccctctgagtctattttgggttcagaaagtgcctgggctggggacagggccagttacgcattgactcagttccgtggcttacagtgcaaacacagagaccttgtcccatgcccgtgggctcatggtcaaggacactttgcatcatttgacctcggaaacaggagaaacggaagcacaggccaaggagggagccgaggggccgcgtgacactgcacgggatcgctgcccttcccacacgcacgttctgtctcacgcagttgctgtgcatttggaagaatcttgcatgaggattactgattccacgggacagcgtgtgaccccctgcagcaccctgactccatcgggggacccccagcatcctactcaacactacgagggagccccactgccaaaaggccaggctgcatgtgcctggacttcaggcgctaggaacggacgcttgggacctgctgcctctggggacagcccctcagggtctggacggaggatgttgggcctgcgggctgggcagggatgatgctctgggaggtgcctccaggacaacagggagacccctgcagccctccacatgggcccctggaaacccaggatagggagtggcagaacacactggcgggggctggacgagcagaggaatgagggaaggacagagtgggtgggagcgagagcagaggagatggaggggggaccacagactgtgtggggagggcagctgtgccgcaggaaatggagcaaccaggctgtgagcaagatgcgcacagaggacggagaggacccagggactgagatgaaggagtgactgcccggcagcagggagcagaatcaggcaggcaagtgcgcaggccgggccagcctggaccgtggagctgtgtctccaacgggaaccttggagggcaggactttgatcccctcccgaatttccaaacaggagtttgaacagaaacatgtggactcagggaccagtgcttcgggcacatcctgacagcgacacagctgccccgacagggctgtggccccccccgccccgtctctctcctgtgttctctcccacattctcaggggccgcctgctgccagctccctcgctgtggcctcatccagctcctgctggcgtggtctgacccctaaatgtgtgccagcaaggcctgtgttggagggaggggagggcctggatgggcctggatgggctggtgccagcacccgggaccaaggagggagcttgcagaagggacagccctcggccaggtgggacctgaacgacattttgcggcatccaatgggcctgaggtgtctgcgtgaccatgaggagaagcggaggacagcccaggtgaggacatcagacccaggagtgggtgaggagcccctgcagccaggctatgtgaaccctggctcagcagggtcagcctgaccccttgaaggtgggagaccccttgaaggtgggagacctgtgagctggtacactcagtgaggacggctccatgcacagggacgaagacccccgaggagaccatcgaaggatggtgggcagtgctgcccacacggatgcccagagcgtgttccccaagaccagcgggtctcatgctgtccacacgctcccaccaggcgatcgacaccagggtccgcctgtgccctgcctgggtggggtcagccacgcccccggaccactgctccaaccagcgttcgtcgtcagccccttacacgggacagggcactgcagaccggcccgggaacctggggacacctcacgccccacatccctcactgtttctcttgcaccagaatagctcaggggaaggaaaggcacagaaaataaacaacacacagcagaggaggccctgctcctgcccgaccgaaggcaacttctcccttgaagagaaaggtgcagacaggctccctctccccttccctcctcccacctcacccaattctgggcactttttcagcctgaaacttgcctgagcgagacaagagacactgcgggcccaacgtgtctgtgaggtccctttcccactggcccttcgtgttttcatgtttcagccaaacataaaagcgagacgtctcctgctcagctttcccaattctgcccagccctcgcgtccccctaagtctcatctgcagaaggctgagcctcatgcacctgcacctccttctcttggtgcctgcgcccaaatgtgtggctctgtctggctcaaccctctcctgggccccgtggctgagctggcctgttcttcagttccagctccattccctggccctcttagtcccgcactgcctggctggtcccccagccatctggttctgcactgcccagccatgccatcccctcggcccccgggtcctgtactgcccggccagtctccccgccctctggttctgcactgcccagccatgccatcccttcggcccccgggtcctgtactgcccggccggtctccccgccctctggttctgcactgcctggctggtcctccagcacctgcctgggttctcccacttccctgcagactccaggctgtgcccagagagagctgagctcggcggcccaggcgcctcaccactggccctcagtttcctcttcctccggtagtttccatgagagccccaaaggaactccccagcgaagctgcccctctgtccctggagccctggaacacaccacgctgtgcctctgagcgccgtccctggggccgtgtgccttccaccatcctccctctgggccctgagcctttgcagactgagcagggttctgcatctgactctggctgaccggaggccttgaggcaagtcacccaacctcccagaactgcttcctcagcttgcaacagagtggtcagaacggagggccccttgggcccccttccattcagtgaaaagctttctgtgggtcctcctgagccccaggacagcccgtgagtgaagctgccatctctgcatctgggagtgtccttgtctgctctccaccaccctgcagccacagactccttacctgtctctcggcagagcaggaagatgcagcaggaggatggggcttctctgttttgctctcacaacccacgcctggcaggcagcaggtgccaaaccagcatcagcgtggatccagcatgcagtggacgctgccctgccatcagctggagccacactttcacggtttaccctggcatctgccagagaaggaatggaccagtgggactccagagaggacagagggtgggggatgcaccctggggaggggaagggtgcgccccccacgccacagaaaagaacctgcaaagccctgagtcctggagccaaaggaggcagagtggcccaccaagggggatcggcagtggccaggttgcccagggctctggggacagctcgcccagggctctggggacagctccagggccgaggcaggcacccaaggtctttctgtctaaagcatcttactgactgctgtgtgacacctaatcaggaggagaaaatggagcggggagaccagcacacgaggggtgatggggctgggcccagggagatgagaagagggtgagggtgaagtcaggagccaccgtagtgccaccttggagccgtgtggcccccaggacctgctgtgggggaaggagtgacttccagcttcaccgcctggtgtagccactgtggctttgtcatgcagctagtacaactgaagagctgacttgtaaactttatccaattttagtgactctaaggaaccacatgtggctactgtatggaacaaggcggctctggagggctgctggccttcaaagtccggggaccttcaaagtccggggagccacaaaacacgattcgacaaagacgttctgctgtcaccacacacagcagatcaggaccatgtgctcccgcgtcaccacacacagcagatcaggaccacatgctcccgcgtcaccacacacagcagatcaggaccacgtgctcccgcgtcaccacacacagcagatcaggaccatgtgctcccgcatcaccacagacagcagatcaggaccacgtgctccacgtcaccacacgcagcagatcaggaccacgtgctcccatgtcaccacacgcagatcaggaccacgtgctcccgcatcaccacacaccacagatcaggaccacgtgctcccacatcaccacacagcagatcaggaccacgtgctcccgcttcaccacacacagcagatcaggaccacatgctcccacgtcaccacacacagcagatcaggaccacatgctcccgcatcaccacacaccacagatcaggaccacgtgctcccacgtcaccacacacagcagatcaggaccacgtgctcccacgtcaccacacacagcagatcaggaccacgtgctcccacgtcaccacacacagcagatcaggaccacgtgctcccatgtcaccacacacagcagagcaggaccacgtgctcccgcgtcaccacacacagcagatcaggaccacgtgctcccacgtcaccacacacagcagatcaggaccacgtgctcccgcatcaccacaccacatgcagcagatcaggaccacgtgctcccacgtcaccacacacagcagatcaggaccacgtggtcccgcatcaccacacacagcagatcaggaccacgtgctcccacgtcaccacacacagcagatcaggaccacgtgctcccacgtcaccacacacagcagatcaggaccacgtggtcccgcatcaccacacacagcagatcaggaccacgtgctcccacgtcaccacacacagcagatcaggaccacgtgctcccgcatcaccacaccacatgcagcagatcaggaccacgtgctcccacatcaccacacaccacagatcaggaccacgtgctcccgcatcaccacagacagcagatcaggaccacgtgctcccacatcaccacacaccacagatcaggaccacgtgctcccacatcaccacacacagcagatcaggaccacgtgctcccacatcaccacacacagcagatcaggaccacgtgctcccacgtcaccacatgccacagatcaagaccacgtgctcctgcatcaccacagacagcagatcaggaccatgtgctcccacatcaccacaccacacacagcagatcaggaccacatgctcccgcacacgctcgaggcagcaggctctctgctccatggcccctctcgcttcccacaggcaactttccatctactacttgggcctgcccttaaaagttaagagaatataggaggaaatctaagaacagatagcagaaggtctttgtgaccttggatttggccaatatatcttgggtatgatactaaaagcacaagaaaaaaaaatatatttttgagatggagtttctttcttgttgcccaggctggagcgcaatggtgcgatctcaggtcactgcaacctccgcctcccgggttcaagtgattctcctgcctcagcctcctgagtagcatctgccaccacacctggctaatgtttgtatttttagtagagactgggttttgccacgttggccaggctggtctcgaactcctgacctcaggtgatccacccgccttggcctcccaaagtgctgggattacaggtgtgagtcacaagaaaaatattttttaaaaagtaaactggacttcatcaaaattgaacacttttgtgtaacaaagacactatcaaaagagtaaaaaaccccgatgtaatgggagaaaatacttgcaaattacatagctgataagggagtagtattcagaatatataaagaactcttagaattcaacaacaaaaaatacaaacagcccacttcagaaatgggcaagggacttgaaatgtctgttttgctcaagttgatatacaaatggccaataagccattaaaagatgttcaacatcactagttgttagggagatgcatgctaaaaccacattgagatccactcacatccactgggatggctgtaatcaaacagccaagagataagagaattacggtcgatgtggcgattccgccccagggacatatccagggatgtgggtggacaccctcacatccacattcacagcaggattactcacaacagcccaaagccggaaacaacggcactgtccattaatacacaaatgaatccacaaagtgcggtccatccatgccatggaatatgagtcagtcataaaatggaagttagtgctgacacacaccacgacacaggccaacctcgaaggcattatgcaaagtgacatataacagtcacggaagcgcagacgcggtatcactccacttagatgaggtgcgtagtatattcagattcgcggaaacaaagaagaacggaagtgatccatccccgtaggcaaggagatgtgtatccacacacaaaatagtaccatgtccagtcgctgagtctgagagctgggtctatgcccgtgtggacaccccaccgtccactcacattcacgccgtgagactacttaggaacgtactcctagccagctgaagtttaaaaggtcgctccagcatgggctcacaagccgtggggattcatattggaacacaaaattcccggtctgtggctcctgccagacaaaagaaatgagtcaccccagactcactctgcaccttgtcaacagccacagctgctgggggatcatacagtgtctgcttggcatggcctccatggtacctggggccacacaggcaccctcttccggcccaggcgcagaccctggtgggaatgccgtggaagtttggccacacttctcagccactgcatttctgtgctggcccctggggagtgaagcctgaccccacccagcatgctcagcccacctcatctctggggagtaccccctcagtgctggttgctcctcatccctttaaaaaattgtggggaagtagaaaaataccctcagtaagtgaagtcactgacaaaaaagtaaaaggcacaaccttggaaaatatcttgcttgaaaaaaacatgttttgctacatgtgagccaagcccttcaatgagagaggaacaggctacctaaaaacagattcctacacaatcgtctattatcggtgagttagaaacgcatctgctgccacagaaatgacacgtgtaagcgcttcccagattggtgcctactttcctgccacaaaacccattgcagaacatgagcctgttgactttcattccaaactgcatcatcgtctacttgctgctaaactggacagtagagaaagaacttcaactattctgagtttgtttttaaaggcccttcaactaggcccaaaggccttaatccctgatgggctgtgtggacaagtgctgctctgctgtctgcggccgcagctgctggagctaaaagcatgcagaggccctgcatgcaggactggagggccctaacatcagcgttggcactgcccgactgcccgggaagcttgggaagggcattctctggtcttctgtaatgcattcctttacagaaagggaaatgggaagaaaggtttcacgtccaggactctgggcctttgatcatttgagaaacgctgggtctgcagtgggggcctccagcttctcaggccagacaaagacgccccgccacacgggcagggcccagcctgcaccagaacaaaaccccagcgcctctcagtgtggaggcctgggaaaggcccacctcagccggcagaggggctgcctgccctttgatctctcctgagactgtggcctgggacccgggtcagggaatttcacaccgcacacaccccagggaaagaggagcaggtcaagaacaggaggagggtcaccaatctcagaaaaggccccaggccagccctctttggccatttccacatggctgcatgcgtattgtccaaagctgagcccactctcaaaggagaattgacatcacatgccacaatggagccagtgaacagcagctcaggtgcctggacaatatgccagccctgccccccgtaccggggtctcgaacccaggacatacttctccatgtttccttctctgtggagtgaacctgagccactcagaacccaggctccatcccatccctgtggagacgcacgctggggtcacctgcgtccggccgcctgcctgtgcttctggtccctggatgggcaggttccattggaatcacaggtgcccccagcaactcaccacatcacacgttcacaaacataggcttggtcagaaacacttacatcaaatgatctgtaacgttctgaagacattttggtttaagagaagaaaaatctttgtctgagagagggaaagaagggagggcccatgataagtggagaaatacaaattccatggatggctctgagctccaatagctgtaaatttggaaaggaaaagaaatatttgacaagacacagcagcattaatggacaaggaaaaatggacttttaaatgacaaaaagttaggattgtgtcatgtccaaaacaaacaaaaaaaggattaaaaatattatgagtgtttgcattttgtttttgtttgcacattcccaccactaaactaatcttgggtgtttaaaatgacatttggtggcacaaaaactgatttcatttctccccagcagccagcaaaggatgctggcggtgttgggtaggtgtggggtgtggggctgggctgcagccctcccctctgctgcaggacgctggagaacttgcccaggctctccagtccttctgcgtaaagccatggctgttgttttatcttcacatatttatgtctttttttttttaaccagaagaaaatgaagtaaggaaaatgcttattttaaaattgctggcattcgtggaagtgtatagaaacttgtttctataatcaatggctgctcctgtcactgggccagtgatggagaatgggatgttacggaaggcggaggtctctgtatgaacacatatacgtgtgtgtgtgttgagacaaagggaattgtttattcacagctgggaaagagaccgtaggatgctaccacctcggtgcctcccaccttccatgggacgctaacgggtatcgcaaggctaatgcagactcttctcaagtaagtgtcggaggcgccaactgaagggaagctggacacatctctctgccctggactccttgggacctctccatgcacacctgccctgtgatgcccaaggagcagactcagtgtgtgcctcctctcaagctcacctgcctggggagccttctctctggcccctatttaaagagatgaccttagaggttgggtattctggagaccaccttttgagaaatgccagagctcaatccccatgcttttgtaggagaaaattggatcccagagaggttaaaagctctgtccaaagtgataaacctcattgctggcagagccagacccgcgcacagatctgcttttccacgctgctgctggacccatcctcgcaccctgcgcctcatgtctaagactccccacgccgtctgcgcatgctgccgctctgccaaacctgtccttctcccaccacaggcctcaagtctaagactccccacaccgtctctgagaggaacgcctcccacagcacgcacagagattccctagataagaaggacattcacaaagagggctgaaaggctcatttgagagggggtgattgacatttgatggcaattactaacggatatttttagtgtgcctctagtgtgaataccgttttgacaacagtggagttacaccaaatactggagcggcattctgcactgcaacaacactgaaggacccgagggtggcttctccgtggctctgaggttaacgctgcagcgtatgcagcaaacacctgtcaaggacccactgtgtgctcggcacaccaaggcaggtaacaaaggacccagtgcatgctcggcacgcagaggcaggtaacaaaggacccactgcaggctcggcacgcagaggcaggtaacaaacgaccagcctcagaagcagatgtgcttgctgcaaaccaccttcctacggcccagcagaggcacaacaagcagcgaattttttccagggcctcccgtgaacacggcaccctacgttgccatagcgacgccatcccagctctgagccgcaacaaagcggcagtgtctgtgtctcacctttggccatcttgttgagaaccatgtcgatcaggacgtaggtgccgctccggcctgcaccgtcactgccaacagaaggagagaaatgaaagtgctgccgtccacacggaagcccgacccacaacaaagctagtgacagttcatttccttcctgcttacgggggccggcgagaggaaaggatggcggatgtgagagggggaggaaggacgcgggctgggagaatccaagtgaggggagaagggaggcccctgggggcttcgagcctctgagcagcttgtagcttgtgggatgagctgctgtgctcagatgtgactccctcttgcttgttcccccctctttggccaaagatgtggtaaattttgccagaacaaaatgaactaagcgtttgactgtgtcagagttgatggcatttgtattgaaaatatctgcaaggtgccttctctagtgttgccgggcaacctcccgagcggagaggggagggcgctgggcggctgggccccgctggctcatgcacgcagggacacttcaggcacatccccctaggctgcctgccaccccttctaaacgcaggtcctccgtctcagaaggagaaattgacataacagtcgttactaaatcttactctttaaaaagcactctcatttcatctctttctcatcccaccagctataattggaatatttaccatctgggctagagttgtaaaaatgttttgaataatacttcaacagtagcaaaggaaaaaaaatttccctttttttctggaagaagagtagcctcaggatcatccttttcttatgaggaatgtgtgaagccatttcctgcccccgtgcagacgctgtcactgggttgcatgagtttgagagaccttcttaaaagtacatagggctcgtgttcacacccatgactggcttttaaacagaggaccttttacatttataatcctagcaaaatcaattgtgactttccggaaaacgaataaatgtttccatttcaagacttcaagaaagatgtgactacccagcagatatcacactttcggttctgctttctatgccgtctgtgatcccaagaaatgactggaatcctataggtgatcttttgatggtaaagaatcagcgcattttggctttaacatgtttcctcaaacaaatggttgaaaaaagctgcagttgggatggtaaatgtttaaaaaacggcacgttcacatcctcacaccctcactgcatcaccaaggaggagaggcggtcggcctgggccgccacgtaaccctcactgctcatttcaaagggccacggtgagcattctggttgctgagtgcctttctcacttgtctcctatgcacagcatatattcacatgaatattttaagatatacttcaaaaatcttccaactaagtgttgcttgtcttgatacatttgtgggtaaaaaagatgttctactctactctgtaaggataacaaaccgtaatctattttcatcctcctctctcatagacaggaatgcacacacaaaacacacatgcttcttgattggatttgacagatttggtgtttgttctttggagacaggtttcctttttattccaggcaggaagaacattctataagacagttctagaaaaatggaatatgagttcttcaccaaaaggagttgggtatgaagtccagcagagacagtactattaggttgagttttctttgcgtaaaatctattcttactggtgtggttttaacgtacttagggatatgagtcactgaatttttacccagaggcctgaacccacatgataaactggaggtggctgtacctcctgtaatgacagatttcgtccctgtacataactggccccaagcatttctcaccatctgcagagggttctgagcctctgctggacgtcctggtggttgagacaatgcaacaggctgaaaccattgtctcgatgtttctgtgtcatgggaccacagggtttaagaacaagcaaggtggcaggacatgctcacgggtgagtagaaggcaggacactgcaccgtgggctgctagaaaatattccatgtgaggcctcgcgcggtggctcacgcctgtaatcccagcacgttgggaggccgaggtcggtggatcatttgaggtcaggagttcaagaccagcctgaccaaatggtgaaacctcgtctctactaaaaatacaaaaaaaattagccgggcgtggtggcgggcgcaatcgcttgatcccgggaggtggaggttgcagtgagcctgacgagaccacgccattgcactgcagcgtgggcaacagagttaaaaaaaaaaaaaaaaaaaagcaagccatgtgcagtttatacagacataatacaagcaacgcccaattgtatttacccaaatggcatagaaaagtaagtttatatttttggtttcctttagaagtgccagttagttatatttattaagcaattagaaagttaagcttctgtatttaattgcatagattagtttttgaggtagccaaaacttcttaatccattaaaagttgtacttgcctgcaatgaacaattattggacaagaacggcccctgtagcacttgtttacttttctgaaataaaaagagatataaaaattatcgttgtgtactaagactttgcgttatccaaaacaactattaaaacaaagcgcaaggtctgtgtgtttgaaatcattttgcaatcgcttgttttgacggagaaaataaaaatcatacgcataatatcaaacatttattcttcttctcaacatgacgttattaatcggagctttaaaaccaatgttacacctctacactgctttcttcttccaaggaggggtgccaggctttgaaccagtggactcccggcctgtcctgcccgtcccacccctgcaggctctcctctttctgtttctgcttatgttgacttgaccttttgttacactacatcttgattcttcactaaaatttttgagttttgcaatttatgctcaaaatttcttagtccagacatcatattgaaaactgttatttccatactgtctaaaaacagcatcttcaagggcatttgtgacccgtcagcttttggtaaggatatctaaattacggagaaacctctatgaagtccaagacaagtcccttccatgcttataactttgagtatacaaacaacttcattgtgcagagtttagatcagaagttgtaaaaattagaaatgagcatatatttaagatttcataaccaacccctaaatcaaaacagaggactgatttaaaattcactgtgtaaatccaggtgtttttttttaattcagtgaaacaatgaaacatgtttatgaagtccattaaagttgtcagtgaactatttctgaataagtaaaattaaaggcggaacctcgggttattggaataaagcatgtgtgaaggagagtgttctacaatgtgctgcgtgaactcctacaagaaacaaattaagaaaaatggaagtatggaccatcaatgggaaaatgtcacgtttctttgcaaagccttgcctatccagcaccaaagagtccgtggaaagtaaacattccatcaaccggtgctttgctacaaacctttgaagccaggaggggcagggtggctgtggaaggagaggggaggtgagtgtccagtgagcatgaggggagggatgcttgaatacggcggagcccaaaccacagagctttctcctcctctcttcctattccctgaggagttaccagaacaaggcccttctgatgggagtgtgaatgcccagtctggagggcaccacgggagctgaaggagcagttgcagggactggactcggcgtgcccacctgcagatgggccgcggccacagcctagccaggacgcacttgatctgtgctgccctctggtctgtgaaacacgaggctgatgcccaaaaatgggcgggctcagacacaggcacaaccagcaacggcctccagggccgtgtcaccgtttctgttagaggtgtttgttgttgtttttccggggcacacagtggtgcgaaggctttggggagaggcggggaaggcaatggtgaactccttagaggcaacagcacttgtatgccagagtgccttgaacattcttggtccctggagaataaagaggttggaaaacagacccacttatgtctacttctacaattttccattcctgactcaggctgtaaagcatcgagggctcctgatgacagaatggataccaggcctcaggggtgcaccccagcatgggggtgggaagccctccagctcagtaaagaccatgtgtgtgtgcatgagactgcacgcatgtgtgtgacgtgagcacgtatgtgcacacgtgtgcacgtgtagaatcaagcaggctcaactatcagaccaaatggtgagtggctttgctttgaaaggccttttgcctttggcagaggagtttactggccatggctcagcctctgaatcttgcaaatgggaatgacctcagttctgctcctccagcttcctgctgtgtttcacacctcgtggtccactctacgcagagactaagctcagcttctgggtccacacccaccagtcaccaggggttgctcattttttcctcatgagaccaagtacacccaaaaaagggacagtaaaacaaaccaaaccccaaaccccaaaccagataccctttaagaaagtgtgctggtttgaggaaaggccagcataagaagtcagtagacagcggtggctcatggatagctggtcagctcctgctttggcaaaatgcagtaataacccccttggctgggaaatgctcctagccagtgaatttgtggctacgatggcctcaacctgcttccccactcccgaaactcctgtctctatctcacagtatacggaagataccattttctctgacatgttgtgcctggtggccttgggaaggtttcgctgtaattttcatatccgtaccagcccccaccttgtgctcaacctatttacaaaaacccacgggcagtcaaggacatgtgcagtgtagatacagggtgtggcatggctgaggactttatttacaaaggatcatgcagttgtattattacacgcaaagcatcacaaatagagaggaaaaccacgacatattgaacacaagagttcatccggttgacccaagatgtagaccacgagttattcaggaaggtgacacagccgtctcatttgactccatcagaacaaagaatcagtgagcaaaaggtctccaacagtaagaaaagttggtatcatagaaacttccacaacaggaattcactgagaaagaacgattagtgatacaaaccaacccaggggtcaccgggcgagagcgcaccgtcatgcaaagcaccagcaagcaaggtcagaggtcgttagaggctcagaaaaggggctttccacatcgcccctgcagtacagtcacagtttccaatgatcacttttgtgactatgcaactgggctcatattactagctgcaacatcacaaaaatgacactggccaccgctaattagctggcaaggtaagggtttgtccgttttaccgtgagcagcgttagtgagcaccattgcacacagcaagaagggagagagtaataatgagagagagagagagagagagagtttttaaagcaaagccctcacatgtgatgctaattatctcttagcagtttctctttaaagtgtaaatgcgctccctctgggctccagaaatatttaatcacacatctcggtgcctggcgaacgcgccaggccagagtgagaacgcgtcgtctattgttcaaagataagaaacgctgcagcatgaagatggccggtgtcttcagaaggggtctcacctttcctgtcgctgaaatcggggtggctattttatacagaaaaccagccaccggcaatgcttgtctaagtgtgaagctttctgagaatgtgttcgctcaaacccactgtccagataacacatgaaaggtggccttggccgaaacgctgggcggtgccaggtaaggcaggcaagaaaagctttctactctgacgtggctttcaaaaccgtgtctgggggttcattagcttttgaatttaacaaaaaccttcttaggctgtatctcctcagaccctggagcaagggaaatttgggaatccaatttttcttggtgatgaatcataaacactgagggtcggtgatgtacatgttcccgtccatatatggatatggacatagcaacgtgcccatatgcatatacgtgcaaacacactggatgaacgcaaagacggggtgttaagatgaattgccgtctttgtagttacatccattttgccaggaatgactgttttttgaagactctatttcaggaaattatgtaagatttctacatagtatgtctttagaaataaatccgtattgacagaatgtacataatggccaggaaattagcgtgggtgaggaaggagccgtgtacagtagttgttttaggatgtactcaggactctggatctacgctctgcgtccccaggggaggtgacggcaggcaggggccactgagtgtgtgttgtggctgtgacaccagattcaagtgtctccttgcagaggctcttgattgatttctattgattcaaattacaaaaaactgcattttgcttttcaatgtagactaaaaggcaaaataaattgaatcataataagcttcagaatctgtaatacacaaattcaagaattccacagagaattcaaaaatcgcttctttatgacaatctttgtctcgttaacctccctccagttacataactgtagactcgagaatgagtaactgttaagaatcaagtcactttatgatagtggggcatggcattggattcaaatgcattttttcttcttattctccttgtttggatatttgtctcttttcctcaataggtagacttctgatcagttaaatgtaagacatattctatacaatttagagcttcgtcactgatgcttttgacaatttcattttccttgtggtggtttattcactaagcaccaccacctagccaatgcggaccgactgtttaccacaatcaaagctgtggtcttaaatgctgcttttttttcattgtcaatttcttcctgtaagacagagtctagcattcacttcaacagttcagtaaatacactctcaaaccagacaacgtattgggtgactggctgactggagcaatgaacaaaaaactgaattttttaaagagggtcagtttcaaaatagccctaaaaatacagacagccacgggctaagtgtctccgggcttccctgcaagatcacgcagggtggtatctgggcctgcgctcgctacctctttcatcccatgcagccagatgagaatccaactgaacatccgagctttatgcatcaatatcctgtggcacatacactttaggctctttgtcaactgaagaaccttatcaaaaataatggccctatttccacagttcgaagatgcctattccccctcacattttaatacctctgaagctagaaaatcgctcacgattaacacgtgccgttaacggagtcttcccgcctctcgcttcccttcccctcccccctgcggcgccgacacagacgcggccctcggcgccaggggcgtctcaggagcaccgaagcctcgctcccctgtgccgcgcgctcagcgcgcactgccctgccggcgggccgcgcgtcatacctgcggaagtccaggagggaccttgaggaggaagggactcctcggtcataccaactcaggaagtggaactgcgtcacggtgcgcgtctcgttggtctgcaggttcttcagatagaagctcctcaccaggaagtcctcacaccagatgtgctcggagaccaggttcacctggcagggaggagcggagggaggggacagagacaggtgtggacattgtgaaccgaacctcaggcactgaggaacccagggccacgtctgaccagagaagggggcgctgcgaagagggcacattttacagcgcaggtgggttccctcggcttcgcggccccctcccaccttcccagtgttaacgcactgaagttagctccgtgcgggtgtgtgtgcttagtgttatttaggggcttgagcgtcaaataattttttaaaaggttacaatccaaaactatcctactttctgtcttttgcatgtccatgttacataaaccctcaaaaaaaggaaccagagaaaaattacacttttcaacaaaagcagcgacacgactacatgttctgctcagtggttccactctaagtgagactccgtcgcagctgcgcacacccgggtctagagcaggaaaagcaaaaggctcacggagtcgcgctgatgtgaaccccagcgcaggcacttccgggcctaagcgtttctgcaggaaccccaaggccacagctgtgtggtttaaggttcacacttgagcctctaactcgcttcctgctgtggagctttggcattctcactcatttaatgccaaacagaatcaaagcatgcattctagtgctggcttaatcacccacgtttatttagttcattcttgatgggggcagaaaatccagccagataaataaactggtgagcaggttatcctcaaataaaaaggtcacatgatccagccacgaaactccaagcagagccacggggaggccacacggctcaggcactggcatcaaggatgggcgccaggttttcttaaaaacggaccccacttaaaggcttgttatatgggaccgggaccacgctgtgaggcgaatgttttttctactctgttatcatttggatttagaaaaatctaaaagataaaaaccacaccacactcccagggtctggttcatgagcacacagccgtgtgaaccatccacacgggcatgcggccctcgggggtgactcagcctccgtcccctgaacatggggtgcgctgagcctccctgcatgcggccctcgggggtggctcagcctccatcccctgaacatggggtgcgctgagcctccctgcatgcggccctggggggccctaacgaatcccattcggaggaggagcagggcccgtcctcgtccggctggtgggtcctgccctgggtggctctggtcggagtacctcatagatgtggtagagattggagccttcatccggccagtagtggtagcactgccggacgccgttctccgcgaggggtgtcagcatgacgatcaccacgcagccgctctcccacaccatctgcggacaaagaaggcccgtggccgcggtgtgactgtctcatcaccgcgtgacatgtgtaattactgcactcggaagcacagtccaaatttattccattcacaggacatttatttcattttcatcagacatgtttactccgcagctgcctgagcatctctgaatgcactggcccatagtttgcatgttccacgaaatattaaaaaaccccgcaaatttatcccatgccatttagagcttcctcaggtgtaggttcagctgtgtggttttccaacttctgatctgtaaaggaaactttctacaacgccacacataacagccagcacttctcgaggcggtgccgacaccctcacttgctggtggctagcatcattttgctcacctagagaaacgttttgcttcgtgaagctgctgtcctgtcagaagcagcctccgaaaggcttcttttcaaagtacttcacggaaagcagtactgcactgctgcaatttcatttgtttataccgaaatatggcaacactattcagattaaagcaaataccaaattgatttactaattcctattagccacattgaaacacaataaacaaaagcacatttaaacccacagaaattacaaagacacaaagtcctctgacctcgtttctttgcaaacacaactggctacttgtggctgtaaacccacatcttaacatttacagcctaactacccaaaaccactaatcctgtggggcacactgatgtggcatttgtagatttttattagcatatgaaattatagagtgaagaggggtctgctttttctgcaatgggttacattaacttggcagaaatgtttataagcaactgcatttagatgtaaatttggtatccaagacagtttctatttcttttaaaaacagacacaaaatccaattaagaccttgttattttaaaaaccctcatatcccaaatataaaatgctgtcatcgtagcgcatgttactgaattccacatttatattttaaaaatcagacacaaacacgacattttccttttttaatattgatttatgttctcacggggctgaaatagtcaatatcctcaaggcacctcactgtgtaacatttacatcggaagccaatggaaccaactgaagtatttacaaaacgcccacaaataaataagaattatgctcaaatttgtgcactttctctttccttagtgcccatccgacaacaagatgagaattcaaaacatgtttcttacgccaggcttttcaggctttcaaacctgctcctccaaatcggttcttccatcacataacaatttaatgtgccttcagaaggtggagaagctcatggaagccattacgaaaatgaggagaaacacagattttatgagtgtaataaaaatacaatgatctagaccataaactaatcatccggcactcggctccgtgccacccaagtgtgacattacagagccccgtcgactggggggacccggacggcctggaagccgcactcattggctctcgcgtccgcccttcattatggggcgccttcccggctctctgaagatttggttaagattaaatccaaatgaaacttaatttaaacaagcaatcccaaaggcgctctggggaataatatttctttttaggtcactgtgtataaaagcagagaggggaatttactaaatcaaacaaataggcagcccaattgggtaccaatattacaagctgttcatggaactgattacattatcttgtgttcctttgaatcggtacaaagcaactcaatcgaggaggaaaactatggcatttctccatctgtttccagccttcaacagcgcgcctgaccagataacctcagaatacatcgcaaaaagttaatttggattttggtatgaatgcagaatcagtaaaaatcccagtcgagtaaggttcaatttctaatcggggagaagtttcactattttctttctcattgacttggtctttgctgacaggtgaaatacggaagtgctaacccctggcacctgtgaatgtgacctcatttggatacaggatttttcagacttaatcaagttaacattggtttgtgtcacaaatctttgagaaatctaaaactgtctctttcaggaagtaaataatgacccaggatccttatttaatcttaatgcagttcattggaatgcgcagtttacaaaactgtatgcctgaattccagaaatgaccattactggcacttcctgtttggtgaagggtaagagaacacggcccccatggccacctgcacagccgagtacctgcacaccccagcacctgcacaccccagcacctgcacaccgcagcacctgcacaccacagcacctgcacaccgtggcacctgcacaccccagcacctgcacacccgagccgagcccctgcacatctgagcacctgcacatccgagcccctgcacaccccagcacctgcacaccccagcccctgcacaccccagcccctgcacaccccagcacctgcacacccgagcccctgaacacccgagcccctgcacaccccagcacctggacacccgagcccctccacactccagcacctggacacaccagcacctgcacaccccagcacctgcacaccccagcacctgcacacccgagcccctgcacaccccagcacctgcacaccccagcacctgcacaccccagcacctgcacacccgagcccctgcacaccccagcccctgcacaccccagcacctgcacaccccagcacctccacaccgtggcacctgcacacccgagcccctgcacaccccagcccctgcacaccccagcacctgcacaccgcagcccctgcacaccccagcacctgcacacccgagcccctgcacaccccagcacctgcacaccccagcacctgcacaccccctgcacaccccagcacctgcacacccgagcccctgcacactccagcacctgcacacccgagcacctggacacaccagcacctgcacacaccagcacctgcacacctgagcccctgcacatcccagcacttgcaccaccatccctggatcgaaccaaagtcaccaacatggactgaaaatgagccgcaagtgctggatcccgagtgtgaacggctggcaccacgctttggaggaaaactgatactccccagttttacatacttcttctccagtgcagcgtccccaggcctcagcatcccccttgaaggctctagctgtgccagctctgtgggcctggggtggggaggggagcaatgttgcgctttgctgtttatgattccagaaggaatggaagtggtcagcccagtggttctcagagaccaccaaacacaggggttaaagcctgctgccaggctctgtgaacctgagccatctcgacgcgcccggcagggacacagcagcttgctgtgaggtctcctgacagctgttcagcagcagcaagtggagaaattcagtgattcggacagtgacccaaggaacaagaagtgcagacttcggctgttatttgacccaactgagtaagtttactgactgtagatttaaaaaccatattgttgtttgttacaggttcaacgctgtcctccccacagcttatattgacgtcctaatccctggtatctatgaatgtggccttatttggaaacaggatctttgcagatgcaactgagctgagggtgggtcccaatccaacgtgactgtgtctttagaagaagagggagacacctcgagaaggcacagacacggagagcggccacgcgcagacaggcagagatggagtgttgtggccacccacgccacacccctcatggcaggcggccacgggacactgcagaggccgtgaggatcttcccccacaggcttcggagagcgtggccctgctcacacctggatctcagactaccaggctccagaactgcgaggggatgccctcctgttgttttaaaacaacgagtttgcagcaccttgtgatgtcagccctagcaagagatgcatccgctgcaacctcactctcttcttcacccatcaaatcacccacaggcgtggaacaatggccaccccgcctacgcttcctatcaacaccgatggagaggaacacagggcctcttcactctaggtcctttttgagtgctaagtatttaattagcaaacaaacaaaaaaacaaatgacccaactaaaaatgggcaagggatctgagcacacatttctccaaagaagacagacaaatggcccgcacgtatgtgaaaaggggctgaatgtcatcagccatcagggaaatgcaaatcaaaaccacagcgcactggcacctcgtgcctgttgggatggctgccaccgaaaagagggggatggcaagtgttggagaggatgtggaagagacggaaccttacacactatacggtagcaatgtgagtgagggcagcctttacagaaaacagtatggagggccaggcacggtggctcacacctgtaatcccagcactttgggaggccgaggcaggtggatcacgaggtcaggagttcgagaccagcctgaccaacatggtgaaacaccatctctactaaaaatacaaaaattagccgggtatcgtggcatgcacctgtaatcccagctactcaggaggctgaggcaggagaacctcttgaacctaggaggcggaggttgcagtgagccgagaccgtgtcattgcactccagcctgggtaacaagagcaaaactccacctcaaaaaaaaaaaacaaaacaaaaaaaacaataaaaccagtatggagagcctcaaacaattacacagaaccactgtgtgatccagcaatcccacttctgggtatagacccaaaggaaataaaatcagtgtgtggaagggacatcagcacccctttgtttattgcagaactattcacaataaacaagatttggaacaacccacatgtctgtcaatggataatggctaaagaaaatgtggtatatacacaatgaaatattattcagccttaagaaagaatgaactcctgtcatttttgacaacatggatgaacctggaggacacgacgttaaattgaaataagccggacacagaaggacaggcaccccatgatctcactcacatgtggcacctaaaaaggacgaactcagggacagagtagaaggggggctgccagggcctggggctgagggtggaatggggagcaattgatccaaaggtagtaacttccagtagaggacagctgaattctggagacctggcattcagcatggtgactgtagttaataagagtgttgggcacagagatttgccaggagagtaggcttcaggtgcttcaccacacacaaagaaacggtaactacgcgaggagacgtgtattcattagcttgactgtggtcatcattcacgatgtctgcgtgtgtcagaacatcaggctgtacaccttaaacatttacaattaaaaacaactcgaccgggcacaggggctcgcacctctaatcccagcactttgggaggccaaggcaggcgaatcacttgaggtcaggagttcgagactagcctcgccaacatggcaaaaccctgtctttactaaaaatagaaaattagccaggtgtgttggtgggtgctgtaatcccagctactcaggaggctgaggcaggagaactgcttgtgcctggaaggcagaggttgcagtgagctgagatcatgccactgcacgccagcctgggtgacagagcgagactctgtctcaaacacacacacacacacacacacacacacacacacacacacacacacacacactcttaaaataagctctcctgaagccccacagagacctgatttaagggaagatgatcaatctgaaatagtgaaacactggagctggatgtggtggtgtgaacctgtagtcccagctagttgggaggctgaggtgggtgggaggatcatttgagcccaggagttcaggaccagcctgggcaacatagtgagatcccatctctgaaaaacaaaacaaaaaactgaaatagtgaaacgccaggccattttctctacaaaacatccctgggccccttcaggaggaaagcttctcctccttctacttagatcttttgtgatgagtcccttcctgcctgtgttagtcttgtctttagcccgtatgtctttcctctaccagactatcatctctttaaagactccatcctagtccagttaccttttctaccctccatggcatctaacagatgcttcattgaaaacaattcacatttctaagaggccgtttggatatttatgtaaaaaaaaagataaccgaaagaaaatgttatcaaaggcttgcatggcagaagtcctccaggacttgcttaaatgtacagacaagtgttcagtttttaaaaaaacaagcatggtaactgcatcccgctgaagcggttgccatgaagatgcatttcctccagagcaggtgcggggcccacgcaattctgctgcacagctcatttctgctcatttctgttgtgagcgtcctctcgtgggctgaacagaggtttagacttataaagaagatgcagctaaatttaaaaggatgaggagtcagttaatgggaaaacactcgtatttcactccttaggagctcaccgatgcctggaagttaaactgtgtggtctgagacagattaaagaggaagaaatagtgtgtgtgacatcttttgcaggggaaaccttcagctctgctctcaccctgcccagaggacagtcctaagaaatgaagcttcaggctttgcggctctggttccgagagagtcacaggctccaggccacagcacgcacatttggacacggtaatataacccaacgcagggtgacaaaaccttcgtgatgccgtccatgaccagctcatggtgcacctacctggcttttttttagtaaacaaatatctcagtgtgggattcatttagggatgacacgatgaggtgacgtagcccacacacacgtcagcagtgctgatggaaaggctgatgagggggcagcgggaggaacccccctgtgccgctatcagatcgacgcctgtgctgccttgtagccccatcccagggctgaggagcagctgcagcaacctctgggacttttccaccagcagtattgccgcccaggaggaaggggaagcctcagaacaccagcagtattgctgcccaggaggaaggggaagcctcagaatgaggacttgccactccaccaaagtcgggtctgtgttctccgggaaggactcagcctgcttgtgtgcaagcagaccccgtgtggcttggtgtggccatcctgccgcataggggttcccacggtgggaatgcactcacacactggacttcctctccacccggcctttgtgtgaccaccgtgggtgcctttgtgatcaggcattggacccgcacaggaagtcacctggcacaggcgtcactgagactccctgtggcctctgcctgtgctcacgttcccggttaaatatgcgcctggtctccttgcggggagctgctgcactgggcggcctttccttttcaagatcaggacctgacataaatgcatcagatccagttgtgaagcaagagaggaagaggaagaggaagaggggaggaggagtggggatgggaggagctggccggaggctgggaaccaatcacacacaggagcagcagagcctgctgttctcagctggagcagtaagaatcagtcagaaaggaaagccggacctgtcctttctacttgagtcccattttaaattccgcatgtgtgcggcgagagactgaccgaccatctttgcactgtcccaggcagaaccatggacaagctttgaggtcataggtttcaaacccaaaatttagataaggcaacgtgagaaacagtttctttcacctttaaaggttcgtgaatttatgaatagaaaaaaatccagcaagaccaaacctttgaaatataacaatgtcctggaaagtctcaggcatgtggttaaagtacttatcaatcatggaaatgaaaaatcaagtttttcctaagaaattaagaatgaacacaactctcatgttaattcctaagaattaacacaactctcatgcttccctttaatcaagtaacgtgccttaaaatcaacccatctgtgacgtagcagcctctgaagtcatttccccccgctaacctcctgactctcccttcactccagagtcagtgagatccacagacggttccctctcgcaccagtcactgtccagggggtggaacaggatgatgagcaagctgagtcttcacccacactagggagctgcagggactgggggacattctcatgcttttggagccagaccacttaaggtaaccaaggacccagagcagacaccgtggtcccaggctggacacatctgacgagaaaggagaggctgccagacaccgggtctgtcctggagactcagggcccctgctgctggatgctgggtatgtcctggagactcagggcccccgctgctggacgccacgtctgtcctggagactcagggccccctgctactggacactgggcctgtcctggagactcaggggccccgctgctggatgctgggtctgtcctggatgctcagggtccccgctgttggacactcggtctgtccgggacactcagggccctgcctcccacatgccgagggaacattaaaacagttgtgagtagctgggggccgtgaaccagctcgggctgagcggatgccatctttggaggatttaaatgtttttaaaaattaggtggtgtaggaccatcccctccaccggggccaggccagggtcatctctggatgctctgaggtttggttgctggtggtgctgatggtgatgcctgcagtggtcatcctgggctgatcaaggaagctgcccagagacagtgcatggtgtggaatccaggcctgccatcttcccacccacccctgcctggactagtgcagtagctgacacagcagacaggcagatacacaggcaggcagacaggcagacaggcaggcagacagacaagacaggcagatagagacaagacaggcaggcagacagagacaagacacacaggcagacaggcagacagcgagacaggcagacagacaggcagacaaacaggcagacaggcagacgagccactggtgccgggtggtgggcggccctgcacggtgacagtcagctgtcaactgtcattctcctgcacctcggccttgtcaccggtggctggcaggcagttggaaggaaacaccgttaaattctttgggtcttccacagttccaagttcaggattttttcttaaccatagtaagaactatgatctacagatgccaaataataaaaagctgtatttacatcaagcctatcaatttggaaatgagaaaacatatccccccagctgaggcttcatcacagaatacttttagaaagcagaaactagaaattgaaagtgcacctttttcttggtaaaatgttgatgtgcaataagagtcaacacacatccgatgccagtgggacacctgctgacttcagcgagcgctttgtgctctctctgggggccaggagagctgtttcgtgtctgactctgtcctgaaaggcagcctgttcatcagacaggagaggcaaggctgaactttggagttgtcctcttggctgagcctcccatacagggagccagttcccacggtggctgtccccatgcctgggctcccgtggtggctctccccatgcctgggttcccaaggtggctgtccccgtgcctgggctcccgcggtggctgtccccgtgcctgggctcccgcggtggctgtccccgtgcctgggctcccgcggtggctgtccccgtgcctgggctcccgcggtggctgtccccgtgcctgggctcccgtggtggctgtccctgtgcctgggctccagggccctggctttccatgtcacatctgcagacatccactccgcacctgatggtgacagactatgctgcctacatttctggtttagaaacagctgttgtgtatctcctgggcacagccagtgtttggtggtgacacacagaagctctctctggaagaagagcacataattctgcagctctttctaaaaataggaaaggggggatggcgggtggccaactcccttcggttgactcgagccgcgtagcacagggtgtggtagaaggtggcgcagcaggtgcaggcagtagggaggtggtccgtgatggaatatcgatgcccgcggcccctcccctgcctccccggcagtcctaatcttacagctacagtcctgcccgcaggggcttctctgtgatccagctacagtcctgcctgcgggggcttctctgcgacagctgccctgtgcaccaggacatgactgggctggggacgcactgtggggccacgtccccgggaaggtgcagaccttgcttccccgtggggaagtctcggcacctggagaaagcgtcactttatctcctgtctctgaggactttgactttcacatattctgcgccttgagactctgcacacgtgtatttttgtaaacaacacctactctggaaatgccgaggtcactgctgccggatctctcttttctgtttatagagacgtcttcatgtcactgtgccttctttatctgtgaggagtgtgtatgctgaagagacaccctggcactacacatgtctgggtctagaatgggctttgcctcccaccagctgtgtggatctgggtgggtccttatggctctctgggccacagcttcatcctgggtagaattgggctcactctgtatatctctattttaattgtagtaaaagatacctaacatataatttaccgtttgtaagtgcacagtgcagcggcagtaagggccttcccaccgttctacaaccgtcaccgtcaccacgctcttcagagcattctcatcttcccaaatggaagccctgtcaccatcaagcccctctgcactgtcccctccctgagcccctggctactaccccctagattcatactaggcttctatgaatctgacgcctccggggaccccatgaggtggaatgatgggaggctcacgatggcttcatcgcagggtcaatggctcggccaaatgagatcccatatgggaagtgcctgcccagggcctggcattgaagagctcagtaaatgggacttcctttcttcccccagccccctttccttatgcccactggactcgaatgtcccctccaatgggtgcgtgtctttcactcaaggtggccccatttggcaggtgggaggcgtctttgcagattaaaatacactttctagagaaaggctttctagagaaaggctatctgacaggtacccaaagccgcagggatccaggagtggaccatggagacctgcctcctcctctcgtcttccttcctgatattcagcctcctccctaagcggcttgttgacagcaaccagagctcaacgcctgggggtgtcaacggatgggtatgaggtgttaagactccttatttagaagcattgaacaaaacagtaaaacctcacagccaaactcgtgttcctaatttaaaatttattagaatattcttaacccttcttcagatttaaattaggattttaaaaagaaagtttaggatttaaaaagaaaattaggattttaaaaagaaagttttacgcaccaccaagtccagacgccagccgaggccaagtttccttgtgacgtctgggctgacagcggcggcgtggatgaagagggagcttgtgggtggtgctctatgccgaggacggctttttctgcctcctgcagtgattttcaaaactctcaccaccccggctgtttccaccaaactctctggcttctttttctgttgtgttttgaatgtcagcaccctttttgaatttatgattgcagaaggaacatcatattccagatatcatcccagaatgaccagcagagaggacggtggacatgtttcttcctaagatcttgatatgacttcaaataatgtagcacaagattggcccatacttaagttttctttccattcttcctttaaaattgttccacactttaaaaaaaaagtttatatgacaaaatgacaccctcaccccaaaatgggtattctttccttgagggatgttttatttctaggccagtttactacttactagtaacactgatttctgaactgtaactcagacttccacagacccctctgagctggagtaaggaccaggaattcagccgaatgatttggagagcactcacagacaaggaattaatttggggtacatcttcctttaggtaatgaatttatttttaggaatttcttgatgtaagtcaaattttggaaatcaaattcttgaaatgcatccagtgtccatatagagctggttcactgcaggaaagcaccatgtgtgcagtgagtggtgaccctccgtggattttcgtgcacgttctgggctctgctcagggacgcagcacggacagaggtgctgtgggccctgcgggacggggagctgatggggcctcgcggtgccatgctgggggagaggctggtgagcatggagtgacctcgatgccccatgctcaccgaggggacttcccctgaacccgtcttccaggctccccccttctggacccatgggcccctgtacagcatttcttgctgaggaacttggggccctcctggctcctctgcctcccagcagcccagtgacctccaaacggactcctgacccatcaccatgtcatgtgggtgccaattagctgcttggaaaaggtcttttttcttcttagccattgtactgggtagaatcatgtacccccaaatccatgtccacctggaacccatgaatgtggtcttatttggaaatagggtctttgcatatgtggtcaagttaaggtgaggtcacacaggctaggatgagctctcagtccaatgactgacatccttagaagaggagggaaatttggaccctgacataaatccacggtggggaaaagctgtgtgacagggaggcagagatgagggggacacttcgaatcccccaaggagtgcacgggcctggggcagacacggccatctttcccatcacggcctttctcacgctcacactttcttcctggaatttgctgattaccgacagagaagaaacacctgtggacctgccccaaggaggagcttcagatcagcatcaacagccggagataaaaggaaggtgctttgggatgatccataaccttcagtctgtgtcccgatccttggtcagcatctgagaatggtccagaatggggatgcaggaggagacggtcactccaactcagcctgttgacttcgtcatcaccaacttcgcatttcaaatccacctttgtccttaaaaatacacgttaccgtgggtttggaaaagttctgccttccgtgggaggttttaaagacaggtgttcttcctctgcctgcgttctgctaagccagagagggcaaagagaaccctaactttgaatttttaagaatgtcaatcttggggcttactggtaagtattcaatgaagaacaacgcctgagagatgctgacattctaaaacacacggtttagaggcctcccaggcaaatgtgactgtgctaggaagcaactctcctccatcctgctctgtgtggatttatggcatcgatggtgggcagctcctgtgttctgcacagagggatccccaggttgaaggatgacgtggaagcaatgacgtcgtggtcagggacgtctgcagggagcaaaatgaagcgagtttctttagttcacaatttctcagaggctctgctcggctggcatgctcgagaacatcctgggagggctgaggctactggccatgagctcttgtcttagaaaagctgtgaccaggttgagggacgctggggtttcctggaaccacctgatacctgctgtccgagatgtgtctcaaaattatcttgcatttcaccttgctttaaaatttgtctctacttatttcatacagagatgcatcatttcaatttcaagaatatatgctccttgattatcactctaaaatagcccataagatgtaaacactgatcaaatgaattgcctccaacaattgcaactatccataataaacagtaagaaaaatggttcacgccttctattcactagccacaggaatctgggcacgctatgagcctctgagtctcacggaccacagagactacaggtcagcatgtgagagcttcatgtaggacccagcacctgctgaacggaggttggatgtgggcatcatcgtggtcgttgagtgtggacaccgagagccttcacacaggatggagggtggatgtggcacctgctgaacggaggttggatgtgggcatcatcgtggtcgttgagtgtggacgccgagaggcttcacacaggacggagggtggatgtggcacctgctgaaccaagggtggatgtgggcatcatcgtggtcgttgagcatggacgccaagagccttcacacaggacagagggtggatgtggcacctgctgaaccgagggtggatgtgggcatcatcgtggtcgttgagcatggatgccgagaggcttcacacatgacggagggtggacgtggcacctactgaaccgagggtggatgtgggcatcattgtggtcgttgagcgtggatgccgagagccttcacacaggacggagggtggatgtggcacctgctgaatggagggtggatgtgggcatcatcgtggtcgttgagtgtggatgccaagaggcttcacgcaggacggagggtggatgtggcacctgctgaatggagggtggatgtgggcatcatcgtggtcattgagtgtggatgccgagaggcttcacgcaggacggagggtggatgtggcacctgctgaatggagggtggatgtgggcatcatcgtggtcgttgagtgtggatgccgagaggcttcacgcaggatggagggtggatgtggcacctgctgaactgagagtggatgtgggcatcatcgtggtcgttgagcatggacaccgagagccttcacacaggacggagggtggatgtggcacctactgaaccgagggtggatgtgggcatcatcatggttgttgcgcgtggacaccgagagccttcacacaggatggtgggtggatgtggcacctgctgaacagagggtggatgtgggcatcatcgtggtcattgagtgtggatgccctccagaccctgtggctttgctggacagagaagtcttgcacaggtgaggagatgaagttgatgttgggctgtgggggcccaagggctcataaaaatgaaagaacacatatttgggggcaccccatgccacacaaataagcacattttgggtaatgggttgaggtggatgaaaactccagtggtattaggactccgtgggtattctctgcccgccctccaattctgaacactctgtccttttccctgagaagccggggtgagcgtgcacagcagggggcatccctggaagggccctggggctccattctaagggcagcgctgggacggatgggtccatgtttcaggaaggcaggtgtgtgccatgcaaagaccttcctaccacgaaactcctgagacgatgggccccagggtgccatcttctctgggaaaggcatgttctcaccgggctgggcgactccccagctgtgacaagtagggagcccaagtgcccccaaaaccatccaagtgccacaggttcgccgtgccatgccgggattacaagcttcaacaacgtcacacagagatgcagtttagttttatttatttattttcaatagtgtgaagacacaggcagacacaaagggcaggaggtcataccgatgtgtttcagatcctggcgtcatccgagctgtcctgggtaagtgatgccatctctccaatacccatgtgccttgcccataaaatgggatgatggcacctgaggattcaaatgctcaccatgcaagggtgctcggaggccctcggaaacccggatctgttccagacttttctggaaagccctgcagagactgttctcaagggcagagagaggaggctccccttcctgtaatcggagtcacgcgaggctgacgggaaagccaggaaagggaagtaaagggaataggaagagcctggggcagaagtgaatttaccaactccggtgcacagcgacatcaggaaatgtctcaccccagtgctgcacaggcgcccgggctgtggatcgccaggaggcccgggctttggatcaccaggaggcccgggctgtggatcgccaggaggctgcagcctgatcccagcgtcactgctgcgacaggcacctccctgcctggattctgccgcatgggtgacgcgtcgcttcccaccttcgtccccagctcgactctccttaggagctcctctctgccaggctcggggttggctggtgtgcccgacacgcggccggtgcctgtgctcctgcggtaactcacggccacgttccaggttccagaacccattcctattcagctttgtcacgtggctggtgaggggagacccgggggcagctggagaaggaagaccccacctgccctctgcatgttgctctatttgctgatgtttgacattcacgtcagccctcacgtctgtgccttcatctgtgtgacctgggcttgcgtcgagtagagaagcacggcctggccttcagatgccctacaggactccaggagaggatgacagaggatgtacttgggtcctgctgtgaccgccatcataacaacgccatggacaacaggcacatttcaataacatggaatgacttactaactttatcctcgctgttttataaaatgcaaatgtaaagtggcttaaaagtaatgatcttgaaagcattaaatctctcaaagggaattttttcatactcaagttttggaaaacaaaagattgataataaaaaatatgaacagactgaaattctgatataagtaacatttgatgagcatttgtaagaagtttgattggcctaatcagattcaagacatgattcgtgacccagttattgagatcttcttttcagaaagagagattttaatttaaaaatgttcacctgccaaaagtcagccacggtggcgggcagcggtccctgggtggcgatgtacgcggggttcctcgggtcgtgatccatctgcagagacaagaccacaccacagcggttagccaggagattaggaagcctggaggttaggaagcctggaggttaggaagccagaaggttaggaaacccggaggttaggaagccaggacgttaagaaacccggaggttaggaaacctgggggttaggaagccaggaggttaggaagcctggtgtttaggaagcccggaggttaggaagccagaaggttaggaagccaggaggttaggaagcctggaggttaggaagccaggaggttaggaagcctggtgtttaggaagcccggaggttaggaagccaggaggttaggaagcctggtggttaggaagcccggaagttagggagcccagaggttagggagcctggaggttaggaagccaggaagcagagcctgggttcaggaagagggaaaggtggcatctcctgaactgagcaacacacaacttgccctttgttgattcaaacgagcacccggcacaggtagggacccagctgtcccgagccttgagcctgaaccactgcgtctgaaatgctttccttatacctgaggttgaggttctaagagcagcatcaacagaaatgaagaccagtagcccaaggagggcaggcagccgttgttagcccactcagcaggtgcgaccccatgacatggatgagctttccagcctgcaagtgaccccagagcttcctggccacggagcccacccaggctgccctgtgttcaggagaacgagcctcttgctagagccacagggctggctggggtgaggctgagctccaagctctcaatggagagtgtgaacagggttcctccaggcctcatggacaaacttgccagcgtcctgggagaacgaactagcgctacctgctgcttccctgctggagttaactcgttgtgtgtgggggcttgtttttgtgtatcctggaaagggggcacaggcacagccggtcagcctgggcctgggtctgtggcagagccggggcggaagggccttgctgggagtggcctcctgttctgtttccccaccaggcagggaccagaaacaaagagggcaggtgtgggctctccggctccccagtttgtccgaacgcatcttgctagctccaatgggagaaggttggcttagaagaccataattattacatttatttcgaagattaagcacagaaaaaagaacttgaggacaaagccttgagaggcaagcgagatttgagcacattgctgaggggcgtcagatggaggtggttctgtcttccagagggcaagcccaggccaccctgcaaaggacacgaagataccaggacatcactatcatccccagggctcaccagctcctccccacacctcccagaagcatctgcagagaccgacccccggagagccggatgctgcgctgggggaacctcaccttggggaggcagccgcttgtgcatctgacgcacagtcctttcttctattgtgtctaggactaaaatggactcttttgctatcagggtttgattcgagatttacaatgttcagatttcaaggtaattattaagaaaacatttctcaacacagtgaaaaatgagcaaattttaaccctatgcaattttaagccaacgcacgaggacatcagtggtggccccggtgctaccttaagtgctgctgcatttgggaagctgacgtggggcacgttttctttaacagcgagccagtgagtccccgtgcagccgtcaccagccccagagatgatggctgtcagcacaaaagaaggcaccaaatgcaccttataattatgttcaccataaaagaggggcgagcataaaggaacagatgtaagttattctcacagaacaacacggtgacgctagccgggggctggggggaagcagggagaaaagctttttgtgcatctgatttagtgattcgtaattaaaactggacctcgttttgaaattcgccacaacacacacaatacaggtaaaattatgttaccgtcgctgaaagccccaattagaatgtttcagtagaaaaatgcttagcagaaataagttttgattttttgaaatatgcatttgttgggggtgacagctatttacagagacccctgtctcttccttgcaaatagtaatgcatgaaaaggaaagccccgcctccttctgaaatgtgtgtgtgtgtgtttttttttttgcccagagcaatttctacagcaacacattttaaaattgtaagcatgttcaaactagcacatttagttgctttcaaaatgagaaataggtgattgaaagtaaaatgctggacagggttgcaggagggtcgataaggtgactgttgatttaggtctgagttgttaaggtgtcctaaagtccacacacccatcacctgctccaatgcctaagacaggagcaaatacagtcagggtgctgggagggggatggctgaacaggaagtgtgggctgtgcagactgagtggggaccggcctcacctccctcccgcccacctgccgtcctgtgggggccactgggaaggcgggaacagcatgatgatccgagtggtgacatgtgtcatcggtttcacaataattcaggagacaattacattcatttaattccaggcacattctgttgaacagaaaattattctgggcagaaggattttgtggaagcagcaactgcaaaggccacaggcagcctccttgtggtctcacgcaggcttcgaggaaaagtcaagcaaatacttaactggccacacagagattttactacatttaaggttttcgggcaggataagtggctgtggaggaaatcaagtgagtttctactaacattgctttttccaatgagggcatctgcgtgacaaccggacatggtgggtgtgtgtccctctgtcttccccacccagcgatcacacggcacctactctggcttcctccggtcttcattcttacccttcgcctcctactcatgactttccatttcattgcaacatactttttatttgtatgactgttatgttcccgacacaaactgcccggctgtgggaaaaggcctgtcatatctccaggcctcagtctccgtatctgtatggtgggtgagctcagggagtgaggagcttggacgtcggcgtctccgggcctcagtctccatatctgtatggtgggtgagctcagggagtgaggagcttggacgtcggcgtctccgggcctcagtctccatatctgtatggtgggtgagctcagggagtgaggagcttggatgatgcggtttctaagtgtcctttagctctggattccagtgcacgtgcatgtgcagactcgtctgtgtgtatgtgtgtgtcctggtgttggtcatcccgaaactgtccgtgaaaacctgtaaatttattaggtgaacgccaagctgtcaggcggtctgcggcccgtgaacacgcgtccatgctgtcctcagtgaaccacagaaggaaggaaggatgctgcttcctcaagcacagagctgctgtgtcctccagtggtgtgcggggccaagcatctgaatggcgaggtgcggtcatttctgagcgctttctccccagacaggggcttctgcagcaacacatcccgcctagagaggccggtaccacagagaatccagtgtgactcactccaagtgacttcatgaaaatcaacagccagaaggcaagtacaattaacagtataattctgtttttacttttttttttttttgagatggagcctcaccctgtcatccatgctggagtgcagtggtgcaatcttggctcactgcaacctctgcctcctgggttcaagcgattctcctgcctcagcctccagagtggctgggattacaggcgtgtgccaccacacccagctactttttgtatttttagtagagatggggtttcaccatattggccaggctggtctcgaactcctgacctcaggcaatctgcctgctttggcctcccaaagtgctgggattacaggcataagccactgcgcctggcttacttttttaaaataaaaataaagcccatttgtctgtgttgactctgttatcccttggttgactgattcttatgaagatgtcatatgaactaggatgctagtgaggtgtgttcctctgtctctctgaatacacagtgtaaagatggcctagtgatgtgccttatgctatcagaggataattactaaacaagtatctttagaaaccctaatctgcatgaaaaacttagccacaatttccccaatattccaaacaaagctcattttagaaatgaagcactcagcatgtcaggaccactggactgtgtcctgcagtcctcaacagcctccatggtggcagaggcacccactgcggggcaggtgaagggaacgccagtttctgctcccaaaccagccccggcctctggcagctgtgaccttaacatcttaagaggatctggccagctttggggaagggcatgggtgtcacgtctttactctgaaatcttgcacagagaataagcacacacctcatctgtaggtatttctacctgcccacctctccacctgcccacctctccacctgcccacctctccacctgcccacctctccacctgcccctctccacctgcccacctctccacctgcccacctctccacctgcccacatctccacctgcctacctctccacctgcccacctctccacctgcccacctctccacctgcccacctctccacctgcccacctctccacctgcccacctctccacctgcctacctctccacctgcccacatctccacctgcccctctccacctgcccacctctccacctgcccacctctccacctgcccacatctccacctgcctacctctccacctgcccacctctccacctgcccacctctccacctgcccacctctccacctgcccacctctccacctgcctacctctccacctgcccacatctccacctgcccacatctccacctgcctttcctaacatttaaagcaaattgcatgaaacgctttcttgaaaaccaccatttgacttctcaagtctcttttccaaatactaaggcttaatatgggaatttattgggaaattgtagcttcagtaatcaatgggagattgacttgttttttttgagacagggtcttgttctttaccccaggctggagtgtggtggcatgatctcggctcactgcaacctctccctcctgggttcaaatgtttcttctgcctcagctgggattacaggtatgcaccaccatgcctggctagtttctgtgtttttagtagagatggggtttcaccatattggccaggctggtcttaaacttctgaactcaagtgattcgcctgccttggcctcccaaagtgctgggattacaggcatgagccactgcacccagtcagcagattgacttttgaacttgaaatatttttatatcgtattcttaggagttgagatttacttaagtaaaatactgaatataaaccattattatacacagaattttggttgtaaataactgaagtgattcccatatttggccaatttcttatgctagtcagaacatccaacctctcttctttttctgaaaagccactctgtccctacatagttaaatgcattctgaattaaaactttaaatgatgtttttttctcccttaatagacagtgaaatgaagaattaagctagtttttacacgtcactgggagtttcagagttgtcctggtaataaagcttgtgtgctgtgtttgagtgggctgttgcgtgaacaccattcctcaacttggtgtcctcagtaataatcaggctgttttaaatgtagctcatgggtttctctctcagacaacctacgagggaaaacagaattcccattgactttcatgacctctgatttaaaagcaaagattgcacattatttaccactggatgccttccctgaaatgtaatgaggactaagtacaaatatgacagatgtaattatcatagttttatcctgcacagccagggccttcctttgctgtaattgtgagcttttcattcagctgctgctaggaaggtaattatcattgtaccttcagctatttcataaagaagaggcaccatcgatttcttctgcttcattcttacaacccaaatttggaaaaaaaaaagaattgtggtatgaaataaaggaaagacacaaaatgtaccataaaattacttctccctcctggccttgccttctcacccaagctcctgcccagtaaggcctggagagggagttgcatgaatgtgcaggaattcatcccccaaacacacaccccctctggttcccacatgggatgaaagctgtccaccgtttccagctcgacacagttgctgcactgggcactgctgcccacgctggggcttggctgtggcctggaatagcgcagacatctgcaagttggaacccatcgagtgggggagagtgggcccagctgcaacgctgaactctcgtcttttaggcttgtgaatcacggctttattcctcattctggcttcatcaaatggttcatctcagggaaaagggacctcaacatggcttttcttttccttcggacggtttcgtgttgccaactctgctgcacatagtacaggaacggaatccaggcgcgcacacctggctttaccagaacgcacgttctgttcatcaagtgagaggctggcacatcagcgaggctttggtttgatgtttttgaattagaattgatgacagaaaaatactatgtgcatcacatcttattaaggaagatgaatgaggatctttgaaacccacacggaaccaagcttgggagtcaacctctgctggaaggaaggaagtgattccttcttaagaatgaacacataaacagaaacctgggttcaggtggtgtagaccaagtacactaggccagttcttcactttgaattcagtctctcaaagctgaacatgctcactgtgtgggccacgaattgcgggaaaacgggactggctcaggcatgtggacatcttcccagcgtgctttatcccacaggtgtgctgagaccagcagagccgagagctgagcaccctccaccatcagtggccgctgagaccagcagagccgagagctgagcaccgtccgccatcagtggccgctgagaccagcagagccgagagctgagcaccgtctgccatcagtggccgccgagaccagcagagccgagagctgagcactgtctgccatcagtggccactgagaccagcagagctgagagctgagcaccctccaccatcagtgaccgctgagaccagcagagctgagagctgagcgccatctgccatcagtggccactgagaccagcagagctgagagctgagcaccgtccgtcatcagtggccgctgagaccagcagagccgagagctgagcaccctccaccatcagtggctgctgagatcagcagagccgagagctgagcactgtccgccatcagtggccgtggcctgcaggcagttgggccaatactttcatccaaagctccctatggacgagcaaagaaactttgggacaccgtagggtgcgatttgtgcctcgatcacctgccccgtctcactcagccctagaacagcattgcatcctgcaggcaccatgtttgattaaaggcaaatttggaattttagtgagatgtcctcatccttccctgaagaccagaattgagaagagctgtttaaagggggaaacatgacaaccagtgtccgccataaatctgcatggagccccagcctctccaccactggtttaaagtgccatccgccaggtctccaaagccccggccctggacagtgtcccatcccgcccccgccacctgccaccatcactgctcatctgaacacccagtccgagtgtccccagcctgtggcttcagccctctccatgctcatatctctccctcctctgctcactctgggagggctgcaaacctccccattcagccctgctcccccgacaggtcatgacagggaagggggatgcccagagttaaatagggtgagagccgcgtctagcatgggctgagaggagcccctgggaagtgagggaccacaggccacagggactcataactcacggcacaggagctgccaccacactcgtccccagaaacacaggacagcccgatctccactgcacctgcgtctatcccagggggaggaacagccagcaaacggtctctttcataagaaacagggtcccattcactggaaatacttcaggaaaacgaacctgaaattctggacctgcctccaagccactgattgttacaaaaagcgtagactgaggcctcatgtccccatgccccatgaatatacagggaatgtgtagctccaggaaagaggaacggcacccactacgaacctctcctaaaagccatgtcttctagtcaggaaactgtccagtcaccattgctggatgttctacaagtcacggaacccaccgcccagcgtgagccgggacccacacggctcataaacagccccgctggtgaaggaacaggggagtggcgggagcccaatgggcagagtcggccctgtccaccgcagagacgctgagctgggtggggacgtgatttcccccgagaaccttcccacgtgatttgccgcgtccgtgccacccaagggaaagcctggggcccctgtcccggcagtgcacttacgatggggctagcgttgatgtagtctgagtggctgtggctgttctccgccttcagcaggacccgggagtggtcatctgcaaggacacagtgcaggggtcagaggaacattggcccacccagcagtgtgagacccccacttggcctccagggccccccacccagcagcacaggacccctgcccagcctccagggtccatcacacagcagtgtgggactcccaaacagcctccagggcctatagcccagcagtgtgggacccctgcccgggctccagggcccacccgcatcctctcccaggactctgctcacacccttctgaatgtggtttccaatgttcctgctcccatcctcccctccgtttgtgatcctccaggtgggaggcagacgaacggcatgtggggaactggcacaaagctcccgctcagcagaatggagatatcctggtgttttcccccacgtggagttcacacaccaaggtcaggggttcctctgcagaattttataccatgctggcctttaaatcacagacacacttggcaacacacagcaggtaaacagaaatatgaacgttaagcaatcgcccgcgtttcaaaatagaaagtttcatagtcaatgaacagttaagtcctcaagattactggaatttagttttaaaaggagagtaagagacaaataaaatgcagataaagaggaaatggaggaaaaatgtactggtggagactggcataaaaactcgctcggacagacagagtaacctgacggctgctgaagccgggcgcagcggggggacagtaggcacttgtgacgtgtgtgatatgagagctgtcttggctttggttctgggataacccccatcctgcttgctgtggccgccctcctctttgctctgtttttagaaacttcgacaagcagagctcacagaggagtggaagccgcaagagcccctcctgcacctcccaactccctggtgtgtggccgcttccttctctctgcaaggtgcgctttgtgttacaggatctttggggtggtgtttttctggccagaaatctctgtggccggtggcgcctttgcccaagttttgctcaggctgggcctggcaggccacgtttggctcacactaccagcctgggtcccatgcctgccaagggcgagtcaggcatggagtggcgaggggtgtgtgaggagcacggggtctggccacaccagtcaggcacgctgggtgctgcagcagggtgggcagctccaggtgccagcatgggtgcgggctctctgtgaggctgcggccagaccagacacactgcaagcagcttccatggttgacactgaggaacatggtagctcctggaagtttggagataccaggaaccacagggtcccaaagatggagtcacaggcctagctccgggagctcccaggtctgggctccctgaagggctacagctgttctctccttctcttcacccacagtgtggcgagcagggggcatgtctcagccctgtttgtgctacagctcttctagccccaccattcgacaggtcctgagttcttgttctgcgaccaggaagaatgaggtatggagacaagtggaggatgagcaagatgaagaggggtttatcgagcaatagaacagctcagtctcccacagggggcagctcctttctgcagccagggggtcccgatgagtgttcagctcctagcaaaggggaggctctggagtgggtagctcctctctgcagctggtcatccccatgtctgcccagctctggctatgcctggggcatttatgggcctcagaggggaggaagtacatgctgattggcccacgagtggccgtgggcaggcctggaaaaggcaccatgagttcccactctgatccacaggacttgcagcccagcccccagccttcaaaccctccctggcctgaaggtggtgcttcatggaggacctgcccccttttgcccaggaatctctgtctcctgctgccattcatggcacccaggctgtttgtgccaaggggcacctgcaggccagagctgagctgccctcagccctccttcggcttccctcccatgcttgttggtgcccaaagtccagagggggctgaggtggcagggggctggtgtgtcagcactgcccagagtgtcacacctgctgggctgtgacagcgcccgggctcagccctgactttgctccaagatcagcatgggtgccaacagcagggagaatccaggtagcaggaacaggcacttcctgcaggggcaaggatcttcttcctgggtgcctaagtgtgcagggctgcctgggtctgcagctacggtttgggcagctgtagctcctccccagcgtgggggtgggggtggggtcctgcctgccgcgtggaacaggatgcccaggttacgcctccctgctgcagctggtgtgatggtagtggccactccagagggcctgtcactgccatccctggctgaaatctggaagcaacaacatctcggctctgctgccgtttgtcccagggaaaacctcttggtgctgcacacaacaccaatttccatcttttctgagaaaacaaaagcaccctcgctggagccctcggaggccagtgcttggtggccgtgggtcccctctggacctgtggccaaactccaaactcgctgcgcacctcctgtgggcgctggcaccagaaggaagtggccccaatcatggagcagtgtggtggtggtgaagctgcacggactctgcttctctacgcaattctttcatttttcttggagattttacttacagtttttaaaacaacaaatcctagggcttggaaaacttagtgagtgttttaactgattgaactaggaaagtactgtgcactagagatcaatacactccaggttggatgctgtcctgacaccttccttcaggtaggaatgtcagcctctttcaggggtgacaagatgggataagataaaacatctagagagaggagaagaatgcatgtgtacatacgcacatgctctatgcagctgaatgcctcaggaatgtcatgaagctgcaagtcatcccatcagctctgaacgaaggtgtgaatgatgcaaaaatcccagggactcaatggcttttagctcctgcacaaattagttcttggagagtgaaaattggcagtggcaggaaattgtaatacaaatcatcagaaaaaaactggttgactctgacatctgaacaccccacacacactactccaaacattgattccagaaacccagtttcacagtggggccacacagacaccgcagccagagatgaggctgtggtcagaggtgctgggctgggcccggtgctgcagcccacacagagcgtgggaataaaagcaggggcttctggctgcttccaggggcctctagggccctgcctcattttcagcacagccacctttaggcacttgtgagaccagcaactgcggaccgttcttacgtgtctgagaaggcattaccaagagcagggtcaggagggagcagggcagggaacaggcagcgcagcctggagccctcaggcttttgacctggcttggtctcgtgctttgatggtgcccacggcaccctgagaccagtggcctggcctctacggagggcagaggaggcatcagggcagcgtgctgggagctcctcctcagctgaggggtccctgctgccaggccctgtgagcaacaggccacggggaaagtggccactgccattggactcagcagacaagtgccagctggattttctcattggaaaattaagaaaatgcttccctagctcgggagtcctggggagttagacatgcattctacgagcccggccctctcctctcgatggcagagggggaatctgccatgggcacctgagccctgctggcaagtggacaatccatgggcttcttggtggaaaattgttttagccgaattcatttcccccgaggtcaccctttaaagatggcactgagtcaaggacccggcttccatgacttcggagagctcctacttcctgatcgcatatttgattttgtgtcaacatattgcttttgaaattaccagcgaagtcttttttttaaagagacagggtcttgctccgtcacccaagctcaagtgcagtggcacaatattggatcactgcaacctccacctctcgggttcaagtgattctcctgcctcagcctcccgagtagctgggactacaggcacgcaccactgcacatggctaatttttgtatttttagtagagacagggcttcaccatgttggccagggtggtctcaaactcctgacctcagatgatccacctgcctcggcctcccaaagtgctgggattacaggcatgagccactgtgcctggccagcaaaatcattgtgtttgtaatatggggtcatttggaacctccgggaaatgcttggagccatcctgggagggccaagggacgctgcaggctgtggaggagggcggactctgattcctgcagggggcggcaaccgttcctcgtgcggagagttcatgtgcctggcgaatctctattttgtgattctcttactttttatgagatgttttgagagcaaataggatgatgccatccagttcccgagtcccctaaagggcagtttccttgacgtgcgaggcctgtggaggggtcttcgtgttctatgaagtgaagggaagcaggtggcctggggcctctcaaggccaaccccaggctggagatgaagccagggcaggcccacgcgcaatcagccctggcctgtgctcggggaactgaaggctgctcccttctgttgtcaaatgaaatatcagacctccctggggaggcaacacagagcaatggcgggaaccacagggtgagaattcataacagcctggggctcatgtttccattaagaacgggtgtgctctatcaaaaccgtagtctgagaatttactgagaggccaggaaaatgtgggaactcacgtagagtcttccttcacctggccctataactgagttaatgtcattgggttaaattaacccactgtgcacgttccttttctgaccctttactgtgtttatcatgcgttagtgccttgttcaacaatatttcaggccggccgcggtggctcacacctataatcccagtactttgggaggctgaggtgggtggatcacctgaggtcaggagttcgagaccagtctggccaaagtggcaaaaccacgtctctactaaaaatacaaaaattagccaggcgtggtggtgggcggctgtaatcccagctacttgggaggctgaggcaggagaattgcttgaacccgggaggcagaggttgcagtgagctgagactgtgccattgcactccagcctggacaacaagagtgaaactctgtctcaaaaaaatttttttttaaatataaaaaaaaagagtatttcaaatttctcagatgttccatattttcacggattagatcctcttctctcatcctggacccagtggccatcctggaccacggacagaacagggactactttcccgttttaggctgaagaaactaagactcataaggatggaacgattcacgtggccacggcctcgtggtccacaggggagcacagggtttgactcccagccccactgcttgccagcgggcgatcctgggtaaactgttcagtgttcggagaatgcaggatgataacatacaactcacagcactgttgtggtaaatggcacgcagcaagcaatgaggagcaaggctgagatgacggtggacacgcacccaactgcgcaggtcagccaagctggcaaagcgtgttcttgctgccccgtggtggcagaacatatggagcgatttttcatagatgccaacagaagagacacatcccacaatttcttgttgattattactatggcaaagagccttgggagatggcccagctaagcatgctagaggacgcggcggtatagtcattaatcatgatctagaacctcccgtgcccaccccactgcatctgaggaaagcgtgtggaagactcctctgcccggaacatcgtcttgctacacagatccctgaggacggcattcccccaggcctcctggcttgctgtccacactcaggaagctgctctgcagggccaagaatctgcctcccaccagcacatgggctccacggtgctgctgtttggaggatgcgtgaggccatctgtgaagccactgctgagtccaggggcctcacggaacttggcaatggggttccctcctcccaggggcctcacggaactcggcaatggggttccttccactcaggggtctcaggtgttctctcgggctctccaactgcctctgctttctgtgaaggtttaggctcagtcatttatgctggcaggaggccctcttcttcatgttgatggtgtggcctgtggagaggtggagccggtgtcttgctcctagagggagtcctgactccagcagagaacatgttccgggatgtgctccacagttggcaccagcacccacaagctcctgctccgagtttatggtgtccatcgaggtctgagggctgcaaaggcacatcccggggctgctggccgtcagcaagggccgtcagtgctgcttagggatcccagcggctcacacacagaaaggcctttgaacttgtcatagttgaggcaaaggaataaatgatcggaccacgtttgtttcaatactctgagaagctacatgggcttgattctttgcagacctgggcacttgaagaccagcaacagcgtgatgacagaacgcattctgaaggggcaggtcctcttcctcccacacgctcctgtccttagtcagcaggcagacattctgcttccaactatgcctttgggaaatgctcagctcaagctataaagctcatcgaacatttaggaaagtcagctgagtgtcattcagggcctccgcagctcagcatacaatgctgcatctgggcagactgggacaggctggggctcatatccagaaagccctgctacatccagagatggtcatgaaaatgagacctgccccacccaccactcaggaggcacgctgctcaccgctgagctgaataaccgagcgcgaggctggtgtccggcttccacactggacgcgtcaaaagcaggtcccagaggagcaacagtggccccaaatggcatggtcacaaggctggtttagtgtctcatgtcttaaatggtttcactggcatcccccacagacagatctctcagaaagtcgccccccaatgggatcggaagcatgttgggcaggtgacctggggcaggtggactagaaggagcctcaagccctgggggattcccatacctgaagcgattttaacccacactagtctcatctcaggcatctgtgtagaaggaactccccaggcagggctatgcgggggcagaatgcagggggaacagacgccaaaggtgtgtgggggttgccgtggccaggcagcgcccgcccagtcactgagctgacttggaggcaccaggtcccagggttgagctgcgtaccctcccccaaaaagacacactggagtcccagccctgggaacatgaccttatttggaaatagggtctttacagaggtaagcgagcggagggcatttgggcggccctaatgcaatatgactggcgtgctgttaggaagaaggactctgcacacccacacgggagggagagcgcccgtgtgaagacgaagacagccgcggtcatgctggggacacgcggagggagcgcgcccgtgtgaagacgaagacagccgcagtcatgctggggacacgcggagggagagcgcccgtgtgaagacgaagacagccgcagtcatgctggggacacgcggagggagagcgcccgtgtgaagacgaagacagccgcagtcatgctggggacacgcggagggagagcgcccgtgtgaagacgaagacagccgtggtcgtgctgaggagcgaggcctccagagaagccagccctgctgacaccctgacctccatttctggcctccggaatgggagacagcctgctttggccacatacactgcccatccctggcgctctgtccctgcagccctccaggcccagagcacctggagcgacctgggtttggcttcccatgccctgagcagcacctggtgcctgcacggagaaagcgccgcctggagccagcctgcagttgtggagtgtgggcaacccagagaccagctccagacacacagcgaggcgtggctgtgtgcgctggtggcgactttctcgcaggaactagaacagtttgctgtaacaggagcacagatatcagacaggcagggccacgctgtctgcacggctccaccgagaggccgtccatcgacactgatgacgaatctcgtctgtgcgagcagcgcagatgagtgtggcggcggcaagacagagacacaaacggctggggggcgcctccaaggagctgaaactaggagcagggggcagctcacacgccttatcaccaggacacagggtatcaccagaagaacagctctggcttgtggctgtgctgcctgagattaacgcccgttttgtggatcgggggcagaagctgcacctgtgaccgacggtcttggggctgccaggggagccgcagaaggcagtgacctctgaccccacagcacggggcgcagggcagactgtgccaagcaggcgcgtctggaaaagtaagggaggaaattcggcgggaacctacacattagctccctagaggcgtaactgatgggcaggtgtggaaaacgcccaaacagctcgcgggagcaactcacttccgccgcacgggaggggtcgcggtcaaagggcatccacagaggcgctggggtgaagcggggaagcgggtgggagcagctccggcggcacaccccggccagggcagggccccccacaccccacggcagccgaaggccccgcctccccgcccgggtctgcggctccgtgaagacacagcagctccggagggttgatctcactgacagggagagtccctgaggaggggccggggtgcttccggcctgggtggccggaggaggaggcagggagagccctgcggctgaacagggcagcgccccccgcatccggagggacaggcccggccccgtctccagtcccgcctcccgcctcagccgcagaacctcggtggttccttcagctcctgaagcggtccgcaaacaggtcgagggcgctgacgaggccgttttctgggctaagcagcgacggcgctaggcgactccgcttgtccttcgtttccgctgtcagctcagcaggtgacttattcccagtgctgctcttctcacagacacaaaaccaacagttccggtctcttccgatagttctggcagagacggctgcggggagacacgggcggaggcgggtccgggcgggccccacgtcgcgcagcctcagcgtgttgcgcctcccgcggctgcggccagagacttccgcaaacctcggggcctcaatcgacagaacgtgtcacctcaggcccaggagagcagggtccggggcgcgtcctcagaagccggcagggcgggctcctcgctgagccgcagggcgagcccggcttgggcctcttcccgcgggaggaggccgccgcgttccttccccggttctccagccgaccccgccgcctccgtctcccacacgcagggaccctctcccgacaccggcctgcctggaacgtgccagaatcgtctccctaacccggcggccgtggatgagcaaacctgcacccgcggcagcctgaactgccgtttgtcgcgtagtcctcgagtctcggagcgcaggggtcccgagggcaccccgggccgccgtcctgcggcccccccacagtgtgccgggactcggggtctctcaccacgagcagacctcggcgctgctatccggactcctcgagccccttacaggccacatggccaggggcgaccctcccgtcacaactgtgactctgtgagctcacagggctggcctccacattcttgctggtggaagaccacaagcaacgggatgccttggaaagcatcgttctgcagcaggactgctcaaccggccaatcagaacacagggaaccatgaaagaggtgggaggaggaaaaaggaggacggagaggagggggaagacaggggaggaagggggaggacaggggagggccagggtggagctcagggccaaggcagggtttgaagtctgtggcccgtggcaaggtcgcagagcaggctggtcatgttcctacagcatcgtggagacctgtacactccgggttcttgggaaacgggggttctggaagggggcaggtgagcttctcgtgggcttgcagagttccctacagacttccacatggagagtctgtgattgtttggaatgggaaagtggtcactaaaagaacagctttattaggtaccattcatatcaggaaaaaaagtcagggacagctgtttcaaaattaaaaagacgaaagagacacaaaacccaaaatgcaatgatgaatcttgactgcatcctggtggaaaaaacaaaacagacaacagataacagaccgtgttgtagagaaagcggcgggagtccctgggagtgtgtgatagcaatggcgctgtgggctgagctgtgccctgatgcccctgtgtgacgaccccaacccccaggactgcggagtgtggccatgtttggagacagggcctctagagaggccagtaagtgaaggtgaggtcctgagggggggcctagtgcagtgggtctgctgtccttaaacaaaggggacccttagttacagacagcacctgcaagccccagggagggcctcggacacggccagccctgccacatcctggaccgcagcctccggcctccaggactatggggaaatgcaattctgtggtttcacctgctcatctgctgtctccaaagcctgggcagatgggcacagctgggtgttagagggcactgagggattgttgttaattttcttagttataacggggctgcagctacctaggagaaggcccttgtatttaggacctgcaggcaggctaaagtatttggacgtcatgacgcctgatacttacttgaagtcgtccagccagaaaataaatgaagtgctcgcaggtcacgctaatacggccaacactgggcggctggccagcgtgggtggtgggtgtgcaggcgatgccacgctaccccttccacttgagtgtttaaaactcttgtaataaaaagtgggggaggaagtcatgctaagccagccacacttctgctccagagagggccctgcaagagcggtgtgcgtgggttgcggctgggtctgcgctggggtagtgtaggctgcactctccggggagccgctgaccttgggctccctaacctccttcagccccagctctgtccctgtgtgaatctcagggctgtttcgaggatgaaaaggaggtgtttagccccgagcctcacgtggaaacatctgatgagcctttgccaatatgctcgggacctggggacggctggggtgaccccatcgcaaggccgggccgtggaaacaatctcagccctggaaccagcgcctgggaagtcccgcggtggatccgcgtcacgggggaggattggctcagcactggtcctgcggaatgtgtttttatcaatgacttgacgacgtgaaaaacatgtttataaaacgagcagatggtgccgagctgagagggaggtgacgcagtgactcaggaaccacaagctctggaggctgaacgagaatcggttacaggagatgaacacaaggctcgattctcctgttaaacttgactgtcaccaacggggggtggggggtgcgcgaggccctgggctccaccgaagaccttaaggaaaagactctggatgttagtgggttcggcctcagaatcagccggcgctgagatgtgcacctggcaggatgaacgtaacttctggtggataaagtgggaggcctgatccaggaagaagcacaccgtggcctggggcccctctggagggtaggtcttccaagtcacgggaaacagggcgcccaggagacggtgagcccggctgctgccaccccgaaggccaggctcgccccacactgtgagaccctccccacacgaagattctgtaagcggaatcggaaggaggatgtgagaaggacgggtagccatgccacaccaggccagacatcttaccaacctatcggttcagttttaagaaagagagcaaagaggatctaaaatctgaactttgagcagctgaactgtgtggagtatcaacgtggctcctgacaaccccaccggcactgtttctttgcactggaggtcctgaagagctcacggaaggtgcacttgcagttgtagttcagagatgatgcttttagacaatctttcccttcgagaagtagcctaatgagaaggactctgtagatctcttcctaaaaaagaatcctcagtctctggcagaacagctgcccagaacagcttctgcctgtgaggtagcaaagaaaaaggcccacacagaatttgctgggatattttctttccaacaccaacaaaccgacagccttcccaaatcctagggcagagtcggctggcactgagatcaaaaggggtgaagggaaggcagccaggctgggagtctctctccagcaactttcttggcgaggtgacatatatgcccagaacctttttctatggaaggaaaaagaaaaccctggcttaatcatcagagttaggagaatcacccacgtattcatctttaaaagcaaatcatgataacttttggtcactcagaagtaaccaaggcaaaatattcctcttaggggactctgtttagagttttgggagagaaaaaaaaaaaaactaaaccaaaggtttatttagaaataaattgttttctgagtattctaaggaaagctatgcttagccaaagtgcttcagcccttgtacatgtttcaaatacttctgtagaagtttgaaatggacatggattttcccaacacacacgcacaatctcaggtgagcccaagacagcctatgaggatggcactggggagtctggatttcagctctgacgggcgggctctaaaccccaaagttcttgtcggccaagtgggggggtttcttgtgaggaccagaggtggcacatccacgggcatgggggacgctggctcacgatgccccagtgatgccgtggttaggacactgctcacgcagctgcagcgcagagcacgggggacgctggctcacgatgccccagtgatgccgtggttaggacgccgttcacgcagctgcagcgcagagcacgggggacgctggctcacgatgccccagtgatgccgtggttaggacgccgttcacgcagctgcagcgcagagcacgggcgacgctggctcacgatgccccagtgatgccgtggttaggacgccgttcacgcagctgcagcgcagagcacgggcgacgctggctcacgatgccccagtgatgctgtggttaggacgctgttcacgcagctgcagcgcagagcacgggggatgctggctcacgatgccccagtgatgccatggttaggatgctgctcaagcagctgcagcgcagggccagtgtggtgaccctgactcctgggaacggtgatcagctgggcctctgcctcactggaccacgctgcaaggcaagggcctgggagatgcccacagccgcgcctctggctgtgaggcagctgtggtcctccagcagcaatgccctcagaagctgggagatgtgaaccccacatgactctcctccttgctgtcttcctgtccctgagccttcagctcttcgttgtctctgtcttgtctctctgcattgtttgtcctggttctctctctctctctcgttattacaacatagagccaaaaatacttttttgtttaggatatggcaccaaaatagtatcatatccctgttcttcatctgaaatgcagacaagcgaaatgctgcataattcttttttaaacattcaaaaaacagaaaatgcatgttaagttctttaaacttctgagataatacaactagacctagcatggtgccagccaagcattgcataatgtgtgtttccttctcctttgggggctcattccgatcagggtgcatctgggaagtcgggcgactgtgtccatctcctgggtggaagaatgacccagggaagtgctccatggggaaggcggggcatgagagaagggaggggtggtcccgaggaccctttccatagacctgggagttcccggtgagcacgcggaaaggacgcggtgggagcggcaggtgcagagggaggacttgaaggttccatccctaacagaggacagcgtggccgagtactcatgcttccaaccctgcacagaggatagtgcatgcccagcatgcagactcgcttccatcgcgacacagaggacagcatggagcccagctcgagtgccgtccccccaccatgacagcgcagcatgggccttccaagccacagagccacagggaagccagtcctcctggaccgtgtgtggctgttttggagccagttgtgtcctgtgaagagcgcagcggccgcaggtgaggcaggagtgaagatggaggaggcggccatctctctggggcctggcaacagcgagagcttttgccaagccactgtctcccggaggacaagatctccttcccaaaagcaagatggccaagagtatggagaagaaagtaggtaatacaagtttgctcagaataaacctatgtgttcatgaaaatatttctatctagggttctcccaggaggtgaacttgccgttctctgtcttccctggtggcctctcaaccctgaagggcagtgctgtgtcttcacaccctggcacatgggtcgggagaaccctgggaggaggtgcaggcagcttctttctggctccagtgcgagtctcgggagggaggtgctttccccctcacccgtcacctggctcagaatgggcagggctgtcctgatccccatgagaacatcaggcgcccatccacatgtggccaccctgttggcaccggctgctacctggggaggctgcctgtgtcccatctgagcacggaccacttcaccatcactaggtccctcgcccccaacccccccatccacactgtacagacagagcccagaaggctgcagggcacacgggaggaaaaccccatcggcaggtcgtttctgccacgctccgggctgtctttggggagggcgtgctgtcagatgaatatttaccatgaaacacctcacaatctaagtaaatgaccagacacacagagacatataatgcacgcttactgcatggctatttaccacgaaccattctccactcaggactcagcaggatacccgctcaccaccaccctcacttgtcctaccacaccggcttcactccccgccctctcctcccccaggctgctcctctctgaggacagtggccaggcccccagagcctgttagtagcccccgacacagggccggtgcttagtaaatatctgttagttggctaatgggatgtattgtattttgcttttcttctaaatataaaatttataaatcacacagcttctgtttttagatctctttagggttaaaaccctcagacctcatagaaactggtctgaacactaaatgggtagcaagaagcgtgcacccagctgggtgaatgggattttacacaggtctgcagtgccccaggttagtttctgaagcaaaacaagattccagcttctcactgttctgacctgtaacacttcctgagggctggaaggagggcaagggcagtgcctctccctggcgtggggggctgtgctgctggtacggggacaggcggtgtctcagggacaccagtctgatcccttgaccggctccgaagggttgaggcagggacacagtgacggagagacggcctcggccacaggggacactggtcccgcctgatgctgagctgaaagtgagtgtggccgagtggtgctctcgaagtgtgagctgacgaagctccctctgttgcatcagagacatgcgcaagggccttgtcttagggtcctcaggagagtaactaagaaactctacccacactgtcatttatcattcatcactcaacgttgtgagtatctacttccccctgaaactctggtcaggaacatatctaggacccccttcctcctggcgggtgggtttataaccaatcaaagtgtggaaccttcattggaacctgctatacacatagaggatgagtgaggtggacgccagcgccgggcagtccttgccctcctcatcttgtaagcagcttagtgcctcccgtgctgtgggaacacgaggcggtgtctcttccagtccacgagagtcactcggagaactgctggcttatatttccattttctggcagtgatccctagctaggtagtaggtgctcagtttgtggaaataattgtaaagttaaagatgctgtaaaagcaaccactgttgattgtgtgcctgcgacgtaccggtgctatgctaatgacctcgtctaacccttacagcagtaatacttcaaggacgacagcgtgaccccaattacagatgtgacgtggaggctccaagaggttcaggaacatgtctcaagtcactcggtgacagagaacaatagagctgatgctcactggggtgcagatgtccccaggcccgtgctggaggaaaggaagacactggttccttgttggttgggctggggatggcatcgcagaggggagattcccaggagggccttcccagagggggcaagtctgctgcaggcggggggtgccgggaaggagaagcggagggctttgcagaccctcaggatggggctgtttcccccgcctgtaacccaggcctccctccccggggactggtacacacaggtcagcatggccagtttcccccgcctgtaacccaggcctcctgcccccgggactggtatgtacaggtcagcatggccagtttcccccgcctgtaacccaggcctcctgcccccgggactggtatgtacaggtcagcatggccagtttccccctcctgtcaccctggccacctgcccccggggctggtatgtacaggtcagcacggccagtttccccctcctgtaacccagtcctcccgcccccggtgctggtatgtacaggtcagcacggctagtttccactgcctgtaacccaggcctcccgtccccggggctggtacacacaggtcagcacggccagtttcctccgcccggaaccctggcctcctgccctcgggcctggtatgtacaggtcagcacggccagtttccaccgcccgtaacccaggcttcctgcccccggggctggtacgtacaggtcagcacggccagggagcggttcttgggcacgttctcctccctctgggccacgaacgagctgttgggctccgcctggtaggcgcacagcgcttcccactccttctccagccggttcttgttcttcaggtggtcctccatgtaggactgaaagggaaacacagggtcaggagcgcacctaggtggtgagcccagaccggcagatgcacaaaaggcagcggaggcctttgcactcgccgcgtgggccatgcccaccttgctcacgagcctgggccatggtgcgacgttgtgctacggtgcacaatgcatatcataccatgcaaccgttaagtgaaatatgtgcattgttaacacacattttacatatgtaaatataaactccggtgtttgggaatcagtttaccgctgagatgacaacaattatcacatgctttaacgacagggccagggagctcagaccaagctctcggtggggctgctccgcgtgcccatttctgcttgcatggaagtcatttttcttaaaaccggcgcacgtttctgaacccactgggtgtgatgcagttgagagactgggctgctctgatctgtgcaaaatgcgggacagcttctagcatgaaacaaacacaaatggatggaagcaaatattttaacccttggctgtttcgatcttaatttttctggtgcttgtcgttgagcattactatgagtagacaaggaaacaaaggcctcctgaaaattcccttccacaaaaacccccatgccgccagcacagcccactcggttcttattcatctgtaccgttgagaacaagccctgattttaagaaagaacatttcaaaggaccaaacccagctgcactatggcaccacaggaagtgacggcctcgtctgctgtcactctgcttgtggatttgcaaggtactgtgtgtcatgtgtagacacaggttccaagtgtgtccacacgagaaaataaagcatgcatgtgtacacatggtcctttgctgcaaagcggccacgcattccaatgtcaggcccggggtccaagcccttctcaccttctgcccaccccctgacatccccttcgattgatccgaggagctgggatggtccctccctgcccactggggcccgttccaggagacaggtagagaaagagacacagagggagggagggctggacacggcgaggcgggaatctcaggtcatcgtgccgtctagtggaagttttgaccacagccaacctgaacccatgcagcaaacacacaccctgctgtgctggcccagctcacacgggagcaggtgcatcgggcacctgtgctgtttgcgcgacacccccgcatctgggtgggtgtggtggtgagggacaatcgcctggctcagggtgggcactctaaggccgtctgttgggaggtcccaggttgtcactgtcacccccaccatggccctgcttgagctagttgggaaaagcagagggactccagtgccgttgagaagccgcaccgactgcctgctccacgcagcgaacgcttttcccccaccacaccttgagccttgggagcacacctgcgccaggaacagaaacatcagggctgctctgagccaaagcgaacgagttcatctactcccgtcaccagccccgacacccaggaagcctcgtggtttccttgtgcatggaagaagcaccccacagagatgtctcgagttgtgaaattaggcaaaattcaaatggctcaatctaggaaatgctacacattctttcttttgagacaatcattatggaacatcaaattcatatttttgtaccaaagttaccctaataggaaaaacatttttggatgatataatatttaagttttgtgaaaatactgaccagctcatctagcccaaatctggtgtgtgagggaagctgggaggttgatagttatggtgaaaggatagtcccagtctgtttctgtggctacttttctcaagttgggcttacgtagagttctacaaataggtaggtcgaaaatggttcctggcaaaatcattctgggtcctagcttttctttgaaaaatgctcttttcataaaatccatcacaaacaaatgggcttccttcagtaaaacatgatgggttctaaaatgatgaaccctagcaggtttaatccaatcgaaaatattatctgcaaaagaggcactggatattatcttaattcgtataaactacagctatttaaattctcacatttatcttaactataggaagcaaaattacactctaagttctcttgaatttctaaatttatggcaaaaatataaactgagcctgtgtggcccaaggttgggtggtaggagggaggaagaggtagatactgacgcgatgttttttcacggagaatgaagtcatctgcagaggcacgtgactctattaaaactgagatagagctgacatctctctgcacacgccactccagtgggctgtgtttgtcccgttctgctcatttcaatttgatctgttctgtattcttctatcaatattttttatgaaacatcctttgtgatattaaactgatgaaatatcccccaactacatcttaggagtcttttttctctttcatggcttgtagataagatgcttttcatctgtgagtctgtggggaagctaggccttcatagcaaagtaatgttttaaacaatgaaagcaaaaccaaaaggtaccacgggagcttagtacagatgctcccctacttatgatgggttatggcccaagaacttcttaagttgaaagtgcattgaggccgggctcggtggctcacgcctataatcctagcactttggaaggctgaggcgggtggatcacctgaggccaggagttcgagaccagcctggccaacatggtgaaaccttgtctctactaaaaatacaaaaattagtcgggcatggtggcgggcgcctctaagcccaactactcgggagactgaggcaggagaatcgcttgaacctgggaagcggatgttgcagtgaaccgagatcgcatcattgcactccagtctgggtgaccagagtgaaactccgtctcaaaaaaaaaaaaagtgcattgaacacaggtaacctactgagtgtcacagctgagcctagcctgccttacacatgctcagaatacctaccttcctctgctgctgggcaaacccatctcacacaaagcctactgaggataaagtgttgaatatcttacatgattcattgaacactgaactgaaagtgagtaacagaatggttgcatgggtacttgaagttcagtttctatttaatgcgtgttgcttctgcactgtaaagtcaaaccatcataagttgggggccgtctatactgtggtcatcctgcatgtgaacttggacaagtatagcaactctactcagacgtcttctggaattattaggaaattaacatgtaatttaaacagtatttgtggcttttccctggtagtgggcatttagctataggtgtttttaaaactgacatttaagcaaacaaatcagtaagaaaaaaaaacacaatcctatcaaaaagtgggctaaggacatgaatagacaattctcaaaagaagatatacaaatgaccaacagacatatgaaaaaatgctcaacatcactaatgatcagggaaatgcatatcaaaaccacaatgcaataccaccttcctcctgcaagaatggccataaccaaaaaatcaataaacagtagatgttggtgtggatgcagtgaacagggaacacttcttcgctgctgatgggaatgtaaactagtacagccactatagaaaacagtgtggagatttgttaaagaactaaaagtagaaataccatatgatccggcaatcccactactgggtatttacctagaggaaaagatgtcattatacgaaaaatatacttgcacatgcatgtttatagcagcacaattcacagctataaaattgtggaacaaacccaaatgcttatcaatcaatgagaggataaggaaactgtggtacatacatatgatggaatactacacagccataaaaaggaatgaattaacagcatttgcagtgacccggatgagactggagactattcttccaagttaagtaactcaggaatggaaaacccaaccatatgttctcactaatatgtgggagctaagctatgaggatgcagaggcataagaaagatacaatggactttggggacttgaggggaggagaaggaggggggcgagggataaaagattaacaaatatggtgcagtgtatactgctcaggtgatatgtcaccaaaatctcacaaatcaccactaaagaacttattcatgtaactaaataccacctgtaccccaataaatggaaaaaaatcataaaaaagttagctcagaaaaaaaaccttgacatttaaattcttttattttatagatgagtgcatgtgtgagagagtgtggtggtgggacggcttagtttcttaaggcactgcaacttttgttacataaatagcatatgtagaaaagaaaagaaaatgaagataagcagaatggcaacgaataaccccagggcccacagcaaactgtaaggcaaccttttcccccagtgctgagtaccttcatttcagctttggacatcctcaacagaatacaatttactgctttaaagtgaaaaaatgcagagatgaggctcacatcttacagataaggaaaccaaggcctagagaaggtaagcaattggtccacagcccccagcagccagtggcagcaccaaagcctgagcctggcctctgaaatgccctgtgggttttctcctggcccgtcactgcagccttctcgctgatcttcttaccatcgcttcccctttccagttgctttttcactgaacgaccaggttggcgtttctggtgcaaaatataacctatttaaaaaaattaccaagggtgcctagactagcattgtcctttttctgaatttccttttactaatctgatactttctatcccataagactgcttctcagcctttgccccgtccccaccgccatccttctctacattttgtgctgatttttctgtaatgaaccgacccagacttcaaggtgcagttcagacaacacttcctcctccaggagtccggtcaggacatgcccattacctaccccaccccatgatctttcttccctataacccaccccccacatcaaacagttactacttcaaacatacgtctctgtggcattcgtcacattcttcctgttgctttaactgtgggtttcaagctctgattcttctcatgagattaatttttttagggcagggactgtgtttcagctgctcagcacaggcagcaagcactcagccaatatctgtggaataataatgcataatctggaaatctctacaagtgatttatattataggtaaacattttattttgatgatgggcatccaaaacactgcctttgaatcttctgaaacttggaagaacttctccaaaaaggagcataaggaacttggaatgttttactatacatgaccttgctgccatcttcctttctggggttgcccagcaaacatcactgtaactcatgacagacaggtgtcagctcattgagtgttcctgtaacaacctgaacctaacagcagtcgtataaatttggaagggcaacagttcagagagctcttctctacaagtctcctccacaactcttctccttttttcacatctccctcattctccacagtccaggtcccaggtggggtgctccatctcccctggagccttctcagtggcctccaggcaccagtgtgcaccgcacctgcagctgggtctcctccggggcgtgagctcctggtggtcagggaccccttctcacaccgtgtcccacttcacacagctccttgctctgggctctccgtcagtgcctctgagttgaagctttatgaagaaagctctagaatgagctgactgaggctgacaataccagagggagtgagccagtgaaggcgggattgcaccacaatgcgtgctcacatcaggaaatccatgaagagtgaaaacagggagcgaagaattggtggtgaatctcagtcgatgcaggctgaagtgcttagggaagttggagttgctgtctgttccctgatccttaggaagcgtttggaggtgtgtctttcgtcttttagagctgcttgctctataattttgggttttgaagggctcttggctgggagaactcagtctgacattttcatatttttaaactccattaagggaattttacttaagctgtttctagataagccctgagtgaaaaggtgtctccaaccttctcaaattctcatacttcctgagggcctagacatgatgtgcttgtggaagagtgaattcctagatcaaaccattcatggagaaagctacggggactcaggaagtgggtttcccaagggtgttgccaacattcactatctgacgtagatcccagagcacacgacatccacaccacagcagctgaagatgtggctgcattctttttcgcgttctcaccctttgagaatgacaccatcagcgctcacataatctactttgttagagatatgaactcaatctaaggtttcccctgtcatccttctcccgtttctgaatccatcctgccagtccctgtctcatggtgttttctagctcatcctacgagaccatttagggttggagcattaaggacagtcactgggtcacaagactgggtgctgctagacgggttttggaggaaacagcctccatgtgtcaggcaaaccaactggcttccacatttaatggaatcattatacacagaaccccaaaatttgtgtaacaaaagtgtgattgccatgaacactttgagggagaatgtgttcacaatgtattacatagcacaaatgtcgtcagcaccgtcttccggtcaaatggtcaacaccttgaggtcaaggggctgatttctaggaacacggagcacagacagtccagaacacaacagtgtctgttaacgattgcaagagcaccttctcttcaggagaggaaccaccctgtcactcgcagagatgaacatggaaaggagcttctgtggaacaggaacgcacatgaacacactgggaaggcactggactttgtgttgatagagttcttaacagtcttacacagaacggtgtgggtccctcccacagctactttttggcgtggagccttccggcaagtcaggccatctgactgagccccacgggtgcaccccttcgtaacctggtcatcacagctcacaggggagagccagagtctatgttcccaaggaggttttgaggggtgatgcgtgaatatgggagacacagtagaaggtgtgtgcccggggatggggtgcgggacggtctcagtgtttcagtagaggaagagggtactggaaagactcctgagttccctcccacgctctgtggctgcactgcggttctggggagactcttatcctcttgtttaaggaaatacaacatgtccactctcttctgttcacttcttttttgaagagggaaatatttcatggcctgtcttcaggagaggaaatcctaggaaatgcctgtttaagagactatgtgacactaaactgctagttaacaaggacaatttctccggtgggaagagcacaccagcatcccgtgtgcatctgatgcaggacccgctcacacgaaacatgctcgccttcctgttggcaccaggaggaagtgcagctgccacctctgagtactggggtagtgcatctggagacttgtaaagggtccagatgtggttccatgtgaatcccgtccacaggcactgggatcctgggtcagccaatgctgattcacctgttcctgcagaccctgctgccaaagacaccgcagaacccatggggaggcagaagaaaggctggagcaggtcagtgctatttcagctccattcagagtcacagaaattaggttattttggcatctatctgttggctgtaacaatgaagaagtgagatactgagaggtgcaagatgatttattattattattaaaaataataatgagaataaactcccaccatgcaatactaaaactcctaaggagtcctaaggactcctaaaactcagtggactatttaaaaatgagcaaaagccggtccatctggcattatttctcatcaatcaaaccactcgtgcagtggaaagtgagtccccacggatgactggaggcgcccatcatcactccgtgggtcttcggatatgggacgagtggaaactgtcctggtgaaacttcgttcctacaacgatgctgccagcagtggagacttcttcccactgtagaacaaggcgtgttaaagaaagctgggctttggggaacccagtcattactgggaaggctatacttctcttttctacaatggcgcctattgcagcacaatgccctttaatttactgaacattacaatcaaaccttttgttaaaacgaataatagaatccctttacattttccttcttgtgacgagaccacaggtttgtgtgttgaagtcacaagttagagtaatgcttttaaaagcaaggactaagctgcttccactgccacttggggaaatgatgaccttttctttctttaaaaataaacacagtcacctgtcttcattaatacatgaacgggaaatattcatgttaaatttttgaattccaaaagtaggacaattgaattccaagcaaaactgtgaaaagatgaaaggagaagttcgatgaggttgattgtcctggctcagcacacacagctatgggggcttcgggagcagcaaacccttgatgagaaggtattttattgtctgtagattgctgcatctggcatattttaaatattatttgttaatattatgcagcaggaatgttaaaatatttaaaattagaaattcaaagtagtacatgtgaacacaaagaagaacagataatggttaaaggatcagaagatagtttcactatttcttagtttaagaaagctcttcctgaaacaggaatcccgacccatacgaccatattcaacttgccatctcactctcagaaagcaatgcccacaacgtgaggcggcagggagtgaaccggcttcttcaccatcccgctcctctaacacaccgtgtgcccgtcacggcagcacctttgacttgccatggaattacgggtcttactcaacagctgaaacaggcattgttccggctctccaaacaagcaacttgagatgcagggcagatatgcacacattaccaaaaggcacaggcccatggcagccaactcgaagtgtgcctgcatgccagggtggagtttgctcgggagaagcaaacacacggttttggaattcagcctctgggtcatccgtacaaagccaaaaagaagtagaaatgggacccaaggaattaacaagagtgtgtgaaagaccattcatggggtcttctcgcttttgatcacattttaaaaactgctttcctgacaacttgtttgtaaggaggaggcattcccacacgtatctgcagtaagtcatatgcttcccttaccgcagggaactgggaagtggtcaacacagatgaaactggcaaaagcctcctcctgtgggcaccacaactggcttccctgatggatgtgaattaatgccatttattccaagctctttctctgagagttttgtctccagctgacctattctgaggaccacctagaatctctggcaagcccagagacccttgaaaactgttctccctgcgtcttaatgtgacttagaaatccatttccattctttgccttgttaccaatcaaactgtggagtaacagaaaattataaaccattaaggtagtggagaaaagttcaaatacttcaaaatggaatcttccggagaaagtccccagttggtatgcagttcgggtggagaaggtgaagtagcagcggcaggaacaaagcgtagaaggggaaacaacgtgtggtgcgtgttggttttgagaccgggaacgctactgaactatctgctttatttaaaactttttcatcattgaaaaataaattcactcactgagaattaagaatcccagcactttgggaggctgaggcgggcggatcacgaggtcaggagatcgagaccatcctggctaacacggtgaaaccctgtctctactaaaaatacaaaaaattagccaggcgtggtggcgggcgcctgtaatcccagcactttgggaggccgaggcgggtggatcacgaggtcaggagatcgagtccatcctggctaacacggtgaaaccccgtctctgctaaaaatacaaaaaattagccaggcgtggtggtgggcacctgtagtcccagctacacaggaggctgaggcaggagaacggcgtgaacccgggaggcggagcttgcagtgagccgagattgtgccactgcactccagcctgggcgacagagcgagactccgtctcaaaaaaaaaaaaaaaaagagagaattaagaatgcccttcagataaggctgtcaagaaaatgacatgcttttttcaaagtcctgttagaaaaacactgtaagaggacagattccttgcctctaatagaggcactgggacatgatcacagaccttacgtactttccgaagagcaaagggaaaggaaggttaactctttgcaaagtggtgtgttaagaggacatgaaaactggctctatcttgattgagtagaaactttaattagtgtatttttattataatttggcttttgatgttccaaatcgataacaaagtccagagttgtaagaaatcacactgacaaaggagttcttacacaatgcccaggtgacctgcagggtacttcctggagtccacagccggcccagtctctgcctcacctctagaaggactgcatgaagacctgcgatgcgtggaaaggtggcctggtgcaccaacgcctggtgatcctcgatttcagtttatgacttccactaaacttctgttacacatttacagaaaaatatgacaatttgataaagacttaacaacaaaaaccccaatggaagatgttaatagtgaacacattgtgttctagaaatgttctaattaataaacttaaaaagataagtaattttttccttaccacctactcttactaagtaggggaaagtcttgttctttcatacgattgatggattgttttacgttgggcattttttagcaagatatcatattagggagtgtgcgtaggagggggtgacaggggtcacctgcagaaagactaagaaagaagctgtttaataatggggatgatgacagaggcatcactttgtatttcaggctgtcattctcagagaagcgcaaagaattttaaatgaacaattttatgaatcttattatcttatttaacatcttaaaaattaaggttatgtgaacataggtaaaatacagagatgaatgcttataagcaatggaaaataattcagagaattatactatgttttccataaatgtacagctattaatatttaaatttagggcaaaagaggtctgcttggcattctaagtgaaatgtgaatgcctcatctggttttgggacagagggctaagagctgctgtcatttctgtcggattcctgccgatgttgtggtggtctagtcatctgtcccttcagtcatccagtttgattaagcacgtcctataagccagggatgacctaggttcgggagcacagtagttagctggccaaagaccctgtcctcatgtggctcatttctttagtttcttttcttttcttttttttttttttgagacagagtctcactctgttgcccaggctggagtgcagtggtatgatctcagctcactgtaacctccacctcctgggttcaagcaatcctcctgcctcagcctcccaagtagctaggactacaggtgcaaaccatcatacgaaaacgaaatttttgtatttttagtagagacagggttttaccatgttggccgggctgggctcaaactcctgacctcgggtgatctgcctgccttggcctcccacagtactgggattataggcatgagctacaacgcctggcctcattaatttctttagctggagggcagaccatctgcaagtagataaacacagctttaaaaagtgatttcagacaacagtgagtagtaagaagatgcggacaagagtcacgacgcagagcctgggtgtggggacggggtgcacctgggatggcactgagggggcccctctgaagggtaaactctcagagccatgggccgagtccccgatgctaaggacctgggcagggcctgagtgggggtggggtcctacagggaagggcagtgaaggctggagcccagggcaggagggcgtggccactccgggaggagggaaggtcggggctgcagagaaggaatggatgtgagggcaacggtgtccggcagaccaggagctgttggcctgcaaggactcagcagtttattttaagagccacgggaagctttcatgagttttaagccaaagatgcttgtgatggtggttgatggtggcgcttttggaagaccaccctggttcccaggtggcagtgcaggatgcaagtcaggactgctgcagcccaccatggaagagcaggcagtggctgtggcatggggaacagcgcgtggggaacagcagtggaggcgggcgaatgagagaactgggcagggtgcaccgcgtcctgcaggcaacacgtcctaggattcccgtctgctcatctgacctgcccttcctcacacacctaagttgtcttcagctctttagcttgcaaaatattttgtcattgtttaaactcttcacccctcacagaaccacagcaaggaaagaccctaatgatttgatctgagaagcaaggtcatacctacccttaagttacctgaagttaacagtctggataaaaacctgaaaaattctatccacaactctgatatttccaatagccttcatgcttttgttacatgggcaagacattcagatattgaatggcactattcagctttcgtcaaagtaagtttgctcaaagtaccatagaaaattaactgcccatagctaaaccccaaatttaaaatgtaaagacaaccgaatcactaacctaacctgggacgccgtgatgtgcttgtccacagatgaggcaactcctgaaacacagaccaaggcatccgggtgcctgtgtgcacacagggctgcgttgtcaatgcatcgcgaccgggcatggtcctgggagtgaattatcccccacaggtcagaggggccgtacgacctcttccagaccccccgggctccagttattaaatgactcctgcaatcatgaactgctttccaaagaacacaaaacaattctgtgaaagattcacaggctgacgtaggctgacaggggttctagcccattaaatccatttcaaactgaaaccagggagacagcaagtttgagaaaaccagaatttttaagagatgaaaactgcacatctgcagtggacgtggtcacctgcctgttgtccttggacaccgcgtgtgggaggagcccagaactttctaaagaacctaacaggcctccaggtcccagatgttctgaccagccagcatgtctcgagtgtgacgttaagtccagaacacacgtgaaggacggcacactggtccatctccctggacgtcctttctcctgtccacagcgacacgggctctaaccagccaacgccacgtatattgagtcagtgccattggttcagtgggaagaatcatgaggacaaagatgtaaatggcaggtgtgcgttaggcactccccataagctaactgtttgctcttcatggtgtctctaacgtctgacatagcctggtacaccctacatgatcagtaaccatgtgttggatgaactcagggtacaggcacccacggaatttcattgtgggaatgtgggagtgcctcccagtttctgatcaaaggcctcttgtgtccaaggctggtcatgtgtgccaggcacatgggtttcaggtaacagtcaccttcactttggaagtgcaggtgcaatgtactgagccacggcagtgctgccatgaaggcgtttcggacaaatggttaccagtgtttcatggaatgattttcttcaccaatatttgtcattcaccatctaaaatcaagtgaacaatcagagggggagaagggtacagatctgggacaataaaccaattttcatttttctagaattttctcctatattttattgtcttcgcctcagctcttttctctggctagcttacagactctcaccccagccaggatatctggattttctagaattttctcctatattttattttcttagccttagctgttttctctggctagcttacagactctcaccccagccaggatatttggattttctataattttctcctatattttattttcttagcctcagctctttcctctggctagcttacagtctctcaccccagccaggacatttggaactattgcataatccattcccagaatgcatgagcagctctggaccctataaaatattcattcactttcaaaaatatttgcaccctgctgtcaaatgtagacaaagtcacatgaagtatcaggaaatcgctattttaatggcaaatacttccccaaccctctctttccactaaaacattttcttcaaaattattttcataagaaagattaacaatttcaacattagctgctaatcccctttcatttaaaactctgctgataaaattctttgcttgtcattcaaacagtaagtaataattatagatttgaggcttccatctctggcttcattaatggtaaattgcatggaagtctgaagcataagtcagctttgatacatctcaaaatgcaatttccatagcttcccttggctatgtacaattaattacacagttaataagggaaatatgttaatgaaaggaacattattcatcaagaccacctgcctttaccaaatatcctttgtgtgtttctcttcttcttgtaattttggtctacagacagttaaaaaaaacaacaacaacaattgacagtgtgatgattttaataccagactgcagctacttcgattaaaacaagtctaatgaaaaattaattcagtcttataatatttctactgatttctgccttttagaagtttaaaatgtctacccatatatttctactgatttctgccttttagaagtttcaaatatttacccatggtatttcaaattcctgaaatggctatttatcaaacacaaagtttactattcaggtgtcttctttataccaggatctgcggtcatcacctttatagatgaatggaaaacactggagaactttggagaaatggcgtggaagatgaagagataatgctcaatcattctaaacagattaaactcccccaattcttttcccgtccattttaaacctctctgcttagcaataattaaatcctctcattccatttggataatcaaagtttaactatagatagtttaacacagaaaccaatgctaacctttacaaagaaagtaaatatcttctaagcctttgatgaggaagagaaatcggaatattataaccagaaaaaggaagttggaaaaaactatatttctgtttactttttataacttatttgaacaatatgaacaaatgtatttgcaaatatttgttctacaacatttttttattaatataaatcaatacacattccttattcaatgagaaaagaatttgactctagcttcgaacatatccctttgacatatgaaatatagtttaagccatgagttacttaaaaattccattagtgtgcaaaattcagctgaaaaccaaccttggattccaaacagatcataggaaaagagggtgcaagagaaagaaaacagttcatgaaatgcaacctttacgtaactaagccctgaagaggtctcctaccacactaacatattctaggagaagagcagaatctctaaagtgaacagcagcccctgtcatcccagctctgtgacaagcagccctgggtgggggaatcggggtggctcagcagcaacatccacaccagcctccagcagcctggggagtggcggtttccgtaagatcccttcaaaagccgtttcgtatcacgatttctatgctttgtgtggcagcagacccatttgtttaagtggtcatgcacccacctctccccaccctgatggtcacctacaaagcccatatggccaaaacggtatgatcagattctctcagagaccagactcctttgctggcacccgacccaggagaagcagcccagaggggaccatttttactccactgatgacgacagtggttctaacagggagacctttcagaagaaggatgaggaggggcggttgccaggcaacgcatagacagcttctcccgctcccaagtagcaggtcttttcttagcagcagcattctctattctgtgccaacgatgtactcattacgattttctgatgaagtttttaggaagaataaagagttccagcaagtgctgtaaaggttacttaggacagtgatggagacatgcatgtcttcttccataagcagaggagaaacactgaattctatagcaccttatttgaaaatgccgaagttctaaaggtgctcactgaaagtagaatgttttgatgcttcacttcctaaaacccacaggctatatgcacatgagcaataatacaagaaaaggggaacaaaacaactgacaaggtgatggcaccaaaaataccagaaagacttgcttgtctgagacaaagttaatatccagctcttcaccaaccaaacgtgatcacaaggaatggatcttgaaggggtcagtctatgtgcgagacaaagttattgtccagctcttcaccaaccaaacgtgctcacaaggaacggagcttggaggggtcagtctatgtgcgagacaaagttaatatccagctcttcaccaaccaaacgtgctcacaaggaactgagcctggagggctcagtctacctcctccaccttccagaccttcctgtgagcagtgaaatttctaaaatgttggtgaagggaagagaacattcaggcttccatagtcaaccacaattaccaagtgttgactggtcaccactcctcttccaattgctttgaaacgaggagtttggaggagaagagaacagagagctgatatgtcaaacagtgttttcacttttcagggtgaagagttagaggtgagactatcagagatattttacatcttttcccagctcagtgccagtcacacggcatggggaccaaatgacatgcccgctggcattcccagggtttggagggtgaggtgggagtggatgatcggggtcactcttcttgctgggacttctcatctgtccctccctgcagctgccttgtcgtcactcagccacgtggaccacctggacttccctaaggccatcagcattagccgtcagggcccactcgctgctcacctgctgcagaccttggcccatcagcactcccagaggcagagcattctggacacagcgatccctttgactgcttacagaaaggtgagtgtggaaacccggcggaatgtgatcattacctgctcatctttgactctagacagccatcggtaggatgtctttctttccttctttctttctttttttttttttgacagagtcttgctctgtggcccatgctggagtgcagtggtgtgatctcggctcactgcaacctctgcctcctgggttcaagtgattctcctgcctcagcctcctgagtagctgggattataggcatgcgccaccaaatctagctaagttttgtatttctggtagagatggggtttcgcctgttggccaggctggtcttgaactcctgacctcaagtgatctgcccgccttggcctcccaaagtgttggggttacaggtgtaagccactgtgcccagctatctttctttattagggagaacacacagttggttcttggaggcaattgtcaatgtgatgtgagatgaagcacagtgcggcctctgcactgttttcctttgtgtaatttgcatggcatgtgtgtttccagtgatatgaagaaggagataacctgaagtgtcttcctccacagacacgtagaatgctggacaaatggcacagtcagcctttcacagaattaagggaaatccccaggaatccaagctgaaggagaaagtgaaactggaatgggggatgtgcggcctgaagccgctcaagccctgggtggaaggcaggcgacaggattccctacatctaaaatcagggtcttggactttgctgcccatgtggggccagcagggaaaaccctgccttgctggaggtagagagctggacccgagccccccacataacacaggaccctcaacaaccacacccttagcaaatgggtgtgctcacaccacaggaatctcgtctgtcaccatatggactcaaaatgggaagacgcttgaaacatgggcctcatccagaattgaggctcaaacacatgagtgatctgggtgaggaattgacatgaagatagtctcagtttaatgacagcctagtgtgtctggcaaaagctctcttgaggttaatactctcagaacagggccatacaaaactagaactaaagccccaccaatgaggagcttataatctggaattatagaacccaccagacaacaaactaccatgagcaaatcagcaaacatcaaagagcaggcttagacccatgagaccttaataaacgtgttagaaaccatcggataatgcattgatcatgattgaaggtgttaaagtaggaaccaacaatttaagaaaagaacaacccagcaggttgatctgaaaaagaacaaaatagaacttcaagtgaaaaccatactctttaacattataactacaatgcatggattacaggttagacactgctgaagagaaacactgtatgttggaagacagatctgaggaaattccctggaatgcaggacagaaagatagagaaaataggaaagggatttaagggacatgggaataagaaggtacaacttatttccattagaggggagaatggaagagagtcaaatgtaaattatatatggtttataattttttaggattagctggagaaaggaattctcagattcaggaatcacagtaagtttggagcaaaaattaaaaataaaataagtccttaccaagacaggacacaaggaaactccaaaacagtaaaggttaatcaggaaggagcggcccacaaaggaaccaccatcagacatagcgatcaggaaggagctagagctggcacacaaaggaaccaccatccgaccagcaacagacagtcttctcaagtgcaggggcaccagagacaagagaacagggtttcaaggtaataaaagaaaaagaaatagaacttgacccttggctaatctgttatgcaagtgtgaggatcaaagacattttcagacaaagagaaggaaactttcccaataaaagactgaaagaaggatatctttcagaaaaaaggtagttttacccaaaatgaagaattgagcagtaaaaggaatggtgatggggggagaggggaacctcataaaatgagagtcggtctgaacaaatgctgactatgaaagctagtaaaacaaacggttgatttcaggatacaaagacaaggcacaactgaaatactgaacaatactgtatgtgtcagagggaggtagctgaggtctgtgtctcaggtcctgggtttatttgtgaggagggcagaaatgtgaactccagatattgttaagccaagcatggttattaaaagtatcaggataattactaaagtataactgctgaactagccaagggggagagagggaataaagaaaacccattcattcccacagaaggcaggagaggatgctgcaacaaaatacaactcagaaaatgcagggcatatgtaaggcaaagaatgagatgtacacaggccaaacactgagtgagtgagagattagcttttttaaagaaaaacttacttggcaacatggtttctataattttagaaacgtcactgcaatactctgcagtatgttaggagattttcccacagtgggcgtcattatttttctttacggcagtatggttgcatgagttttgtaaccagccatattttgtggaaggggaagccagagttcacaggatgtaatgctggcccagatgtcacactgggaagccagactctggacgtggcaccatcttttcactgcagcaccaaatcttcctgtctttccaagatcactgtcctcttgctccagaagagaaaacactagtgacaagtcaggacccactcagtccctggctcatgcatcctaagtgctcccaccttctgcaaacgtacacaaataagtgaataatgtcgacttttcgggttcaagaagtcacaacaattacatgtggagtcaagcaccactccacatgtggacgcacaaagctacctgacgtctggctcaaggtgttcactcgagtccaggctgagctcatcttctgctccttccaccgtgaactccaattctgtgaactgccctctgcttcctgatggagctgtgctgttccctcctctgcatgccacctgcccaacacagctgtcttcaccgaccaaaacctggtctcaaatgtccacctcaagtctcctctgtagcccccctgccacgcccgacactcccgtcaaggacagagacgtcttctagcaaaagaatgcagcttggtgtgtggcaatgtctagtgtttctccagcccttcacccccttttgccccaaattggctgtaagcctcttaggagccagactgctggcctccttcacacccagcatccccatggtcctctgcccaggagccgtgctgaggacatgaaggtaagcagagcccacctgacgccagctcatttctgaactgcttgtggaatttcaaaagctgcattttattaaactcgtgttaggtttacacatttacacaaagaatcagataactccatccaggccctgaactgctgtgattcaattcctctgatgctgtctataaacctgcagatgcaggagtcactggacagaccagatggaggcggcctctggtctcgcctcctcgcctcgggtttctccaggaagtttccatgagttcccgagcagcctgtggacgtctccgtccgtcactgggtgctcagaaaacgctgcacgaatgagcactttccagacctgactttatgcaccagcttcaagtgtttcctcccacaaccgttaattcgtggacctgttaacttttaccaagtttaatgtttggttacccaatttaattcaacaagtatgagttggatgcttgattccacttcttctatcatgccccattcacacactataagaagggtctaccaagtcaagaaacagcaaaaaaaaaaaaaaaaaaaaaaaaaaaaaagcagctaaaacgcagggctgcgggacagtgggtgccatttacctaagccaatcgccccggcagccaaaggccaagctgcatcacagcagcttacctctttctcccgcagactctctggaccatcacccaccttctctggagcccaaacatccaatcaaaccaggtcgtaaatatacaggtagtccccgcttatgatggggctatggcaggataaacctctttggagttgaaaatatcattaagtcaaaaatgcactttcaacttacgatgggtttgttgggacataacccaccatctgtcatactaaagatggtacaaactcttcctatagactcagccacttgtctcgctggggccagcatggcagcagggactggtcagattggggtcagagaatttttcctttaaacattaagtgctcaaggcagaaaagacaacatattgaaaacttggagagactgaaaaataaagcactagcatggctctagcattttaagcagcaaatcagatttttaaaaaataaaaagtcaaatcactccccctcccacaaaaaaatagagttccacaccctcaataaaggcggatcatggaagggacactctctgcctgtgtcacaacccaactatccacagagcgctgcaaggggcactgtggcggaggtgtgggggctgcaggggaaggccgtgatggccgctgaccaaggcacagctgctgcaggacgggcacacccacggcccgggcatcccagggaaatccagaaccagtggctgtgactgctcccccgacggagcccctgttccttgcacagccgctgctgcctccagcctctgtctgcgcccttcccaaggaccccctgcagacacccgcacccacagtaaaggaggtgggagcaggcggccaggctccagccaggaagtgtgagctgagctctagaaagtggtggtgtctaaagtggctcaccagcctctccgtcaggcctcgaaggttcgtcaccaactcgtgcagcagatagacggcagtccgggctgtggcaggtgacagcccagggcccagacaccggccagcctcatagtgctcgccgcacgctcagctcaccagtgcggggagactggagcttcccccgtgggactgtggctggaagaccaggggcctctcatgcgctacaagctaccagaaaacactggtgtgcatcaggcgtcggtccctgttacgggctgaaccattccctagaatccatgtgctgcctccctaatcccctccaggttaccccgcaacataacctcatttgcaggtggggcctttacagagatgatggagttaaaatgaggccactggggttggccccagaccaatctgagtgaggtcctgagaagacagagcaggatgtgctcccacagacgaaaggttctgggaggacacaggaaaaagatgtcatctgccagccacggagagagacctcaggaggaacaagccctgcctgcattgtagacttctggcctccgaaactgtgaggaagacactgctgtggtttcagctgcccagcctgagggatgtcgtcacggcagccccagcaggccagggcaggcccctggaggtccacagacctcacatagccagcatacgcctctcccaggagccccattcttgcttcatcaattaaagcagcactctggctgggcgcggtggctcatgcctgtaatcccagcactttgggaggctgaggcaggcggatcacgaggtcaggagtttgagatcagcctgaccaacatggagaaaccccgactctactaaaaatacaaaattagccaggcgtggtggctaacgcctataattccagttactcggaaggctgaggcaggagaatcacttgaacccgagaggcagaggttgcagtgagccgagatcacaccattgcactccagcctgggcaacaagagtgaaactccatctcaaaaaacaaaaaaaaaaaaacaaaaaacaaaagaaaacaaaacaaaagcagcagcactgtctgctctgagctacaatcctatgcacgatttccacccgtgggaaccacacgggcccgagctacccagccggctcctttctcacctggtcacatacatctggacaggacaagaactctcagagggctttctctttctccttggtcttcctaaactttgccctaattaatcgatatcactgcctctctcagaggtgactgtggctgtgatgacggacacggaggagacgaacaggagcagaacagtttcactgccacgtccatttccgtgacagcacctgtgattgatgttgcgtggacgtgccacacttgcacttggcaggctttcgaggctgctggccttgctgccatgaggactgtgtccaaaaccactcttggaaggaaccataaacggctcccaaacatgagaaagtatgctcagtctcacgcaagccagagaaacagaagtgaaaaccacttggatgcagcccttcccacctaccagcggcaaagttcaaaggttcgctgatacctgaggctgggagacctgggacagaggtaccatgtctatggcactagggggacgccatcttggcaaagattattgcagggaatgtggcagtatctatcaaaataaacaataagcatccgcgatgactcaggatctggcttctaaaaactcacatttcacatggtccgtgtagtctggagtggcaaaagtttgaaattgcctacattgcccttactaggagacagtaaatttctgtgcgtccaataacaggagaacatatggctgttaggagggtggggccgggctgtacacactcatgcagggccctctcctgagagcggcgtcatgtgaggagctgctgtttacgcaccacatgaccacagcagcaccggctggccctggggagggggctgggccccagagtcccggtgtgggtgggcacccctgccgtggttaccttccccacaatgatgccgagtggctgtaatgtcttcatgaagcacgtcccagaccaaaccagcccgggacttgcttgctgggacacagtcccaccccttggtacaatatgacaaagaaaaccacgagtttagagcttaggtcactgtaaagctgcttttgaaaaaggtgcaagacgtaagggctaaaatctttcagtttagagattagcagatgaagggcctcctttcagggaagagagtggagcctgtaccccaaaaccccaaagtagcagaaccagggatcctgctgatcactgactgaatgccaactgtttgccaggcacacagtaggcgctgcctccgcatggccttgtgatgtggtttggatctgtgtcctggccagtctcatgttgaaatgtagccccagggctggaggtggggcctggtgggaagtggctgggtcacagggtggtttctcatgggtggtttagaccatccccttggcgctgtcctcaggatagtgagcaggctttcctgagatggtgttgttaaaagtgtgcggcactccccatctgttctctccctcctgcacctgccatgtgacgtcttggctcccctttgccttccgccatgactggatacttcctgaggcctccccaggagcagaggccaccatgcttcctgtacagcctacagaaccctgagccaattcaacctcttttctttatgaattacccagcctcaggtatttctgtatagcagtgtgacaacagcctaacacacctgtctaatgaacccgggtctaattaacagcccatgtcctcccacccaggggaggcccttgcacaggggaggctgggtcccactggtaccgggccctgtgagagtctcaggtacagaacagagtcccaggagcgtcaagcaggagctgtggcttgggtggctgcatggacacgggaggctctagaacgtcccctcaagcaagttagggtgtgaggacggatacttgggtctgcaccgggcccaaaggccatggcagccactgggaggtcagacccatccagcgtgcaccgaactcagtgggtcggacccattcactgtgcaccgaactcggtgggtcagacccatccagtgtgcactgaactcggtgggtcagacccatccagggtgcactgaactcggtgggttggacccattcactgtgcactgaactcggtgggtcggacccattcactgtgcactgaactcggtgggtcggacccatccagcgtgcactgaactcggtgggtcggacccattcactgtgcactgaactcggtgggtcagacccatccagcatgcactgaacttggtgggtcggacccattcactgtgcactgaactcggtgggtcagacccatccagcatgcactgaacttggtgggtcggacccattcactgtgcactgaactcggtgggtcagacccatccagcgtgcactgaactcggtgggtcagacccatgcagcgtgcactgaactcggtgggtcagacccatccagtgtgcactgaactcggtgggtcggacccattcgctgtgcactgaactcggtgggtcggacccatccagcgtgcactgaactcggtgggtcggacccattcgctgtgcactgaactcggtgggtcggacccatccagcgtgcactgaactcggtgggttggacccattcactgtgcactgaactcggtgggtcggacccatccagcgtgcactgaactcggtgggtcggacccatccagcatgcactgaactcggtgggttggacccatccagcgtgcactgaactcggtgggtcggacccattcactgtgcactgaactcggtgggtcagacccatccagtgtgcactgaactcggtgggtcggacccattcactgtgcactgaactcggtgggtcggacccattcactgtgcactgaactcagtgggtcggacccatccagcgtgcactgaactcggtgggtcggacccattcactgtgcactgaactcggtgggtcagacccatccagcatgcactgaacttggtgggtcggacccattcactgtgcactgaactcggtgggtcagacccatccagcatgcactgaacttggtgggtcggacccattcactgtgcactgaactcggtgggtcagacccatccagcgtgcactgaactcggtgggtcagacccatgcagcgtgcactgaactcggtgggtcagacccatccagtgtgcactgaactcggtgggtcggacccattcgctgtgcactgaactcggtgggtcagacccatccagcgtgcactgaactcggtgggtcggacccattcgctgtgcactgaactcggtgggtcggacccatccagcgtgcactgaactcggtgggttggacccattcactgtgcactgaactcggtgggtcggacccatccagcgtgcactgaactcggtgggtcggacccatccagcatgcactgaactcggtgggttggacccatccagcgtgcactgaactcggtgggtcggacccattcactgtgcactgaactcggtgggtcagacccatccagtgtgcactgaactcggtgggtcggacccattcactgtgcactgaactcggtgggtcggacccattcactgtgcactgaactcggtgggtcggacccatccagcgtgcactgaactcggtgggtcggacccatccagcgtgcactgaactcggtgggtcagaccctttcactgtgcactgaactcggtgggtcagacccatccagcatgcactgaactcggtgggtcggacccatccagcgtgcactgaactcggtgggttggacccatccagcatgcactgaactcggtgggtcagaccctttcactgtgcactgaactcggtgggtcagacccattcactgtgcactgaactcggtgggtcggacccatccagtgtgcactgaactcggtgggtcggacccattcactgtgcactgaactcggtgggtcagacccatccagcgtgcactgaactcggtgggtcggacccatccagcgtgcactgaactcggtgggtcggacccatccagcgtgcactgaactcggtgggttggaccctttcactgtgcactgaacttggtgggtcagacccatccagtgtgcactgaactcggtgggtcggacccatccactgtgcactgaactcggtgggtcggatccattcactgtgcactgaactcggtgggttggacccatccagcgtgcactgaactcggtgggtcagacccattcactgtgcactgaactcggtgggtcggacccattcactgtgcactgaactcggtgggtcggacccatccagcgtgcactgaactcggtgggtcggacccattcgctgtgcactgaactcggtgggtcagacccatccagcgtgcactgaactcggtgggttggacccattcactgtgcactgaactcggtgggtcggacccatccagcgtgcactgaacttggtgggtcggacccattcactgtgcactgaactcagtgggtcagacccatccagcgtgcactgaactcggtgggtcggacccatccagcgtgcactgaactcggtgggtcagaccctttcactgtgcactgaactcggtgggtcagacccatctagcgtgcactgaactcggtgggtcggacccatccactgtgcactgaactcggtgggtcggacccattcactgtgcactgaactcggtgggtcggacccatccagcgtgcactgaactcggtgggtcggacccattcactgtgcactgaactcggtgggtccgatccattcactgtgcactgaactcggtgggtcggacccatccagcgtgcactgaactcggtgggtcggacccattcactgtgcactgaactcggtgggtcggacccattcactgtgcactgaactcggtgggtcagacccatccagtgtgcactgaacttggtgggtcggacccatccagcgtgcactgaactcggtgggtcggacccattcactgtgcactgaactcggtgggttggacccacccagggtgcactgaactcggtgggtcggacccatccagcgtgcactgaactcggtgggtcggacccatccagtgtgcactgaactcggtgggttggacccatccagcgtgcactgaactcggtgggtcggacccattcactgtgcactgaactcggtggacgcgtaaatggctctcaaaggagctccccaggcccgcaggagtgaggctgggaagtctcggggtctccagagccggctactatggcacctggacgctcctcctctcctggctctgcctcttgccccagctttccccttccctgctggtttaatgccgtctctggtcatggggctccgtgcctggtcctgtgtggcgtgaaggcttcccaaacctgcccgccggagagagacatcccccgcaggggctccccatcagggcagggcacacccccacccgccgtgctgggaaggggggactatgtacccctccatgtgcaggccttgcctatgccacgcagtcctcaatggtgagaaacagctttcctgcaaaaataggctcctccaaatgtgcgccacaaagccggcatcgtccagacagcagcaacggcctgccgtgtctgtgaacgcaggccccacaaagctggagagttcgccctgcggcctggtttactcatcaggcctccgcgccagcacccgagccagagcgagaacggccagcccagccgcgtggccccagagtgaaattctcggtggcccagtgcccctcatcctgggagagcagccatctgtgcccgtcaaccacgtgggaacgatggaatggaatcttccagaaatacagggcactgggtctgaaggtggagggactggggccaggggagcgcctgccaaggccccggcactggtggcgtggggtgcaggggaccccagcccctttctgctgcagctggtgacttgcagccttgggcagggacatctggcatggtttcgcgaggccctcctggttcggtgacttatcgctaagaactaagaagcctggagcctgacaagatcaaacaatgagagacagagatctctcaaggtgcacaggcagagacacgacgggcccagggaagactccaggcaggcaggagggccgaagttcagaggccgtgagccgtgtgggtctgaggaggtcacagcttgtgccggcatctgttggtcgccagcacagacacgcatcacgcgtctcacgctgggagttcagaaaccccacaggcaaatctgcggaaggtgcggcgcgactccacaggctggcagcaccccctccctcctcagcaaaattcatgaactttcctgttttctgtgatcatgggaaatctttggtcacttcctgcaatgcctaacttttcgtttttcacgtctctgtcactgcgcttggttttaatgtcgtcatctgtgaaatgggcctactcacagctcctgtgccctcagtgcctcaggactctccaaggatgagcgaactcaaagatcactgtccatatcctcatcttcaacactcaagaggatggattctgaaaagcacttactcagcacggctttcccaagttaagttctatattatttaagtcgaatggagaagtatgaagccaacttttttcttaacatccccactctccaaaaaacgttctctagcctttaaaggtggacgcggtggctcccggccgactcaggcgtaattagtcacatcgggacggtgacactcttctccacctcctcactcagagccagccaggcagaaatgtcacccttctgaaagcaaagtgatagggaaacagatcttgaaaaaactcgatgattctttatcttacaaaaggatgtgacaggatttcttgagaagccacgtccccgcagatgattaacacgcagccgctttgataaccgtcctgcgaagtcgccttcatcacgtccttgcttttcagagtcccgagccttgctctgagtgagcatctccgtgttgcctttcggccgtttccagagaaatgtaccggtttcttgatggaagtgtttccttcctgcctctccctcctctgagtgctccattcacccgcaggtgagcctcgactcagcttcttccagacagtccaaggcaggggcacggactgcaccttccctgcgcctgggaggcccattttccaggaacaagtgacattctgggctgggttttccctgcaaataaagccctttctccttagttcatcccagaagaaaactggaatttttaaaggacctttctaagaaaatgaaggcaaagcaacacaaaaaccagaatcaaagcccagagacagggatcaggcagagtgtagagaatgcaggcccagaggcccaaaccctaccaagcaaaggccccgccgggctctgttccttcagcacaaccccttcctctccagcccgacgcaccttcggcacaggtgaggtctcaggatgggcggcatctcagatgctcacccggttttaccctcacaggaaccccaggggaaaggcactgccatcaagcccgtctcacaggggagaagaaggttggaggtctgtcctgggacacagcacctgcaacagcaaagcgtctcagctctgacaccttgctgatggagcccagaatctgtgctccacatctagacctgaccacctgctgtcatggcagagcgggggacccagcggctgccccaatgacctgcccacccctgccccttcccatcaggctttcatgtggccccttccccgggggtccctgagacgtgtgctctccctcttgttccacctgctgggacaccttgaccaggtaactaagtccctccctgcagtcctgagacaccagcctcttcctggtgacacccagtggctgcacagccccatggatccccccatcggggcaggcacctgccgcctcctgtctcccagggaagcctccttctctcacaccctggcctgtctcctttataagagtgttgtatgctcccctctctagatggagtgctcatttctagagttctgttactccgggtctccagcacggaatcccagcctctgtgcagaaagcagcagcgtgagctccagtgggtagagtgccccagggcgggagggggctctcggggccaggaggcccttcctgtggggccacagccaggccagccccgcctgaaggtctgggctccggggcagtgtgcagcctccaccctgccacatgtgtcctttgtcacagaaagtctccgctcttggtgctgagcctgccccccagacggtgcagccggcctctcccacctgctggggctcctcacatctagcttggcctccagacatcaccaacctctgctgtttatttcatcggatcgtggggttcagatgccacgttttgtccaacgtgccccaggagtggctgcatgtcaggaacatgtcgctgggaatctctgtggcttatctgaccatcctgccatcctcaggtgaggggcactgaggtggccggttgggtgtctggcggaaacgaggctttgcgcacagagggctgggctgctggatcaccacggaattggctgccttgtagctgtgatgagtcggaaggtcggcgactctgatgcgttcctgcggcaccaacctgcatgtgctttctacagcctgtgtgtgccagggagggtggcggtcagtgccccgagattggctgtagcttccgagcctaaaaggctacctgtgtgagtcctgggaagaggtctacctggagctcacctgtggcgtgagtctgtgcctctctgctcctgtaccagggacatgcccaccaggagaccccgcatggctgagagggcacgggaatgcacttgtaaagtgagctcagaggaaggaaaatcagaactgctgagtgagaggagacgccagggtccaaggcccacgtctggcccacttggttgctggactccacacgatgcccgctgctccccacacccaccccaactgcacacgacgcccgccactccccacacccaccccgactccacacgatgcccgctgatccccacacccaccccaactccacatgacgcccgtctctccccacacccaccccaactgcacacgatgcccgctgctccccacacccaccccgactccacaccatgcccgccgctccccacacccaccccgactccacacgacgcccgcctctccccacacccaccccaactccacacgatgcccgccgctccccacacccaccccgactccacaccatgcccgccgctccccacacccaccccaactccacactgcccgccactccccacacccaccccgactccgcacgatgcccacctctccccacacccaccccaactccacacgacgcctgccgcttcccactcccaccccgactccgcacgatgcccaccactccccacacccaccccaattccacaccatgcccgccgctccccacaccctccccaactccacactgtgcccgccgctccccacacccaccctgactcccaccagcacctgctggcatcgtggagtcagggaaatatctcagtaacattcattttcaaaacagcattggttgatgaggaagatccagtttccctgagtttacaatctgtacgcacagagtctaagtcagccggactcatacttggcctgagtgtgtttctcgtttcggccctgcagttgtgggcggtggtgagacgcgttccgaaacaggaccccgtcacggtgtgtggccctcgatgaccccccaacagggtgtctggagtcaggctttgcagggtttccgccaggtggaggctgagtctgtccttgcggtttaggcattccagcagaagtggtgcttgctgtcagagctgccattacatatgtgaatgccaaacacaattctctgagaaatacagtatttccaggtaccaatagagcttgagatatcatcaaattgttactcaagcaccttgaaatgtggaaatatcagaacacaatgagagctcgctaagcggctctcctcttggctgacctgtcagatgaatgtctttggctgatgggtttggccctaataccaaatctcatcacaaatatgaactcctggtctctgctccttttctaaaagggacaaatgtcaaaacagcctcagaaaagtcagatctaaagtaacaaaaccacagtccatcaagggaggaggttctgccaaagtcgatgacaggtctgccgagtgaactccacgagctgtctgctcccgggt[450 bp omitted]tggtacggcgaagaatgtttccctgacccgtaagtgcagccgctgcttcggccaagcagcgtaacaggctctgccctttcaccccagaggctccgtctccagtgcgggaaacagcacagccaggcacggtcacccaccaggacgacgcctacggcctggagatccaggaggcagccagcaggacgtgctgcgctattgacagctgtcctaataacacccggacattcattatgtatggagtggcaatgcacggccacacacgcgtgatcactccagcgaggaccctggaaaaggccgctgaagccgcgtcgccgtgagcctctggccggcgccaccaggaaggctcctgtgaagagccgagcacccagcccacacctcctcctgccttgctgtcacagcagtgacatttatttacccaaatgacgcttgctggccttgagtgccaaggagacagcagctgcttccgagtcagaggcccaaaacggcagcgcacatggtaggcactaacagacgtgtattccactgaaaactaaatagcgggtgctcactcttacacaccagggactgtgtgtgggggctgcacgttccaggcagaagcacggcaaagatctcaggaagtaaatattcttgtttatctaaattaagaagactccctgcagaaagagccctgcctgtcagcctctgcagcgggcagggtgcagccatcatcgcccagtccccgagggtcagcgggcgcagatgctgggtgttgcaggggccgaggaaggagggccctggtgtttgtgtggcagggagtgcaaagactgggcttaccaggatcatgtggccggtggagatgtccatgttggactgcacaggctcctcggaccaggatgaggcgctgctgcgtgcggaggggctggggatcggcccgtcgctgaactgggatgagacgctgctgatgcgtgacgtgtgcgggccctcaggtcggtctggtggccgcgtggccatacgctggcggcacagctcctgcaggacagggggaggaagagcagggggttagtggcattggggacacccagcaggacgagggccacggcacccacgtggcacaaccccttctcctgctaagatccaaggttcaggcaggcgagagtttaccccagggcaggccagcgcaacatgacggtcaacgcaccccaaagcacgcgcccagcacggtgacccgagaagacttcaggcttgtgcaggaaaagagaggccttgctctcagaatctgagaatacaaacacacatacacacacacatatacacacacacaccacacacacacacacatcacacatatatacacacatacaccacacacaccacacacatcacacatatacacacacacacgccacacacacacaccacacacatcacacatatacacacacatacaccacacacaccacacacatcacacatatacacacacatacgccacacacacaccacacacatcacacatatacacacacatacaccacacacaccacacacgtcacacatatacacacacatacgccacacacacacaccacacacatcacacatatacacacacatacgccacacacacacaccacacacatcacatatacacacacatatgccacacacacaccacacacatcacacatatacacacacatacgccacacacacacaccacacacatcacacatatacacacacatacaccacacacacaccacacacatcacacatatacacacacacaccacacacatcacacatatacacacacatacaccacacacaccacacacatcacacatatacacacacaaacgccacacacacaccacacacatcacacatatacacacacatacgccacacacacacaccacacacatcacacatatacacacacatacaccacacacaccacacacatcacatatacacacacatacaccacacaaaccacacacatcacacatatacacacacaccacacacacaccacacacatcacacatatacacacacatacaccacacacacaccacacacatcacacatatacacacacacaccacacacatcacacatatacacacacatacaccccacacacacaccacacacatcacacatatacacacacatacaccccacacacacaccacacacatcacacatatacacacacatacaccacacacaccacacacatcacacatatacacacacaaacgccacacacaccacacacatcacacatatacacacacatacaccacacacaccacacacatcacacatatacacacacaccacacacacacaccacacacatcacagacacacacacaccacacacatcgcagacacaccacacacacacaccacacacatatgtaacagacacacacacaccacacacacgtcacagacacacacaccacacacacatacacacatcacagacacacacacactgcacacgccacaaacactcactcctatagattcaagaaagcatccactggatcctcctctgtcatcaacgtggaatattctgggataacgccacagtagccttcgttgggtggcttctcattctatcagaatataagccacaggggaggccgggggcggtttgcactgtggactgagatacagaaactggtaccacaatcaaagagtctgcagaaaaaagaagaacctcattctgacgtttctttctctttccaaagcaatgtccaagagcccatgcaagagaaggcaaatggagccgtgcgggagacagaaggcacaggggagggagaaaggcctgtgctgctgagtagacaccaaagcagaagttcccgtatttaaaggaaactctcaacattacaccccaagacagcttctgagggatcactgcagggtcttcgaccctccttccccaggcaaagctcaaccacacacgcggtgggcatcccgagcacctgcccggccgtatgggacccgcctgcaggcaggacacggccacgcagcctcaggtgctcagaacacgccgggaccccgctgctgccgctcaccttcagggtgcagcctgggtgcccccctgacgtctgaccaacaatctcgttttgaaagtgttctaaccactgtgttaggatagcccgtcctattgcctgatgaaaatatacctgtaccctgagtctgcaaagtgaaatgatacccagaaaaagtttataagagaactggagctcaacagaagaggtgaaaatgcattcgtgagaaaaagaaaggctccggggaacctcgtgggctgctgctgccttggtttcattttggtggtgtccgggggaggccaagccacccactcgctccccacagccgtgtgcgtcaaaggccttgcactccccaaggcaatcgccaaagctcaggaaacactccatgtgtcccttctcccttcaccccggggtgccggcttccttgtgtccattctcccttcaccccgggctgccggcttccttggctttaaagatgtctgccaagcccaccggcaccacaccatctagaaaacatttccctccacctggctctctgggatgagcaattcatgctcccgggctctctgcttcggactcatagcgagatacaggtgctgtgggaaggggccctgcggcccccactctccaggagcctgcagcccctgtgagagcagctggggacaaggaggatgaccgcggggactgggaggatgactgcggggacggggggggatgaccccggggactggggggggacgactgcggggatggggggggacgactgtggggaagggggggacggccgcggggatgggggggatggctggggggactgggcgggaggtggatagccgcagggacaggggtgggaggatggtcacagggatggggggggcgggggggatgactatggggaccgggcagagacgcacaggggaaggtggactttaccaagggcctctggtgagggtaaggggtctctaagaaaagggagagttccagttccttctttcccatacatcttcaggtacttgttagtttatagacagttttaaaatagtgagtgtgtttaaaaaaatccacccacgttttctcagaatctcaaaaacaaagcaaaataaacaaacaaaaaaaaccccacaaaggataattctttattttttatttttatttttatttttgatatggagcctcactctgtctcccaggctggagtggagaggcacgatctcggctcactgcagcctccacctcctgggttcaaacgattctcctgcctcactcccctgattagctgggattacaggcgcctgccaccacgcccggctaatttttctatttttagtagagacagggtttcaccatattggccaggctggtctcgaactcctgacctgaggtgatccacccaatgagggatgattttaataaggtagatgataccagtaaccaacctgagtatacatctcatttatttctcaattgtgcacatgaattttgcttgacgtgggggaaaagcacactgagaaatgtttctgaagtaacttctatctcttcacacaatttctccagaaaaataacgtccaaccaaagcatgagaacagctacagctcagggaacccagagggtccgagaatgtgaccctctggggaagaggatttgaaacgctggagatttactcacataaaaataaaaaatcaagctagttccatgcccatcctgtgatttgccacccatgggagagctacagtgaggtctgagctctgttatttcctgagtgccatggagggtgaagccaccaagaggccccacaggactgaggtccctgctgcaccacaaacttccgtttttattgtatttatttttctcccaaagtcaccaatagcaaacaaccacaaacttttcatgtgaacttgggaaaacctctaaaggtctctaagcctattttttcactttataaatggagataatcctatagttactgtgaagattaaaatagatggtttcctgtatattcagtgcttagcatggaggcagctacagagaaagcctcaagcattcatgagtaagagagacgtattagtgaatagaagttagggccgttctctaagccagagccaaactcttgacggcttggcaaatgtaaagatatttctgaagaagttacagaatttattattactattattatgagacagagtctcgctctgtcgcccaggctggagtgcagtggtgtaatctcagctcactgcagcctccgcctcccgggttcaagcgattctgctgcctcagcctcccgagtagctggaattataggcgtgcaccaccacacccagctaatttttgtatttttagtagagacgggcttcaccacgttggccaggctgatcttgaactcctgaccttaggtgatccacccgccttggcctcgcaaagtgttgggattacaggcgtgagccactgcaccgggccaaagtcgcagaatttagagctggacaagccgacatcgcctcctccggcgggtggctcagtgcccagtggctcagtgctggtgcacggtgagggagacccagggttcggtgcctctcagcggggacccgcggctctcaccagtggtctcgcgtcactgcgcagcgcagggtcttcttgaaggtcttaactttttcaaaggagggaaactgcgataaagatccaagaaaaatgtccctggcagagaggaagcccccgaaagcttggcgcagaatgctggagacccgtggcggcagctcttcgcctgtgcagagggagacgctgccgtgggagaagggtgtgcccacagcaaggcaacgcgcggccggggacgctgctcttgcccgaaggcgctctccctgcgggcttccgcctgggaacgggggcgggtgctctagcccggcgctgctccgctctgaacccaccgctaccaagtttctattcagcaagtggctcaggcaaacatctgagcagcgataaggccgggaatggcctgcagggaggaatgggatgatggggaagccgggtcctgggtggaggaggttggcagtgataaggccaggaatggcctgcagggaggaacgggatggtggggaagccgggtcctgggtggaggaggtgtctggggctgaagccccccatgctgcccctgagcctgggggcaggtgagagacgcgtcctacttccctggacactacgatgggcaggacgtggctccccggaggcaccagccatgtttccctcacatcaccagcgcaggcttttctgaaggctctgggggaacctgccacttaggagagtctctgcacctccacaaagctgccctgagacagaggcaacggggccaccatggacgcctcctagaaaccaggacccagaaaacaggtatgtcttcagaggagcaggatgagaactgcaaaaacagacctaactttggttcttttccttgacgtccagggcagtcattgactcattcactcatagcacctgcagtcagagggcctgattttgaatctgggcttcaggtcttactgactgtgtggccttgggaaaacactaatctctgtgtgcctcagtttccccatctgtgaagtggtgataatggtaccgacttcaccgctgggaggattaaataagataacatgcttagagtgaggctttgggcctgtgcctgacacacaccaggtgattatttgctgttcctactacgatgattattagtttattcaaaatcaggtttgctatggtcccttgccgagtcagcactgcacagggtgccaggaacaccaggctgagccaggctgggtcagactcgccgggccctgacccccgagcactcccacgccacccagagctgggcacgagtgaccgcaagaagcgatgggaatgacagcaacagcacgtgttgggcgttcgtgggaaggggtgccgtggggccgggaggaggggaccctccctgaacttgaggtcaaagaaagctttaggcaggagaggctcaggccccaaggctaggccgcaatggcacctgcagagatggggaggtgtgagcaggcatggggcctggaggtgcgtaagagcttccacggggcgaggaaggaggaggaggagagagaaggggccgccactccctacagcctcctgggtgggcagtgctgcgggcacagcgctctgcatccatgccgcgactgctttcggaatgtgcttttccagggcgagccttctttttggacatgggatgtacccgatgtctacaagcttgaagtaacattgccgaccgtgtgcttcttgtgcatgcagggtctgaagggaaggccttgcatccaccgcccacctaacctcacggctcagccacgttcacgcagcacggttcagtcagaagttcacacctcattcaacccagctgttgctaagtcagtgtggctgtcatgggaccaactgaagagtgtcctgcctcacgccgtatctcaggacatccacaaagcattgcttttgccacattctgcttggccgcgaagccactttctgcagcccgagctccacccccggccataacccaggctgggaagaagttccccgggcatcggcgactccctgcaggtacggcaggggtggcaaggggcgaacagcgcaccaggcccgcgaggaggtcactgagcaagggctgtgcgcgtggaaaccgtgatgacatcacactgacaagttaaaccctggagtcccagcggcactggctgtcggccgtcctgcacgtgcccctgggaagacgtggctgcaggcccaactcctggtgtctcccttggcgataaacacaagaaagccacatctatctactggagacagaaacagaaattcctcacaagtgagctggaaatgcgccagtctgctgcgctcacggggaacggggtcgggccagctccctccaaggacgggggctgggacgtttggccgctgcctctcccactcactgtggcctgcccctgccagcgtcccttccccttgctgtgtggcccctttctgggccacctgccagagctcctcacagtggggaccggcccctccctctccacccttccctggacactcttgggaatctccagacgtgggggaagccaggaaggagcctggattctgcctcatggcttgctggagaaagcactgaggggcatctcatgtggtctcattcactggtcctttaggctgattatagtttccaaattcataatggaaattctatagtctgtccattctcagtcctttaccttaacatttaaaaattttgtaaggaaaaacacacttcttactagaatggaataagaaatgtagaacgctacttgacttagtaatggtttagccagtgccaacgagacaaacctcacagcatttgaaatcgctctaggttataatttgggacatttccaccctgcatgaggtgactctaaccctctaagcaaggctgccagtgtgggctcactggagatgccactgggagctgtttttcccctcccaagactagaaagtgactggctacagcgggggagggggccacactcctcactcttcattgaaaagtagcatccacacctgaaaaggcagtcgcatccacggtgctgaacggaggcgtgagcttgctgaccgctgaggcgatgactgaatggacagcgtggcacacatacttctttaaaacctcagttgaaggttacagcatcagctgccatcacaccagaactgccatcagacgagagcagccgctgcccgtatcacctgcgttcattatcagacttctgtgggggcccagggcacagagcgggggctcctgtcagccagtgacagaaatggccatcgccactacgaatactctaagtaccattctgtgtggtgagtttaaaatacagaacggtagtcgggcgtggtggctcacgcctgtaatcccagcactttgggaagtaggtgggaggatcccttgagcccaggagtttgagaccagcctgggcaacatagtgagaccccatctccaaaaaaataattagctaggtgtggtggcgtgcacctgtactcccagctacttgagaggccgaggtgggaggatcacttgagcccaggaggatgaggctgcagtgagctatgattgcaccaatgcactccaaccctggtgacagagcaagaccctgtccgcctacacccgccaaaaatacagagctatgatctcgagagcattttatttgagcaaaagataatttataaagcaaaatcaacaacatgagcctcctctgagagaaagctggaggccagccccatcatgttttgaaatttccctgatttataatcctcggtaaacacaaagggtgcatcctcacccggaacaaaactctcctggtcagacggtgaacaccccagagtgaggcctgtgggccacacgagcctgctgaaggggttaaccggcagtggtgccaagcaggaagccccgagacctgcccctccacagcgcctgcttgcaggggcccaagggcctcccctgcacagcctggcctgggggcactgacacatttttggcaaacagatcttggccggacagaaggtccaatccttccagccacttcacttaaaggaaaatcttctatttaagatccagactcagcctaacaatcacgaagatggctctgtttatgatccgcgactatgcaccttcagccacagcggcccagtgtgtgcagcttggcgaccttgagtttgtaaggatgagtaagaccttgtggcatttgcgtgactcaataaccaacaggtaattaaatatgaatgaagaagaaaggtagatgtaaccacataactcttttgattgtagatttagctgcgatgtcggcggcacttgcgaattccctccccactctgaggagctggacggaggctccatcccactgagggctgggcatgggcctgcctggccctgaaggcacccacggggccactcccaccagggtgtggatgaaacctgttttcttttctcttcccaattcatactctttagcagcgaagaaaaaacaatatatatgtgaactaagaaaaggactataaatcatgctaccataaggacacatgcacacatatgtttattgtggcactattcacaatagtaaagacttggaaccaacccaaatgtccatcaatgatagactggattaagaaaatgtggcacatatacaccatggaatactatgcagccataaaaaaggatgagttcatgttctttgcagggacatggatgaagctggaaaccatcattctcagcaaaatatcacaaagacagaaaatcaaacaccacatgttctcactcatcggtgggaagtgaacaatgagaacacttggacacaaggcggggaccatcacacaccacagcctgtcaggggctgggggccagggggaggggtagcattaggagaaatacctaatgtaaatgacgagttggtgggtgcagcaatccaacatggcacatgtatacatatgtaacaaacctgcacgttgtgcacatgtaccctagaacttaaagtataattaaaaaaaaaaaaagaaaaaaaattccaggtacaaaggggaagtcatttatttttgtgccatgctgccttgcatttttggaatgcctgtccctggagatggagctcacatctttccggaaagctctgaaggtccctgcgtctcagtatagctgctctgtagctttttagctgtctggcccctcttaggtgttgagaaagttattaagaaaattattaaggatagcatgtcaaattcccagtgagaaggacgcatttgcaataatggaaaaagggcacggttttgcaggtcatctccatagtaaaatatcaatgattataatgtgcctctattcttgagaagaaagtattccagagccattagtgtgttagaaaaaaaaaaaaccccacagtagaaaatgaaatccattattggcaaaaaaagcaagccaagacagagctgagatctgcacggtgtggccgtgtaaggcagaggctgaggaccaggactctgggtccagatcacccggggctgtgtgccactggacaggctgccaaaagctgcgtgtgtgtttttaatctgtgaaatggggatgaaggcagagcagctccacagagttgttgggaggactctgagggtggatgtgtgtggagcacagagtacaaggcctggcttgcagactcggcccgtgtgacactgatctcaggtgggtgcaacaagtacacagcctgacttgcacacttggcccatgcggcactgatctcaggtgggtgtgatgagtacgagccctggcttgcacactcagcctgtgggacactgatctctggtgggtgcaatgagtacacagcctggcttgcacgctcagcctgtgggacactgatctctggtgtgtgcaatgagtacacagcctgacttgcacactcggcccgtgggacactgatctcaggtgggtgcaacgagtacacagcctggcttgcacgctcagcctgtgggacactgatctctggtgggtgcaatgagtacacagcctggcttgcacgctcagcctgtgggacactgatctctggtgtgtgcaatgagtacacagcctggcttgcacgctcagcctgtgggacactgatctctggtgtgtgcaatgagtacacagcctggcttgcacactcggcccgtgggacactgatctcaggtgggtgcaacgagtacacagcctggcttgcacactcggcccgtgggacactgatctcaggtgggtgcaacgagtacacagcctgacttgcacactcggcccgtgggacactgatcttacacgggtgtgggcatccccctgccagtgcccgcatctacatttgggcacagagaagccacacagcctcacgggagctgggggcctctggcagggcctccttccaggacacaataccaaggaggccagacccccagggctgtccgcactggatgaccctctggccactctgtcctgctgatgagaccctctccctgcctcctccctctcagtaaaactagagtaactaggcatttttaaagaagatggtggcgtcttccactgttgccctaaatggaaatgctccaccgcaaaactcaatgtgatgctagtgcctcacgacctaacaccctccccacggggcagcgtttgtcaggaacggtaaacccagcgcgtccgcacccaggcgcagaaactctccatcagggaaatgtgaaaaattgatctttttgcagctcggtgctgcctccaacacatccagagccaactggaactgtgagtgtgagcccagtggcactgcaagcgcccacaccagcaccctgccctgggcagagtcacgtgggaccatccccgcaggacagtgctgcacccagagcccccaccctgaaagcttcccgtgctctgagcagctcctcaggtgtgagcacacaaacagaggaggccatggtcagcacggcacattcggacaccacagtcctcgctcgccgtagagccgcctgctcctctgctgtgcccaggccggggccctgggcgtgtccgcagagtcctcaaagtatcttatacttctctataacacaatgtgcaaaataagctgaagaggattctgggggcagaaattcatccatacacatcacaaggcaaatgtctcatctcttaactcagcatctgatggagaaaattacagagtggaaatcactcagagaagagacctgtcattcttgaattctgccaaaagaagaccaggacaacaaaggtttcaggaaaacctctctgcacgcttccgggagccaactgaatgaagccgtgttgcccgagtgtgcgcacagagagccttgggtttttagggttatttcgagagtgtaatcactagtaacaggacaacactaaggaattaaacgtacaaagctgggcaggaaaaagtgggttcactgggctctgctggggaggaataaaggccactctccagactggacgtggcaccaagagaacgtggtgaacgggaaccggctctgtttggggagggccctggccttcagctcagagggcaacacacagcagaagccgcggggcccggtgcaaccacaggtggctcgaatgtaaaacggttaaggaaaaagcctgcgctctgtcagtttgacactgaggctgcagggcacgtgacgacaggaaatctaaacaggaaggtgaaatgttgagaaagcgtgtgcagggaaaaggccggggaaaaatattccaggttgttaaacggggtcatgtgtcatagtggggaaaaaaagaaaaaaaggtttcttgtataatcacctctccccgatcatgacacagttttacttgattttatttcatcataaaactcagagggactcagaaggaaccgcctcacatgctaggccagcaaggccagctgggagcagaggagcagtaaccaatgatttcgttgaggagagcgactttacacaaacactccaccatgctaggtctctgatcggcaccgctacaaggtgctccggggtctgggtgcatctggggcagccctgtgagacctcagggaacacagggccacgctcacttctggagagcaaatggcccacggccgcccctgaatgccaggggagcctcccttcttctgccacggagtcagggccccggcagccgagcctgtccgtgatctaagccggggacgtcctcggctcatggcccacgtggccaacgctgctctggtgacacagtcccaccgcctccagtggcttctccttggtgtccaggtaacttttacacttggaccaagaacaacccacacacgtgtttgcacgcgcacacacacacacacccaggggaggatgcccctgacagcagcgcccaagccagggccacagagctctgcaggcccctccccgctcctgacacacgacgacacccagtcaggggctgtaagcacagctcctgcaggaaggggttccacgcacgggcaaacaagccgagtcagcccacgatgagcgatgttggccaagcaatatggagtgagttcttcccatttcgcaagatgttttctcaaaacaaaaattaaagatatagacatgtttcatgtaagtgaaaaataattttcaacactcttctaaatgtggaacagtcttggaacagcctaagatcagtaggaaaaaagcggcctctccgctcgctcagcccccatccctgcggcgcccagagcaccagccctttctcgagtccccacacaacctcgaggccgggctccgggcatccaggcgtgtgctgtttcctagttattttcacgtccatacccctgcctcccacactcaagagcagaagtccttctgtctgctttctgtacccacagcatctacgtggtgcagaggggccctcgctgagcccctgcacactggtcagcatccctggcctccagatcacggctcgctcagggaccgagtgtcccacaccaaggcagccctgggggagcagcaaggggcacggctggagcagctgcatcgagcccccgccggccgacagctgcggcttcctgctctggggaggtgagggctgtgtttgaatctcctgaagcccctggtgggtggctgggaaacgcaggtgctccacgtgaagcacagaaggcacgtacgggctcacgggacccgcggtcagctgcatccgagagtgaccgacgtgctgaaacccgacctcctgcctccctttttcttagggactgcctctcccctaagactaaagacattcattttcttcatttgctctgctcctgataacatcagattgaaaccaggaaacagttgtgaaaataaagacattggaaggaaacacagaattttaatgagcatcttctctctggaacagcccatgtctaagaccggcttctgtgatggtctttaatgcttccataaaggtggcatcttagatgtgagagggagcacctttaacccacgatgcctgcaacccttcccgttgtcatgggagaccccagtcacaccgcagcaaagcccctccagccagactgccgttggtgagacaaatccctcccttcccggctcccacggaggatgactcaccgggcaattaagttctaagggcttccaaaaaagtcagtggtgccttcaaagttcacagatccaacacgacctctgtgagcaaagccagccttgagaggccccacaggctgaaccttgcttttcagtttcatagtcagacaatttaaaatagccagtcagtaagaaacaagtcatccgccttcagagcagcccaggcctgacgtggaagtagagaacgggcagctgttttttttacaagaaacttttgcaccttcctaattttctttttgctcagaataagggctgattttcatgtgccatccctgtcatcacccgcatcttcagcctgcagcgcgtagggaggactccccatgggcgggcaggactctggacctgagaattgcacaggatggtttccaagagggtttacatgctcccccgccccccgtcccctgcccacagacctgctcttaccacatcaagatcttagttcaatgtatcgattcattcttatcgagcatgtaaaggtccccggtgggtgctgtgggtctattggacagacctggcctttgggaagccaaggctgtccccacacgggctggtctggtgtgggcaacaaggcccgctctgcacccaggcctgcctccatccaacacaatgaggaagtcaccctacactggagggatggtgacgagacgtcaccgcagaggcggcagaagggataaaggggaggtagggatgaatagggccctggtgttcgggatgggacgggccaccccgggctgagatggaagctcaggggacgggggtctgcacagggctggacagatgggagggtctgcagggataaagtgggagggggggcggtgcaacggagggagccgggcaaacaaaggctcagaagcagaggagcccagcccagggacacaaaaggtattcacatccttccattcggtggccaccacagcttaattaagccaaaggaagggcaggggcatgcgggctgggggcggagcggctactggagcagctgcttctccattttcggaactgcacgtcgttctggggcccaattattctacctaaaactgatctgagtgacacctgaactgcacaaggcctgaaggacgccctgaagagcttcttcctaccagacccccgaaggccagggtctgggggcctgctgggaatcccggtctcagaggtctcagctctgaccgaagggtgctgagccctaaggtctgtacggggagtttctaaaagtctacgctgtaccccaagaaggggacgggtggggcagcagccctggaggaaaacccgtgagcgagtcgtggagggagtgtgagggtttttggggagtgaactttgcagagggtgctgggagcagccggcccgaggacaccgctgactggggtacaggggccacgggtcgcacgtggggtgtcagctctgccgcctcacttggggttgatttgaaatctcaagatgtgtctgaaaaccccccctggagaagcgaggggcccactgggaacgggaaggcctgagcaagacagacgcatgcccggggcgaggaaggggagcctggaaatccaccctcagaagaatcagacacgttttctagactttccccttcacatttcagcttcacgtttggggctcacttaacaatttgtatatttgttctccttgaatctggtagagaataagaaatccctgggatggggacagaaataattctgaaactcacacaccagctccagtttccatccaatttagtattttgttttgcaaaaaaaatctgcattgtatttcctcccactcaggaacatccgatctctggtttcagggtgcgttttacaggccaggaaaggtgattccaggtcgggaaaggccattccaggaagattgcgttattgtccactctcctgcatcatcgtcttcaccaaaaaagctgaaagcgacgaaacgcctacccagagggcaaatccagcttccgctctcctcagaggtactcagtccagttatacatcaatgtgagaatagtcccagcacttatcacttgtaaactcttttaattgattagctattaaatggcataagatcaatccaagtttaaacctgtatatcaaatccacattccacaaactctgtagtgaattatgtattttaaaacatgtagctttactggctaatgtaatcgtctgcgaatcttcccatctgttcttcaagtcactgtacctggaggcgcacactagcacagacccagacactcaattctggggctgcattattatcctgtacattaaaaaatcttgaaagggtgcttgttcacacctgccacctttctagtgagtctcttgtacttgctaatagagaaataacatacccaggttccatcctttttttttgagatgaagttttgatttcggctcaccgcaacgtctgcctcccaggttcaagcaattttcctgcctcagcctcccgagtagctgggatgacacgtgcacgccaccacacctggctaatttttgtatttttaatagagacggggtttcgccatgttggccaggctggtctcaaattcctgacctcaggtgatctgcctgcctcggcctcccaaagtgctgggattacaggtgagcccctgtgccagtcccaagatttcattcttaaccatcagtaattctcccaaagcagaaaagccacggagacgttacattttgagcaacaaagtttcagaacagctggctggatgaagaagggagcactattctgcagcccccatggaacaggaaaagccgctgttcagacacctgcagaaatgcctgactctgcccacctcacgtccacataaacctgaaaaaatgggagaggagtagctagctgtctgcccctggaagcccctccatttcccttgtgcatcctggcccctctctctctgagctcaggcccttccatgctcctctcccgccccacagaggccccctctgtcctggcccctctctctctgagctcaggcccttccatgctcctctcccgccccacagaggccccctctgccgttgcctttttcttcctctcccacgttctgttctcacgtactctgaaccccacgcggcacccagggctccccgcgttctctgagccccatgcccgccccacccggcacccagggctcccctagggtcacagtgttgtctgtttccgggttcacactggggagtccttcacaaaggcagactgggccgactctgatgtaagatcaagttctctgctgtccccgttgttccagaatatgggattctacccttagaagcgataagctttctgagaaaacgccttctgggtcagctccaagttcagctatcccgaggttccaaggctgtctgcccacccagacccaaggtgtccaatccttaggggtgaccctcgggccaacaccaatcacagctctggggacccccacgtgtcagccatggcaaaatgaacccccaacacagcaggggagggaaggaggaggcggggctcacagagcagagagccatggagagctccgggccgaaggggacttgggcctgggagagaagagacagccaggcggcgagggacttgtcctgtggaggcctccccaggaggcgagggtggggggactcctgctggaggcggccggcagatcagccttccttatccacgtcctcgaagtgatccccgtttgacatttggaaatgactttcatctgctgggtcctcctcggtttgacgtgcaattgcttttcccgaagctttctcctcttgtaacacccagctcctgcatgccgtggcggctccagccatcattcctcatcccaccaccccgcgcagcgtcttgcctccttttatgccggtgtacgtgttgtgttaagagctgggctttgccatttttgacaggctaatgcatttcaccacagataatgccattcaccacagaggcgcattctctctcgtgcccatcaaggcagaggctgagaagaaggtctgctttacagcaacggcctgaggaccctcggccccaaggtgaggccccgcgcaggtacctctgtacacgcctgtggagtcccaccctgtcgtgtgcacgaggctgtcacctggagattccggccctgccgggcgtctcctcccacgccgagctcctcctgccgggggggtctgcacagttctgggtgggggaggctccaggagctacccgaggcttcttctccttgccaacaacgatgccctcctcccgagggacggtggccccaaggggagccgggagagcagaggctacaggcagggagtggggagacccagccttcaagcacagcgccccttgggtgggacttgcctcttgctcacacccactcctacctcctggtacccgcctgctggaatctcctccccaccgcctactgtttcttttgaaatcccagtttaatccacttttttacacttccctttactccctcaagtgtctcctcccaacacccactttatttcacagcggctcgcgtccttcggagagcctgcctcccgccatgggcagcagggttcccgctgagctgggcccacctgaccagggcttccctcctgccgagccctcacctcgatgtgagccctgaagccccttgggctgggaggtgaggtgttcagagcacagatgcccgaggctgcacctgcaccaagacctgaccttaccccccagggccccggaccacacaggggctcacccgggtgttggctcacccgggcgccttctccgaacaccttccatcaagtgtcttgaattctgcagagcagcccaggtttcagggctttgcttctgttttcttctctggaagtgcatgctttgcagacaccaatgtcctcagttttagttcagaaaatgtgtcccgcctctctaatcaggtctaagggaggggagcagctcatgccgaggaggaagtgtgcggaaacgggtaccctggaaacgggaggagcaggcaggaatccaacacccatcccagccccgcgggcactgacagtcgctgcagaccgggcaagtcaccctcgggcagcgcttcagagctgacgtggcacccgcacccacagggctgccctcatccgcatggcggcccaagaggaggccccagttcatagatgaggaaggcggccttcgggagggaggggctgggcctcgcaccccagggaatggaagggcaatggcacctttcttccatgaatttcaccattggagaaaaagttaaaagatgaaaagtgtggcaagaggggaataagataagaaggaagaaacggaggggggtgaaagcaggcagaatgtgcctcttctgatcctcttggggtcactcagccacaccgagccatggaccgtcccttggagcgccacagactgcagggtttgtccttgtcacgaactcaaagagctgacctctctgggccggcacacaacttgcagccgagtcctttccacgacaccccagctccctgtctaaactcttggcctgactgggaggacctcttccctctagcccagttcctcctggcagccctgcaaatgcccaccctcttgggtctgtccctaccctgcagatggctccagcacctgccccagccacgcctccatctcccgccagccgccaagagctccacccaccacctggcccagcccctcctctgtcatctccaaggatttgatttcagtttcacacgaatcacctcctagtgatgcgtggactaatgctgtttaccgccggttcactttcattgcaaactcctcatctccaagaaatcatcaaccgagaaaagaaaggatgtcaccttttcccaaatctcccacagtgcctcacactacgagggaagatggtggaggagctgtccagacccacgggacagaaaagcccgggccagcccctcaacaccctgcagtggggacagcgcagctggggaccgcccagtgcagctctgccactggccctgtgggctggggcgcctctcagtttatctgctgctgactttgcccccttgtaaaacagggttgggagataatgagatgcctggggaaggtgtcctgggtccctttccacagggtccctttccacggggtgggtgactgatgaggacagggggtgcctaggaacaggggctcggaaggacctgctgtgcatgcaggggtcaccccaggagcgaccctggctttgacgagaaggaagtgttctctggttctggcagagaaatgtgtgaggcggactggtacacaacacaagcctaagggaagcagcacccgctccacagacaccacgcacaccgcccctcccctggtgctgtgtgagcacccatcctcctcccggggcccagccctcttccttggctgctggagtgcagggtgagcacgtctggaagaagcctgcagcccccacctcctttcctgcgcccctccttgtgtgtagcaggaagtggcttccttaggaagcagttattcgagtcatacccaggtgtgaaaagctaccaaggtcaaggcaaacataggaatggcctagtgccaaaatgaagccacagaattcagccctccacattttatgtctcagactttccaattttttttttatttccaaatatctcactgcgtggtctctgtgattttaattaagtctgatctaatgactactgtctgatggggggagtggcttgctgtaccccaacgagcagcatgcttctgttttatgtttagaggtttctctggccacctttcgagacttcattgttctctgaagatcgagctctatctctcaggagctgtatctgaggaagcattttgggcaaaacggcaggatgtacactgcttttggaaactgcatctgtgaacacttcagatttatgagaaaaatgcacttcaaaggggcactttccagaaaaacgttcagactcatggtgaaaaggtatctagaagattccatggagcctgcagaaaccaagccggctgaccccacatactgatgatctatactgaacacacaggcaaacaaaaacaggttcttcccacactggggacgacacgtaccctttaccctcatcatcctggctaaattctgcaggtttccttccgatttccttcacatcagaaaccatgggatttggcaccagcgtgacaaccatttagcatttgctgattcctagttagtccagggaagttctgtgccgccatggagtatgggaggagggaggcacggccttgccctcccggggcctggagtctgttcccggacaatctgcaaaaccgaatccacgtctcgaaagtttcaagagaattctactgtagacatctgtactatcagctacatttggaaaggattataaaattagaaaaatttccattttcaggcttgactttacaataaaatgttctctaatcataattatttcataacaaatgatctttaatgttgtatttttatacttgtaaactatttggcacagttttcacagggtgcccttcatttttgaagcagcataggttttgcttatttgagttttgcaaaaaatatattattttgacctggaaatttaaatatatagtgaggaaagccattctaagatacagagctgattgaaaaggctttgttaaaaacttctggtggggtcaagtaaacctcagtaaaagtcactgttttccaatttaattgtgaacatcctacttctattactcgtgattacaccaatgcctgaagattaaactcacctagagaaagaacggtctcttaaagccccagagaatgaaccaaggcgtgacctgtgctctttgtcagaactcagctttctgcaccgggggtaagaagtcagggtgcatttgggacttgcagacacgccagccccagtcaactgagcaccctcagatcgcagcaattgccaccacactgtcactgcctttgtaatcacttgctaatgggagcagcagcagcgaccgagacgtgcacttagccgctgtgtttacaggaggtccccgtggcccggatgcatgctttcctctgggtttggttccaaaggcctccaagtacacaaggaaacctgctgggtattgtgaaataaaccatcaaaagagaacttgctgaaaattctgcaggagtctctgccctcatgtcggggaagggagagtgggctggcagaatactaaacttgctgctcaaagatgatcaaagcctcaaggaaatggatgcaacattcaaagagactccgagagaaaaggaggagaatgtcttctaatcatctaacaacttatttttggcacagtttttacccaatcaccttccatagaaataggacacctacatgaaaaaagaatgcataaagtatactggtaccaaaaatcacaattcttccatgtcttcacattatccttagtgtgtgtgtgtgtacatgtgtgtataaatatatatatacacacatatatgcatatatgacaggctatgccaatttgaaaaaaaagaataaaagtcaataaaattggatttttacatcatgaagtacagaattaatccaaatatatcatgttttatctatttagaagaaaaaacaacatttactaaaacaatggggagaagtttggtgcgagtagtctgttaaacaaatgacctttaagaatatatttcagttattctgaaagttaatacacccaatttttgctccagtctgagcaaattaaacttggctggattatctgatggggttgatatcctggtaagtgtcaaaaatatgagagtctgtcaaaaaagatttgcttttccaataggtaaggcaaacaaaaatatcacactcatgtaaatgaagaaagctctaacatcctgaccctgtccatgaaatagttctattttgaggaaaaacaggtaaacatgtttgaaggtgtttgcattagaagctagtaattcaatctccttactgcttcaaaactattttaagaaaagctctcttactccccaggagcacaacgtgggccccctgtggtcccaagcccaggctctgactcacacacacaggggtcggggctggggggttctgtacaagcactaatgatgtgcgtgcattatcagggctgaggcggacaaatgctttagcagaggttggcaacatgagggccccccaggtcacgcgggaagtgccttgccaggacactaacccagctgctgtttaacagaggacatgaggattcaccttttggaaccccagggaggacgcagctctacaccctgaggccaccagtgccccccaggataccacctccacgcacccgtctcctccactccatcagaacacctctgctcctgaccttcctttccccaggtaagaacacaagttcttttgtttaaagtgtaacttcatattctgatattaataaaacttatgatattgccacctaccattctctctctccgaggttacctacctctcacctaccttgcacaataatctttttatttttcagaagctttaagacaatgaattgagtagttccagcatgtccccatgaaataaagcataagatcaaattgttccattttccttgtaacccagtgatgagagttatcatccacaacctcactgtgattatagaatcagcaaagtacacaggttcagtgagccagaaataaatacattaatgcgagaagacacctttcctgaaatttgttttatgtttgcaatattttaaaaaacttttcaaacagatttttacacttcacaggggactcatggctgtgatagaaaacccaagtgagatatggatacgttaatgaattaatacctgcttcatttaccaaagtaaatatcctttccttgtaaccgcaattgtctgagtccttgacacgttactcagctaacttcaaagtgaacaatcatacagtcccatcctcactactgcgtcctgctccgccaaaacacaaatcacaacaacacaatggttcggcacctagaactttctcaccgggaaacaatccaccgtgatggggcaaacccccactttaatcaaagtacttccctaaagggcattttgtggtgatttcaaagctaaaccaaccagaaagtctttacactcatttcatttccaaattttcctagatcacatttttaaagaaaaaaagttttttttcctttttattaatctggattgaagaaaagcacacatttcatttattgtctggattacagattcttattaaacaaaccggagctcattataaaatcaatatcaacttaaccaccatgccctcaggaggaacagcaaaaaggtcactccaagaaattcaaacaattttcctgctggaagggcatgattttaattacagatactattaattagagctgtcactgggaaggcttttttttttctgttaattatcacaaactcagtcctaagtatgcattttcaacctgcagtttttttttcaaattagtcatttctgcatgcaagtccaacctttccattctatcaatattttatatttgaatttcaaagtatatcaaagggcgccacgctttctaaaaatctctgcctgtatgatcttccgtctctcacgcatggaacagaactggtgtgataatttatttatgtactgacacagacttggcctgaagacctggcatcctacattgaaggtcttgctcaatggaatttctggataaattcttactagtttatgtgacatttttttcaggctgcttcttcaaacgtgattttccttttgctttgaagcaaagctatgcactgcaactgaaatgccagcctcaacacatttgaagttgccatttctttgtaagaaaaagatcgtcctgaccgggctggtgaccctctccagaaaactggaggcttcctccattcaatggcaataccaggaattttgaaatgggaggaaaagctgtcttgtggtcaatctcttttaagcatagagattgtgtaaattccttatgtgggggagggtcctgagagctcacagagtatagaaaagctagctccaaggagctcaggcagcaggagggtatggtgctggagggcgctttgtggagagagcttgagagcccacccatgtaactctgatgatggaataataatatttactttacatacgactgtaaaaatgatgaattatttacaagacgtattgcacactgtaatcatgtgactagagaaaacaaaggatccagtccaatgaggaaatcttacacatgtactgaccaaacttttaaaacagtggttaaggagtcatcctaccttcccagatgggaatatcttctcggaattaaatgatattttatatgcaaaggaatcaaacgccttgactggtgtaagtattctgggcttatgctgctgttaaaaccgaaggcctatgttcattacaggacaatactaaatacgaaatgtgcgccatagaacttccagaaactctgtggttttttaaaaatgcccgacttggtctgaacttgccttcctcgcatcctccccggtttccagctcatttccaggggtgtctgtggtgcctctagagaaggtgtccctcatggggacgcgtgtgggtcaccttcccctggtcagcgttaggcttcactggaccggacaacagcacagggtggcaactgggcaggtcaaaggatcttttcacagaagaccccgaggaagccgatgatttttgagacatcttcaaacacctacacgccaaatgatctcgcaactctggcacttttcagtagtagtggccaaactaagataacagataatacatcattcatgtactgtactttttccacacttctaattaacaacattcttccagagttaacacgaggctatccaagaagagcagacggatacagagctgcacaactgtggctgcaacgtatttgcacgaatgctgatgagaagttccaaactgtcctcataaaagaccccaaactatgatacaggaacaactgctgggaatggaggaggggccagagaggaacgccatcatctgcctgttcaacagataaatccgatataccactttttaaaaagtctcctcttacctggtaggcggcagtggcatctgcacctgggtcgccccctagtcccgagagcttctccttcagcctgtgctgagagctatggcggaggcagtagatgaggccagaggccaggaggacgcccaggatgcaggcgagggagaccagggtgagcgcgatgaacttggtggagtcttcttgctccgcctgaggaggcaggaacttgagtttgcttttctgcagaacaaggagagaggggtgtgttagctcctgacaaagcatgacctcctaaaaacacacgtctccaaatgcaacttgaaagtggaaagctcagccccacaggacgctgtgctggccctggagccacaacgggagggccctgcggaacaacccccgtcaaaggagaagcagaaatcatttgaaaatagcacatcgcagattgcagcgtgctcaagaggacagtcagaggcatcactttttccttcagtggtggctgtttttcaaatttatgtaacgtatttggcagctaatttgctgccttaagtaaagtatccatcccttcttctaaccgggcacagcagtttgtccagagcttgcacaatgattgtcgggggtgctggggggaggccaggcttggcggtggaggagggtgggcaggcccggagccttctgcagcttcaagtagccaccaagtccagcacatcttcagcaacaaaggaacgtgggactggctctgtgcatcttcacagaacattctccctcccaggtcaggggatttggatccacctgtcttgaaaggcgagcgctggtcgaatcccacctgactccagtcactctccaggagtggcctggtgcagaccacaacacttgccacctatgcacctacgtatttttccttgaaaggagctgcagagcctttggaacttcacttctcagcgaggaaaacccttcagattctcactgcttcttggagggcgggggtagggctggtgaaaatatgagaaagccctttcggtgcatttcacttgtctccacgtgcaaatagttgcacggctctcccctcattaacttcattagaaggtatattagcaacaattaaggacgccacaggaaaatgggaaggccgccccgcagaccgcgcgccctgcacaatgactcggggagtgaatgggggagcacgcccggccttggtcctggctgctacaagatgagaacaattagcaaacccctttccaccacctaatttcgcgtggtaacaaaatggatttttccccatgaatgcctggccggcctattcattatctctcttctattagtaattttctgctccgtattcagcctcccaactcttcatttcctcccgtctcccagcgtacacagtgcctcttatgtcaggccgggcccgtttttatcttgtaatcataaaggccaccaaagcaattatcgccggtcttgactggaaaagctggtcattaattagcctccttttgccttcggtgcagcggattagctggtgccgggactgagttaatggaaacgcgggttaaatgagaaaagacgcccggattttcctgcctggatgcgcggctcggaggaggaccgcgaggttctccagcggcgggaggcggtggagccgccgcggagagggagggaggctttggagagggagggaaggaaagggggagggagagggaaaggggggagagggagaggaggcgcggggtgggggaggggagtgagcagggagccgggagagggaggaggggcgggaaccaggggagcggcccgaaccccgtttggtccggaccccgcagccaccgctgggtctcgccgccgggtcgcccttcgcgtggagatccggtccgcgccccctccccggtctcctcccctcccctcccctccgcccccctccctccggcccacacagcctcttccagaaagaagtcactctagagccgcgcgacccagccccagagtccgccggggtccgcccaccgggtctcctgcgcgcccctccccgcccctccccgggcacagcccgttcacgaaacctaaggcgccggccacgcgccacctcccccgggccggggtctcctcggtccccgcgcgggcgctggttctcccgggtgggcggcagccccgccctgtgccctcctgggccggcgcgagggaccctagagcgcgcggggggccccaggcggggaggagcggccgcgaccccggatgcgagaggcgtgtgggtccaagcggcgccgggacaggggccgggtcctctgcccaccccagggtccatgttcgcctgcggggccgcgtcccccggagccatacctgggcgggagggcttttcccgggggcccggcctgcgcccctcgccgcccctcgcccctcgcctctcgcctcccgcgggtcccgcctggccttggccgacggaacaagaacaacaaaggaagcggcgcgaccggcggagggggcgcccgccgccctcccacccctcatcccggccgggccgatggcccccgcgcgcctccatccgccccagcgcggaggcgaccccggccccgctgccccggcgtcgggaggacaccgcgcgctcacgtggatgactgcgcccgggaacagggacttcccgaaccttcctgccccgcgccgtgaggcccacacgcgcgcggtgaccaccctggttctgagggggcggcggggccacggcgtgtggcggacccggcagtggcacccaggctgtgcgcgcgggtgtgtggggttccgaggcgcagggcgaccgccggctccggctccccgaggaaggggcacaggcgctgcccgcggtcactcgggccaggtgagggcaggggacgcgcgggggccggaggaggaggcctggtctgcgggcggcaggagggacccggggccagccgaggctgttcccagggaggcagacacctgctgtcgccgggaccctcgacacgctccgcacgcgcgggagcggaaccgggcctgctttggaggcctcccttggcgcgcttggatttactcaaaggtcaaagaaaaatgtcaaggagagcgattgcctggagagctcctggctctcctcccgggtccccgctgggtcccaggagtccccggaggggaagcaaggagccccagtgccctggagtcctgtctccaccaacctcgcccggctccctgctgcctaggcccgcgctgtcccagcagaggaggggtgggagccgccccaggcccacctccccgcgccggtccacaaggaggcccctcctgcaacctgggagaggccgggggaggcccggagggcgaccgcgcggggccgcgggacctggacagccggggagtcgtgaccgcgggcagcgccggggctgagggcgaggagggtcttactgcagggaagggcgggacgctggacagagggaccgactggggtccaccggcctgacacagaagtcgctggatcccagggcccggctgggaaacccgcttcctacccgcccgcgggcgccgcagaagaaaccgaagaaagaggtcttccctccacgcccaggacggtttcaagtgtcccacccagcgctgagcaggagggtgatgcggagggaaaaactgttggctgcaagtcaggtcttaggaatcccggaagaaacgaagatttaaagaatttttttctaagtgattgagttccaataactttacaatgacttgactccctttttgtggagttaaaaaaaatcttcaaactcctgctagccatggcctttaagagaaagaaatgagtttaaaagtgagtttgaggcacagtcttgacccaggtgtggctttggtggtcctcagcgccatctcccccatgggcaccgaccccccaaggctgcaccacggcgggtggaccccaaagagagcccagactaattagaggcatcttatcagtcttgacttgaaattgaaagaaaattatgtttaaatatttatgactttgacatttacagtcaggcgtttttgaaaagcggaacacccccttctgtacagcggcagctcaatgactgaaagtttggaacagagaagaagtgaggaggaggaggagggagaaggaggcctggtaacacagcggcaggggtgcgtcccgggtgggggagatgcacagataggcacacttcagtgctgagttctcagaggcaggaatagtataatttaaaaaaataatcaggaatgattaagttaattttatcccaggttagatctatcttgagaataagatgaagtacaatatcgcatatttcttcctctcaaccgtctgcacctgcaactcctcaaatttagaatagacagtattgcaaaagttgtgattcaaaataagtgtatgaccacagagacaatttgtggagctgtcttagaacttagcatctgcagacactgtcctgaccaatttaaattattttgaccgtgcccctgagtggaggtgcatgaggcttccaccccatgcccttgtgagccatttacgggaaaatgccttcagaacttttttagctgtccatgtggtaagcttaaaagaaaagaaaaaaggacatgttatgcccaaactcaattgtgagagctgatacagccacacaaatacaaaactttatggtaaatatgtgttgacgggtagccagatttagtccttttccaaggttgtgtgatataaccagttaacaggagcagttcattctctgagtcacgatgtgcagtattaaaatatgcttgcatcataaagacgtagggatacaggtgctcggtgccagttaatgttaaacttctaacattgttgatgctttcatttgtatcatttctaaggaatcagatttcagtcccagcctcatcctatctttgtgtgcatttaaattactaaattataaatacctttttctcttaaaacttagaagtcagttttagagaccattaatgagttgctgtaacaagtttatctttggtttgctggatgaatcctcttagaattattaggaaatttcattctaaatttactaaaaggcattactaaaatataatactcactttagggctgatgaacattttaagttttcaggccatagcaagtgatccaacttgaaaacacgggggaaggggtgtcttaaaatattttaaaagtattttttaaagctgttaacggaactacttttaatttggaatttgccacagaattctaataaatgagagaagtcaggcggaaataatcatgtattaattctctgcattacaaaatcttttcagaagctattatcagagcaagaggcactgcggtctgaattcagggtgggagaagccctttgtgcaactgaaagctattgttcctccgtgcagatgaaattgtacttgcaaatctgccattcaagtggccaaaaaacccaaaaaagcaaaagaaaagaatcttcaaggaaaaattattcttaaatgtaaactttaatgaaaataagttgggatatactgttttaaaatgggctatttgttgagtttttccaggcatacacttaaaagtgaatatacaagaaaggcaataaattgtctatttgccatctttaagcactcctaaaacatcagttttaaagaaatactgtgttttaagacatcagggaagatttatgatactgatgtccaaagggggaagcacccttgtgcaaactaattctaaccagcagattgcctccggtgggagagagggacccagaggctgagcaggggaaggatgcccctgagaaagccgcccccagcctctttcagactctccgctggcgttttcatgacacccaaactcagactcagcggatcacacttaaggcaccggctcctgacccctatttttggcccgcccgcctggtccccaggcctgcctggacgcacgcgcgccttccacaccaggtgcttctcgggacggggcctggcctccccaccccgcaagaaccagaccctcttcaggactgggggggttaccgcttcgcctcctctacccggactcagaagccccaacccaagacccgcctagcgtcgcttgtcagaacccctctgtggcacgactttgagcagagggcgagggaaaggagggtcagcgttcggccccgtcccctgcctgggctttctcccccgcttccccgtccctcccccctcgccggttcaccgcatccccacaggagtcataaagatcaggccccagcgccggacacaaaggccaagggttcccgggagccgcgggtattcagagccaggagaggggtcccggcgcggagggtgctgcggcccagcctcctggccacagagcgcgccggccgcgagggaggaccaaggtccccaaccacgcccgcgtccacccgtgaatcccggcgctcgcagcccccgggcggcgcagccgccaccgccgccgtcttctctggagcgcagaggggtgtgcttgggagggggcgggagggcactttcctctgtgtcggtgaaaggaagagcttccagctccctcctccgcacaaaccttcacttcctctcttgttcgatcgcgtcctaaaatctgggatcggcgacgcaaggacagcctggtttggcgaagacccctcggacaccctgcgctccggactccaggcgggtggctccacggtgccggccgggacgcgcagctcggggggcgggaccacgtccgggaccccggggccgctgtccgaggacggaggtcggtgacttgaaccgcgtcgtcctcagggctgtggcggggcccctctcccagccgtccagcccgcagcgcccagctcagcgcactgaggaccaaaaagggcgggagactctctccggccctaaaaggcaattgtgctgagattttaactctaacttgggggttcgcccgattccctggagcaacgcttctctaaaaccacggagcaggccagtgttcggaactgcacaggtagttacgaaggaaggaaatgaagtccctcgttccaacagcttcgggtccagtcacaagtttctctctggcgagcacgcggccgcctcacctggggtgggggaggcgctgagaaagcgcagttctctttgggggaggagagatggcctctcagaggcgtccccacctgcctctggaacgcctctccctgcaggccccctcggttccctgcaattcgccgcccgctgggatactcccatggctcggaggcgcgctcccggaccctggtgaggagggtgaagagcgccccaaaatgggctgagaggaaaatgcgcccacactggcgcctctccatcctggctgctcgccccttccctcctcctttcccacacgcctcccatctccgtgcctgcacccccccacccccagcaccctgcaatggtcggaactgcagggagtggggagcaacgcgaaaggccgagagaagagcgctggggagaagtcccggaggtcctagactccttggggcggtctctgcggggcgctgggccaggacagctgccaaccctccaaatctgtgcgctcagaaggagctgccctttgcccgctcctcctcacaggcccaccctagacccacttggggatgatcccaggcgcagctctcccctgccggcccaagcctttgacaggagtcctgcggcgaggcagagaccccctgaactgagctctccgacgccctagttgcccgttagagcccccatgcgcgccctccagccttcgaaagctctcttcctcgccccaccacctacgcgcctggtgatgctctcgtgggcccttcctgctccctccgcccccatcccagcctctctcgcctcttccagggcccacccaaccgcactacgagcgcccgcgccccgcccggcacccctggttacctgcagctgggccggcgcccagcgcccgcgcgggaggaggtgggggcgtgcgccgggccgagcggcctcggggcgcagcagctgcgggtagcggcagcgccatcatcacagccagctgcttccctgcgctggagccacagactagcggggtcatccgcttctgaccacaaacttctagggcggccggaggagacaaaggtgccgcgcgtcgctgctccagcagcagcggctgcgcggcggcacgggctcggagcccgcaggcgccggagctctgcgcggccgctcggcccagctccgcgtgctccgccccggcccggcccccgggctaggcacgctgggccggggcgcggcgcgggcgggctcagggcgggctccggacggtcccggtagggccgccggccgcgcgcgtagcaccaaccagcgcggccgccgcgccccgccttatatccggcccggcgcgcacccggccggcggcggcgcggctcgcggcccagccaccggttgctatagcgatgtccccccccccccccacatgttgctgacagcaattggctaaggggccgcggctctccaaacaccctctcccgcccgagactatgaatggacatcagctttgtcagtcattggtacaacgccgaagccagggccttcgccttttctttcttttcagtgtttctccctttcatcgttcatactgggcaagttcagggtagcaccgaggggagagagacctcggccagaaaagtcaaggcgcgcggctctgctgtgacctttgtcctgggaggggtgggtggggtgcgtcgccactcttggcaagagaaaattgcacggcatatcgttcttcccagttaccttttccagtgttgccgttcgggcctttttgctccctttccaaatggaagcaggccaatgattcagggcgagtagacgagagcccctctgctcactttaccagggtcctcccgagtgtttaggtcccgatgcgcgtagaaagtgtcttgcgagacgcggaactggtgagactttgccaccatttggtccaggccaatgtcggccgccagcccaaaacgccgaagggagacggcggtgaaaacccaggcgtgcgagctgcgtccttgcccttccccctacccaggtcaatggtctggcctagaccaccgctctgcgggcgaaaggagtggagcagaatcacaggccacgctcccagtcgttcgagcctgcccacataacccccggcccctggcgcagtcaggcccgcagcgggcgagaagagctagggtctcggggcgactaggaccactgagcacctcccccccgcgcctcccgcccatgctctctctccccaggccctggaccccgggccacagccacaggttggggcaccccggtgcgcggcgcccccgcggagctggcgagagccggagagctgaaacccaacatctgtgtgtacaatgcgctctccgaggcccacagctgcaggaacaaggagaagaaaggaagaggggggcgcagatcttgtcacacgcagatgacagtctgcggagggctctttagtttctccttttctggaaaccccagcggccccctcctaggcccccctctcccaccgcctggccattgttccctgcgcccgggacagctggagacggcggcccgcgccactcgacgcccctcccgccgcacacccggctgcccgcggcgcccgctcccggcccctccggggccaactcctccacaccccccacctccccaggccaggcccaggcggcgcttccacagtctcccctcccctcccttgcactctggcgctgcccctagacctgctcggtgcagagggccttgcctggcgcttttctctcacaaacctagttctgtaaaacctgggggcgagccccagggggcagggctcagaggcgggggttgtccacagatatgagtacggtgccgtccgctgcaggcccctgtctaaaagtggccgaaggaccccgtttcctctgactgcaggcccaggctgagttccgcatttatttttgtatttatagggcaaggccagagcgcttcataaagctccagggcaaagaagtggcctcgcatcgggccatggttcccgcaggcctgagcgggctgcaggaggcccggtgcggctcggcgggggcgcgagaggcgagaaactgcggcgtcactggcgtcctctgcccatgagtgaacccctccagtaggcggggacggggtacatcaccttggccctctcgtcccccctgcccagggcaaggcccgcaaaaacccccgcaccctggctcgggggcggcgcggcggcgggcaggtcagagagaagcggtactcgggttcccccagcgcccgggatgccctcccagggaccttctcgggcaaagagtcgagtggtagcggttcctgtccctccccgccaccctcctccggtgcctcggcgtccccagccaggctccagggcgaccccaggcccggccctgggcagagacagaggaggggaggggaggtggcgctggggggcggggggccggagacggcgggaggaggactcgggagccggggcgggaagaggggaagacagcggagagaagggacggggaggggagggggctcggaggaggggacctgctgccctcagcctggctggtaaccggcctctccatagcaacggccagcgcgcgcgtctgtgtgtgcgcgcgtgtctgatgtgtgtgtgcccgtggtgttcccgggactccccgcgggggctgggaggggatcgcagaaccctagggtggcgacagagcaaacccctccaggactggaggcccgacctccgcggtgctgggagcgccctagggtctggctgcgccgcgctggcgacggggtaggctcggggaacgcgcgcaggccccgggatcggccgctggggcattggggcatcctgccctcgctgccccgaccctcccgctgcggtcgcagggccttggggcaccggggagtgggcgggtcttcccagcgacccggagcacaggggcgggcgacggcgcccccaccatggccctgcccggcccgagcgcccggcgcacctgaggtctgggccggggagcagctggggaaccgcgcgtcgcctcggggagctcccggccaggccggctccgggcagaggccagaggggccctggcgcaccctccccgcccgcggcgacctcgcaccaccttccccgccagcccgcggctctcctcgccctggatcgccggagcctcatccaggctggggtctccagcaggcggccgggagctctccgaggtggccaggagtggccggtagccgtctccctcggccaggccgtgtccagcccctcagtctccacggcggcgcagaccgcacgcggccaccctgggcctcggacagggctagggggacgcagaccctgccgtctgggggtcctggggcggccacggggccggcgaccccagagcaaggcggagcctagtacaggccagagagctggttttgctttcttcacagacatgacctgacagtgaatacacaaataaatacaattcttttcgttagtcccttcttccgttgtctcagtgtttcacttccaacatcaaagcaccgcattcctgatttgatcttaatttaatgacctgtctttctagtgctttgaggaaagatgggtgggaggtggcaccaattcagttcaatttgggtcactttaaaaatcgtgagagggcctgaaaggttccatgcgggttcaccagcagaacagcacacttcctcgtccacgccttggtgcacctgcggcaatatattctgggtggcagacggttatttatgtctgagagcctccaactcactccccttcctcccaccacccctcctctaaggtgcggcctgacctcagtggggctgcagaactggcctcgccaaagctgaaggcggacccacactctaagccctagagtctaggggggtcatgagaagaacgcgtttgtatttgaggtgctggttcttttagtctattgcttcagaaactggtaagttactcgccagatttccattctatttttctttattttaaattccctttttatttccagggcaggaaaatgtatcttctaattcttgaaaatactttagaaaagtgtctcggcaataatgtgagactagattcagctaatttgaagaatgaataatgatgtgaggattttttcttttttcttttttttttggtcatgagatcttagacttcatttaataataaatttcaatttacatgatttcaataacattttcagagaaaacttttaaacatgacacaaaatatttttgagagacatgttgattgaaatcatttatatatgacaaatgagtacattattcatatagaagttagggttgtttggctgatgaataaaaaatataatatatgtaaaattctccaagacctacaaaatagctacacaatataaatagtttaaaaatgatttgttgatcctgccaatacttcttttaaagtgcatttcacatttgttatgtgtaaaacctaatgttctgtgataagaatctcattttcaatttaaggaacaccaaattgttatagattacacatttaagtgattagaataaatatcccatgcactaaattatcaaagaaaatgtatttttaaacaaaatagagaaagactgttatgggaaacatgattattataaagcaaaacacatatttcaggaatttaaaataatatggtaaggtagaaaatgatttaaaaaacacctgagactcttgatttcagaagtctaaatcaattttgttttttaaactaagacagtaatttataattttacagtacacaaatagtatttaaaatacttttgatttctaaatccatttttaaaaagtatttactattataatataaaaataaaaatagatccttaaaaatattgtaggtatgtgtataaggcatttcttcatgcatatatttaaagaaaacaacattttaaagtaacaatgagtgcattttgaaaacaagatgttttgagaggtcagcctcctagtaaagcatagtagttggcattgagataatttaagaacaaagacacttccacagacaaatatggatgactctgagttgaaatgtattaaccaccagtagttattttttcaaggacaatatttggaagagcatcagacactagtgagaagtccttattcatcataaaagaaggtaagtccattgcaacaatagggcagtgaaacaactgcatcttagtagagccctcaccgtctacccgtgcatactggatcttagtagagccctcaccatctacccatgcatactgggtcttggcagagccctcaccatctacccatgcatactggatcttagtagagccctcaccatctacccatgcatactgggtcttggcagagccctcaccatctacccatgcatactgggtcttggcagagccctcaccatctacccatgcatactgggtcttggaagagccctcaccatctacccatgcatactgggtcttggcagagccctcaccatctacccatgcatactgggtcttggcagagccctcaccatctacccatgcatactgggtcttgggagagccctcaccatctacccatgcacactgggtcttggcagagccctcaccatctacccatgcatactggatcttagtagagccctcaccatctacccatgcatactggatcttagtagagccctcaccatctacccatgcatactgggtcttagtagagccctcaccatctactcatgcatactggatcttagtagagccctcaccatctacccatgcatactgggtcttagtagagccctcaccatctacccatgcatactggatcttagtagagccctcaccatctacccatgcatactggatcttggcagagccctcaccatctacccatgcatactgggtcttggcagagccctcaccatctacccatgcatactggatcttagtagagccctcaccatctacccatgcatactggatcttagtagagccctcaccatctacccatgcatactgggtcttagtagagccctcaccatctacctatgcatactggatcttggcagagccctcaccgtctacccatgcatactgggtcttagcagagccctcaccgtctacccatgcatactggatcttggcagagccctcaccatctacccatgcatactggatcttggcagagccctcaccatctacacatgcatactgggtcttggcagagccctcaccgtctacacatgcatactgggtcttggcagagccctcaccgtctacccatgcatactgggtcttggcagagccctcaccgtctactcatgcatactgggtcttggcagagccctcaccgtctacccatgcatactgggtcttggcagagccctcaccatctacccatgcatactggttcttggcagagccctcaccatctacccatgcatactgggtcttggcagagccctcaccatctacccatgcatactgggtcttggcagagccctcaccatctacccatgcatactgggtcttggcagagccctcaccatctacccatgcatactgggtcttggcagagccctcaccatctacccatgcatactgggtcttggcagagccctcaccatctacccatgcatactgtgtcttggcagattcctcaccatctacccatgcatactgggtcttggcagagccctcaccatctacccatgcatactggatcttagtagagccctcaccatctacccatgcatactgggtcttagtagagccctcaccatctacccatgcatactggatcttagtagagccctcaccatctacccatgcatactgggtcttagtagagccctcaccatctactcatgcatactggatcttagtagagccctcaccatctacccatgcatactggatcttggcagagccctcaccatctacccatgcatactgggtcttggcagagccctcaccatctacccatgcatactgggtcttagtagagccctcaccgtctacccatgcatactggatctcggcagagccctcaccgtctacccatgcatactgggtcttagcagagccctcaccgtctacccatgcatactggatcttggcagagccctcaccgtctacccatgcatactggatcttggcagagccctcaccatctacccatgcatactgggtcttcgcagagccctcactgtctacccatgcatactggatcttggcagagccctcaccatctactcatgcatactgggtcttggcagagccctcaccatctactcatgcatactgggtcttggcagagccctcaccatctacccatgcatactggatcttagcagagccctcaccatctacccatgcatactgggtcttggcagagccctcaccatctacccatgcatactggaagcagagtttatcccacaggacaaattcatgaactgggaagatttttaagataagattttgccacattgcttatgttagatataacataagcaatgcaaatgtaagcagtgcaaatgtaagatatagctataaaatcaatgcccttattttaaaattgagaaatgctaaaattattttttcaaattatttcactttatttcaagaaaaatatgaattctttacttaaagcagaacaatgcaagtcattttttgttttgaaaaataaatcaccaacacaactcagcttttattattaattctcatgctggctcatatgccgatgaatctgaagcttttgaaatccaaaaataggaactcaatgatgagatagacttgatatcccaccaatggcttgacatgcttacatgaaaccacgtgcttataaaccaagtatgtgtttcagcaaacatttctgcttgaaggattggctgacaaatatgtcgggatgtttagacttttcttccccaaacttcaaagttataattcaaagaatagaaaaagcctcaaggcttcattattactattattagttttgtccattaaaagtagcattttgaaaaaatactgttcataagcacaggtacttataaacagtgcagtctccctagaggtgaatccggttttcactgtctagattctagtatagaggatctattacttttaatcaacgtatttgtaaagatctaatattttattatttacagaataatgccataaggcacgtatttaatagttgatgttcagtatagtatatatattgtattttcataactagattatattcttttcaaaactgagctaaaattccttagattgaatgtttgtaagaaagactcattaccacatgaacaagaatctaacttttttgaaaatggctaaatagtgccattatgttcagatgaaaggaaacaagataattctgtgaagaataaccaggtcatctctatttttgtttaaaatctctttcacatattttgtcagttacatactacacatccattacaatatttggaaacttttcctcgggttgctttggaattaaaagtagaacaataattcaggtaattcaggtaaatgtttgtttcacaattatataacttagccatgtcctgttcacatattctttaagaaaagtgcctatgtatattttaatgtatgaaaataggctccaattaaatgaaagaacagcaacagcctgacaaagctcacctttgtacctggattctactgagaaggaaaatcaaatgatcaccatcaagtgacattttttgattttatattgcaaatatgtctatacatatttagatctaatgtgaacaaaaattcaggaagcagccagttgcttttcttttcttttttttctttttactgagacggagtcttgctctgtcacccaggctggagtgcagtggcgtgatcctggctcactgccaaccgccgacacccaggttcaaatgattctgctgccagtagctgggattacaggtgtctgccaccaggcccagtgaatttttttttgtatttttagtaaagacagggttttgccatcttggccaggctgttcttgagctcccaacctcgggtggtctgcccaccttgagcctcccaaagtgctggaattacaggcgggagccaccgcaccctgcccagttgcttttcattctgacacagtgcggagcaggttcagggtaagctgtcactgagacggagcattggtggtgcaggattccatgtgactcaccctcagctgccaagtggccaactgcatggagccgccgcatgtcctcggtcagtgcggtgggatgcacgctggcattctagcaagtctggcacattagcatataatctgcaacagggtgctgtcaggtactgagaccacttttaaaaccctcatgaatctgccacatgtaactatatgtctccctaatatgtttccattcacacactttaggaagtgatatacctacttcgaccttgctcagtcatttctgaaattcccatttggaattgtcttcagaaatatgcccaaagaaaaccagaaatctagtcttacgttttctaagctttttcacttgtgattctccacaccttaacctcatcactcctccagttgactgtccttgtctccaaatggctttagagtattaaaaaagaaacaaatctgaaatatcacttccaccattaagagtgcatttgaaaaggccatttcaaaagagtagtgccccagacatggtgagcactaagacagacagcacctctgagtgacactgcggaaaaaccaggctcacttgtccaagcacgttcgcaacagagtcagttacttttcctccactgggtttcccagtttccatgacgacagcctgtcctgaatgtccatctttggggtgaggcttgaggcttccttgtcttttgtcctccccacaatcagatcccattacttttttcgggtcatcccttatctgaccttattccccatccccctatgctgatggcggctggcctcctgcagtcctggggtctggtcccctccatccaccaccctcagcctcggccatctctaccttgtccactggaacagcttcctgtccctccctgaaaattccaccaacccttcctcacacccatcagaggctggctccctttcatctgatcaaccaaggacacacaggggcgcctccagacctcccctgcatgccttccccacaccaggagcccctggtcagcggccgcgagggcaccctcaccctctcctgcacactctctccccatcgaggaaccctggctggctcagcggtgggctcggggcctttcatttgtttgaggtcgaatgctgagtccctcaccttcagaacatgtgagtgctacggactgctcatcatttcacgcatgtgcacatgcactgtctctcacacacgcacgctttcgcacacgtggagacaggcgagtactttctagtcagcatgacagcagcggctccatcctgtcaagctactttcccatattttatttcctttcactcccagagaaaccgtggaattcatgcatttttttttccagttttacagatgagaaaaccaaagtactgagaggtaaatgaagtatccgaagctggtcagtggcagaatctcaatcaacacacaggctcctatgcgaacccacacactgagggcatgtttcacaggggagagctccgttcttagctacagactcaggcaggcttggagtcactcctctctgcagtctgagctccgcgggtctccgccagagcctccaagcctccccccagtaataatattaataatagttactattctttgaatagtaattcaataatagtatcagtctttcaaaaagatggtggtctttattctctattttccatagaatgtggtcacaggcatcgtgtgagcactgccatttctgtgcttctaccacacacactctaagaggccagggggtgtctgctccggcagctccagatgcaccttccaggggcgtctcctcctgtcactcagcgctgcccccagacccttcctacccgaagttctgtggccacagccatgcagactttatcctacactctgacccactcacaaagcactgcggttctaggtatgaaagcttctcactcttaactgacgtgggctgtgcgtttataagagagccgggtcaatgctggtgtaactgacacgggctgtgggtttgtaagagagccgggtaggtgctggtgtaactgacgcgggctgtgcatttataagaaagcccggtcggtgctggtgtaactgacacgggctgtgggtttgtaagagagccgggtaggtgctggtgtaactgacgcgggctgtgcatttataagaaagcccggtcggtgctggtgtaactgacgcgggctgtgggtttgtaagagagccgggtaggtgctggtgtaactgacgcgggctgtgcatttataagaaagcccggtcggtgctggtgtaactgacgtgggctgtgcatttataagaaagcctggtcggtcctggtgtaactgttgcgggctctgcctttgtgtgaaagcccggtcggtcctggtgtaactgacacgggctgtgggtttgtaagagagccgggtaggtgctggtgtaactgacgtgggctgtgcatttatgagaaagcctggtcggtcctggtgtaactgacgtgggctgtgcatttataagaaagcctggtcggtcctggtgtaactgttgcgggctctgcctttgtgagaaagcccggtcggtgctggtgtaactatgagaaagcctggtaggtgctggtgtaactgacacgggctctgagtttatgagaaagcctggtcggtgctggtgaacatgggtgtctcccctcagagaagtaagctgaggtgtgtgcacctctcacagcccagtggggagcacagggctgcctgcccacgctcactggctggctcagtgccctccataggctcctgtccaccggcaggcgtgctgcggcgttggtgagagccccggggcggaggctcaccatcaggcttccagcatatggtggataataatctctggcaacacaaaaaggcaggcagcagctcagctcactgtttcatctgttgatcagtctacaggtccagggttttaaaaatggatttttgctaaatgaataccacaacatatgccaccagaaaagtgcgtgtgtgccatttcaaacacccgccgtcctgctgctccgcgctgccgaatctgctcctctctcctctggccccgcgtccctcagaaggagctgaggtcagaaggaggtgtctccaggaaacactaggggaccttcatacctgaggggccaaaatagctgttttcaagctgctgctgttggagaccggtcttaggaaggggctgtgatagagctctttgtggaaagccttaaattaagatgaaggggagaaaaggaagtatcgaaagtttggaaaaatagagaaataagaagagctcctaaactgagcctgtggcaaagggagtatcctgaaattgaacgggctcattcttgaaatgtcagtgtggccggcagcctctgagacggcccagggcctccgtcctcctggaattctctttcctgagcgccactggacctggtgactccactccgatgcctggaggacagcaaaggcagcagagatggctgctaaggacgcacactggggtccccgaccgactttcgagctccgagggatgtctgctgccaggtggtggcggctgatggggaaacctggtggacagggcccatggacaggggctaacagcacagagggcctggggctgccgctgctgagctgagaggacaccctcagcacagcctatagggacgcagctggaacccccagctggtccacaccaggaccccaggcccacagaaactgtaagataaaacatggttgtgttaagctaagtttcgggataactcgctgtgcagtggagggtaactactggagctagcaacgtcaagccgtccaggagagaaccagatgggaacacccagcgtgggtcttccacaaaagaacttcttctcagccaggcagaggcacctgcaggaggtgaaaggcaagttcccggccagcctggtggggttcctgcggtccaacccccacctcagcacgctcccctcactccccgcggccgcttgtcctctgccgctgctctggatttgggattccgagactggcaggtcaggaggcccggaaaactacatttgcctcactctggttctccggggctgtggtgaggctgcctctcccctgccctccactttctctttccctgtaatatttatgtagctgagtgcagcaaacattttgaatgcgtgatcaccgtggggctcagggccctctgaagctctcactcgcccaaagctgacggcctctgttttttccagctgcagctccgggtgccatcctccgcggggtgaggtgccaccaggaatccctttccttagattgtctgatgctgtgagttagaagattcctgtttctactcacacgattgggtgcccagtatacactgccatggtttagaggaagctctgccactaactgtgtgactgaggcaagtggcttcactgccctgtgcctcagtttctctccctgaaaatgggaataaaatgtacttgactcatgggcttaatgaactgatcccgggagctcttggctgtaaggtgctcaggacagggtggcatccacaccctcaggggccctgctactttttattaccatcttgactctaggagctccgaccttggttttcatggatgccaatggaaattctgttttcagacaaatgtggaaggcatccttaaagataataggattaagtaacacaaatataaagaggaaaaatgatcaccgatgaagagtgcaagagaccacgtgtgtgtgcttgggaatggagggcctgaaggtcccaccctcggctgggcccgccctgccccatgctgctcccgctctcctgggcaccctaccacctcctggctccccacattcgcttctgggcacacgtggagggagggcaggtgcccctcaggtgttccctttctttccttctcagcacctcctgaggaagccccaggacagaacaggaaccactggagtcagaagcagaatgaggggcatctgtattcactgcagtttacggcggccattctattgctctcgtaacttgcaaagcagacttttaacttagaattgacatatactaaatatttaaagtaatcttcataagccccagagtgtgtgtctgtaactaaggacaattttttcacaattaaaaaaccctcatgaaatgacagtgactgttatcaaatgtctaactctgtgctcgagcactaacctccatgcttgcaggaaggctctttgtgaaactgacaataatcctgtgaggtgagcaccattaaaacctgtacttggccgggcgtggtggctcacgcctgtaatccagcactttgggaggcccagggggcggatcacgaggtcaggagttcgagaccagcctggccaatatggtgaaaccccgtctctactaaaaatacaaaaaaattagctgggcatggtggcatgcgcctgtagtcccagctactcaggaggctgaggcagaagaattgcttgaacccaggaggtggaggttgcagtgagccgagattgtaccactgcactccagcctgggtgacagagtgagactccaaaacaaaacaaaacacaacaaaacaaaaccctccattttccagacaggcaaatgaagcccagagtgacaaggtaacctgcttaaggtcacacagcaggaggcgaggcagggtatgaattgagtgaatctgacgccagagccttctggatcaacatgggccacattcccccagaatgccaggaactgagtgaatgtgaccccagtgccttccagatcaacgcggatcacatcccccagaatgctgggaattgagtgaatctgacccaggtgccttccggatcaatgcggatcacatcccccagaatgctgggaattgagtgaatctgacctcagtgccttccagataaatgcggatcacatcccccagaatgctgggaattgagtgaatctgacccaggtgccttctggataaacgcggatcacatcccccagaatgctgggaattcagtgaatctgacccaggtgccttccggataaacgcggaccatatcccccagaatgctgggaattgaatgaatctgacccaggtgccttccagatcaatgcggatcacatcccccagaatgctgggaattgagtgaatctgacccaggtgccttctggataaaggcggaccacatccttccagaatgctgggaactgggtgaatctgacgccagtgccttccagatcaatgtgaccacatccctccagaatgccaggaactgagtgaatctcaccccagtgccttccaaatcaacgtggaccacatccccctagaatgccgggaactgagccaatctgtcccaggtgccttccggattaacgtggaccacattcctccagaatgctgggaattgagcaaatctgaccccagcaccttccagatcaatgtgcactacacccctcccaatgccaggaactgaccaaatctgactccagtgccttctggattagcgggaaccccattcctccagatggtgggaactgcgtgaatctgacgcagtgctgtctggattagcgtgaaccccattcctccagatggcgggaactgagtgaatctgacccagtgccttccggatcaacatgcactacatccctccacgatgtgggaactgggcgaatgtgaccccagtgccttccagatcaatgtggaccacatccctccagaatgttaggaactgagcaaatctcatgccagtgctttccggatcaacagggaccacatccctctagaatgccgggaactgagcgaatctgacccaggtgccttctggataaacgtggaccacatccttccagaatgctgggaactgggtgaatctgaccccagtgccttccagatcaacgtgaccacatccttccagaatgctgggaattgagtgaatctgacccaggtgccttctggataaaggcggatcacatcccccagaatgctgggaattgagtgaatctgacccaggtgccttctggataaacgtggaccacatccttccagaatgctgggaactgggtgaatctgaccccagtgccttccagatcaacgtgaccacatccctcctgattgccagcaaatgagcgaatctgaccccagtatcttccagatcaatgtggaccacatccctccagaatgccgggaactgagcaaatctgacccaggtgccttctggatcaaggtggaacacatccttccagaatgccgggaactgagtgaatctgaccccggtgccttccggatcaaggtggaccacatccctccagaatgccagacagatgaaggacacagaaaacttaatagtaaaacatattttctgatacgcaggtacctgggaatctatagattcaggtttagtgctgtgggttgtccttttatacacagcacacataccacaaacacacacagatacagcatacacgcacacacacaaccacattcacatagacaagtacctcgcacacacatacacagaaacacacacaccacacatacacacagacacatacccagcatacttacacacacagcacacacacaaccacattcacacacacataggcatatagtaaacaccaactcaagcacacatcacacgtgcatggacaccccccccacacacgtggagatagagtcgacactatattagcttcccatgaattgatgtcataagctcagttaacatacgtgcccgctaagtacccttcagggatggcaatgctaacccgctgtagtttaaaagcttcagggaagacttgatcagtctcggcaggtattacaggcagaggcagatttctttttcctttttttttctttttttttgagacagagtctcactctgtcactaggctggactggagtgcagtgacacgatctctgctcactgcaacctccgcctcctgggttcaagtgattctcctgcctcagcctcccataatcccaattgggattacagttgggattacaggcacgcaccactacgcccagctaatttttgtatttttagtagagacggggtttcaccatgttagccaggatggtcttgaccttgtgatccactcgccttggcccccaaagtgctgggattacaggcgtgagccactgcgcccagccagaggaagatttcttatgctgcttttaaaacaaaagtagccacaagagttaacatttctagttttaactctcaaaaataaagtccttgtggattttatgatctcatttcagcaaatgtcactgcaaagtggagatgctatcatcccttagcagtgtgcatctgccttgggccgctggggccagccgctggctgctctgcaaggaagggtccctgtaagcaggacagtggccttccagggctgaggctggagaaaggtgctttgcctcggatgggcaccctttcttttagctctgattctgccccgtgccgtgtgcctctgagtgttgccttcccttctgaagctcaggcacatcctctcctctgctgccagctccctggtgccagttccctcctgcttccattccctgccttccaggcggggtgccaccctgtgtccccttacgattatctctctgcttgtgcaagcatcaccatctgcccacgacccttcagccaggacctgcagcactcagagctggccacagagactcgttccttccacagggactgtccagatcatcctaaaggttgggcagtggtgtgagtggctctcggccattcaggagtacctgcaggtggcagaaggtactccagagttggacggaggggccgtcccagggctctcggtgagactgagaaggttcatgagctccgtgttcctgtctgagatgaccagaaccagggcaggcctcatgtgtgccccaacttccgtaaaaccacacatgcatagtcacaagcggctccctgctttatgcattctaaagcaattcagcattccacatgaaaacgcagccgtgacggcactgtgtgattgataatgctctccgtgagacttacgggtccataaaccaaagaatggctataatcacccacaggtccatcatttctttatcctttacatcaaacatgagatggtcatagtcacaattcaataacaagccacgtatggctccatgaaagccaccagtgagagctgaacgtgctctcccagctactcttctctactagagcctgcaccccaccgactttgaaaagagataactgtcacctgggaaccgacactcctgctggggaggggaagccacctggggctggagactacagtctggaccctcaggcggcagaggagcgagccgagagagacaactgtggcttctgcctctcccagtgggagtgaggcccctggtcagagggcctgggtcgggggctgtgctgcccatggctgggtgggattttaatctaggctctcacaggtggtcacacagagcggccctgctgactcccatcaggggagatggaggccatacgtgccacagatcaatacgatgcccttccatgcacagctctggacaaaagctcctcctgggcatagtgtctgaaatgagctgcttacttttatttccaagaaaatgacaaagacgattttgacccctgacaattctttcagtcctggtcctcctgcgggtagctgagagcctaagtgaggtgtgtgggacagaatgaggtgctgggaaattactggcagtggacatttaccactgggttactcggacatctagagcacgaagtgagtgacacagaggccggggaccctccttccctcccaagtgggcacccctctgagaaattccctgcgagccccccagctctgtcttctatggggacttcgacctcgctccacgttgtgcagccacatggcccacaggaatgggcggtcctgctacatgggaaggagcttagggtttaacacgcctgctccaggagctgcgccacacacccgccttcagattcagcccggcgtgcctgggcttctgaagtcccagagcactcagcccggcccatccacggatggctgggacagagatttacacatacaagtcggatattctggggagctggaattcaaggatggacaatgaaagcccagagacagaatcctcatcagtgagcagacaaggctctggcagggatgttttgggggagcagtggttccttacaacgtgagcctgaaggagtttccctcacttagccctcagctgggggcaaaccgtggatgctggagagaggagcgtgaggcatacagaggcccaggtggctctgtgggggtcggacgcatgggtgtgtccccaccacccacagaagggtgctcgcctgagacacagggtcggccgtgaggacacagtttcaggaagcatccacacaaggggaacccacagggcacttgggttatacgaacctaacaaagagctaaaatctgagctctctccctcctgcgtccattcgatccccttggacgaggctttctggaacgtccagaataaagagaatcctcatttctcagcacacggacttctgatgtgagaagacagtgactgtgtgctcattaaaactcactcttggccaggtgtggtggctcatgtctgtaatctcagcactttgggaggccgaggcgggaggattacttgggcctagagtttcagaccaggtggccaacacagtgagaccccatctctacaaacaataaaaaaatcacccaagctgcctaaccgcccccacccccccgccccgtggcacaggatgtttcccagggcagagagtgacatggctgcggggtcccgctgcagaagaaccctgtgcagtgagggccacaggcctgggaccccaagccgctcaggaccgtgcacagctcccagatgtcccctggggggacatctcttccggaggatctttagggtccctttcagccctgccatctgtacgcccaccatggactggtgcctactgcctgccgcctgggcacaggtgcccttgcgcctggccctcagcccgcccatgtgcaggaggggttccggggcagccgggttacacgcgagagccccacgcgccggaggttccggggcagccgggttacacgcgagagccccacgcgccggaggttccggggcagccgggttacacgcgagagccccacgcgccggaggttccggggcagccgggttacacgcgagagccccacgcgccggaggttccggggcagccgggttacacgcgagagccccacgcgccggaggttccggggcagccgggttacacgcgagagccccacgcgccggaggttccggggcagccgggttacacgcgagagccccacgcgccggaggttccggggcagcccggttacacgcgagagccccacgcgccggaggttccggggcagccgggttacacgcgagagccccacgcgccggaggttccggggcagccgggttacacgcgagagccccacgcgccggaggttccggggcagccgggttacacgcagagccccacgcgccggaggttccggggcagccgggttacacgcgagagccccacgcgccggaggttccggggcagccgggttacacgcgagagccccacgcgccagaggttccggggcagccgggttacacgcgagagccccacgcgccggaggttccggggcagccgggttacacgcgagagccccacgcgccggaggtccggtttgtgcacctgcacacgggtcctgtctgtgctcccctgcagcccgggggagtcctggcccttcaccacgtgggaggctgtcctgggacctgaggactccgcccacactccatgccctccttcccttcctcaggcccacctgaccccggcagacctcctgctctcctctttgtcttctggccttgcaggcagctgtctaatgcagggcctaggcctgaggacaagcccccggggtggccaagctggctgcatccctgggaccctggtctccgtcactgggacgcagcagttctgccgggttaacctcagggggcatatgtgtctctcccatggccgtcattttctaccgactttgttatttcagcattcatttagtgcatatattccttttaagaggtgtctaaatccttcgtgggccacaacagggtagacatcaggggctgtagcctccagtgtctggggggccatgcaggccacatgagtggggggaggggctgcgtggtggaaggggggccgggcagctgggggcaccatgagtggggggaggggctgcgtggtggaaggggggccgggcaggccacatgagtggggggaggggctgcgtggtggaaggggggccgggcagctgggggcaccatgagtggggggaggggctgcgtcgtggaaggggggctgggtggctgggggcggccagtcctaccccaaggggagagcacacaggtactgctggctgggaatgcgggtctggggttgctcagatctttgattaagaaaatagaaatcaggcatttgtattatttatgtaaaatttctcaattttgaaaaccctcattgagctcttagagtacaaactgtgtcccctcaagaggatatgttgagtcttaaccccaggacctcagcatgttatgtaacttggaaaaaggaccttcacagatgtaatcaagtgaccacgaagtctctggggtaggccatgaatccagtaggactggtgtcctgatcaaaaacggaaatttgaggctgggcagggtggctcacgcctgtaatcccagcactttgggaggctgaggcgggcggatcacctgaggtcaggagtttaagaccagcctgaccaacatagtgaaaccccgtctctacttaaaatgtaaaaattagccaggcgtggtggtgggcacctgtaatctcagctacttgggaggctgaggcaggagaattgcttgaacggaggaggtggaggttgcggctacccaagattgcgccattgcactccagcctgggctgtgagagtgaaactccatctcaaaaaaaaaaaaaaaaaaaaaaagggaaattcagacacagacagacgtgcacagggagcgggtcacacacagaggcagggactggagtggggcagccacaagccgagggacactgggagctgtcaggtgctggcagaggctggaggaggagggagcacagcttcagacatgctctcagacttctggctcccagcactgtgggagaataaacgcctgttgtttgaaggcccctaggttcatggtacttggtgagggcggcctcgggcagctcacacatgggccacacagaacgtggctgtgggcgggattgttctgggtgagccatgcgcatcccctgctatcagcaacacagtggactcacactggctctaaaacccctgaggtcgtttccatctgatggtcgcacttgggcagggctcttctggtgccagcgggagaccttactcagaccctcatctccatccacccctcctcctcctagcactgcatggtccaaaagtttactcaacccaatgacgcatctttaattctattattgacaacatcgtggaatataacagaattgaggaatagccccacggcacgtttctagagaacccctttgcacttaatctattttctcctcattaagtaattatttaattaatagcctgtaagaatagtgtacgtaggtagaaatttatctaacggcatgatcgttccaagtctctatcttttcttttggatactttgtaaaaaaaaaaatcattaaaatctatacttgtgatgtcaacagccgttcctccatctctcagcaagaaatgccatcagcaaagagacggtgtgacgcccggctccctccccgtcactgatacggcctaggatctcaccagggaccaaggcaagcacactggtctgcggttcccacaatctacctgtaaccctttctgaatgtttgtccaactctcttattccggcgtctttcccaactctgccaatccctcagacattcccgacagctgtggccagatccagctttgctacggacacggagccacagaactggtctggacatggagccacagaactggtgagagccccacgaagcagctctcgtgggctgtgccctccagccctcacatggcacacacctgctgctctgcagagcacgcctcgctccccttcacgaaggagcggaaatacaatggcagccgcgaagctctggctactaagatgcattatctgctccaagctttcaattgagtgattatgtcttaaaagaatcacataaatgatacagctccacattttgaggtgtgtaaagccacgaaggcatcgtcttctatatcttattcttgctgactatatgacgatgacattcttaggtgagctcactacctcatggcatcaactctgcagagacgtctcacaggtcacgttagaaggctatgaaaaattaaaacacataaaaaacaatgtttaaacctgtgtgcatcactgagtttgacagacacagtgtatggatgccagattagttcgttttactgtcagtatagtacagtccgttaaactgcgcatctttgatgagttactacctgtggggtggcacctgacccaggccaggacagtctgagtggtccttcctttcgccctgtgcagggctgggcttgcgacctcagtctttcccggcagctctgcttggcagaattgagggatgtctccattttatccagggcgagctactataggaataacaatggaggcttaagatctgtagaaaaatctatgagtttaggaattgtgattcctgatttttattgagtaaaatgctcaccctaatttcttcaacagaaaatcaatattccaaaccctccagaaatctggtatttgcaggaatcccgacactcactaacagaggtggcacaaaaggccctgaagtcagggatccctggggaacgatgcccagtccgacgtgcttctcctgagccgattttgggtttcccgttttctaaagccagctccccagggaacggcgcccagtccgacatgcttctgaaaggattctaggtctcccgctttctgaagccaactccctggggaacggcactgagcttgaggcgcttctcctgagcagattctaggtctcccgctttctgaggccatttccccagggaatggctccaagcccgatcacttctcctgaatgtattctgggtctcccgctttccgaggccagctccccagggaacggcgcccagccccatgtgcttttcctgaatggattctccgtctcctgcttttggaggccagcttcctggggaagagctctgagcccgacgcgcttgtcctgctttctgagcacttgaatctggtggcttctgtgtcatcttcactctgaatgagtgaaatgtgtgcttaaaatggccttgagaaaagcaccccctgcagggtgggagagaaataccgacaggtggggagggctggaggcgggagtccaggccgtgcgcccaagaggagggtcgtggtgggaatgaatgaggcccagggagtgttgggagacaggccggcggccgcgggaaacccctcagcaacctaccagcacagatgcaaggacactggggtgccagtccccccgctaccataaaggaagaagaggaaaacagaatgaggcaaagtgataggggatgaagggcatgaggaggctgctgtgtgctcgcagaggaggggaggcccccggttctgcttggcgctggctactcttcttggttgttgttttctaagtgctgttgactgctggctggacctcagtgaatgacccttctgctaaagctgccaggcactgcgctggtgtaagctgatcatagctccatcatcccaaatctaaaccactccagaaacaggccggcccctgctgcaacagcaagttgatctgtgactttgggcaaatccactcagcgccagactgccaagagaaaacggcggtctccgccgtccaagcagcacatcgtggagggcctacacaccccgatgttctgggggagcacttacatcttcagcaatgcctgtcaagatggagacagactcctgtgctgaggttgcagggttgcactctgaaaagacacccagggcagcactccaggcaggctgcatgctccggggagacacagatggcaaggagcagggcagcgggcggcctggaggtacagctacaccagctctggggttccacgctctgatctgacttagctgttttccaccctaaccccatgtgagacagccactgccccaaaactagggatgggaaccaaaacctttgagaagcccacgtgggacatgggatggcctgtgacccatcagctcccgggccatccctttgggttcagccacaggctgggggtgggaggtggtgccaggacactgtgggcatcgccttgggctgaaaaagggggctgtgaggaactcatacacctgagtcctcgtcctaagaagtcgcagttgttgggtgggccatggccacgaagactctgcgggaacactgcctggtcacacagactctgcaggaacactgcctggccacgtagactctgcaggaacactgcctggccacatagactctgcaggaacactgcctggtcacacagactctgcaggaacactgcctggccacacagactctgcaggaacactgcctggccacgtagactctgcaggaacactgcctggccacgtagactctgcaggaacactgcctggccacgtagactctgcgggaacactgcctggtcacacagactctgcaggaacactgcctggccacgtagactctgcaggaacactgcctggccacgtagactctgcgggaacactgcctggtcacacagactctgcaggaacactgcctggccacgtagactctgagggaacactgcctggccacgtagactctgcgggaacactgcctggtcacacagactctgcgggaacactgcctggccacgtagactctgcgggaacactgcctggtcacacagactctgcgggaacactgcctggccacgtagactctgcaggaacactgcctggccacgtagactctgcgggaacactgcctggccacgtagactctgcgggaacactgcctggccacgtagactctgcgggaacactgcctggccacgtagactctgcgggaacactgcctggccacgtagactctgcgggaacactgcctggccacgtagactctgagggaacactgcctggccacgtagactctgcgggaacactgcctggccacgtagactctgcgggaacactgcctggccacgtagactctgcaggaacactgcctggccacttagactctgcaggaacactgctgttacctctcactgcacggggactcacagacacaaagatggtcattcacagcatcaccaaaatcgatccacgaggctttgagaaaatgcatctctaaaaaaagcacatttggtgggtccaacaagcctcacttattcacggtcctgaactcagtgcatggaggcaagaggcatgtcggtgacccagtgagggaacaactgcacatctggggcaacagcctgatggtgccgtgggagccacgggtgggtatcctgcaaacatcagcttggacactcagcacctgcatgggacatgcatcgccacaaggtcacaggtgggcacctgggtgctgcagggtcagctgacttagtcaaaggctaagcctgcagtgagtgtccgagcctgcaattgaccgcggaagccagtgccctccctagttggcaacgttgttcagctgagctacagagaaagagctcggaggtctatggactccttcatggaaatcgctcccttgcgtctcctcatgtggacacagctccacgcctcacctctcaggccaggcagcggccaacccagcctcttcaccaggtatgggcaccggctgctccttgctgcaggaccgctggctggggtggccggggcacgcagcaggcacatcccgacctgcgggccagcacctgcgccccatccctgttacacctgttctgaagccttcaagagcaaagactgatgttcatcatggccaaagcagctgggctctttactacggaaggagattaattgctaccccgcgtacctttcagaggtttatatgaagccatttttcggtatttctctaagtgactgaaacatgcgcagccatttcatgtatttctacgcgtgtgggcaggcggccagggccctgggccacattccccagaaagccacgtctccactctggggaggggaatgcttcgtttttctgtgagtggtgaggtctctcttttaacctgttataaattaccttttgtaatctctcctaaaccattatatagaggagggaggggagacaaagaataaatacatctgtaataaatgtgggatttgggaaagatgataagatcagaacaatttgaatgaacgtggcaaatgaatttagagtttttgaactatcagctatttctgcaaataatgacttgtagaaggagaggctatttttaaaacaattcatgttctctgctttcatgtgaaggaaataaaacaaggcactcatgaatgagctcttcaagcacggactttcctggagctcacaggaaggggccagcacaggtcaggctggaggcacagtctgattctacggtggcttcacagggcgtgtttggagagcgccttcctcctcccaaccctgcagtccccggcctggctccaggtctgccccgcagccctgaggtgagtctcagcatgtccaggcgtctgaggtgacactgcagcctctctccgtggccctgtggtgagtctcagcatgtccaggcatctgaggtgacactgcagcctctctcggtggccccgtggtgagtctcagcatgtccaggcatccgcggtgacactgcagccactctccatggccccagggtgagtctcagcacgtccaggcgtccgcggtgacactgcagccactctccatggccccggggtgagtctcagcacgtccaggcgtccgcggtgacactgcagccactcttggtttctcagctgccgcaatcggtccttccagtgtccgacctctggggccctcagacccccaaacccaccttgtcgctgtggcctctccgcctcctgcaggtggcagcgctactgtagcctgccatgccccaccccttgcctccatccccacacattgccctgtttcttgggcagccatcttctggacctctccctcctgcaggcgtctctggccctgggggctccaggagggggtctccccaggagcgtgttccccagtgcatggcccctgtcctccaacacctgctcaggcctgcagccaaacccacatctcccattcctgcctctcctgagcaggaagccccatgagagggtccctttacaattcgtccaggctggccctgggccctgtgtggccgcaggtggtcacggaagccccacctgagcttccaggcccctcgtgccaggacttctgaaggttgtgcctgactcacgtctccattctcgacccattaaagggggagcggagatcgtgcttcccaagggaccctgaggccttctctctaggtctgagaagtgggaagtcccccattgggagtggaaggccaaggccacagcactgccgtcatgcgctccagagaaaggtcacctgccacccttctgtgtgcttacatgtctgtcaggacagcccggctccggccatgccctttgcacatcccggcctcctgggaacgcggagaacttcgtgcctgctgtccagttcttggcatccgggagctccagctggcatgaaggcagaaagaataacagccagtggcagtggaaggcatgagcgcccccggagagcagggccagaccatcagcagggcccctccaagaggagctctgtatgccgggggagtgggctcggcccgcgggacaaggctgaaagagctccccagacccctctctgaagacagcctctgcaatctccggccttcccgcagttgcccgcgtactttcttcattcctcaaaggtctcattaatttacagtctaagtggaccaagagagatgttacatatgttaccaggaagctagcatgttcattaattaatttctgtctagtcatccaatatttattgagtccttaagtctgaggcattataatagttactgctgtggggtcatacagataaataagacatggttcctatttctcagactcatcacccactggtaagacagccaccgatggaaacgactccaatcgactggaaaatagagaggaaattcctttggaatttaggggaaagaataagacttttggctggggtgtcagatattcgcttataggagcaatttcttctcagctgcatggcaccaccagggaccaggccccggggccagtccagatatctgcagtgttagcgagagacgctgttgacccttcttggcttatcatggaactgaatttccttaggttcagttggtagctaccctcgccccatcatgccgcggtgacactgcagccactcttggtttctcggctgccgcaatcggtcattccaatgtccgacctctggggccctcagacccccaaacccaccttgtcactctggcttctccgcctcctgcagctcctgctctgtgtttgggaacgcgtgcggcccacaggacaaagccttgttgcacacccgggtcaagggcaaatcccagctgcacagccgggtgatccagcggccgaccctgcttccctgcgtaggaggcctgagccaaggacactgcggccccggctgcaccgatgcatgggtgtgcacgcggggaccgagggagtcacgtgaatcatgtggcttccacgagctacctcttcccacaccaggagcaggtgccctcgtctccatcaagcgctttctggggagaaactccttcaaggataacggcaaatggtgagcgtgcctcactctttataatagaaattacaaaaagatggagaaacaggcagaatcccacccattcctgtggcaaagccgagaccctcatttccagtctttctgggacagcggagccctgggcaggggacaccgtgtgactggctctagctctcctaaaacacgggacgcaggagtgtttcttaagtgtgacaaggtgaaagcccctcgcgagttgaggaaggtctcattacttctgacagaggccccatgttggggaggtaggtgtgggggctcggggaggtgtcaggacagcgggatggacgtgggtccacagagctgactatcacagccgctcaggatgcagccgtggtgtgtgtgctctggcctattttaggtacagatataaaacagaagacttcggggcaaaaggaagtcttagaaaaatataaaggaatagaaagaaacagctgttccccggcacagaaaattcctgctaagaacacacaacgggcacggtgtaggcccattagtgttgctctgggtgctgcatccacaagggagatttgcttcttcagaaatgtcaggggtgcctggtctgcaaggggcttccctcgtcggaaagtctcccatccacatcccttcatgtgccatgttcgcatcatgagcaatgttgtaatgaacagccacgcacttcattctttgcacatctcaaagaattgtgtccttaggatgaagtgtcaggggacgagtgtccatgccaaagcatctccacacgtcgagagcttcggatgtgcacagctgcgttgcctcctgactgtcagccgagcccagcgtcccaccagcaggagccacagcaccgctgtctgttcccaccgatgcccagtgtcagcgtccactgagtcgcagctcccctctacactgggtgtgcccgagcttgctgcatgggaggaaggtggctgatggcaagggtgtgtgtctcgacactgtggctgcagcacggtttcctcacagatgtttggggagaggctgagaggacctgcctgccctggagagccgggtttctgcctagggctcctcctgtgctcctgctcccaccccaggggcctggggctcccgctggaggatggtggctttgcagacccttccattttattcatcgtgttacagagcattctaaacctccttccttctagagtagaggctcaggggttaagggatatgtgtcttcaaacgagaacacttcattcaacagacttttcccgaagaccacgtgctgtgcgcagcctgacatgtggtgctcggccgcaaaagcgcttcagtctcgccccccacccccggagcagccaccaaccaagaaacattgtctgtatctggcagcatttggtccctgtcatgaggttacagtgagcccctggcccccaccctcacgtgtctgtgaggtcagctccccacgccctggtcctccccacctgcgaggaggctcgtggcacccacttcacggctggtgggaagacgggtgagaccacgtgtgccatgtgcctcatatgctgcctggcatattttgggtgctcacgaatgctgactgcagcctggcattgggaagggagtgatcccgccagggaggggaggcctgacagaagacatggtctctcagggggggtcctgatgtcatgtcagatggagccagggccaggggcagggcgggggtgcaggggctctcgaggcagaacctgggacccagcgcccatgtcggtgcagttgggaaaggtgcgtggctcccgtgggtggtgcagacgagcagtgaatgaagatgaagctggagtggcagcttggcccagatcctggaggctttgcgtttgcactgaaatgtgtggacttgacgccagaagcaactcctgcgtggcccgagtgtgggcctgggcggccctccattcctcggcagggcactgcctatcgcagcatccaggtgcagccgggggggacaggggtgaggagggaaggaggcatgagtgccagcctccccacacctgggagagcagcctagagaggagtagagggcagcaggggcccagtctgtcatccagagaggcaagggagaaggcaggggtgagcgaggcggtgcagggtggggctctgctcccacgggttcgatgtggggccatgcttggtggtggggccaggctgtgtcacctgtgaggtcacccctgttcctggcacctggtaggtcactgaatcaacagcccaccgccagcagggcagggcgatgcattttgcgtccctggctcaactgcagagtttcgttaccatttcccggaaacccagactctcaccaatgcagatggtctcctagctatttttaatgagggaagatttgttggaagcacaaaattgaattaagtcacattcagaaattctccttcaaagaggaactcacacagtcaagctgagaaagccagcatctgaggatagcggagctgctctgtggtgaacatagaatgtggggccctgacggactgtccccttgccctgacgcctctcctggcctctgcccccacactctggcaccagaatgtccacggggacagctctggtctggcctggcctgagctgcaggctctcctgtcacagcactggctgaatgcctcccctggtgtcccctggcctttccccggctggccacctgtcccccactgagctcacggcttctccctgaaccagcttctactccagtcccaaaccagctccacactgtggctctcggccccgtgcccctctccccacaccagcatgtcactgcgctcgccggctgtgttcccaagcactttctccctcctctcctttctctaccacagcccaggccttcctcacctcatgctcttcacccatccacctgtccatccttgtccccggagacgctgtcatcccacccaagtgacctgccagccactgtggaagttctatgcactgcagatgttaaacgtgaggctttttcctactcagggatgtgcagtcaaattggtgctcagatggagtctgatgaaaggcaagctctggaaggaacacggaccctgagcaagtgtgagagacgtaagccagcaatgaagccatgccccaaagcgaatccaccaccatccaattcccgctcatacacagcaggccagaaagacttccacgctgcacacaacgctcagagcagaacgtctgggaatcaatctatccaaatttgatttaatttatgtggaatttagagacctgagacctgttgatttatgtagaatttaggcttcccccgtctgaatcgcgctggtgtatctggaatttaggcttcccccgtctgaattgtgctggtgtatctggaatttaggcttcccccgtctgaagtgtgctggtgtgggtggaatttaggcttcccccatctgaatcgcgctggtgtatctggaatttaggcttccctcgtctgaattgtgctggtgtgggtggaatttaggcttcccccgtctgaattgcgctggtttacgtgacatttaggctacccccacctgaaacacatttatttgcagacgcttgcttacaaatagcagcctgaaactgttcattttctcttgtaattcacaaataaaacaggaattacgaacataaaacttctataatcaaacgggtaaggatattagccatcaggtcactgaaagctttgtttgtctattattggagccaatttcctggttaaatttactttacattttgatatgtattcagttctcagataaacacactatggaggttcctcagtgtatgatggggttacatcatggggttacatcccaatgaacccggtgcaagtcgaaatgtgctaggttagagacgtactggatccatataacctgctgagcatcacagctcagcccagcctgccttacgtgtgctcagaacactcatgcaagcctgcagctgggcgaaaccatctctcacaaagcctgtttatgataaagtgctgaagatatcaggccatttcttgactactgccctgaaagtgaataacagcgtagttgggtgagcactcagagtacagtttcacaccactgtaaagtgagaaatactaagtccaaccatcctgaggcggggaccatctgtgtattgttgagtctgctttccatgaatcatgcttcttcttacatgataaatttaaagtaaattaaaaggcatgcattacatgttaaatgggacagagtcaatatctggcttgaaatattatcaatattttaaagataatattaactaaattttataaccttaaaaatgtactgatctgaaataaaattctcgtgtccttaaaaataacctgctttttcccatactaaacaaaaataaactgacttttaaaaaacctgtgggggaaaggacggtttcctcaacaggtggttctgggagaactggatatctacacgcagaggagtgagccagaccctcgcctcccaggagaactggatatccacacgcagaggactgcggccagaccctcgcctcccaggagaactggatatccacatgcagaggagtgagccagaccctggcctcccaggagaactggatacctacacccagaggagtgtggccagaccctcgcctcccaggagaactggatatctacacacagaggagtgtggccagaccctcgcctcccaggagaactggatatctacacacagaggagtgagccagaccctcgcctcccaggagaactggatatccacatgcagaggagtgagccagaccctcacctcccaggagaactggatatccacacgcagaggacggcggccagaccctcacctcccaggagaactggatatccacacgcagaggagtgagccagaccctcgcctcccaggagaactggatacctacacccagaggagtgtggccataccctcgcctcccaggagaactggatatctacacacagaggagtgagccagaccctcgcctcccaggagaactggatatccacatgcagaggagtgagccagaccctcacctcccaggagaactggatatccacacgcagaggactgcggccagaccctcacctcccaggagaactggatatccacacgcagaggagtgagccagaccctcgcctcccaggagaactggatatccacacgcagaggagtgaaccagaccctcgcctcccaggagaactggatatccacacgcagaggagtgagccagaccctcgcctcccaggagaactggatatccacatgcagaggagtgagccagaccctcgcctcccaggagaactggatatccacacgcagaggagtgtggccagaccctcgcctcccaggagaactggatatccacacgcagaggagtgtggccagaccctcacctcccaggaaaactggatatccacatgcagaggaatgagccagactctcgcctcccaggaaaactggatatccacatgcagaggaatgagccagactctcgcctcccaggagaactggatatccacacgcagaggagtgtggccagaccctcacctcccaggaaaactggatatccacatgcagaggaatgagccagaccctcgcctcccaggagaactggatatccacacgcagaggagtgtggccataccctcgcctcccaggagaactggatatccacacgcagaggagtgtggccagaccctcgcctcccaggaaaactggatatccacacgcagaggagtgagccagaccgtcacctcccacccgagcgtgcgctgactcacagcgaatagcagagtggctggacgcacacttggccagaacatacatgaactcagagctaaatgtgagacctaaaacatacagggcaagacctttatgacattggatttggccacgatttcctggatataacaccaaaaacacaggcacaaaagaaaaaaatagataaattgggtttgatgacactcaaaacgtttgtgcgtcaaagcgcaccatccagagagcgaaaagacaacccatataaagggggaaaagatttgcgaatcaaattgcagtgggggattaatatccagaacatgtaggaaacttccacaactcaactacaataacgatggaaaaccatctcgttcagaaaacacaaagtacttgaacacatgtttctccaaagaagacacacaaatgacctcaggcacaggcagaggcgcttggcgtcaccaaaatcattggggaagcatgattcctcagtgcaattccacctcatgccatgtgcgtgactcttaccgaaaaaaacagaaagtaacaggtgctggtgagaaggcagagagatgggaacactgcgctattgcagcagctagggagaacagggtggcggttcctcagagttagaaatggaattcccataggagccggcagccctatgtctgggtgtccatggagaacaactgaaagcagggtcttgaagaggtatttgcacgccaggttcacagcaactttatgacagcagccaaagggtggatgcaaggccagcatctgtggacggatggacagaggagcaaaatgtggtccatccacactgacagatgtcaccagccctaagaggagggggtgcagacatatggcataacatggggagtcctgaggacatgtgcccagtgaaataagccagtcaccaaaggacacatacagcacaacacagggaaccctggggacactgcccagtgaaagaagccatcactagaggacacagactgtgtgattccacttgtgtgaggtccctggagtcatcaaactcagagacagagggtagagtgggctgccggggtggggggaggaacaggggtcagtgtttactggggacagagttccagtttgggatgatggaaggttctggaaatgggtggtggagatgctcgcacaacgttgtgaacacatacaatgctaagaggcgtgcacctaaaaacggttaggacgatccattttctgttttgtgtcgtttacgtaactatgagattctgtattactgagaaaaaggcttgagagaaccagaagtgtcacgtaaagtgtgaggcgtgagccgtgagcagtgattgagcccagacccccgcgaccagctctgctgctggccctgcctgaagctgcagcagcccctgcccttggacccctgagtctgtggggcctgcactgctgcatctctggctgccctgtgcccagaaacccaccctccatccttccacactcagagcctcctcccagctgagcaccctcccctctgctatggggcatctgtgggccccccagctcccaccctgcagacgtctgtgggctctgcctctcccgtctacacctggaggcccagaggggctcctgagggccacctggtacccggtgggtacccagcgagggtctggcaaggaggtcagctcagctgggcagacacatgcagcccggaggcctggggtgtccgggtcccacgaagccaggagaacacagatggggccgactctgccgcgcggtctcctcactgtgcttcctgcaatcatgccttgtacagcctcctgacaggccaccctcagccccatgtggccagcagcaagggctgctgttgcaccccaagcctctccgtctaggggaagaaggcgcgtgaagatctttctcagaaaggacaagcccacagcatctgcgtcggtgcctcctgcctctgacagggctcctggcgcccatggcggctggggtttcacgggggcgaggggctgggccacacttgtctgcatcccggggcccttggctcagtggacaaaacagctttaaagttcaaggataactcaaattggattttagaaatacaaagtcttaaaacatttgtaccagactaagggattacactcttaacttatccacagaaaggcttttgaagaggtggggaaaggtagctcagattttaaattggggcctcaaaacctgcctgtctgcggctccttcctttgcctggctgctattatcaaaaggtaaaatgtcttagactattgaaaaaaggatttgcataaattgcttttacctgcttcttatatgaggttaatgaaattggaacaaaaaggaatgaattcccaatcccagaccagaacctcaaatcccccagaagagacttccatgagccccactgagcccaggcatgaagaactctttctctgggtccaggagtggcaccaccttaatcagctctcctcataaatgtcccaaggagaccaggaaacagcctcgagggagacggcgctgacccggggccaggggagtttggctcacgtgatccagtcacacagaggtcggtcgttgtctggacacagacaatgggaatctgggctgataccgggcctttgaaaatagtcggggaggaaaacagaaaagatgcagaagttgataattgctttgatatacccatctctgtttttttttttggacagaattcctattaaatacaatatagagtatttcattttctgcatctgcccatctttgaatcttcatgtatttttaaaaaagaatgaatttaaaactctaatccacttggcccagatttgttttgggaggcaggtgggaacccatgagctgtcttgagcacagtggctggagtctgtgcggtggctggaaccctgggctctggagggctggatgccttcaggtcccggaccccccactctgctcccgtggacagctccatcttcagcagctccgtgcatagggactcctgggaagacttctctttgaggaaatgtttccgctgctaaaatgcaaagttccccgaaggcaggtgggcactgtgctggtgctgtccgagtggagcctctggtgagccggacaccatcaaacaacatcagagcttgcaaaaggagctctgcagtgcctgagacctgcaaagggccatcctggggtccgagggcttcctggtcctgacccagtcctgcagggaggtcctgggagggtcgctagggtgaggacgctgagagcccatgtgctggaaaggacccaggaagagggctgaggtctcacgcctggcagagatggtgcccaggtagtgactgcaccacacccataagggccacctgctggccacgtggaggacggggagcggcaggcggatgagggaaggaccgtccatttgactgggccacaggtgtttagattaaacctgatccacgtgtgtctgtgagtgtgactcggaggagtccagcattggattcagtgggccaggaacagggcattcttctctccagggagcagaaaccacaagatagacatggcccattgtgctcgagggtcactttcattggaagatttagagaaaatgatttttatacaataacgatatgggcttatagggtaaagtccacattcgcataaaattttaaccaagtagggacagagcctggcaattctgggttctgagacccctggggatggcacctgagtcccactcaggccaccacccctgcccccccccgggcactcggggtgaagctgtgtcactgtggctggacacatgtcctggaatcagagttgctctttaactgtgtctggctttaaggctcgtcttctacgccagacaaagtaaacttcctggaactgttttttgaaatgtggctactgtcctttcctcttctagaaaaacgaggatgaggagccaaaacagaggagggtgtcgcaagcggcagacatttgaaagcagcttaagcccctgagccccctttctggggttcctgggcaagaggtcgcacgcctggccgaggtggtgccccaggggtgacagcggttgccctcctgtatggcacaactgaaaataaaggctgggccatttccccctccatctgccaaaatcccattactgaggttgtcaaaatgcttcaacctctcttaaaatgcagtgagattgcttcacgatgaagggtatgaccaagtggaattgtacacggtatagttaggaggtgatgatgaccacagtggggtctttaaaacagtgcacggcccgcctaggggacagagccggccctcccaacacttccccgctacagaggcgttctgtggccccggggctgctccccgcctgggcacatggcggagacatgcaagccacaggggagggctctgacctcggcgtggctcccgccagggacctggcagctcttccgcttgttctctctctcattcctcatggggactgcactaggactttccccttctccccaactccccacccaatgccccctcttttgtggcaggtgagctcacgtcctgctctgaagagaaaatggaggtgccacacgtggtctcctgaactcccagccctggacgagggggtcctgtctcattcaagtaaaccccctgcagttcccagcagccttaggacagcaggctcctttacgacttcacctctgcgctgcccccactgagaagctcctgctaacctcgtccagttgtcaaatcacttcttagcatgcaaaaccttgcccgcatatcagctgctctgccaagcccaccctgagttccgaggaaggtaatcgaggtgccttcctgaaggtctgcaccaggcagaaagccctgttacagcctagttgcatcgtgtgacaactgcctgctcataatgtgaactctgcggtgactagaaccgtatctggcatatggcagacattcagtacaaaacccatggacagaacaaataagtaagtccagaggtctccctggggacagggcctgtgttactcttccttcccacgcgcccagcacagttaccctttcccgtcccatgcgcccagcacagttaccctttcccgtcccatgcgcccagcacagttaccctttcccgtcccatgcgcccagcacagttactcttttccaccccatgcgcccagcacagttaccctttcccgtcccacgcgcccagcacagttaccctttcccgtcccacgcgcccagcacagttaccctttcccgtcccacgcgcccagcacagttaccctttcccgtcccacgcgcccagcacagttaccctttcccgtcccacgcgcccagcacagttactcttttccaccccatgcgcccagcacagttacccttttccgccccatgcgcccagcacagttacccttttccgccccatgcgcccagcacagttactcttttccgccccatgcgcccagcacagttactctttcccgtcccatgcgcccagcacagttaccctttcccgtcccatgcgcccagcacagttaccctttcccgtcccatgcgcccagcacagttaccctttcccgtcccatggcccagcacagttacccttttccgccccatggcccagcacagttactcttttccaccccatgcgcccagcacagttaccctttcccgtcccacgcgcccagcacagttactcttttccgccccatgcgcccagcacagttaccctttcccgtcccatgcgcccagcacagttacccttttccgccccacgcgcccagcacagttactctttcccgtcccacgcgcccagcacagttaccctttcccgtcccacgcgcccagcacagttaccctttcccgtcccacgcgcccagcacagttaccctttcccgtcccacgcgcccagcacagttaccctttcccgtcccacacgcccagcacagttacccttttccaccccacgcgcccagcacagttacccttttccgccccatgcgcccagcacagttacccttttccgccccatgcgcccagcacagttacccttttccgtcccatgcgcccagcacagttaccctttcccgtcccatgcgcccagcacagttaccctttcccgtcccacgcgcccagcacagttaccctttcccgtcccacgcgcccagcacagttaccctttcccgtcccacgcgcccagcacagttaccctttcccgtcccacgcgcccagcacagttaccctttcccgtcccacgcgcccagcacagttaccctttcccgtcccacgcgcccagcacagttaccctttcccgtcccacgcgcccagcacagttactcttttccgtcccacgcgcccagcacagttactcttccgtcccacgcgcccagcacagttaccctttcccgtcccacgcgcccagcacagttactcttttccgtcccatgcgcccagcacagttactctttcccgtcccatgcgcccagcacagttaccctttcccgtcccatgcgcccagcacagttaccctttcccgtcccatgcgcccagcacagttaccctttcccgtcccaggcgcccagcacagttaccctttcccgtcccacgcgcccagcacagttacccttttccgtcccacgcgcccagcacagttactcttccgtcccatgcgcccagcacagttactctttcccgtcccaggcgcccagcacagttactctttcccgtcccaggcgcccagcacagttaccctttcccgtcccatgcgcccagcacagttaccctttcccgtcccacgcgcccagcacagttactcttttccgtcccacgcgcccagcacagttactcttccgtcccatgcgcccagcacagttaccctttcccgtcccacgcgcccagcacagttactcttttccgtcccatgcgcccagcacagttactcttttccgtcccatgcgcccagcacagttacccttccaccccatgcgcccagcacagttactcttttccgtcccatgcgcccagcacagttactcttttccgccccatgcgcccagcacagttactcttttccgtcccatgcgcccagcacagttactctttgccgtcccatgcgcccagcacagttactctttgccgtcccatgcgcccagcacagttaccctttcccgtcccatgcgcccagcacagttaccctttcccgtcccatgcgcccagcacagttaccctttcccgtcccatgcgcccagcacagttaccctttcccgtcccatgcgcccagcacagttaccctttcccgtcccatgcgcccagcacagttaccctttcccgtcccaggcgcccagcacagttaccctttcccgtcccacgcgcccagcacagttactcttttccgtcccacgcgcccagcacagttactcttccgtcccatgcgcccagcacagttactcttttccgtcccatgcgcccagcacagttacccttttccgtcccaggcgcccagcacagttaccctttcccgtcccatgcgcccagcacagttaccctttcccgtcccatgcgcccagcacagttacccttttccgtcccatgcgcccagcacagttaccctttcccgtcccatgcgcccagcacagttacccttttccgtcccatgcacccagcacagttaccctttcccgtcccatgcgcccagcacagttaccctttcccgtcccaggcgcccagcacagttactcttttccaccccatgcacccagcacagttactcttttccgtcccatgcgcccagcacagttactcttccaccccatgctcccagcacactcttccgtcccatgtgcccagtgcagtcttccgtcccatgcgcccagtgcagttactcttccgtcccatgcacccagcgcagttactcttttccattccatgcacccagcacagtcataggcttccagggtaggtactgtcaatgtttgttccaggaaaacccaattcagcttttcaaacaagatttatacacaccttcaggagcaagcatgcttgaatataatgagtctacctttaaggtaaatttcagctctttgggtttgtaatggatggaaaaaggcaggcaaagaaacaatttcaacatcttccagccccagagatgtacaaatattttagcaacatcccagtgactaaatggtgattcagccgagacgccccaaataaacagtctctattcttaactctgctcccatcttactgaagcgttacaaggctgtacttacatctggggtcaagccattctcatttggcttcgaaatgataacacaaaactgttacaataacctggaactgtaagggtcctggggatcccacattcagtcccacccgtgtcatggatgaacccgggaccagcagggcagccagccagaggcaaacccacaccaggacctggcgctcggccatgtgcctgcgttttccaatattgatgtcgacgtgggaggcaagttgctatggaggaaacgcgcacacacatctgagattattaaatagcagccgctaactgcctcgatgcaggagtcccatctccccaaacaaattctggctgtgatgccaactgcagcaggacggttagtggtgccgctggcaccgagagcacctggcctggtggacctgtctcccagacctgctggggagcgccgtgtgctcagctgaacacggctcctgtggccacagtcctgtgttgctcccgtggttcggccggcgaagctccgtgttcatgtgcacagccacattggccattttgacccaacagacactcaagcaactcttgcgtgaatttggtgggaagatccatcgaatgtattgtttttggactaacctgatgagtccctttggtaaagcagtcccactgactatgcctgtggacccagctgggtgcagccatctctgactgtatggtgtccatcctgagctccaagtcatcagagagcggccaggagtgcatctgactttgctggtgacctgcatcttatctgcgtccacactcaactgtgtgcagcggcccaggaaggtggagggctgctgagctgctttagaaaatgagggtttgaagctgccctttggaaatgattaggttgttcaaaagtaattgagctttctcaaaaggcagctggggctaaaataaatggaagtctacttaacatattgttaaaaatatgaaggggttgaatggcatcaaaacacattaaatgacagaacatgactcgcctccttggctggattctaaactcctcggggcaggcgctttctttagtgacactctcagtgttgtttgtgggagacgctccgcaaatgtggggagcaggtgggcgcctttggtccccgtcctcctggcaggcagtggctgagtaccttctcgggaaaggaggcccccgtgaggctgggtgggctctgaattcccggtgtgttgatagcgatcggcacatgcctcaagccacctggaagagaagctgccccaagattctccaggccctttctgagctgaaggtgacgtgacagacaggcttcaaagaagggtcagagacggccggtgggtgggccccgttcccaaacacccaccttggatctcatgccctggagcagagcatgtgtcctggtcctgcctgggcgaggccggcacccgctgccctagcttcaccactggtagccccaagcatctctggctggggatacatcacccgatcacaccagcccgagaaccttccctttcccaccaccattcaaaggaggctgctcttagccagaaggcctctgtgttccaggcttaaatctgggcgagattcagggtttaactctggccttgcagttttagaggttgttataggctgaattgtgaccccccaaatccatccattgaagctctgatccccatgtgcctatatttggagacaggacctccaaggagctaattaaggttcaatgaggccaaaagggcggccccgatcctacaggactggtgtccttacaagaagagtgagagacaccccgtgcctgcaccagggaaaggccgtgtgaggacatggggagaagatgctgtccacaagcccgggagagaggtcacaggaagaaccgcccccacccccgccgccccccacagcttggtctgggactgtcagagctgtgagaacagacgtgtcctgcagtttaatgcacccagtctgtggtcctgggcacggccacccgtgatgacttacacacagatgcacgcagacggcttggggagcatggccagtgcttgtcttagtgtgggaggcttggtgtccgcccctggccacggagtctcgtgtctcctgctctttcgtggacggcgctcacctacatcttacatgcaggtccctccatgttgagtgaaaaaatcagaggaggtacaatcccaccagtgcccggctggacacatattggttttggagccaaggggtaacagtttccctctacaaatgaaaagctcctctccgtcctggtgggatggggatgacatttttaaagggtagagtaaatgtgctcctgcttcaggtgccctttgcagaggcttcccgagtctcccgggggcaatgcatcttctcagtaagaagaaaccccagcaagaaatcacaccaggcgtcttggataaacagaagtgaactacgtcctggttgcagctgtatttatttcacacattcatttaaaaagttaatttgacatgtatttcatgaagcttcggtacacacgccacgttgctccccgattttatcttcatgcgtcttccttcaccagacggcctggcgagctcactctcctgtctgagggctgagaagcccaagctcgccccagactggggcctgtgtggacgcggcccccagcagtgttcctgtgtccgtggtttggaggctctgttcgctgagcctcagcacgacctcaacctgatctgggagtctgagtgcgctgggcttggagggcacgtgtgctgtgagtgagccctacatgcaggagcatggtgctctctggccgggcagcctcacctccagtggaagctaagcgttgtgcccgggcagggggcgcaggcaggagggctgagcttccctggttatcccctgaggcgaggacgcagcagcaagttcccatcccctggcctggcttctctgggcccaggcgctcccattcgtactcacggtcctgagttgagctccagagtgttcccctacagggaggggtttgctttccccagaatggggcctgggcgtggcagcccctccacagaggaagggccctggtcctcgggagcatttacagcatcgtgggtgccggctggggcgccagccaccaaggccacaaggccggcttagaaggtctggaagagcctgactaggaattaggatgctgtgcgttaatctgcaaataccacccccgatgcggggaggacctggtgtctgggcgggggaggaggctccgaggggctcttgctgccttggccagacctgcagcagcagggacagaggctcccgggaatgcctgggtcagaagagagggctctgccactcacccctcctctcttctcatccatctcctggtgccccaaagggcctcactgttcctgtggagagctgttattttgaaattatatcttgtcatgaaagtttcacttttaaacactattaaggcctctcggtattatacttcttttgaaacatctattagaataaggatctcacaggcagctgagaatcaacaggaatgtggccgtacacaataagctccacgtgacccagggggacgtatctgtgtgctctgggaaggctgacatttcaacattcctggcgtctgaattcgacatctctcccaccaccgggaaggaggcgccccagaggggagggaggtgctggggagcgggattgagagcctgatactggcgtgaagttcatcagcagaggagcgaagggaggagggcagggtcaagaccagggactcatggaagcatttggcatcctgtgaagtttctcagcctctggaggctcctctctgatgggagccttatccgagaggtgggtgggagggacgcaggctgccggtgctggtcccgggttgtttgtggtgcagccagcggctggtcactcacatgcagactgagctgacgcttaggacaaaatccatgttttttcattttgaataaaatcactcgatatttgacattttaggcattgaagtcgtcatcacggctcatcacaggagaaatcagagctctgtgctgttgtttctggatacgtgcttgttttagggttttgtatgtattatttcagagctccgtgctgtttctggacacgtgttttagggttttgtatgtattatttctagttccatgaaggggtaggggcatcatgtccttaggatgctcacaggtcaaattagggctgtcccaccagccacccacacatccccagcgactttggtttggaggaagatggaaaagagtcaggagagaggggtgcagcccaggagacagagcacctggaaggatttgattttaagatttaacttcgcattaggggttttcttcataggctcctgcaattcagatagtatctttattccaaggagctttgagtggtttctgcatcagttttcatttcttgttcccaaatctctgtgacatagggagacaggcctttctctaaaacccactgcagacatgaagagccacagccgggggggactcacccaaggtcacacggttaatcctccatgttccggagattaaagcaaactccatggctctcagtctcgtctgaaacttcatgcctctgaattgcccctgaattacccacataacagcagctggacacaaatataagcagcagcagatgtgatgttggctgggacagccgagggaaactggtaaaatgcctcttcttcctgactactctctcaccccggcatctgcctccagagtctcgcagcctttggagatgggtttgcggcccaggggcaccttcgttgtagcttattcgtctatgaggggaggaaaagatggtctcctgtaaaaaatgttaaagtgccagcaagaaattgagggtagtatcttggagtgttgtgagaagagccgtcctgagttctgacggtcaccatacaggcagagtgacacctgtgccttcagctgccccgaggtcaactcaatgccaactgccatctgggactcttggagagctctttctccccaggtgtgaccagacaaggttgttatggaatcaaataccaaattatggcagatgctaatttcagtcatcttgcacacagatcagccctggggtcaccatactgtgtttttgggacactccaagatggatgtgctttggttctgacggcagagaacaggacacctcccaaggtgaccgcaaggaggcctgagctcctgggccgctcattccaccccctctgcgtgctcacgcatggctccccagcaagacagagcagctttcctctgacctcttcctcttccagaagccagagccagccagggttcagggagagcggaatcactgggactgtatggagtttccacttttagcacagctggatcttttcattaatttttttatatctacatgggtttaactgtacattatattgtgcttttttattgctgattcggccagcaggaccccttcctccatatgccttttatcactttatttaaccgtgttgtacacatacacccactttgctttgtatatggtgagctaccttaatgccattgcccagatgcagatttgttattatgtatacattgttaaatttaacactttccttggtggatcaggttcctgtagggcacagaacactaacctatcaatgacccagactcagaaaagccaccagagaaccagcaaggtcaaattgcttcggcttcagctccggaacatcgtctccctccgtccacggcaacgcgggagcctgaccagctccggaacatcgtctccctccatccacggcaaggcagggggagcctcaccagctccggaaccccgtctccctccgtccacggcaacgcgggagcctgaccagctccggaaccctgtctccctctgtccacggggtgacttcatgctgccatggccatcacctgggttgggggtgggtagtgcccagggcaggggaaacacacagagcaactgaaatattgtcgtctttccccagagagggctccaaggagtggcgggagcttctcagaggctcctaatcaatgctttttcttttaaacaatccacgagctaatgagagggtggagaatcccatcccgatgggcactggcttctttccagcaagcctcggaatcacctcagtgcccctggcccacgggatcccaggaatcaagttctgatggatttgtaagcagattcgttcttcagattataattagagccgctctctctccccgcctttttgaaagttcccattagcctgagcaagggccaaaatattattggaaaacccatgggccactttgttccctctgtaccacaggttaaaaccctatttactttgtcagagaggaaaaaataatcaaataaactctccatttcagatgctactgaaacgagcaacaagggaaggggggagatgatgctcatgtgatttggaggccaaaggtgcttctaactcacagtcggagccaccccacgcctccttccacaggctccatgacggcaaaggccctgtccaccagccctatggaaaagagcctggctccagcacctttcctgggacttgatttcctcactttttaaaatgacttgccaatcaattatcaattgataatgactactgattgcaacatatctttagtaagtaaaatgaaaggtgtgtcttactactgctggctgtttccggccaacaagcccaagactgagaattggtgaaggaaggcattgcctgtggacctccctcccatgggtgcccggcctgctcttagtcccccactgaaggctcttcggcacctagagccccatcatcccttccccgtgtgtttgctaacgctgttcatcttgtctaggatgcttctcctccatcaaaaccacttcaagaatcagtccctcctggaaccctccccggagacgctctcttcctcacctctctctggacatttgcaggaagaagcaagacccgtccacatgacccatgcacgattcagtggctctcctccctctgggaggtcagttttactggttgtacgtggagtcctctaagctatgagggaagaaggggacaactgtttggccaaaccatagtctctgtggcccttgggaagaaggatgttgtggacactgcacctggcatctcctgggcttctgtcctctctcagctttgctcttcatgtccccggcatttttaactcctagctcagttacttctctgctcatctttcctcttagacttggggtccttgagggccagctctatgtctggttcatctttgcattctccatcagattgcagaagttgtgtcaacgacgaaccaataaatgaatgtgtgcagtcgggtgtggcagggaccaacaatctgaccagcgctctttctgtgtggatggtctggccctgtgttgacaaacacctaaataatccagcacgattcccttctagatgtatctctctacggtgactgagtgtgctcaatgcttacaactaggctttttccaatcacctgtaactcatgtgaatgtggtcactgatttgagcatcaaaagggccaaagttatcgagggcttttgcatatgtagatggagaacaggtgactggggtaacgcgttatttacctgtatttagatgggcagtctccagatgtttttaaacaggtgactggggtaaccagctacttaactgtatttagacggggcagtctccagagatttttgaaaaggaagaaggaagtaaattcagttacttggatacaagtaggacagaaaatattcctttgagattgtgagggtatttattcattgaacagttttagaggtacagagagactacttgatgagctgacttctgtttttttttttttttccagaagtgggtatctaggtttgctgattgctggagtaaacgatgaatgtggatggcagggcagcattttggaggtgaagccatctgcagatgcgtgtaccccacgagggtgagaagctccaagcacacccagaatctagggtgggggactgttcgcctgagcagcaccaactccatctcaagatgtgtgtctgctgtctgttgctgttctttgtttgagctttgaactcctcacataaccccttaactgtcctcttgatcttttattcatgagcttgacacattgggcagaaagacacagtctcagtgagatgataccaacttggagcttagtttcttcttcctaataccttttgcttgtaattccaaagtattgatattaaatactcataagtagccaaggaagaggaccatcccactactcagtttaatctgtcttgaaaatgcttcggtattgcatgaacgtgatgcatgatccaacccaatgctctgtgctaaggctgtgcttgtgttatctgtggtgaagagaaccttgtaatgaatggaccactcactgagccaggctgtgcttgtgttatctgtggtggagagaaccttgtaatgaacggaccactcactgagcctgggcagctccctgcatctgacttctggagagttctagagatactcacaggtcaggaggtctcttggggtgagggcaggggaggcagctctgggaaccgaccatcagcaaaggtcagagacttagatgcccatccagtgggttcgaatgtcagccgccttccacagcgaggtctggtaatgggcttggacctgcctgaatcctcctggctaagctgtggagtggagccaggagtgctgtctgctcacggtgggaccagcctgcaatcggtgcggcgggctatgcttagggcctaagaattaggcttcccacctgccagcgatacaggcacgggataggccacattaccctgcttttgtgactcatccttcctccatttaagtgggacccacacttgtggctgggataacaatttccaggttggctgagttgggctcctggcaagccatggctgggatagctatctccaggttggctgagttgggctcctggcaagccatggctgggatagctatctccgggttggctgagttaggttcctggcaaggccatggctggggtaacgatctccaggttggctgagctgggcttctggcaagtccgtggctgggatagctatctctgggttggctgagttgggctctcggcaaggctgtggctgggataacaatctccaggttggctgagctgggcttctggcaaggccgtggctgggatagttatttccaggttggctgaattaggttcctggcatggctgtgaaagtgctgccccatttctttgccaccagccacggaagtcgcagctccctgtgtcctctttgcacgttgcatgtgtcgtggtgggagctgtgaggcggtgccgtgacggggcgatgctgctgcaggagacgtgctccggggcacgactctgacgcagcttagaagagctaatgcttgacaccatctggatccccttcatgctttctgtttttatgggaagtcctaattcaacacatgtttcctgaggtgctactacgtgctaggttactgggtacagcaagaccatggaggaatcagagcgtaaacaagcgggcgcgaggtggtccaggcatggagggcacagaagccgtgatgctggggtgggctgggggtcagctggcctcaacggggtgaacacagcagctctcccagacatcgaaggagattcaaggagcctgaaactcaaacaagtggaagaggctggaacgtcacctaaggtgataggaactggggacccgacctggcgcccgttcaacagacccaagcctcccatcccagcatcgggccgtgatgtgccgtccattacacaacgatggaatctgctctgggaagaataaatggctctggtgagcatgctcagaattccattttaatattaaaaaatttaaaataattcttggtttaaaacacaaatagaggtataatatagtagccatctagaacctcaatttaagatatgagattgggtctgcttttgaattttagaaagtagtaagagtctgctgttttcatgtttaaatgtgtgaggcacttcagtaccatcagaacgtgtgcagaagacggaggatgtggaagggcccccaaggacaggtctgtctgcctggtggacactgagtgaggtggaggggaagccacagatccccactgtcctcatcactcaggcacatccaggctgatgaaaaagcaacagaatgggttcaaaggcctcttaccaaacgactcggggcttccctcagcccctgggtgttcacttcagccgcaccccagtcccccggcatctctgaggggccctgaggcgtgtcacctcactccccaccacccctcacttctgcctccatgaaatgtgggtccccttccaggcggcaccttccttacgaggactacgggtgtctgagaggcgcctctgagtccctatgccaccgcatctgggttgggtcacgatgctccccttgcacggagctaagatttatagaccgagacagctccaggagtggccaccccagcatttctcaggggaagaaatgaggatgaaagaggtggagctcgtacagtcagcaacggtggcccctgggcagaccctagagctcctggggccctgcccaggtccttctgtgtatgtctcagcccaggtcatcacagatccagccagtgatctgctggatgagaagcttctgcacggactcgtccaccctctcactgtaaacattgctccagacgaacgcaaggctgagagccgggggtggtctgcgggaggcaggcatgggggagaggacaggctgcgggaggcaggttgggggagaggacaggctgtgggaggcaggctcagggacagggcaggctcagggaggcaggctgggggagagggcaggctgcacaatgctgggctcctccgacaatgctcacctctcttctcccctccatttgcacctcagtcctgatatttatctccccaaaacgtctgggacactgggcagaggctgagtgagggtgccagcatctgcagggcaggctggaggccgctgctttgctctcaaatgtcagcatcttttgtaggctccagaaccgtgtggataaagcaaaacgctcacccaagaggaagctgatacagcagcaaagaccacccaacgatctggttcctacccatttccaggcagtcggtaaatgaaacctaacatgtttgacgcacgccctgatttgaccatcacaaagctccttctctggctgcaggatgcactcagcacgcacgccacaaacatggagatcacaggactccctacacaccatagtccatacagggccttgagtgtggagatcacaggcctcccctgcaccccacagtcctcacagggccctgagtgtggagatcacaggactccctgcaccccacagtcctcacagggccctgagtgtggagatcacaggactccctacaccccacagtcctccctacaccccacagtcctcacagggccaagagcatggagatcatgggcctccctacaccccacagtcctcatgggaccctgagcatgaagatcacgggcctcccctagaccccacagtcctcatgggaccctgagcatggagatcatgggcctccctacactccacagtccacatggggccaagagcatggagatcatgggcctcccctagaccctacagtcctcacggggccctgagcaaggagatcatgggattccctacaacccacagtcctcacggggccctgagcaaggagatcacgggactccccgcaccccacagtccacacggagccctgagtgtggagatcacgggactccctacaccctacagtactcacggggccctgagcaaggagatcacgggactccctgcaccccacagtccacacggggccctgagtgtgatcacgggactccctacaccccacagtcctcacggggccaagggcgtggagatcacgggcctccatacaccccacagtcctcacggtgccaacagcatagagatcacgggcctctatacaccccacagtcttcacggggccctgagtatggagatcacgggactgccctgcacccacagtcctcagcagtttctagagcagaagatgcccattaaaggcagatctcttccgttcagctgcctggtctgctgagcagttgagggggatggtgaggcagtgtgggaatccgcatgtgttgaggcctgcatccctgagctgcgggcagttgaggtgattctgaggcctgtgtccctgagctgtgggctgttgaggtgattctgaggcctgcgtccctgagctctgggctgtccgggtgattctgaggcctgcgtctctcagctgtgggctgttgaggcgattctgaggcctgtgtccctgagctgtgggctgttgaggtgattctgaggcctgcgtccctgagctgtggggtgtccgggtgattctgaggcctgcatctctgagctgtgggctgttgaggcgattctgaggcctgtgtccctgagctgtgggctgttgaggtgattctgaggcctgcgtccctgagctgtggggtgtgcgggtgattctgaggcctgcgtccctgagctgtgggctgttgaggtgattctgaggcctgcgtctctgagctgtggggtgtccgggtgattctgaggcctgcgtctctgagctgtggggtgtccgggtgattctgaggcctgcgtccctgagctgtggggtgtccgggtgattctgaggcctgcgtccctgagctgtgggctgttgaggtgattctgaggcctgcgtccctgagctttgggctgtccgggtgattctgaggcctgcgtccctgagctgtggggtgtccgcgtgattctgaggcctgcgtccctgagctgtggggtgtgcgggtgattctgaggcctgcgtccctgagctgtgggctgttgaggtgattctgaggcctgcgtctctgagctgtggggtgtccgggtgattctgaggcctgcgtctctgagctgtggggtgtgcgggtgattctgaggcctgcgtccctgagctgtgggctgttgaggtgattctgaggcctgcgtctctcagctgtgggctgttgaggtgattctgaggcctgcatctctgagctctgggctgtccgggtgattctgaggcctgcgtccctgagctgtgggctgttgaggtgattctgaggcctgcgtccctgagctttgggctgtccgggtgattctgaggcctgcgtccctgagctgtggggtgtccgggtgattctgaggcctgcgtccctgaggtgtggggtgtccgggcgattgtgaggcctgtgtccctgagctgcaggctgttgaggtgattctgaggcctgcgtctctgagctgtggggtgtccgggtgattctgaggcctgcgtccctgagctctgggctgtccgggtgattctgaggcctgcgtctctcagctgtgggctgttgaggtgattctgaggcctgcgtccctgagctgtctggtgtctgggtgattctgacccctgcgtctctgagctgtagggtgtctgggagattctgaggcctgcgtccctgagctgtgagctgttgaggtaattctgaggcctgcgtccctgaggtaggagctgcccgggtgattctgaggcctgcgtccctgagctgtggggtgtctgggggattctgaggcctgcatctctgagcagaggggtgtccgggcaattctgaggcctgcgtccctgagctgtgagctgcctgggtgattttgaggcctgcgtccctgagctgcggggtttctcggtaattctgaggcctgtgtccctgagctgtggggtgtctgggtgattctgaggcctgcgtccctgagctgcggagtgtctgggtgattcttaggtctgcgtctctgagctgtggggtgtccgggtgattctgaggcctgcgtccctgagctctggggtgtctgggtgattctgaggtctgcgtccctgagctgtgggctgttgacgtgattctgatgcctgcgtccctgagctgtgggctgttcaggtgattgtgaggcctgcgtctatgagctgtgggctgttgaggtgattctgaggcctgcgtccctgagctgtgggctgtccgggtgattctgaggcctgcgtccctgagctgtgggctgttgaggtgattctgaggcctgcgtccctgagctgtgggctgttgaggtgattctgaggcctgtgtccctgagctgtgggctgtccgggtgattctgaggcctgcgtccctgagctgtgggctgttgaggtgattctgaggcctgcgtccctgagctgtgggctgttgaggtgattctgaggcctgtgtccctgagctctgggctgtccgggtgattctgaggcctgcgtccctgagctgtgggctgttgaggtgattctgaggcctgcgtccctgagctgtgggctgtccgggtgattctgaggcctgcgtccctgagctgtgggctgttgaggtgattctgaggcctgcgtccctgagctgtgggctgttgaggtgattctgaggcctgtgtccctgagctctgggctgtccgggtgattctgaggcctgcgtccctgagctgtgggctgttgaggtgattctgaggcgtgcgtccctgagctgtgaactgcccgggtgattctgaggcctgcgtccctgaggtgcggggtgtctgggtgattctgaggcctgcgtccctgagctacaggctgttgaggtgattctgtggcctgtgtccctgagctgtggggtgtccgggtgattctgaggcctgcgtccctgagctacaggctgttgaggtgattctgtggcctgtgtccctgagctgtgggttgtctgggtgattctgaggcctgcgtccctgagctgcgggctgttgaggtgattctgaggcctgtgtccctgagctgcggggtgtctgggtgattctgaagcctgcggctgtgagctgtggggtgtctgagtgattctgcggcctgtgtctctgagctgtggggtgtccgggtgattctgaggcctgcgtccctgagctgcggggtgtcagggtgattctgaggcctgtgtccctgagctgtgagctgcccgggtgattctgaggcctgcgtccctgagctgcggggtgtgtgggtgattctgaggcctgcgtccctcagctgtggggtgcctgggtgattttgaggcctgcgtccctgagctgtgggctgttgaggtgattctgaggcctgtgtccctgcgctgtggggtgtctgggtgattctgaggcctgcatctctgagctgtggggtgtccgggtgattctgaggcctgtgtccccgagctgtgggctgttcacgtgattctgaggcctgtgtccctgagctgtagactgttcgggtgactctgaggcctgcttctctgtgctgtgggctccccaggggattctgagggctcttttgcttgtggcccttctgcttggcatgcatactcaggcctgcaacatagcacgtggtcctgatccttcttcgtaatgtgtattttactggttggttgcttgttgttcataatttttattatatcatcttttagagaatgctcgatttagagaaaaaaggatgagttttggaagcagccctaccaatgttctttctcttgtttcttgttgtgtggttttggccaaacgatcaaaacaatcaaatctctgggtcttggcttcccccacggcaatgaggctggccggatgtagggagtgaggcgtagaggatgagctgctactactgcacaggaatgtcccagcctgctgccagctccttggggaagcagcaagatgccacccaggtgagctgcttcctccgcacctatgagaggcaggaagtggcaggtaacatggagctgctggagacccagccccagggaccccctgccaatatctgagtgaacagttcttgcaagctaggaaggctggcccgaggatggcagttgtatctggcatttcttggagtgtctccagtttattttggaaataggttttggcaaaagttcaaaatgtcaaactcctgaggctttcagttgtcctctccctccggctccagtgtcgagtacccagtgagctgttgagagagaaattcttaaatgtaccgcagcgttcagctcctcagtgggttcggaaacagctggaaggaagggtgtaaagcccgcctgagatggcttcctcagggtttgcctcccagagacaccgtggcattggagcagggtgcagctgcattctggggtgggccagctcggcaccatcggccgatcttcctggacgagccagggctcgctggtaggccgtggaaccttctggccgcatctttagcttctctagaaagggctactcgaccgtgggctctaaagagcctcctcaccagtgagcgtcctgcccaactctgggaaaacctcccagatcctggcggggagctgctgtgagctgtggggccgaggaggctcccgacgcccagtagtaggctggggggacctgcagccgcaggaccaagggattgatttctttctcggttataaattgcaactggagacatgctgacatgtgaagggaagctcgtggatggggggcacaaggcaatatcccgaggagagagacaggctcaattccagtttgcgcgcactggacaaagtgaggatggggtcagcgagggagagcaggtggaaagaaaaaaatccatgcggcgaacgccctggctgtggcagcgggtttatttttgaatgaaggcaccatgcatttaaattaaatgtcagatgtaatttagcacccaggcatcaagaggctgagcgtgtgcagggaaagccggcagctcgcaggagtggctgagtgcctgctctccagcgcccacggagtgcgctcgctcgggaggtgtctctgtcctcggcgtgggagggtctttgagaaggtgaagcttggctgttgctaagacacacgagatcattgtttggaaggcgttttcccttctctctccctcaaatgactgtttaattgaggttactctgcaccgctgacacgcggtggaaagcccgacatcacttggagaacttaatcaaggctgatggagccgcgcgcacagaatcccaactgcccgcaccctttgtttcatgttcaccaagaccgaggggaccattcctacgggatgaggaaacacatctaacacaggccttctaaagagagaggagggagggagggagggatggaaagggggaaggacagagaccaccgtgaacacatctccgcttttcgctatgggcagatgcttccatagacatgggactttgcagccaagtgggacttgcagttgccctggacagcccggccttgcgagactcccattccgatttcttgacccctgagggtagatatgctcagaaaagctctggtcttcaggctgcaagctcccaagcaggatccacgagctcctgcaccccaaaccccaggctcctccacacgcactcacgaggggctcttcagagcccacctgcctgctgtgtctgcagctctggcctggctcggctgggttttctccagggtgggggcaccgagtggccagggcggctaagacaggtcggccatcacggatgtagcggggaacgtcgtaagtgctgcctcaacaacatggtgacttgtccgaacatgacctgactttgcatcccagggaaggcacagccacagcttcccatcctctgagagccccagagggggcaggcttcaggatgggtctgcagctgtgctctgggcgagcacgtgccctcgtccagtctcccttcctgggcagcccaggccagagctcccctggggtcgagctgggcgactggtgcgcggtgtggctgtcgcccttttgtgctggcctcagggtcaacgcgcactctctcttctgcttccctgtttccagctggcttcttcacccgaaagcccatcctcgtcttatcaaatctgatcctctccccagccacaagctcccacctaacctacagcccacctccaggtacagaggccaccctctctgtttccgtcttcctgccctgattgcagcttcctctcctacctggagtccagcatccatattttcatcttttagaacagaggacacccatcaaaggcagcaaaccactgactctggaaatctgtgattagagatggccagctccatctcagggatggcgagggccgccaagacaaggaacagccgtgggacagaccctcgcagcagccacgccgcctttcagaagggttcagggcttatgacaaacatctggcagcacccactcctgctggaagcccagacagtcagtgaccagatggttttgccatggccggcagtgctgataacagacggtcaggagatggatttctgtggtgtggctgttctccaaggggcaggaactaactgggaggaaaggcggggtgtcggcacaggcaccctctccaggcctgcgtgcagggggcaaggacagtgaagctactgacacttatgtctctgctcaaatcctaaacgcctccctctgctgacgtcggaacccacaccccgcgcagtgggcttctgtcccccgggcagtgccatgtgccaggcatgtctgctgtgctgtgggaggagacggtgctgttccctggccgatgcccactggaccccacagaggaactgtgctgtggggtgtggttcccacagacccttcatcgggaaagttgagaacttacaataggaagtgcagtttggtgcaagcttttcccttcctgccagcctcctgtgctatcagaacacagccccagacacaaagcccattacaaagtgaccagcacaggcaccagccaccactgcttctcctcccgtctgggcctcactccagccctagtggcctccgtctgggccgcagctcacagcatggcagtgacccttcctccaacacccccacctctgaaaatgtccatgtttctagtcgaagctccgttctctaccacgtgccaggccccacacctgccttaacgcctcccctccgttctctaccatgtgccaggccccacacctgccttaacgcctcccctccgttctctaccatgtgccaggccccacacctgccctaacgcttcccagatcgtggcatgcgtgcatggctgcaggtccctgctctcctggcatctgcaaccgtgccctgcccacctccccatcccccaccggttccttgccaggcaagaaccaaagccacctagcacagcacccccatccgcggccatggctgctgtccaggcatcacgcccacacctgccaccaggcccagcatcttgctccctcctcatcctggcaccagctgaccccatccttgggaggccttggtctctggttccccgctcccctatctgaagtgggtgctggtgagaggctgggaggaccaggcgttgtggctgggatctgtggcaacccaggaaggagctgcaactccgaggagttggggtgtgaaaacaatcgtccactgtgggctcaggaagagcagggcctggtgcgggcccttcccgaggaagcctgtggggcctgagtcctgggagaagcaaactcaggcctggaggctgagtccgtgtggggaatgtggcctgtgctgctgctcctgtggactcacgagccgtcaggacactgagccacgttacctggtgcttctccagcatgggcctgtctagcaaagcagtggcagtgctctgagctgggggcaggcggacatgccccgacactcggcttccaccaaacagggtggtccaagcactgagttctagaaagaaaaccgggaggaggcggtgtgggaccgtgggcagacatcaacctagaccagcccctgtccccccttggctgtgtcagaggtgacagtgacagtggccttccattctctgcacccactgcactcacgggactccctctgcaactctgccagggtggcttcatcaccacctttggaggaggccgaggctccggctggaaaggtgcccagtctgggggggcccttctcaagggatctttgtgttttactgaagttcacggggtgcccccagccctacttggcatgcgtgttttctttgtagttagttttctttgtagttattgggatgccacgtcaagttggtcatttcaggtaaaaggtggcgtaaacactggagctgcagagaaaggaaggtgcttcatgaacactctgcagcggggtgtgcttcaaggggaggaagaacttagattataatgcttttgttgttgttgtttgagacagagtctcactctgtcgcccaggctggagtgcagtggtgcagtctgggatcactgaagcctcaccttccctgggctcaagccatcctcccacctcagcctcctgaggagctgggactatgggtgtgcgctgccacgcccggctaatttttataatttttgtagagacagggtttctccatgttgcccaggctggtctcaaactcctgggctcagcaatctgcctgccttggcctcccaaagcgctgggattacaggcgtgagccaccacacccagacaatattataattttactcttaaaaatctttatgaaagatgtaaatatgtaaatattgagatgtttagactattcaagctgtcaaagacaaaaactacccagaaacccagtactgtgccaaatgttgagaaaatctgtaattccaaacagtagcttctgatgatgtttgttattttaaaaattacaatttagtcctgggtacgaatgggagtatttcagcctttcttgagaagttcatcgaacttctagggcaggttcatgtttacagctgtgtcttcacgggggggtttgagaagttgagtcatcctcatttgattataagaaaatgtggtccatatacaccgtggaatactatgcaaccataaaaagaatgaaatcatgtcttttgcagcaacatgggtgcagctggaggccatgatcctaagcaagctaatgcagaaacagaaaaccaaatgccacatgttctcacttatgagtgggaggtaagcactgggtacccatggacacaaagatgggaatgacagacactggggacccccagagggagggggtaggaaggggagagggaaggagtgaaaaaaaaccaccccttggctactatgctcactgcctggagacggatccattcttactccaaacctcagcatcatgcaatacacccaggaagcaaacctgcacacgtacccccgattctaaaataaatttgaaaaaaagaagaatgcgagcatttcccattggtcacaggcccttcccacggcagcgtccagcacccaggttcccagccagggctgggcggggctggcattgtgtaggtaaatgctgcagtggtttacttggcatctgactaccctgacattttatgggtaggatttgtaccactgcacaaaaatagttttaaccaaaaatatacttgtgaaaaacagtaggaaatgccagaaagaccagacttctttacaatcaaagaattacgtgtatgtgtttttaagtggaattatctggaagagtggcacttccaaaagagtttccatgaatgagtgaataatgaagttctaggttaggatctcggctctgtaatttattatctgggtaaaccagggcaaattttttaatcttttaattaattttttttttttttgagacaggatctgtcgcccaggctggagtgcagtggcgcgatctcggctcactgcagcctctgcctctcaggttgaagtgattctcctgcctcagcctcccgaagtacctgggattacaggtgtccgtcaccacgcccagctaatttttgtatttttaatagagacgggttgcaccatgttggccaggttggtctcagctgcccacctcagcctcccaaagtgctgggattacaggtgtgagccactgcgcccagcctttaaccttctaaagctcagcctcctgttttgtggagtagcagtatctgcgcctgcgctgctctcactgcgcaatggaagcaatacagcacggagcttagcagggaaaggcatgagaagctgctagcgtggggactcaaggaacatcagcagtgtccttaccttcataggaattaaggccaaaccatttatgggtgactatgtcaggagaagggaggaaaaaaaaaaaaaaaccctgttcctgatagacgagaaactgctcaggggaaagaggacgtcgctttccatgtcattattcctcagccagggttgtgcggatgggagcgctggtcacttaagcacatgaagaagaaaaagtctttctgcgaaacatggacggagcctggaacatgcagggccacgcgtgagggacgggccgaagtcagggatgtggggccaggagccgccgtgtggggtggacccctgccagaaaagcaaacgggcagtggatggactatggtatgctatgcggctcacaagataaaagtttttttttaaaacctcccccaccccctaaagagatcattattgttacgacatagaaaaacctagccttgcagctgaggctgcaccgtgcaggcagagaccgtcgaggaacccacagcagaattggccatgggtgaaggctgagtctgcaccgtgcaggcagagaccgtcgaggaacccacagcagaagtggcccacggaggaggagcactgagccgcctcctatggcagcgacacagaagccaggcctggaaggcagagcgggagagcagagagacatgctccacgccgcaggcccagctcaccctccgactgaggcaggagtgctggagctctcggcggccggtggggacaaggaggaccccggcaggcgcgggcagggccggggcaactgggcaggaccccagggaactttggatacgggcagaggaaggtcttccagtcggggaaggcgggaggtgttaagatgcaagcacttggcagttagcgggctatgaggatcttttctatctcgaagccgtgcgtctttcacctgttgttcgactggtatgctctgtggctcacaagatacaagtttttttttttaaacctcccccaccccctaaataaattattattgcaatttaaaaacctagccttgcaaaacagcttttgaagaacaagggaaataattgctcaaagcccacttgctctacaaacaggtgatttcagagacctttgaaaagagccccagctgctgaacttaacctggggccccgcgaatgaaccaggctccgcccctgacgcccgagacaccgcgcacaagaaggcagtgctggatctcccgcagggccctgaagcagctctctggtgcactgaaaaggcagcaccacgtggtggatcatccacggggcagccccagggcaaacgtggtgaagccaggggtttgcgggagggacagccttgccggtgcgggggacgcggtctcgggactgacggcgcaggggacgcgcgggattgacggagcgggagatgcggtcgcgggatgggatgtgctccccgtagctcccggcgtggctgcagtgggccggttgcggggaagaaaagggccggtgtcgtaattgactggacaggtactaatgccgaccacatccaaatatggatgatgacgagcgtggtgttgcccacagtccaggcctgtccaggcgccattccccgtggcctgcacgctcctgggtcatgctccgctcaggcggctccttcagtgaagttgcacagcagtcagggtaacctccatgtccccaaagggcaagaccggctcagaggcgaggtaggtggcacgaggccacacagctggtcagctcagccgggctgggacgcgggccccagaccgtggcccccgtgcagctctgggtccagctggccaaggtggactttgcacaaggtttgggaggctaaagggagccgaggcaggtggcagctgctgtgctgggaaggctgcgtgcgcggggcatcctctcttggcccgggtgggcggacgcaggggtccctggaggacgggactggcatgtctcctgcatcccgcggtgtccttgctttgtgtccaggtccctcctgacccccgcccatccaccctactggctcagagacgtggaggcagtggtcccttccccagctccccacgctaccccccaacccttgctgcacagcagaaggccctgctcagaaaatccctgatttcacgggactcctagtggctctgcctcccggatggagccctgcctgcgtggctgctctgtggctaacaaacagcgtgctcctggtttccctgccacggtacgcccctccagccacgtcaggccattgctcaactggaggagtgacatcgctccttaactttcatacctaggtttatgtcatactttccaagttacacaagtcacatcaaataattccgacgtttcaagaaaaaggcaagtgactctattattcctcgtttctcttgggtctgaaaaatcatgtcctgtgaagcccttcagacctgcctggggttcgagtccctggatctgccgctccccccttccctctcctgggagcatcggtgcctgggcgccgtgggcgcaggcggtcggcattgttacttaggtccgagctaagttacgtctcctctgcccaaatcctgtcaatgcagcaccgtgtccaccatgcgccaagggagcctgctgggctgagatgcacctgtttaggcagcatcggggagcgatgttcctgaggagctgggaggccctgcttcctggatggactggctcctgcgggaactccggcaggtgggagaacccgaggtggacagaggtctgctagtgtcagccgcttggcccaggagcctggcgtgtccagtgtcagctccttgtaagcccatcagggccgcttcattaaagttgaatttaaagccagactttaaagaatgaactgctgtcttttcaaaggcctccttcaaatggaagacggacacgtgtgactcagacatgtggggctcactgtccggggcggcctggctttttatcttcagcggttgctgttattggtcaatgatgttggtgttcagatctgcaagttctggactcatgactttgaggctttaaaaattactttaacaaataatgtacgcgttgagaatggtcgcctgggcagcgattataatggaagttctttgtgttatatctttcaaaatgtgccagtccatgtggggtgctggtgctttggggcaccagcccctgcccctctcttggggaggagctggatggaacacaagtccagcactcacagaggctcatcctgagttgtctgcccagggaacatcagtgagaaccatagtgtaggaagagaccgggcgggcaaagtgggaccatccagcagcccctacctgtcagggggacccaccccttccttccagccttccctgttcacagagggtgctgcaggccgccagggtgctgtccccccaacgccatatcggcattcagaacagatgccatactctgctctaggggcctccttctgcccccacatcacccactgaatctctctaacaaacatcccccacgtggtgatcagtttcccacgtgctcagggggttctgcgccctgccccaaatcttacagctgatgtggggtagagacagaatcccacccaggtttggctcccaggagtgtgacccaggatgggacagcgatttgtgctttgcagagaagtgaactcagcagtcgggatgcagggtgcacgttctcggtgtccccacgttcagctctacatgcacgaccccaaacttcctaaaggctcatgacgcaaataaaaccacaagtcctgccctcgagagatcattatctgggcccagagcagctgctccacagaagtgcgaaggagaatgagcagagccagtccttcctgtcctctccctgtcctccctcccatcctccccacctcccacatcttccctgtgctccccgagtcttctccatgcccctcagccctcttctggccagatccagcctcaccccatcaccattgctattcagcggtcacagtctccactgacacctgctggggtacttgccttttaacaaggcatccaaaataagaaaaaacttttcagaatgcttgtgatttttgtatattgattttgtatcctgagactttgctgaagttgcttatcagcttaaggagattttgggctgagacaatggggttttctagatatacaatcatgtcgtctgcaaacagggacaatttgacttcctcttttcctaattaattgaataccctttatttccttctcctgcctaattgccctggccaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaaactactttaaagttcatatggaatcaaaaaagagcccacattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgcctcatatctacaactatctgatctttgacaaacctgagaaaaacaagcaatggggaaaggattccctatttaatgaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacgccaaaagcaatggcaacagaagacaaaattgaccaatgggatctaattaaactaaagagcttctgcacagcaaaagaaaccgccatcagagtgaacaggcaacctacagaatgggagaaaatttttgcaacctactcatctgacaaagggctaatatccagaatctacaatgaactcaaacaaatttacaagaaaaaaaccccatcaaaaagtgggcgaagaacatgaacagacacttctcaaaagaagacatttatgcagccaaaaaacacatgaaaaaaggctcatcatcactggccatcagagaaatgcaaatcaaaaccacaatgagataccatctcacaccagttagaatggcaatcattaaaaagtcaggaaacaacaggtgctggagagggtgtggagaaataggaacacttttacactgttggtgggactgcaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcagcattattcacgatagcaaagatttggaaccaacccaaatgtccaacaataatagactggattaagaaaatgtggcacatatacaccatggaatactatgcagccataaaaaatgatgagttcatgtcctttgtagggacatggatgaaattggaaatcatcattctcagtaaactatcgcaaaaacaaaaaaccgaacaccgcatattctcactcataggtgggaattgaacaatgagatcacatggacacaggaaggggaatatcacactctggggactgttgtggggtggggggaggggggagggatagcaatgggagatatacctaatgctagatgacgagttagtgggtgcagcgcaccagcatggcacatgtatacatatgtaactaacctgcacaatgtgcacatgtaccctaaaacttaaagtataataataaaaaaaaaagagaaaaaagaaaaaacttttcagagccaaaggagagaggtgggagcatggtggccccaggcaccgcatgcagggaggggtatcagggccccccttgggaagtgtgtccctgcgtgtccaaggccctgcagccacaatccagccccgcccctgaaaagcatgttaggcccaggtgctggtgccggaggctaaccctccatcagagcccacagccgcccactcacggtcggtcacagggctaaccctccatcagagcccacagccgcccactcacagtcggtcacagggctaaccctccatcagagcccacggccgcccactcatggtcacagagctaaccatcagagcccacggccgcccactcatggtcggtcacagggttaaccctccatcagagcccatggctgcccactcacaggcacagagtccatcccaggccacagtgggaaggagagggagatgccctgaggtgtccagtccaactcaaatttccagccacatacaccatgacctctggcgtgatgtgccctcctcatttttctctcccttcccttttccaacaaaagctcagccctggtgatgacagcacagactccagctctccagaggcccaagacagcctgccccagtcactgtggccatggggcggccttcgctctgaggcacaggttggcggtggccctgagccaggctggtgtggcctcgagtcccttctcctagccccaaaccccacggcacagttggggatcctctcggctgggtccccaggggagctgcacactgagcctccacctccttttcagagttgggagcagctgcccccctggccatgggggaaggccacgcccctaacctgactgcagattaaattcttctggaaatcttagcctgcctcactgcttggtttcctcttcattcggaattaattcctcccttggatgctgagggctggtggctggtcctctcttcgcagtgcagtcacttgctggagtctcctgagggcaggagagccccggcagtggtaggaggaggctgcaccgggcagggttaggggctgctgggcctctgctgtgtggccactgccccatgtggctgccccatcccccagagcaccacggtgcccaccttttgttttcagagaagcaacaacacctcatattcagtctaacctgtgaccattttccaaacactctcatgttcgtttgatcttcatgatgtccgtgaacacagggaagctttagtcgcagccacatgagtggagcatgtggaggctaggagaggccatgcacgcaccctctaggatggccgtaactaaacacacacacacaacaaaaacgtgctggcgagaatgctgaggaatcgtaactggcacactctgcagggaggaatatagcatgatgcagtcgctgttagtgggtcctcaaaaaactaaccacagaatcagcccaggacccagcagttccaccaggggcatatgcccaaaagcaccgaatgcagtgactcagagagagattcgcacgcccatgttcatagcagcagcgctcacagaagccaagaggtgaggccacccaagcgtccaccaatggaagaaaagataaacatcatgtggtccacccacacatgggaatattactcagcactgaaaaggcagagattttggatgcaggctacaacatggatgaaccttgaagatgttatgctaagtgaaataagccagtcacaatatgataaacactgtgtgattccactcgtatggggtccttagagtcatcagatccatagagacagaatgtaggacagtgggtcctgggggctggggagttagtgtttaatggggacagacttccagtgtggaaagatggaaagagttttagaagcagatagtgatgatggttgcacagtattttgaatgtaaatactaccactaaattgtacatttaaaggttaaaaatcacaaatgttatatattttaccacaataaaaaattaaaaaataaaagagtgagagactgcgtgcctggcatacagcaggggacaggagccgattgtctgtcctacagctgggaaatgatccatcctgccattcatccatccatccatcaagcactcatccatccttccatccttcatccacccatccatctacccatccatccatccattgatccatccatatccatccatccatatccatccatccacccacccacccatccatctacccatccactttcatccatccaaccatccatcattcttccatccatccatccatcatgcactcatccatccctccatccttcctccatcatccatgcatccatacctccatccatccaaccacccatccttcccccatccatccactcactccccatccatccttcatccatccatccatccttcttttatccatccaaccatccatccatcattcctccatgcatccatccttcacccatccatccatccttctttcatccacccacccacctgtcattcatcatccattcttcctccattcatccacccatccaaccatccatccatctttccttcatccatccctccatcatccatccacccatccatcatcctttcacccatccatcatccactcttcttccatctatccaccatccctcatccgtacaacccatccatcatccattcttcctccatctgtccacccttcacccatccatccatccttctttcatccacccacacacccacccatccatccatccttcctccatccattcacccacccatccatcatccatcatccatttttcctccatccacccatccactcatccatccatccatcattgctccatccatccacccacctacccatccatcatccattcttcctccatccgtccacccttcacccatccatccatccttctttcatccacccacatacccatccacccatccatcatccattcttcatccattcacccttcacccatccatccatccttctttcatccacccaaactcccactcatccatccatccttcctccatccattcactcacccatccatcatccattcttcctccatccatccactcatccactcatccatccatccatccatcattactccatccatccatccatccacccacccatccatccatcatccattcttcctccatccatccacccttcacccatccatccatccttctttcatccacccacacacccatccatccatccaaccatccatccttccttcatccacccatccatccaaccaaccattcatccttcctccatccatccatccatctatccgcccacccatccatcatccattcttcttccattcatccatccatcatccatctacttatccatcatccactcttcttccatccatccaccatcccccatctgtccaccaatccatccatccatccatccatccatccacccacacacccatccatccatccaaccatccatccttcctccatccatccatccttccatccattcacccacacatccatcatccattcttcttacatccatccacccatccatccttccttcatccatccatccatcatccatctacccatccatcatccactcttcttccatccaaccaccatccctcatctgtcaaccaaaccatccatccatccatccatgcatccatccttctttcctccatccatctatccacccatccttcctccatccatccattgatccacccataaacaaacactttcactgaagagacacgggaggaatcagaaaaagctattctcagagcttctatcctagagaattgctggcacttgcagagtgtgtttggatgacttgggtgttcctcacaaatgcctgtgctgcgggtcctattcttttccccagtttatggaggagacactaaggtacccagaactgcaagaacttgctcaatgctccatagcatttggctgagacaccatttcttggaggacaggacattgaaatctcagaggctgggtgagacacagggccactttgcaggtggctctcgaaacacgtccccttggctacctccgttggggccttcaccctctacttgtagttgatggcaccagaaatggtcttttctgggcttatgtctctgtcttcctggccagctctcagcactggctcttgccgggtgggtggaatcctgtctgatgacccagctgggagtggcttgtccccctctggacactgccagccctcctcctggcaccacctagcaccatacaatagtcactccaggggctgccattgccacagctccccctgcagggtaggggccaggccttggcacgtcttgattcaaatcctggcacttgcagtgtagatgaggagctctgggcaaggtactgagcttccctggctgcagggaggttgacatgaagtagccaggctgtgctgggcacacagcactccacgtccatcatccatctgtggcttatgaacgccttgtaccagatttatccttggaccctaccaatttaaggggaccacggaagcttctgaacaagaaggaggggtttccctgttcctcctggcatcttggttttacaatgagactgactgccatgttatctgtgttcttaggataacccaatctttctctctccttctaccttgataatgatgcctgacactttgtacggtgtttgcctttgcgtacaaatggctgggaagtcctcacagtcacaccctgcagtaagaatgctcacgaatacagcagtaagaatgctcctgctctcccaggaaacactgcattggggaagtgagtgcccatgggtgcaagtcagcaactggccagggcgaccgctctttcactgccaggccagtctgccttccgtggtcacaggcgaacactgttctgtttggtgctgtgcctctgcagtgtggtgagaactgtctatactcctgctcctcttagaaacgctgtgtgtgtgtggaggcggtgggaaccagtggtcctggcaaggcctgccaggctcagacctggagcagagccaggccccagctgaagcagaaacttccagctctgtgctccttgctattttttgtttgtttgttttgttattgtttttaaactcaaaaggcaggtaggacttaggaggcaagaaagcccgcttgagggacattaaggacatgaaggcacagtcatgggacgcttccatacacgattcctgcttattgctgacaccgagcggtaaaaagagaattgccactgtgagtcacacactctgcagtgtggcgactaatattgatcttccaaacggtaaaaacaagaacaaactggaaagacaaactctacttcagattgcaactacttaagcatctttgtttaacaaaatcaataaaaaaagatttcactaacaagactgcaacctatatttgtggctatgaattccccagattgctggaatatcaaatccagagcacaggagatgcagagagagtgaggcccagcaagcctgttttacagtcaacggatcgtcctctgctcctccgagcagctcatctgcgttcggctgtgcgatctgagtgtgttcactgaagcacagcacacgggcagaaccgcacgctacatcctcaggctttgctttggggccaagaagcgacccccctacagtgacagagtgtggctccgggccggacgccccacgctggcctcccgttcccatatcccggccatgagagcacgcggccgcaacacttgtcttcaaggagccatgatggggatgacgtgaggctccccagctcctggagaggccaagggggctgcgacgccccagcccagccccagctccaccccagatgtttctgttcagaaacaaaatcagttacaaaaaaacctaaacacatcaccccacaagaaaagtcatttggaaaaatcatttggaaatcacactgatttccttaaaatataaaaaacattgatttatctcgatctcatccattctgcttaggggagcagtttctgctttaattgtagtgtctttctttagaaaataaggacaagtgattggggtgttttggcacccacagtgccatggcacctatggaggctttaaagaacaaacatgccctcggaagaagttactcggcgaagtcgacacacacatctctgagtcagacatttcctcacattgtcccctcatttgtcaacacataattactgtcaccgctgtgtgctgacgctggcatcaggttgcacgtgccagtcagcataaaaatatggccgtaatgttggcataatttttcatgatcatcttcattaaccacagcgaacgggaggagcgtttgcctgcacccagccatcgtcatgacaacgcctccaccgcggccagcccagtgtccaccgagggcagcggttgaatgtcctcattattccgccccccacacgctttgcccgtgccaagcaaggaccaacacatgccggtgatttatccccaggccactcccgacggcatccaggcttaaggcgctggtctgatttcacagtttaattactgctaatctgagaggccacagctaatgagctgccggcaaccagctcgccctgctggaattccacaccccttccctggatgactcccctcattgtcgggggggcagttaaggaaggtgtattgacttctaggtgtgacaggttgactaagcacctatggaaacatcacagcaatgtcaacaggcaaatggaacacagataggattttggaattcagccaccacaactccactgaagacagtatgggttgctgatacaccccagaccttctgcaggccttgggtagaagatgttgggcttggctttagccacgccacgggctcccttggtcctgcataaaacacacccacacatcttcaccaggatttgtaacagcacagcagacatgtcaccagcccctccacacggaactctcttccgcagctccctgtggctcagcgcgttcctgcctcccactccaccacagctccctcccagacctgcaggcttcacatctaaaacactatcccaggcgctcctcacctggattccctgggggctgccatgggcccctccctgccacccgcccctttgcacactttattcttcccaagacccggcagatggcctgaaagcacatgtggggctgtggcctctggtgcaggcatcatggcttactgggctttaggatacacaccccgacctcggctaccgcatccacgcttggccccagcagcccgtccggcctggggttctctgtggcttccttggtctccgagcctccccagcactttcacttcccgctgccaccggccccggtgaatgctgcttctgcttctagaacactgctctgcaatttagagatgaaattctggcacccttaattctatttgtttaatccagtgaatttaatttcaggaacatattggaaccatgcttagcttcagagcagagtttatgtagatagaatatgactggaggtttctgctggtttaagtgtgtcagtcacagaatgcatgatgtcagtataacaactacccttgcttaatgataacgctaattaaatattcttagcagcatcatgtggagaaactggattttcaattaagcactttctgaggtgagggtctcagcaggtcccacctctttacgttaaaccggaggctttctgctgttgtcaggccctgtgcacccagagaatgtaggaattatgaatgcgtgaagctaatttcttttcattttcattcaatggtatgtgagcttttccaaatacatgatcctactctctcctttggggagaaatctttgttaaaaattagcgctataggggagcttattttgcccaatgacagagcagatctgaaaaaagcatcaaatcttccttcgtatcctctaatacatccctccagctcgggtagacggacatcctcgggaagagcgttcagccagctccagacacagcaaggtcatgaggcgcctgcattcagattcattgctgggtgtgctgaagagggccacacattctctgacgcacttgcccccgaggtgagacctctgtcctccccacctgagtgtgggggctgtgggcccgcttggccagttgaggcagcagaatgcacctgcccccgaggtgagacctctgtcctccccacctgagtgcgggggctgtgggcccgcttggccggttgaggcagcagaagtaacgccctgccagtttctggcttctgggctcagactcgagagactggcagctcccatttcctctcttgggacacttgttcttgggaaactcgctgccattctgtgaggaagcccaagcagccttgtggaggctccacatgcagaggcccagagctcccagccacagccctggctgagctccacaactgccaccacaatgtgccagctatgtagacaagccctctttggggcgagccctccagcccccttggaccactccagctgatgccagtggagcagaaacaagacttccctgtcatgcctgaccagattatagagctgagagcaaaacagggctctccaatttgggataatttgctatgcagatatagattcctggggtacctgcccccccattccctgtctccatctctgatataaaactaatcccacctgctgccagttcatgcccttctgtggcttgcagcagctgacactgacacctctttgccaactcaatttaacagccacccaccatgtcacgggtgcagagtgctggatctgggactccacagagcagtgagacacagcccctgccctcagggagcttacaactgagtggaggagaaagacacacacggcacagggaaaatgtgctggcaaagcagtgcaaagggcagtgcacacacacagtcagagacacacaaacacacagacacacatgcagacacacaaacacacagacacacacgaacacacacagacgcacaaacagacgcagatacagacacaaacagacacacatgcagacacagacacacactcacagacacagacacaaacacacagacacagacacagaaacacacagacacaagacacaaacagacacacacggagacacaggcacacatgaacacacacagacacagacacaaacacacacagacaaacacacagagacacacacagacacatacaaagacacacatacagacagacacacacacatacacacggacacacatgaacacacacagatacatacacagacacacgcacacacagatgcacagacacccacacatagaaatacacacagatacacacacagaacacagacacaaacacacacatggatacacacacacagacatacacatacacagacagacacacacacagacacaaacacacacacaggcacagacatacacagacacagacacacatacatacacagagacacacatagacacagacacacacacatacacacagacacagacgcacacagacacccatacagacatacacagacacacaaacacacagacatacagacacacatagacacagacacacacatacacacagacatacacacacacacatacacacagacacagacacacacagatacacagacacaaacagagacacacatagacacaaacacagtttgtgagagccctggcccgcagaccatggtggctgcagtgtgagcccagcagagtcctgctcagtgctgcccagagacctggggcaggaagtggaaagaggcccctgatccaggtgcagctcctgctcccggaaccgcctgtgaacgactgtgacctgggcgaatcctgctgcgggcggcctcagctccacactctctctaggatgaatcaggtggagctggcacccagggcgaccccagaggacacacgaggctctcggcattgggtctcagcgttgggtctcttggccgggtctggggggacccctgtggggggtgggagaacatctttttgaacaaacacgtaaacacattgagtctttggtcgcttttgcatcttctttcttctctggcctctgcgccccagctcctttgtgcgaggtcccatgtgctgctaggccacgggtggctgtccagggtgtggcttggagccgtggagctggaggcctgggtgatatggtccaggctgcatgccgactccgggtgtacactgggtactggcggggtcttcctgggccgcctgctcccctgtaaatgggcagtgatacaaccagcttcccagaactcccagaactggatccaggcctgggtgagaaggtgccttgcacagatgtccacacatcatcctcagtgctgggaccatcaagatgctacagtttccaaccagcagctcatcgcgaggacctcgttctaggcactcgcagcagacggaggcaggggtcctccacctccgcttttctgacccctctctcttcaggacaagcctccttggtcatgctccggctggcctttagctgaggtttagctctacgcggacattagaagcacaaaccaagcacagccccttctgtgagtgggagtcatgcctagaaaacaaacaggagagaggcggctcccaacctccaggagatgaaaacctgttcttacaatgcgtgggactcttaccctgacgagctctgcagtccccacagacgcctttgctcaagcccacctgcctcttcccagcaccacccgtgtcttcatctggggagaagagcccgtgctcagttttctccatcagcccgctgcgagggccaggggcccctatgcactcaacatcagcttcacaaagatgtagtgggctgtggggccaggcggcttgctgtacctcccacccaagcccagggccctctcacccagactttggcccagtgcctccctctgtctgtgttgcctctgttccttggagctgtatcttcctcagcctcaatttctctgcccattggtgtctttgttcccgaacctcagcccccaggtcctggttggtggggcttgtgtccgcctcatccagttctggactctttgtgatgatggtaacaataactggactgatccaagttgaagtcagttggtgaatgaatcaataaactccaactgagagctctacacagcacatcctaagtgtcatacagagcactaagtaatttgctttttcatttatacctcacttcattccagaaagatgcatacaagttagcaaagtaaacacatatttaaaaagaggtgacaaaaagaaaacatagggaaaacaagaatgggaaataagttggagcctagaatgaggttagtatgcaaaacccatgacacggacctacttactaggagctggctacggatggggctgtgagctccctagctgccacggggaagagaggaacaggatccacaatgtctatatgacaaaaacagacaatctattttttgaaaatcatagctattcttaaattaaaaaagaaatgttccaggagtcctcacagagatgcgctgaatagaatatgcaccatcctccatgatgtctttatacaacagggcaagggaatgcctagggttgctggcctcaggccaagtaaaaatggctatgcaggagcccagcatggcctgggcatcatgcctgtcaagcctggtgaatcctagggtgggcctgcgagggtttagaagggataaaccacgtcaatattattcttcccaaccaagatttcactggaagttgagctgcagtgagtttaagaaaatggtaagccccccatctctgcacgcagttcataatctaggttgtgagaccacacaccggctcatgtgcacaagacagtgtgcgtggagggtgacagtgtcggcaaaagtgggctcagggctcagagctgtaactgcggttaaggggttaggaagctggccttgggctggatccaggaccccagagtgactcagcctcatggtacagcagagggcacgcccgacaggggaggtcttcgagtcaacaatgggaagtagaaatctgcccaagatgaggggaccagtccgagtggggaggcttccaaagatgagaggaccagtccgacgggggaggcttcctctagaggaaccatgaggacaagtcagagtggaggtaaaaggcctgaaataataactggtcaaggaacatggtctcttcttctgctacttacatgccagagtctctgaaagttcttgatgagaacagtgacacaatgaaagcaaagtcagggaagatgagaaggtggccttgcatcctaactgctgtcagcagagtctgagggcctgaaaacgtccacatgccagggagtccctcagtcctcaggaaggagaaacgtttcatgaaaacgcgaacagtctcggaacgcctcactccgtcacggcagtgtaggctcagatgtgacttgggaagatggcgccactctgcaggacgccgtgtgtggcaaccactcgctctcacccttcgggtctgcggcagctactgtcatatgagctgctctttagagggacagaaatccacaggaccccagtttccacccaaattcatgagccgcagtggccaggctacctcacctcaccctgctgggtctgggcagtccctattctcccataggcataacggggacagtgaaggtgcaaccagcatggacagggccgagggatggaaggaaaacaaacccttgcagttcaacccacagggcggaggcggcagcgtgagaagcttcctgaatacaggactcgatgcctcgaggagaggagcgtggagcacgcccggggcacatggggacacagcagcgctgggaaggcttcgtcctcgggagccggcgctcacatgcagggagtcgcccaggacagcaagcctgggtgtggggctgaggcgggcgcagcctcggggcagtccccacacaagggcaggacggagcctggacggaagctccacgccctggggtacctgctggggcatccagggtttcctgccccaggcccgggtcatggtgtcccccgcaggcctgcaggctgggttcctcacagggcatctgctcaccaagtaagcctggcgtggccagaactgtgtttcttgagttgtttgagccgtttctgttcatgacctacagtaacgccgctgtctctgtgatgctatagggatggtcagtgaggagaccgccgcaaaatgcagactcagaggtgtgcataggtgggctgggcccggggggatagccgcagccagctgtgtactcggaggtgggcaaggagtgaggcggagggggcgtcacctcctccctctcctcctcctcttcctccctcttctcttcctccctcctctccacctcctctctcctctcctttttcacctcctccctctcctcctccctcctctcctttttcacctcctccctgtcctccttctccctctccttcacttcctccctctcctcctccatctcctcctcctccttctcatcttcctccctcctctccctctcctcctccctcctcttcctcttcacctcctccctgtcctccttctccctctcctcttcctccctctcctcctcctccatctcctcctcctccttctcctcttcctccctcctctctcttcttcctcactctcctcctcctccatctcctcctcctcctcctcttcctccctcctctgtctctcctcttcctcactctcctcctcctccctctccttctccctctcctcctccctctccttctccctctcctcctccctctccttctccctctcctctctctccttctccctctcctcctctctctccttctccctctcctcctccctcttcttctccctctcctcctctctcctcctccctacctctccactcccctcctctggtgctgtggctttccctcttttcctcctctcttcctccctcctctgctcctccctcctcctgcctccctctcctccgcctccctctcctcctccctctcctcatgctctctcctccctctcctcctacctttcctcctcctcttcctccctctcctcctccctttcctcctccacttcctcctccctctcctccctctcttcctcctccctctcctcctcctccctctcctcctcctccctctcctcctccatctcctcctccttctccccctcctcctcgctcttctcctcgtccttcctctcctcttcctcttccctctcctcctcctccatcttctccttctcctcctccctctcctcctcttccctctcctcctcttccctctcctcctcctccctacctctccactcccctcctctggtgctgtggctttccctcttttcctcctctcttcctttccctcattttctttctccgcttttcctgttctcttttcaacacttttatcctcagtatcattttctccacacacaattcaattttagagaatgcttgcatttttttcacattcaaacagatccacaaattcttgttagatacacaagaaacacatacaagtggaattggaaacacgcccatgtcggtcgctgagttacagaaggggccatgcactgtgacttcctgatgccagaggacacgcagtgccccacactgctaagctcagggacgcagccttcctgatgccggaggacacgcagtgccccacactgctaagctcagggatgcagccttcttgatgccggaggacacgcagtgccccacactgctaagctcagggacgcagccttcctgatgccggaggacacgcagtgccccacactgctaagctcagggatgcagcaaggctctggcagatcctgcctgtcatgtcctgtcccccggacactatgaaagggcagtcccgctgcatcagggacatgcatgctcctctcacacatgtggattcagagctagggccagaaggtgtgcttaggcacagcagtcattcctgggctgctgacataattcagcgaacttcacatcccagtgggaagggcaggctcgctcatttataatcagtctgcatgcaatgcctacagtaaaactttgaaatagaaatgaaaatttctttattgttatttactttaaaagcactgaaagatccaccagaataagatgtctgctgaaaagctagtttctttcaaccactgctgaggaaaatggtttaatccataatattgatgcataattgacttgtataacattaaaggacctttagaaaaatctttacaccacagcaaaaaaaaaaaaaaaaataccccaattcaaaccaaacgagagcaaaaaccaattcagacaggaaccactgaaggaattaaaagttacagaaccagagtctaaagtgagcacagcaaactccgcggtgacaccagagctccaagaacacacagactccctgttttcctccctggggacaggctaggaagtgaggaaggcaactgaccttctcaaaagccaacgctccgcctgcatggctcaggctgacgactaaacatgtccacgtgaatgcaggcgtcgaatgcccaagtacatgtgaatacaggtgtcgaatgcccacgtaaacatgtacatgtgaatacaggcatcaaatgcccacgtacatgtgattacagttgttgaatgcccacgtaaacatgtccacgtgaatacaggtgttgaatgcccacgtacatgtgaatacaggcatcaaatgcccacgtaaacatgtacacaggtgaatgaatacaggtgttgggtgcccatgtaaacatgtacacgtgaatacaggtatcgaatgcctatgtaaacatgtacatgtgaatacaggtgttggatgcccacatacatgtgcattcaggtgttgaatgtccacataaacatgtacatgtgaatacaggtatcgaatgcctatgtagacatgtacacatgaatacaggcactggatgcccacgtaaacatgtccatgtgaatacatgcactgaacgcccatgtaaacatgtccacctgaatacaggtgccgaatgcccacgtaaacatgtccacgtgaatacgggtgccgaatgcccacataaacatgtccacgtgaatacaggtgccgccgaatgcccacataaacatgtccacgtgaatacaggcgctgaatgcccacatatgcaacaagtcaatgtcttcctatgccactgctctctggacagaccacattctgaaaacaatgatgaagccacacagtgctcagctcaagtcccaggaacttcctgctttatgctggaaacgggccacagcgctcaagcagagctccgctcacagccaggtggccgtgttctctgaggggttgtgccggggtcttcagacagtgccctccctggggtcttgggaccctcaagcaaatgccacctagaagcaaaacctgacttaggtcaccaggtgcaggccttacatatagaggtagtagcgctacattgaggatgctggacacggcttatctcctggaggagggctgcctccttgccatgggagccccgccctggctgccaggcttccctgggcaaggtcagcaaggcatgtgctcggtggaggaggcctaactgttgctactcttggtgacctgaggtgaaaggtcacgtgctggtcgcttgtgctgagcaaggccttgcttctcatctgaccaaagaagaccgtgtttcctgggaccctgcaggctgccagaatgaccgcccacccgctgcccctcaccacacactgctgcactgtgctccacatcctgacaggcagcaggaacccccaaattccctcctcaggccagtgccctccacgttgtccccagcagggcgacggagggtgggggcggcaggctgtctccggtgcttgccttctctgtctaaataacttgcttctcaccctgctgcaggagtctccgaagcacaaaggctgaccctagactctggccaggacgagctggggtgaggggccccggccagaaggatgtcctgatgaggggtcctgagggtctggggaaggcgctgtggcctgaatgctcaccctatggctgggtcacccagggcaccccgaggtcatcagcctgaggaagagtgctgggtgatttcattctccctggttgctgaaaatgagcagtgtgtgtcctcccaagcagggctgggacgccactgataccatcgacgtacaacacgccgcaagcagccctcgaggaatggaaaactctcagactgctgtgtccacacgggttaataaaaatgctgaccccagttcccaaggtccacaatgtccatggagagtaggattttacacacttattgatgaactgctatgagtttttgatgatggcttggctagttgaattctgattcgatactttataattagggctcactagtgacgagcaaaagcccgtgaaactgtctttgtttatgatcccaccacgtatctctactattaaagaattagcctctgggccgtgtgtcctcctggtctacctccagcacaaggacgttcctcagagcaaggcatttgctcgctccccttgctccttacacacggccttcccactcccagctaacacctgaaataggatgggatagtgcacactctgaaggtgaagctttaggtgacgtcgaagcatccagccatatctgtcagtttatataaggggtggcggctgctcagcgaggcctcaggagtgtgaaggaggcttggctggcggaggggccgtgctgctggatcagatggcggaacacggcccagagcaactgaagttcgcttgtccccacaggcagctcgacatggtgcagaccgtggcagccaagtcaggcatacagcagccctcttgctggcttccagtactggctctgcacgccttcaccgtgagaggcccctggacaagggactgccttcctctgtgcctcagtttccctgtttgcacaatggggcttcacccatttcgcagggtggtcacgggtattccctatgttggaatgcatgatggggccacacccagcacggagagagcacttgacactgttgcttgcatgtgcccccgggccaaggtggacgagctctccaaactcgctttctctgcctcatccgtgatgagctgccccgcgggtccccacagatcaatcaggacagaatactcactaaccaaaggtcggtttcacttctctcctcagtgcacacctgaactctcaccacccccaccgaggcagtgggcagcccctgagccaggcagctccaggccaaaccttctctggcctcctgccgctcacggccacaatcaccccacatcctggtccactcacacccacgtcacccacatgcggctccttctagccatgctcactcccctctgcggaacaagacaagggctcccttcgcctggctgtggtagtgcttgcggtcctatggccagagcactgccctgccacagccctgaccccacagcaccaggccttttgatgaaaagtctgtccttcccaggtccacggctgcttttgatttgatatattacacatgggctagtgttattatcatctcctcaaagtggagggtctgctacattaccgcctggacatgtccggaccaaaacatattttcagaataacacacagttaaccctccctgtgccaagttgttgatgtcaagtctctttgaggacagtgcttacaacatgcgtgcccttcttctggtcccagcaaatgcagcaaacaccatcgaatcaggccagactcgaccactgcaatcaattcttctgggtctgctctcagacttcaaggtgagatgaatctgtactaagaaaacttccactttttcaatactatcccagagagcctggttttattgtcatgggttcccatctcatacaagttcgagtatgaagcgtgcagctgggagagctcctggatggtgcatggcggaagcttcctgactgaggacaagctgacccagcttcctcccaggttgctttcttgccctcagtcaaatcgttatttctgcatctttatcaagtcatctgacttcacagtacccaaaacgtatattacttcagcctcaataccctgccccagcctcccagccagctccaaatcacatcccactgctgtcgctgacttctgtggcaaaccacaccccactgactttggcagcagctgtcagccctttctgggctttcaggggtggatgtgaaatgcccacacagcagcttcaggcagatgcccatatgcctgagaagcttcctgcattttcagccaccactgtcctccaagcttgccacagacgggagtaggttcccaggtgcgggcacacaggtatggcctcgcctatgctatctctttcactgtccctagggaatagacctgggctggctttgccaaaggtgtgggtggatttgccctgatggcttacccaggcctcgcctgctctgcacaggaccgtagaccccatgctgaggggcggccacagaggtgtgcagtgcaaagccacagaccaaactgcaagtaatttgttcatgtaagaattcagctcatgagctcagccctggcacaggctccagtcaaccacgctaagtgggtctggactcaggcatccgagaattaatggggccccgggttgggatgcatgcagtgccaggcggaatcggttccagcaggcgtctgggagggccggtttggccccagtatctgaaaacggtgaatcagctctaagggtaggagctgcagcccgccctccacagagggggtccagggcttcttactgatcatccaggcatgggaagctgatcagggtcaacctatgaaatcacacatcccagttatgttgtctataatcttaacagaaacagcagaaataacctgagagagaggagccatctaaaaactcatacatgtataatataccaactgcccccaggggtccctgaaagaacgacgagtgtcggtactccaagaaattatttggaaaatgactacccaagagatgatcacacagcatcgcatcaacattcaggatttctttccagcacaaaaatgcccagtttggaaagaggaatcagaggaaaatggacaatgaaaataaaggctttgctctctttccttaaatagtagaggcgctgggatgacagaatgtgctggctgcttgactcggggagccttgagtgcactcggtgctggctggctaacatggtctgactgtgtccccacccaaatctcatcttgaattgtcccataatccccacatgttgggggagtgacctggtgggaggtaattgcatcacaggggtggataccccatgctgttctcatgatagtgaccgagttctcacaagatctgacggttttatcatgggcttttccccctttgctcggcacttctccttgctgccgccacgtgaagaagaacatgtttgcttccccttctgctgtgattgtaagtttcctgaggcctcctcagccctgcagaactgtgagtccattaaacctctttccttcataaattacccagtcttgggtgtgtctttattagcagcgtgagaacagacgaatacacctgccttggcggtgctgtgacacgtggcctgttactcacgttcccatctgaatatgtaatgcacaatggacactcccatgcacagcacaccgggagggtcctcaccacacagcctgggacatacgtccatccatacctaggaaggttcatcgaacgcatgtctgagcctgatgttcctcggcactgctggcccaagaggagctgacagcccacaatcctgaacattaccttgtgcttatttaatctagtatgaagtcatcttactaagaactccactaattctgagcatgcaggggccagcggagtccatactaaagttgaccgatcctggctataaaaagttctgcaaagaaaagtatggcagtaaacaagattccaggagccctcttgaaacagcagagaagacgccctggcaggaaggcctgtcccacctgtgggtcctggattcagcctcccgccccactcccacttactcggaacagggactttcccatgtggattcgtatgaccctacttttgagtgatttcctccggaggctgttcacatttcatctttgctccaggccctctgaggcttgaacactgccctgttttcattcaagaagaaaagtgaaaccaggaaggcaggtgtctttccagagggctgggaggctggttgaatggaggatattccatctcttactctttcaagcagagcgcagctgctgtcccacaggagtaaattcaggatgagtggctgaaacatttcccacatggttggagtttaagtctctcaaggtagagacactcatggtgtaagtgcagaggaggagaaggaagctgggatgggtgtgtttagttctgcttccagggactattcctaaattctgcttgtgggcagggcacaggcagctcaacgttaggccagggaccaatcttaccacgtggcttctggcccagagcagctcgtgagtcagcctggcctagttggaaaggcaccaactaggtctcaggaggccaagtggggggcctgcccccacctctggggtctcagcatctgcacagtgacggattaggggggcggttcagcagcccctcgaaccttcacccggggctcgtttgctgcttcacactggaggaggtgctcctagcaagatgccgacctgcagcagcgcccacaaggctcagggctgggtccagcctcacctgcaaaagctgtggctgcgggaaccttcctgccctgcaggaaccacctcagcctcagcctcagcgctggagagaaagccctatcccgctcggcctgaccctcctctccacaaagggcttgaagagcaactgacccatgaaacgggcaggggctgggctgatcccatatgaaacgggcaggggctgggctgatcccgtatgaaacgggcaggggctgggctgatcccgtatgaaacgggcaggggctgagctgatcccgtggcagtgcaaaccgagggccccctgggtctcgacatttcaccgcaaaccctgaccccacacccggcctctctgcagctaatggaaggaaatgaacccatcgtgtggggcgacataggggcccagggggcctggacaagtaataaggtcaagatatttttggacttgttcaaatgggtgggcagctgtttctctgaggaaacgcgcccctccccagtggccaggtgagcagtggggctggagaggagagcagagggagccgaggccctctgtccaggcggctgaggtcacgcggtctcttcagtttccatttttccacttgtaacggctgttacagccgctgtttcatcgcgtcgtcataggagttgaacaaagctgtgtgtgtgtttccagaatgttggcacagcggcgagaaggctgaccgaacaccgagaagcagccagcacaggctctccacaggggctctggcatggagcaggataacccgggcccacgtggggacacgccccgccccacaggcttgcaccggggtgcggcctgccctgtctggggcgccaaggccagtggtgtaaatccacactctatggtgacggtggatccacagctgccgcgggtccccccaaccccaaagccactgagtgaaaacagaccacggtgctccaaaacgaaatcgcccccgaggatgaaagggggtggtggaaaaggccttggagcctggggcagggctcagaggggccccaggccggccccactcccagactagagccagcactcgcgggcaggcctccccaggaccagagcgcctgcgacctgcctgggtgccatccgcaaacctggtctctgctgaaatctgaacagtctacactggacagacatggagggaagcttctcccaggaccagggtccctgctttctgcagacggtgggcagagggcagagacggagaccgtgggcacagcacaccaagggggagcctgctcagagatgggcatggggccggcctgggaagcatggcgggaggggagaagaatcgcgatcctttccaggtacacagtctagcagctgccacgcccggctgggagctgagacgcgcagggggcccagctgaagcctgcgttttcccttctgcacaacagcggaggttttcctggagttcataatcactggttttttttgtgtgcgtgttcaccagcctgctcacctgggtagcagggtgggagggccgggtggggatggctgcagggaccccctgggccggctctgggtgctgctgctcccaggagagatggtcccgtgcaagtgccaggcccctgctgtttggcctcctctgccccctgtggggcacgagcgttagccgcactccgagtgcgcgccaagggcttcagctggctgagcgcttttgctgtggggtggatcccaggccctcgggccagccctgcgtggggttctccctgctcacacaaaccacacggggaacggcacaggtaatattaaccaggactagcacctagggccccacaggtaccgttcacgtatcctggctttagtcttgctggttttctcaccagcatttagtgctagttcagtatttatttaaatcaacatgttttgaaaaactgcctaagtatctgaattgttataaagtttaaggaccatgaagtctaagaaggaagattatttattgtacttctgggaaaagcccccagaggtgggctcatttgctgtgatcttcgtcccattcacaaagcactcctgggcactgtcccagctgtggatggcactggaaactgggcttgtccacagcgtgagtcccttgaggctggaagcacagagtggctgtccccaggtagttggtgacggggtgaggaccgggctcgctcccactctcaggagcctcactatggtccccagagatagaggacggtgaggcgctgccggtgagggccacaccaggccacatccgtgcagaaagcaccctctcattgcaatgtgtttggaaacatgaattcatgtggcagcggtaacatttagaagagaaacagccacatttaaaaacgcgtaagactcacagaacctcagcctgctgtggtttcatcatcaggtgggtggcacattccagcggctttggccttgcctgcccagtgcccagagctcagtgcccactgtgggaagtgcagggagcagctctggcacatcccacagtgctgtctgcaccaccgcacacagagtgccagtgtcagctgtaggtcccatggcctgaggaagccactgagcctgggacagcttgaggggcaggaggcggacacaggtgcggcgggggacgcgggggtggctgcccgggaggcggacgcgggtgcggcgggggacgcgggggtggctgcccgggaggcggacgcgggtgcggcgggggacgcgggggtggctgcccgggaggcggacgcgggtgcggcgggggacgcgggggtggctgcccgggactggctcttctggaagcaattcgtgggaaacccacttggatgccacttatgacccccgcgtgccagtggatgcccacaacccctctggggtgtcggggatcaggtgagcaagggggctcatccgtggcctccaggccccaccttgatggaaactgcgacaggagggggtctggcctctgctgggagtgacatctgaagatgccatagaaagtctggcgcagcagccggtgggcctggggggcgcgtggactcccagctgttgctgtgcctgggtcaccccagtgggcagggcgggcagggggcttccccacagtctagggggccaggagagcccctgggcctcacgtcctgcttctctccttgtccttcatgtcttgtaggcgaccccacagagagagaggcagaggagagtggccgtgacctggaggacaaggacatgcatttcacactgaccggggcctccctgggacaccctgaacacctgctctgtgggagacggggtggtgtttgagctggtgccatctgggtcccctggggtggtggctgggtgagcccagccccatctttccctcggacttcatttgtgctcatggctgggggaggcacctgggggccccgtccaagctgccaagggctggggtgggctgttcccctcttggcatctccctcacacctctgcacccccagtggataaaagctgctggcaacatcgacgtccccaagacactgacaggcctggaggtctggacaatggggagccagcaccgggtcccctgggaaccacgcagccggggcctggaggccgacacaagccagacccagcctctctgccattcgcaaatcccagtgttcaaacagagttctgccaaagaagagaagaaccagtaaaaagcagggaagaggctgggcgcggtggctcatgcctgtaatcccagcactttgggaggctgaggcgggcggatcacgaggtcaggagatcgagatcatcccggctaacatggtgaaactccgtctctactaaaagtacaaaaaagtagccaggtgtggtagcatgagcctgtagtcccagctactggggaggctgaggcaggagattcacttgaacctgggaggcggaggttgcagtgagctgagattgcaccactgcactccagcctgggaaacagaatgagactccatctcaaaaaaaaaaaaaaaaaagaaagtacaggaagctttcagcctccttggcaagacactgctgtctggagaccctgggagaagtgtgccatcaaccaacgtgaccagaacccatcctggtttagggaggagctctccacaggcctccacggggctggagcagtccccaagctccaaagagtcccccacgacctcttagtcgtcacccctaggaagggcctagaaggcagatttcccaccatgagaagccacatggagcccagctcccaggcatgcagccctgctgggctatgcggggaagatgtgtgctctgaaggcctctggggccacccaactgccatgcaggaggcctccggggccaccccactgccacgcgggaggcctcgggggccacatctccgccataggggaggcttctggggccagccctctgccacacgtgaggctgccggcccacttctctgccatgtgggaggcagccggggccacatctctgctatgctggaggccgctggaaccacctctccaatgctggggatagctccctggagccatctcctttctcacagaggcgaaacccacaccttccccaaggaacggagctcacgccccttcctgcctccatttcccaagctgtcaccgtaacagtcactacaggacagtcagaatggtaggatttgagctaaattgctagaattagagagcgtcacaaaaattctaggaggtcagcaactttaggtaatgcccacacctgatgggggaaatcactgtcttccggcgggctggtcctctttggtgacagatgaagtcagatgcttccgggatgaatttggttcacctttgaaggacactttgaaagcaacacaacaaaactggctgggccttgtactctccgctccctcgagaagctccccgcccggtgccgctggcttctactgtttctaagctgcctgttgggcacgttccctcctggtggtcccggggcagccagacccaccctgggacatccaggccccctgggcacagacatcttgtacaaggtcagagagactgggtttcgggcttcatgagcctcagaaattcagctctcaggaggctcgtgggaggcctccagggtcaggtctctgccggagagaaaaggggcggcctgggcttctcttcaaaagtgttacctgacaacaagggaattcagccacacaccaggtggctccgtggtcccctgaggtccccagcctttgacagtgtgtgtgtatgtggtgtgtggtgtgaaatgtgggtgtgatatgtgtgtgtggtatgtgtgcatgtatgtgtgtgggggtatgtgtgtgtggtgtgtgtggtatggtgtgtgtgtctgtggggtacatgtgtggtgtgtgtggggtatatgtgtggtgtgtgtgtatatggtatgtgtgtggtgtgtgtgtgatgtgtgtagtatgtggtatgtttgtgtgtgtagtatatgtggtgtgatgtgtatgtggtgtgtgtagtatgtgtgcaggtatgtgtgtggtatgtgtggtgctgtgtgtgtggtatgttgtgtgtgtatggtatgtggtgtgtgtgtggtggtgacatgtgcgtatggtggtgtgtgtgtggtgggggtgtgtgtggtgtttgtgtggtgtgaatgtgtgtgtggtgggggtgtgtgtggtgtttgtgtggtgtgaatgtgtggtgtgtgtgtgtggtgtgtgtggtggtgacatgtgtgtatggtggtgtgtgtgtggtgtgtgtgtggtgggggtgtgtgtggtgtgaatgtggtgtgtgtggtgtgtgtatggtggtgtgtgtgtgtggtgcgtggggtggtgacgtgtgtgtatggtggtgtgtgtgtgtgtctgtggtgggggtgtgtgtgtggtgtttgtgtggtgtgaatgtgtgtggtgtgtgtatggtggtgtgtgtgtgtggtgcgggggtggcaggatgtcattaacttggttctaaaggtggtttgggttcaggtcctggagtacatgctcaggaactgtcaagcaatctgggggcacaggaaggagaccgggcgctcctgcaggtattaaatcgtgttttgcgtgaagatcagcgttcagaccagtagtacaaaacagatggtctaggaatgaacgtgacaacacaagggcctggagtgtatgacgaagggggcatttcaaacccgtgggtacagaaaaaatccacccgataaacacaagtgggaaattgtgtaagaaaatgaagtgagattccaatattaaaaagtcagataggtcaaaatctaaataataaacaatttaccataagataattagaagaaaatataaaatactttttaatcttgggttcaagttgtcacaaaacctaagctattttttttaatccagaagtattaaaagtttgctatttcctatagacaaatagctcctacaacttggtgaggaaacagggtccaggagcattttctctgctcgggtgaagctcaggggaagacataagtacatgaaagacattccgttctgtaatgattaaaaaatcaaaagttaacaccatcacattggtaaacgttaaaaggtttaataactttttttaatatactgctgttgcacatgcaaactgataaagcctttttggaaagtaatttggcaataaaaatgcacatactttatgagcaaaaaaaatcccgtttcttataatctaattgataagaattatagcataagtgcatgtatgtgtatgagaacagtcactctggcatcgcctgcaacagcaaataaatgagtggcaaacaagctctcgcggagggtatttaaatattttatgtgactaagaagaatgagatacgtccatttgctgtgataagaaaagatattccacagtttcgtatttgttaagtattttcagcaaatcatggaacacgatgcaacacccgattccatgtttgaaaacagaacagaacaaaattcaacaagaaataagcgcccgcgtccacatattctcgtgcctggcgtgttttacgtgcttgggaagcggagcggccgctgggcttggctctgaggtcgggactggtgcaggcggatgcatgtatgtgcccgggtcccgcctccacacgcctgcctggcgccagcctgcctgtcctccctgcacccgcccccgctccctgcacccacctgccccccctccctgcacccgccccccctccctgcacccacctgccctactcagggtggtgagagcggaggggctctggggcttcatccacacgtctcctagtcaccctctcgaccaagagcatcctctggattttacattcacttggcaacaaaaaaagtttgagagaggactttgaacatcaaaaatgcttacatttgttatgtcacaaacacaaagcgttctcctaggaggtttctggtacagaccatgtttcctgaggacctggagggtatcgcacctacagccagcaacgccgtgcagcacgctcggagcgcacccaagagggcagatcagaggggcgcacgcggatccccaaaatcctgaagatatgtacggaaaatatgtgcggcttttcctgccgaccaggcctccacgaagtgcttcgataaaataaaaccagcctgtcatggaggagtcccctttgcccggagagcctgtccttcccctctgggggtcacactgccagtttgtcaaagttgggcgaagtggcccctgcctggaactctctggccttatgaagccccctccccgttcatgccgctcaatcgagtgactcttacagatcatcttgagctgcctcatggggtggggctcgcgttcccatctgccttctgcaaggtgtggcctctgacctgcagcccgcactgagccagcaagccgcgggagaggccaggcgcccgcagcggggcatctgcgcctggtgtgcagcgtacttgctatactcaggccagcccagccctgggccatctccctgagtttcagctccccggggccacctctcctgggtcccctctttgctgtggctctggcggacattagccagcagtggagagaagcccatctccacccccagggagctcagccgaggtctccgcgtcccagcaccagctgccttcagctcgagggtgtgttttcgggggtggggatcccacatggcacggctcctgcacgtccagggcatctgctagtcgtctttgcctgctccccagtgtcccaagcaactcagtaggaccttggggaagctgggtgctcacagaacaccttgtaagcgaatgaggaaagcaggcttgtccgctggccacactgcacgacagacgtctgcccaggctggggccgggggtctctgctcctacagcccgcagatgggccacccggaggctgccccgtgatggctggacctgaggctttccagtgactaggagggcttgggtacttcttattcatgagctgtacgttctacagcgtggctggtcatttaatgtgtgcaatcgatgggcactgcgcttcaacttcaaagcatgaccgggcggatcaatctcccagggccgcgggtgccgagtttaaaactcatctctttttctaaagtggaggcaagggaccccagtttgggattaatcagcagtgatgagcttaaataaatgagataaattttctatctatcttgtaaggctttttttcagaattaatgggacccctctacaatgcgctgtgcccggggagaggaagggggcgcagctgcatctgcagctgcggttgtggtcgggagaatgagggcctggagctgcccaggacgggctcaggcacaggcacccagccgagagtcccctgctgttccctctgcagagcaaacacagtttctgctgaaaagaatgtggcagatgaacaaaaattgtaaggttttctaaaggtgtttcattacgtgagatggcagaggttggtctccatgtcacagatgaccctcgcggcggtgataacctttacattttggggtgctctgtggaccccctgtgtaccctgtgagtatgcacgtttctagaggtggagtttgacccttgaattgttcaaattataagtagaatcacagaaattgggggaggaaaggatctgaggggcctccagggcccgtggcttcaccctggggtgggggcaagggcggggcgtggtgcctcttccggggtgggatgggtggatgctcgtggttcattcccacgtgggattctcacatgctcgccctccggctgtcaggagcaatggtgagttctgccacacgtggaaaacacgttggcttctctgggttttaagtgtcctgtcagcagctcggagcctctaggagacaccgtcccccagggccacgtatagatccactggaggcctgaatggcataattcgtggcacccctggcaccacacaggggtgtttctgtccccttctcctcccatggcttagaagcagtaatctcctgacctccaggcagaagtcaatttcctcctttgcctcctccgccttgcagggaccccagggctgacctgcctccctcggccccctctctgccagagccaggtctgaggtcaaggctttcggtgtttctgaggccacgctgagggccccacagccccttcccgggtccccaccctccaggccaccttcgggcctcggcagcacacctcgaggggcccaggacaagctcggggcccaggtggccgggagggggccgcctgtgtctcgcccctcattctctgctctgacccgggctcgcacctcccctcgttctctgctctgacccgggctcgcacctctcctcgttctctgccctgacccgggatcacacctccgacccgggctcacacctcccctcgttctctgctccgacccgggctcacacctcccctcgttctctgctccgacccgggctcacacctcccctcgttctctgctctgacccgggctcacacctccctgctccacccaggctgcctgcacttccggttctgcgtctggccggcctacgggcactcgggcagtgcggtgaccaattatagcgtcgacgatggcagcttccctctgaaagcccattgtgtctgcccctattctttgaagcttcactgctttcggataagtatgaaaataggctctccctctctgagtcaaaggaggcaattatacaataggactatcaccctcactgtcactctccgctttgtttaaatgtggggatttcatttcttcatcgcctctgtgaacacccactaaaaccgtaagtgggaaaagtgggtgccttctgtattttacattttttattgtgtcacttactgcaaagcagctcaaggagcctgaagacacccagcctgaaaccacgataaatgtgtggagttgtggagacagctcaccagcagaacagtgagctaccttctctcccagtaaccttttccagaggaaacctctttgaaatatcacaagcaaaatttaaatcacaaaatacttcatatctgcctgcactcattgtcatgctaaagcacatcacctcggtcctcagagaggagggatttccatgtgaaagaggccagagtgcttccctcacttagcggggatgcaattataaagtattgaaacttcctctaagacatggatccctgtgcgtcgcagcccctcacctgtgcacctgggaggcacctggggatggggtgggggtgtcaagcttgaagcccctcacctgtgcacctgggaggctcctggggctcaagctcaaagccccctcacctgtgcatctaggaggcacttcggcggggtcgggggcggggggggctcaagctaaaagcccctcacctgtgcacctgggtggcacctgggagggggactcaagctcaaagccccctcacctgtgcatctagggggcactttggcaggagggagggtgctcaaactaaaagcccctcacctatgcacctgggaggcccccaggagctgcagcaaagctgggccccagccacagcctgcaaaatctccgactccacatggggcctcagcaccgtctgtttgctcaccctccccagggggctgaggctgggaaccactgctctttaactctcaacctcttcccaaggtgctgtctatctgtggcccttggagttctgtactcggcagtcatttatttacaagtcgcatgagaaagtccttccagccactttctgtgcttgctctgacatttgcccaaactaacgttgctgaggttgacctcatgtttattcagggaacttgattcattttcaagctattgataacaacaaagtcctccccaaccaaggaacttccgccatggaggcgttttcaaaagaaagtgcttgtgctcatccccagagggttcctgagcctgtggacgaggcgggaggcgggaggtggaggaggtggcacctggcagctcacctggtgtaccttctgtgagacccagccagcccatcggtcaccaaggggtgcatgtcacaccctgacctgcctgacggagggagcccatgaagcagaacaaacacatgtgatgctgacgccctcagaaacctggggctaaggccacacctgatcaccgtgatggaggggggcaggcgccgaggcgaacttgggagaggccctatggtgcacacccctacccttcctggctggagaaaaatggcccgccccgtgaaacagcaaataaacacacgcgttccaggacgtgagatacggcctccacatcaatcagagggacctgcccagtcctgtcaattttccatctaaattacataactgtcctccttagagacgcggggatgcccaggcacaggcatgaaagatcggccttgaggttattttgtctctgcaagtattgatgcgaggacttgtggcgcttttctttcccggtgaactttcccaactgctgatgttacgtgcactaagcacatgattttcctattcattcccgaatctcacattttaccgggatggtgacatccctgtggggccttgtgggctctgagctcatctacacccaatcctagtcagctctgctgcccctgcggggtaaactggcagctctgagttcactgggtgctgtttactgaacgcctgcccatggaagccactgtcctcatcactgggaaaggcgcagagaagagaaggaaacgttaaaaatctggttggagagaggaaacaaacttggaccatctttgacagtggtattagtccattctccatggctacaaagaaacacctgagactggatgattctaggaaagaggcttaatcggctcagagctctgcaggttgcacagggagcacggcagcttctgcttctggggaggcctcagggagcttccagtcacggtggaaggcgaaagggaagcaatctcgtcccacggtgggcgtaggcgcaaggtgggaggggctacccaggtttaaacacacgggtctcagaaaactcactatcatgagaacagcaaggagagggtggtgcaaaaccattcaaaaatcacccccaagtccagtcaccaccccccaggccccacacccaacactggggattacggttcgacaggagattttggggcacactgatccaaccatctcaacagcaaagagtgatctgcctcgagttccgactcgccgctcagacgaactcacggctcagctgggagaatcacacgggaggggcccatgaacgggcactggggccacagccggggattcaactgcaccgaaatcccagccctcaacacggcccacggctgtgtcatcccggatttatcactataaagcaaaaccaaaaacggacctcaggtttctctgcaatatgtaggatccgtgaaacctccaacgtgaaatgagaagtaggtagcctcgaatctgcacccaggcagccccaaaggctatctgatgacaacacacattttctcatgaagcggaggagagtccggccttgttgctgggcctgcaggacatcccatcgctcatcttaattctcctgagggtgatatttacacctgatatttacaaggtgtggcaagtgagaatttcatcccagcctcctgcctggcaggttacacaagctggccacagggatgcttatgggctgaggtcgtgggaggcatcccgtgagggtcacaggctgaggtcgtgggaggcatcccgtgagggtcacacaggcaaagactgtcagccaaaaggaattccaaggcccggacgggaggcggccacaggctcctgggtgtgctgtgggacgtaccactcggtggcagggcctggccagagagctgccctgcaggcctgtgggatccttcaacgcgaagcttgcattccaggagctccctgagccctgagaccatggtgaggggctgcgttgggccaggctgggtgtgcacctgtcagttacattttcctatgtgtcctccttcctttctttggagcctgaatctttgtctttagcatcctttgtagtcttgaattctgagcccattcctgagacccctctgaacctccagaggccccgcagctctcaagctggaggactggggactatgctcatctttcctttgaccccaggtctgtcttcctacatttctttaacgattatttctctgggccaggcgtcgtggctcatgcctgtaatcccggcactttgggaggctgaggcgggtggatcacctgaggtcaggagttcgagaccagtctgtccaatatggtgaaatcccgtctctactaaaaatacaaaaattagctgggtgtggtggcgcacgcctgtaatccaagctgctcgggagactgaggcaggagaatcgtttgaacctgggaggcggaggttgcagtgagctgagatcgtgccactgcactccagcctcggtgacagagcgagactcagtcctaaaaaaataaataaaaataaaaatagaaaagaattatttctctaccttttggaatgtgaaattgcctctgagacgaacctgtgatttgtcacctctgggagatgacaaggatgcctctgtgacctttgtccccatgctaaatattttgtcaccatgctggctttcttgtttgcatcagtaacagaccggccatttctcccatttggctgtacagtcgttagcagtggcccctccacacacacagacacacacggacacacacagacacacacatggacacacacggacacacacacacacgtcgcttctggtctgagaatgtctgcctcctttccattcccctgggcaggttattttcttctcctaatcacaaaacccatccttcatcttaataattctcctgagagcgatatttacaccctataattagaactttatgttcgttttattaattacctcttttttgcctattgatgtgaaagaatctggggctaaaagtattacagatggctctacacattgaaccgttgatatttaaactcaatcagcagatgctggtgctgtggggtggggtggggcagggtgggcgtcccaccggctcctcaggccttcctccacatcccatcggctccactcagggactccacttcttctcagcacctgtgccctccagtccctctcccaggaaggcagcaggagaggagacccccgtgccatcttcaataccacccctgtgactagggtgctgccccctcctcctttcttctccaacttctagatttggcccctaaatgtgactgaataacgtggcaagcccttcagacatgacaaccccatcgggtcagagaggtagtggttgcagctgggcctggcccaccatcggggtggggccagcaggagcaggagcacgctgtgtgctcgtggggaggaagggctgggtgaggctggagcgtgggtgggaggtgctggacagggatgctgagggcaacgggccctccctgcaccgaggcttcagcagccctgctctctgctgtcagcctcggatccgggctggcctggccttcatctctccccaggctccaaagaccccacatcgccatctcttgccgtgagacctccccacgctgaacgtgtgttcctctagccacttactcaacgtctccactgcaggccccagtgtaacttggccaagcagacatttcattttccccaccagagcagacccagcccagggctccctcctcaccttgggacctacagcaggtcctgccccagctccatgtgcgggtccctcatctgactcgcacactgcccctccgactggcccagggcctccactccagcgtgtgctcctcaggcccagtgttctgagcgtggagtgaactttctaagtcacaatttaagtcacatccctctccctctggaaatgtctgctggctttgcacccaccaaggacaagatccacagccttcaacacacggcatcacgaaccacctcccgagccggccccctccatccctcagagtcaccacaatcggcctaccccgtccctcagaggcaccacagccggccccctccatccctcagaggcaccacagccggccccctccatccctcagaggcaccacagccggccccctccatccctcagaggcaccacagccggccccctccatccctcagaggcaccacagccggcctcctttgtccctcagaggtaccacagccggcctcccccatacctcagaggcaccacaggcagcctcctctgtccctcagaggcaccacagccggcctcccccatcccttagaggtaccacaggcagcctcctccatccctgaggcaccacaggcggcctcctccatccctcagaggcaccacaggcggcctccccatccctcagaggtaccacagatgccctcctccatccctcagaggcaccacagccagcctgcgtggcctctgtgtttctccccggggtctttccaggctgggcttcttctcgtcctaacgctcagaggcctctgcttagccccaccttccatcactgtgccctcttctcctttcttcacatcacaccttactagaaattacccggtcactatagtgcctgtcccttctccgcgacaaggggacccctagcgtgcttccccgctgcgctcccagctcctacaacagtgtctggcccctcaaagcgactcaacgaccctctgctgatccaaagactcggcatccatgtgcctcccaggccgccgcactcctcctcctgggaacaccctcgtacggacgttctgtggaaatagatgttgtgttttcacctcttgtaccttgttcacttaaaatttaatcaacatcttattagagaaagaaagaggttctttgctttttttaacttttaaaatatgaatacctgccgggtgcggtggctcaggcctgtaatcccagcactttgggaggccgaggcgggcggatcacgaggtcaggagatcgagaccatcctggccaacacggtgaaaccccgtctctactaaaaatacaaaaaaccagccgggtgtggtggcgggcacctgtagtcccagctactcaggaggctgaggcaggagaatggcgtgaacccgggaggcggagcttgcagtgagccgagatcgcaccactgcactccagcctgggcaacagagagagactccgtttcaaaaaaaatatatatatacatatatatatatacacacacatatatatacacacatatacatatacacacacatatatatacacatatatatacacatatatacacatatatatacacatatatatacacacacacacacatatatatatgcacatatatatgaatacccaatacccaatccacagctttctctttgtggtgcttatgtggtgtcacaatgcgtcttgtgcctctcatctgattccgctacacggtgcaagttacgccagaccagaaactgaaccgacgctgaaagtatcaggccttccgcttagcgctgccttcgagatcagtctctcgacccctgttaggagcaacggcggtgaggcaggatgaacggcctcatccacggagcactgctttgccgtctccagaaagagctgtcgaggtttatttattcacggagaggctctgcatcacgagagtgctgcgttaacccaggtgcgggggatattatcctccccgtgagagcagctgcatggatttttttaatgtcaaattccatatgaaacagcacaaatccccatttctgccccactgggttgagaaatctgtgggtgatagagtataggtaaaaacatcttagcctgcatgaaaacaaacatcatcttagaagaaggaaagagcaaatgttttaaaggcctaaaaataataattttctctagggaaaaatttgatgggcacgctatgatttattgccaaatgatatttaagaaaaattcacaggagaggcggctgctgaatgcctccaccgagggttctgggaaggaaaacgcccgcttagtggaagaacagaacggccgcacagaaagtgcttggtccttggcttcctgtgtctcccccaaaacacacgtggcttatcagaaacctgcaggaaaacaacacagatttattctctcacaggaggccacggtccagatgggtttcactgagctgaagtcagggcttgggtgggccgcacgctctggggcggctcctgaccttttctggcttgtggcacctggctggacttctcggcgtgcagctccttcgtccaccgtgaaacccgccccggcgtccctctccgactccgcttccttcatgggacttcacttccgtgtgctaagaacgtgtagcgaggcccaccgtgttgacacttccctgagtgtgcagcgtggtactgttggctctcaaccgtacggcagatgtcgagaccgcgttgaggccgcgtcgctgaaaccttgtgcccttggaacggccccttcccgtgcttcccccagcgccagacccggcagcctccatcctcctctcttcttcggtgcgttcaattgtcatagattccacgcttcagcgacgtcgtgcagcctctgtcctgggcctggcttttgtttcacttcacgtcatgtcatgcaggtttatccctgttgttgcagatggcaggttgtccgtcttgtcttaaggctgaagagcacccactgggtctatgcaccacgctttcctgcccgctcgtccctgggggacatgtgcttccatgtcttggctcctgtgaacaatgccgtgatgaactccggagcgcacccgtcacttcgaggtcctgatttaacttcctttggataaatatctggaagtgggattgctgaatcatatggtggctctatttttaattttttgagaaaacttcatactgttttccataatggttgcaccatttatattcccaccaacagcatgtaagtgttcagagtctacacatcctcaccaacacacgtctttttggtcacagcctcctgatgggtacagagacgtatctcatcgtggctctgatttgcatgttcctgatcattagtgatgttgagcatctttccatgtacagtgtgttggccatttgtatgccttctttggagaaatgtctactaaagtcctttgcccatttttaaatcaggttatcattattatttgctattgaattgtaggaagtccctatacattttattttattattattactttttggagatggagtcttgctctgtcatccaggctggaatgcagtggcaccatctcggctcactgcaacctccacctcccagattcaagtgattctcctgcctcagcctcccaagtagctgggattacgggtgcccgccatcacacccagctaatttttgtatttttagtagagacagggttttgccatgttagccaggctggtctcgaactcctgaccttaagtgatccacccacctttgcctcccaaagtgctgggattataggtgtgagccaccacacccagccacctatacattttaaatattaactccttatccgttatgtggtatgcaaatatttcctccccggtgaccagtaggggatgcagagaccacacacccaccactcaccctacctttcgtgggctgccctctggatttgctgattgtttccctgctgatgcaggagctcactggtttgatgttgtcctgcatgttcacatttgcttctgttgcttgtgcctttggtgtcagatccaagaaacctttgcctagatgaatgtcatcatgcttcccccgtgttttcttctagtacgtttatggtttccagtcttatgtctcagtctttagcccatgttgagtgggtttttgtggatgtgaggtgagggtccgatgccgttcttttgcatgtggacatccagtttccccagcacctgtgaagaggcgacccttccctatggtgtattctcctcatgcttatgaaggagcacttggcagtgtatgagttgtttctggactctctgttccattgatctataagtctgtttttatgccagtagtgtattgttttaataaccatagctttgtaatatattttggaattgggaactgttgcatgattttttgtggagctctgggcaggtttttcatgatggcaaaatatgtcaacttttctttttggtgtaatttcttcattgctaacattttccctagacagtgaaataataaacattttctaaaagttcctcaagaaaaactattgaaattatttagtagaaacatatgcaagagtagataatattgatgtatccttattatatttagaagttaaaattaaagaggatcttatgggaaatttaaaaattgcacagtaagggattccttaagaaacaggcgcaagcccttatttcgtagcatctaattcctcaccgggtgtggaggggcctgtttacccaatgcccccgcgaagtcatagtttggtggcatacagctcttaagaatgcttattagctcttaatatcagagaggattaacctcctacttcatgaaacaatttgctaaggctgggaatttttcttccatgtctgtgaggactgccttcccttctttccacacacttcttcattcgttgtgtacctgctgagcactcatgatatgtcagaccaagttctagggactgcagtggtgaacaactccagtgtctgtgcacggagcttccattctgtaaccatgcagctgctccagagaatgccaaggtcccagccaaaaagctctagatgattctagactgtgcacggagcttccattctgtaactgcagctgctccagagaatgccaaggtcccagccaaatagctctagatgaggggtgacacataaggtgaggacccacgcgtgcacacacatacacacacttgcacacacatgcacacagtctcccctctgacccttctcgccctactgggtgaccagtaggtgatgcagagaccacccacccaccattcagcaagatctgacaccttctgactcttgacagatgatttctgcagacagatccgatgtcatcttcctcccagccccccttctcccagtcctgcctcttcccaccctgcaggtctaggcctcactcacgagagaaggctggttttatccactgtgtgtggagcctggcaacaagcatcccacattggtgtgatccaggttaccctctcgccatgcagtgccctcactgcccttgctgcccctgagctctcagagggatgcgctgcctcagcgtggggtgggagtgccgctctgcacactagactcagtcctctctctgcctggaaatacccacaaaggccacaggatacagataatagctgtactggtgctctcagacacattttccatgaaaagaagaaaatagcaaattccagtaagcattaaggaaactccttctctgggagtctctgttcctctcccccacagtgcttcttatactgtgcatttgaaaggtgttttaaaaggacttgttgtttctttaagaagcatagaaaaaatatatatactcctgtgtgtgtgtgtgtgtgtgtgtgtgtgcgtgtgcaaatacatcatcaactgaaggtctgaagaaaagggaaaagatcgcagctcatcaggaatgaaaggtggcttgttctccagcatcctagttaaaagttcaaagcacatttttcttataaattaggctggagtaaaattcagggagatgggaaaaggaagacataaatttttaaaacatgcgaagaatttaaatgagcaccaggggtgaaaattagacacatagaacatgtattcgacgtaaactcccggttgtttaaagtcattaacgttgtgtcgttatgtctagtgtcaggttatggctccacagcctgtttgccagttaagcggtgggggcagggcaggccttggtcaatatttgagtaaaagaagaatcttaataaacccaagaaagtaacttcaataataagaccaggcagtgttttgcaaagcagaacagaagcaattcaaaagggagagagacacagccagaggccccaggagcccccaccttggggacatggagtgtctgtgtgagcctggctttgttctgaggcaggagggacccgagtgcttggggccagccctgtcctgttctgcgttagcgatggggtctggtgcttctccacacacaccgtggctgtgtgtgcaccggctgggtgacggcccaggtggttttgtgccagctgctgatgctgagtgcacctgaaaggcccacttagcctctttgtgaagaggtgtgggaagatgtgcacacagtagagagcagactatcacaagccacaaaaatgtgtgtgtgtgtaatatatataaaggtcgaccattccttatctgaagtgattggaaccagaagtgtctcaaattttgcattttagaatatttacatcacacttactggttgagcatcccaaatacaaaaatctgaaatccaagatgctccaaatcagcattttcctttagggtcaggcctatgctcaaaaagttttcgatttgggggcattttgggttttagatctgggatgctcaacctgtaggtgcatgtatatatgtgtatatatgtatatctacatatgtattcatgcatgtgtacaaaaatatgcacatatgtacatacagatgtatctgtatatatgtatatgtgtgcatgtatgtgtgcatatgtgtctatagatgtctggtatatatgtatatgtgcaggtgtaaatgtgtgcaatagatgcatatacgtgtatatgtgtgtatgtatgtatacatagatgcatatgtgtgtatacatgtatatgcgtgtacatctgtgtgcccataaagatatatgcatgtgtatgtgcatacgcatgtatgtgtgtgtgtgtgtacatcttctgtctctgcattcttactggcaggattattgggaactattggatctttctgaggaggccaggatgatttccgtggcctgccagtttctcagagctatctgggttgaggcactgagaaccccctcagtccaggcagaccacggcccggtggtctgcatgaacaaagtgagtacttggagggccactggcatgggcccagcttcccgctctcctctgcatgcacagcctctatcccatcagacctgcacctcagcagcaccaagctcaggggctgccctgggctcccctctgagcatcagctcctctgttccagggagagcctctgctcccctcagggcccacctccttctagcagaaagctgattcttccccagactgggccctcagttctctgctaggtttggccaggctggtgtctttgacatgatcttctgggaggagaggcagaaatggggcccttccgatgtagctggcaaagctgtaggtgaacggtttgtaccaccagggaactgtgcccgagaacacatatgttcccacaacaatggggtttgtcagcttgcaggtgcccagccctttccgtgccctcttgagatgggttggggcagacagagtaggaatgcttcctggctgattacaaggaaatcccggcccattggatggggaagccacaagacggctgcttggagagatggtgctgcacacacatggcagccagaacgagtgtgggttcagagagcaggaatagcactccctgcccttgtcatgctgtggccaaggtttaggactccacagggcccagatgtctcctctggtcccaggaggatggagcctcagacctggggccatggggagggaagaggtgttccttgggacaagcaggagcccagtgggcagatgcctttctgcacagccaggggactgctcctatttctactgtttgcctggcccaattcatcacaggagggtgagggcagggctgcatgcctgagagctgacaaatccttcacatcctggagctttgtactgaacactgcagggttccatacagctgtcagctgcagagactaggcaccgcccctgcaaatgcctggcctcctgctgtccagctgccttcactctggcccggaagtggttctggggacagtggcttccttccagggcagaagctgagatccagtgtctgtggagcctctcatggcacgtcaggctctgggatggatgtttacgtgggttaccctaccaaatccctgagaactgctgctatgattcccactttacagatgagaaaactgaggcttagaacattaagcactgtgagctgagatcattggctagtgagcagcagagctgaggtccaactccaagtgtgtttgcccccaaactcacactctgtaaaagtccatgggcatcccagatctcccacccatgtcttcccactggaccaggcatccccagcctctgggccacggactgacaccagtctgtggcctgttaggaactggggtgcacagcaggaggtgagtggtgggtgagtgagctgttgagtggccggtgagtggtgggtgagtgagcaggtgagtggcaggtaggtgagtgggtgagtggcgggagagtgagctgttgagtggccggtgagtggtgggtgagtgagtacgtgagtggcaggtaagcgggtgagtggcgggtgagtgagcgagtgaaactttgtcggtatttatagccagtccccatggctcacagtactgcctgggctccacctcctgtcagctcagcagtggcatcagattctcataggagcttgagccctgttgtgaactgtgcatgtgagggatccaggttgcacgctccttatgaaaatctaatgcctgatgatctgtcactgtctcccatcacccccagatgggaccagccagttgcaggaaaacaagctcagggcacccactgattctacatgatggtgggttttataattatttaattatatattacaatgtaataataacacaaattaagtgcacagtaaatgtaatgcgtttgaatcatcctgaaaccttcccccaaccttggtccatggaaaaaccgtcttccatggaacaggtccctggtgccaaaaagagtatggaccgctgtcctggacaaaccctgggcctggaattgaccttgttgaaaacactcttttggattaagcatctataagattcagttgttgccttggacgattcacatttcacatggtcagtccctgcagcacctcccgaagtgtggtgtgtcacttgcttttatgtggaatgtgggcagttcttaaaactttattttaatgcacacgttcagtccctgcagcacctcccgaagtgtgctgtgtcacttgcttttatgtggaatgtgggcaatttttaaaactttattttaatgtgcacgagaaaaagcaaaatagtacatcaaaaacatgaattttgtgggtactgttgcttaggataagtaagaaggtttcgaaagctgagtcagtccaaagaggaacgtgttgcgacaagccagatgccttatggagccaggaggctgtgactctggccctggagggggctcagccctgagcgaggtgtggaaggagcccggcaccacccctgccgtgtgagctcccacgtaggcccagggttggatgagatgacaccgaggctgtggagccaggaggctgtgactctggccctggagggggctcagccctgagcgaggtgtggaaggagccccgcgccacccccgccgtgtgagctcccgcgtaggcccagggttggatgagatgacaccaaggcactgtggcgagcagaaccgtttccccaaaaagacacgttcaactcctaacaccagcacagtgaatgccgccttctggacatagggtctctgtggatggagttagtaaagatgaggcccttatccagtacggccggcatccttctaagaagagacagcacagacacgccccgaggacggagacggaacggagtgaggcgtctacctgccaaggagcccccggcattgccaggagccacagagagtcgcccgagagcttcctgagcacgtggccctgacaacacctggatctccagcttccggcccgcggtcccgtcagacaattcatttctgtggtttgaagccacccagtttgtggcactttgaccccaggatcctcacaggaaaccgtctcactggcccagtcctgctgggccctgcccatgggatggacttgctgtccttgaacaggaggcaggttcggggaacaggactgtaatgggtcatggaaaataccaggctgatggcagagggtgcgtggggaggagatcagggaaccgccaggccggagctggaagccggggccaccgtccaactcacgagggctcggcagagaggacaggggagcttcccctgctggctgaagtgggtggaggcgaacctggcccacaacaccctgagcttctgcggagccatgtgagggccacgtggagaacactgcagttccaccttcatcagataaagccaaccgttgttgtttaagcaaaggctgcggacagtgagcacagaacttcacaacacatcatggtcgcagcgcaccatcccccgtgatcccaaagcagcgatctagacgtgtggggtccacaggcgggcgccctggcactgggggctctgcaacttgacgaggctatgccaggctgggctagaggtgccgtgctgggcacaggctctccacgggatggcgggactgctgggcacaggctctccacggggacggcggggctgctgggcacaggctctccacggggacagcggggctgctgggcacagggtctccatggggacggcgggactgctgggagctgggttctccacggggacggggacggcgggactgctgggggctgggctctccatggggacagggacggggacggcgggactgctgggggctgggctctccatggggacggggacgggaacggcgggactgctgggggctgggctcttcacggggacggcgggacttctgggggctggctctccacggggacggcgggactgctggaggctggctctccacggggacggcgggactgctgggcacaggctctccacaaggacggcaggactgctgggcacaggctttccacggggacggcgggactgctggggtctgtgctcctcaccccagggctcacgcttttccatgagaccctccccagccacatcgggggctctgaagactgagcactgagggtcagcagcaggtaggagatgtctttgaagtttcatctgttatcttaaaaactcgtggatttttggggcggggcgctgtggctcatgcctgtaatcctagcactttgggaggccaaggcaggcggatcacgaagtcaggagatcgagaccatcctggctaacacagtgaaaccccatctctactaaaaacacaaaaaattagccgggcgtggtggcgggcacctgtagtcccagctactcgggaggctgaggcaggagaatggcatgaacccgggaggtggagcttgcagtgagcggagatcgcaccactataccccagcctggatgacagagcgagactccatctcaaaaaaaaaaacccaaaaaaataaaacaaaaaaaactcatggatttttgtaatctactctattatatatatatatatatatatatatatgcacacacatgtatgttttagtatcaaaatgacttcaccccaaatctccacgtgaagtagatgcgtctcctctccatcgtggctgttggcacagtgctgtgtacctgagtgtgttcaacgtcttgagatttctaagcttaagggcaggagatagcccagggctggcacccaaatcctaagaaccctggccaaatatacaggatttaatgtcctcagcaccaggcatcacacaggaacgtgcgtgagcccatgaaatacttgctcaataataaatgctgccaagctgctaagcttggggaacctgatgagcactcggcttatgggagactgatgctccccacaggccggcccctgtgccgagactccacgcagtggcttcctcgctgtgacagcctcccctcatctgacgaggtccaaacagcgggtccaattctacccacacctctttgcatagggtgcttctctggattttagggtctagaccaaagctgaggctgttttatacattttggggtccctggaactcaggacaaggccatctgtatccccaatgctgaatgagtctccgacaggtgatagggcgatggggtcgctgtctaagtagggaaggaccaccctcgacttaagacatggctcagtgaaaaaagcctcgctctgaggacaggcagtgagaaatgaggaggttcagggcaggcggactccatgtgactgagggtttggccgggctccccttatcaacccggcatccctcgaccatgttctctggtgcacacaggtgagcagagggcagtgtctgctctggccaaggcaggggcaccccaacatcgcagccccttttggatgtgaggtccgctcattagatccgaggggccgtcctcctcccgtgctgggacccttggggcttgccgggagagacgcccagagggaaggggctttgtgggaggaggggttccgctgcccttcctggggcacctgtttcgctttttgtctttctttcctccctttccactccactccctttggggcatgagggaggtgagggaggagggtgggaagaacaaaggagagaattctgaggagggcgtcctgagttccagggacttctttcatcaagaggaaaaagaaaaactctttcaacactccctgtgcatagggtgctaatgagctgcaaattgaaattatttggagtttttcttaatggtgaaaagaaagaagttgtcagaggagaccagaaactctatgtcagctgagaaagctgtaagcgagagagatgaatggacggctcatctgtgctttggtgcatctttcatcagccggtgtcacccttggtagccgggtgctggccaatttccatttaacttccatttaacgtatagccaaggaggcccgtgatttcacctgtctgacccaccacagatgggtagctgggcttcacagaaatggaggttgagttcccggagcggtagcccagggctggtatgttgagaattccgtttggaaaccagcgttgtgcaaaccggggttaggatgtggaaaactcgccctccttccaaacccagaagccttcgtcttggtttagaagtccctaagccaagtccctacccacattccacgctgctccctaatttcacccggaccacagcctctggatgagcttctgttaaaaagagatgactcggtgacaaacaggaggacggtgctcaaatgactgtgacacgtgccgtgtatctgcaaagacctgtgccgtgctaaaaccacacgcatggcagcctcccccaagccaaccacccgggcccacagacaagcatctccagagcgcgtgggaccgtagagaaggcagtgacagggccagggcaagccggttggagaagtggaacttcagtggtaagcccagacctttgggacccctcaccctgcccggtcctcctgctgtggggtgtgagtccagccagtgctgggaagccggtgtggctaggacaacaaagaccaaggacagcggggaacggtggggagggaagagggtgggagaccagagtcagaggcggacaggggttcgatacgccattcaggtccccaaaacagcatgtgcagctctcgttaaatggaaaaggccctaatgtcatgggaaagtctaacaatttgttaaactttgttagtgtacaaaatgtggtgatcctactcgtataaaaaagaaagttcaaatgcgcagaagaaagatcagaggacaagatgcccacgaatgataagcgcctttgctgcctctgggcgggtccgggggagtcgcatttcttcctcactgcatcgctgtattttccagatgtccactgaggaatgagcattgctttttaattagcagctgccccgagtgctccagctgccctgcgtgtggctgtctacacagcacgcattccttaccccggtggttttcatctggaccctgagtcagaatggcctggagcgcgggtaaaacagctcggggccagccagagcttctgagccagggctgggcccaagaacgtgcatttgcgttgttccccaggtgatgctgctggtgaccccggggaccccgccgtgagagccccgacacaagtcgcggtttgtggtgctttggaggagtttgctccttagagtgagggggattgttctgccccaatggcctcttcagagctgcgagactgtgcccacgcgaggcagtggtcgccacacccacactgccgtgctgcgcaggtgaggcctggtgcacggagcccctgggggacacggcgaagggccttctcctgccatctgctcaggaacccctccctgggcttggcctccatcttgacaggcaggcgaggaagcccctgctgacgccatttacaactgcaaacctcccatttcctcccaggtccttaaagctccacatcataaaacggatgtgcgcgtgaaggaaacgtgggtgtccacagagagctcccccggagaaggccacgtccacggtgccgcctgacagcaatggcttcctcagcgtttgacgggcagggagaagggtggggaggccacaaggacaggagaactggcgctcgacatggggcaggacgggagcaggatgggaacaggaggggacaggagggggcaggacagggacagaggagagacacggggcaggacggggcaggacggggacaggcgggggcaggacagagggaggacagggacggaggagagacggggggcaggagggggcaggagggggcagggagccacgtcttctccaatcccatatggggccatctgccaccctctgcccaaaatgtacgattcaccatggcaaggaggcgagaagcggggagatccctctaaacccaaatgaacacagagtgatggggccccagcaccccatccacaggctcattccattatttgaaaatgtttctaaaaactgagcttcttttcatctttgaattggcttcttgtcacagagcagctttgcaggcagcctgtttcaggtgtccacactttgcagagggcgcctctgcacagaagcgcacgagtcccagatggagggaagcaaatctcacccaactttaaatatttgtttctccaaagctacgtggtcacccgtgcatggtgacggtgatgtttgatttcaggtgactttgaggctgaccttccacacggggccctgcgtttctctcctctgcacctgaaccctcctagtctttattctgggagcagcgcgggaggcagtggagacgtggaagcaggctccggctgctgggcctgcatgaccggtttccctgcagaagattctgcgcccttcagcctcaccgtcctcacctggcctgggtgctgctgtgggcaggcgctgggcacgctgggaagagcagggccagccgtttgcaggacgggaggctgaggctgtgtgcacctcctgagggctgggccacaggtgggctcaggcctgcgccctcccatggccgtggcctcttcctcggtcctttgccctccagggtgccaggcctaggcctccgcgcatcagtgtggtcaaaaggcaggactggtgtgtggtgtttcctgacattttgttacctgtagagccacttagagaagcaccgctgccgaggtgggaaagccggagtcccagccagtgggctgagctcagggtgctggggtcctgggcccagactctgtgctgggaccttgtttggaaatagggtctttctagaggatcacatttagatgacgtcatgggagttggccctagtccagtgttgctggcatccttttaaagggacattcggatgcagacaggcactcatgggggtcgacgtgaaggagagagccacccacatccaaggactgttggaggccaccagaagctgtagagatcctgggacagaccacccttacagcctgccatgagctggggcgcgcgcacatgtgtgtaaagcagcacacatgcatgccacaaagcagaggctaagcagtgcacactgtgcacactctgcacacgctcaggcggtgacacgttgcagacatcgctgtgcttcagaaagagctgggcggcaagattcacacaagtaagcatgttgcagactccccagcacacgccctctctggcttgtgctcatatgaacatactgtcaccctcgtgcagatgtgaagatgtgctctcactcatgcacgtacagatcacgccctctcgctggtgtacatgtgaacacatgctcccctcatatatacaaatacactcactccttctccacccttgttcacagcagcagcctgagaagacacagaattccatgaattgcagcccagagaccccccagccctgccggctcgcctcctgcctcccgcctcctagcgtgctctgaggtggagaccagctgctgccccgtgcctgccccgcctccctgggccatgctgccttgcagactctgctgctcggtgtggtcgggggcctgggtcggccccagggtgaatgagtgatgggttccaccctaaactggctgtggagaccttccacacactttcctcccctccacgagctctagggcagggcaagcttggaagccaagggctggcagaggccgagccagcctggatctcagagtggccacacggagcagagccacactccacctcaggacgctgcactggatatgagtgagaaacaaactttcttgggttaagttgttaagatttcggggatgtgtttaaagtccctagtgttctttttactgtccactgcctgtctccaggaggggcccgggggcaggcactgaagcccccgcagtctacaggcctctggcactcagacaggagctctgctctcagaaaagcaggcaggctggcattcggcacatccttggaagcgggtggtgcgagactctgccctctaccctctgccctctgccctctgccctggcgttgagtgctttgctgggactgcggctccctggccccctctcttgccccacatgtggattcgcacagaccctgcagcatccccctccctttctcctcctcttttctctttactcaggaatatcccatcttagttacggggctgggcaccccaagacctctctctaacaggggtccccacatccagggcactgcagatgggctgccgaccacatgcctctggcctccggccagtctcgggccatttgctgacaccccggaggccgatgggccctctcgctgctcaaggtggagggaggctgtgcaccgggggtgtcggcatgggagcgctgtgttccgggggcgccgcgggtccctcctccccaggctgcttacgcgtcacaccagcagctctgatttaaacccaaatcctttcacataaaacccttcacttgtgctcttaggagagggttttgcacacgtctggctctgcttcccttctgctgcattttgctggtgcgctgggggtctgtgtgtcttattcggagaagacgttgctgctcccccaaacgaagaatcatgtcacaggaaaccatgacaaaccccccttttgactgtgcctcccagcaggagaacagggagctgagaagacaatgaggagcaggctgtggggaaaggagaggtcactgaggtcacatgagtatcaggcagatggtgccactgccggagccaccccagagccaccatcacggcaccgtttcatcccatccagtcctccccacgtcctcaggtggccaaagaccacattacaccacatctgtcctcagggaaaagaggagagaatgcatctgagaggacctgtcgaccagggacacacccgacctgcacaaagcagcatctggagctacggccggggccatcaatggggtgagggggccaaggagagccctggctgccctgcagagggtgtgtccgtgtggcctgtgtgcatgcacgtgtgtgtctatgtgtaatgtgtgagagacgtgtgtgatgtgtgcatgtgtacatgtctgtgtatgtgtgcatgtttggtgtgtgtgtgtagcgtatgtgtgtggtgcgtgtgtgtggtgagtgcacatgatgtttgtgtggtgtgtgtagtgagatgtgtgtatgtatcatgtgtgatgtgtatgtatggtgtatatgtgtgttatgtgcatggtgtgtgcctgtttgtacatgtgtgatatatgtgttgtgcgtggggcatgtgtgcggtgtgtgtatatatgtatatgtttgtgtctgtggatgtgtggcatgtgtggtgtgtgtggtgtgtgcatatgtggtatgtgtgttgtgtgtacagtgtgggtgtgtgtagtgtgtgtatatgtgtatgtgcatgtgtggtgtgtgtggtaggtgtgtggtgtgtgtgcattcatgtgaaagtgtgtgcacatgtgtgtttgcatgcatgtgtatgtgtgtgcccgtgcatgtgtggtgtatggtatgtgtgtggtagatgccggcagtgtgttggtcatagggagggaaggtggaggctgcggtctagcagcagagaaacagatgggtggttttttctaaagcgtgggaaatgacacgggggctgtgtggcctcagagatgggtggggtcattggggagctggatcaataatctggacatttgggaagatgtcttgggggccaggtgcccaagctacatcttcaacgatgaggaagacaggaaacggggagggacgtctcaagagagggcgtggcctgagccaaggagttcaggtggcagcttccagaagggcagaggccacgacaccgaggcccccagctggtgcctcctgtggctgagtgatgaggggcactggagtccaaggccctgggtgtgagtccctgggatgctaaaatttaatttcctcatgtgccaaatgaagacaatatagtatttacccctcaggcaattattaggaagattaaatgttaattttagagaaaatgtaaaacataaatgcttttgtgattaattaattcattaattacgtgtggagaacctcctgggtgccaggcacatggcactccagccacaaacaggagaagctggcccgccctcctccagcagccctcgcccaacacacccctcctctgaaaccagcaaggccaggcccaggcacccgtgacaactgcaccccgagccacctctcaggacaggccaggcccaggcacccatgaaatctgcaccctgagcctcctctcaggacagaggccatcagcccacgtgcctgtgggattcttcatttctgccactaagctgccctgtggacaccactggccccagccccccaaacacctgctgggcctgggtccacagtggcccacctgcacccgctcagggtggcctgggcagcccccttcggaagcccagggctctgctgcctgggagctccagcacccagggacgcgctcatttggcgctgggtcttccaaagtgagccctcacccccatgcctcatcagcatggccctgacagggacaggagtgtggtagaggacttgggttaataagtgagatttttaacaggctccgctcagctggctctgtcggctcgagtctgagcccatccgtcagcgtcaattaggaagcctcagctcagaacgcaacaccaggggctgcgcagaggaagaagcgcgagggcgccctgcaggctcacagcgcctgagcacacaccgagcggccgcagcacagccctccctcccgccccaagcacacaccgagcggccacggcacagccctccccgccccaagcacacaccgagtggccgcagcacagccctcccgccacaagggtacaccaagcggccacggcacagccctccccacccctacctccttttggcagcgcaggtgcattcaggggagcgtgctggatgggagggggctccctgtcacgtctcctggaaggatgggatccctctgcacgccccatcacccgcccacccactgccagccatgggcacacacacaatatttgtgtattcatgaacacgcaaaacacactcacacatgcgatcacactgcatgaccccccccacacccacacatgcagtcacacacacgcacacaacagacacatgcttatgtgcacacacacaacacacctgcactagcccaggcactcacacatacatgaacacagcagacccaaacacgttcacacgcacaacacacccacacacacagaggcactccacacacacatgcacacacacacccacagtcacacatgcaccaccacacacatacagcagatccacaatgtatatgcacacacacaacacatccacactcacacatgcactccacatacatgcacacagcagacccccacacacgcacacacatatagaacacccacacttatgcactcacatatatatgaacacagcagacccacacagtcacacaccaacacattcacacatgcaatccacacatgcagcagacacacacacgtgcacacaccacacccatgtcacacacagcagacccacacacgttcacacacacaacacagtcacatatgcactcaaacatacatgcacacagcagacccatatatatgcatattcaaacacacaacacatccacactcacacatgcactccacacacctgcacacagcagatccccacacacatgcacacaaacacccacactcatacacgcactcacagcagatccaacacacgcattcttacacatgcacacagcagacccacacacgtgcacacacacgcacacacactcatacatgcactcacagcagactcccccacacacgcattcttacacatgcacacagcagacccctacacacgtgcacacacacatgcacacacacatacacacaccttcacctgaggccaagccaagggggagtgatctgggaagtggcatctggaggctgaggaacctcagagcatttcttcttttgcatctgaggtttcaaaacccatgagaatgatcttggagttattccttattctctacatgccaggaaaggtgaaatcagaaaggagaggatttgacagcctcacccagagggaaagtgtcaggctggggctcactttttgccctttggagccgaggatgaaggaaacagtaactgccacagggcagcaggagtgcaccccgcagcctggtggagtctcccacgctggaggggaggcaagagtgcaccctgcagcctggtggagtctcccatgctggaggagaggaggatgaggccaggcatactggacagcttgtgtgaccccaaggcaggcatggcaggatctaggtgcagatgacacacccagcatccttgtgccaatgccactcgggtgtactttgctgcctctgctgaatgtaggtggaagaaggcaactcacctgtgaacagtgctgtcctctctcctgagaaccagcacaatcataagtttggagacaacaacaagaattcagttttagttatgagaggcctataagacctctgagtaaagacataactctaggatctggtcagagctataaattcagggtcaattcactccatggctgccatttggagttatacagatgaatgaggtcatggagggaggtggtgtctggagagaagtgtcctgaggaacccagcatttggagagcatgtggggaggccaccattgatgagcctgagaaagagcagccagagacatcggagatgaaggtgagcccagcatggttgacaccaagacaagaggaagttttgagaaggggcttattagctctcaaaagctgatggagagcccacagttgatgaggattgaagagtggccattggcttcagcaccatgaaatcacagctggccttggttggcatggtgggatagaagccactctgaatgagctggagtctgcacctgtggccggggcagaggcagtggctgaggtagatggaggattggggagaatgcaaacaggaagacaaataaaccagaggccagggaaaccaatggttgttgatgtcacagagaatgatgacataggttgtggtgaagataattgtgagagacgtgactaagggggaggagggacatgggttaggaagccattcatccatccaggcactcattcatccatctatatatacactatccatcatccatacacccactcatccacccatccatccatctgtacactatccatcatccatccatctactcatctatccatccctccctctatctatacaccatccaataaccatccattcactcatccatccatctatatactatccatcaatcacccatacactcatccatccactcatccactatccattgtgcattcatctacccactcatccattcatccatctatacactatccatcatccatccaaatactcatccatccatctatatacgatccattatccatctatacactcatccatccatccactcacccactatccatcatccatccataatacactcatgcatccatccacccatctgctatccatgagccatcctcccactcatccatccatccatccgtccatccatctatacactatccatccacctactcatctatccatctatatactatccattaactatccatccactcatctatccatctatatactatccatcatccatctatccactcatccacccatctatatgctatccatcatccatccacctatatattagccattatctatccataatacacttatccatccatccaatcatccgctatccattatctttccataatacacttatccattcatccaatcatccactatccatcatccatctaccctttcatccatccattcatctacccatccactcaccatgcatccatctacacactatccattatctatccatccactcttctatccacccatccactatccatctacccatccacatatcccatcatccatgcgtacatgcatccatccttcctcctatatatccatcagcccatccatccatccatccttatatccatccactatccatctatccatccacccatcatccatgcaggcatccatccttcctctcatccatcagccaatctgtcatccatccatccactcatccatccatttatctatatactatccatcacttatccatgtattcatccactatcaagcattcatccatccacccatgatccatacagacatacatgcacccatccatctttctatccttccatccttctatccactcatccattcacccactatccatcatccatccatgcatgcatccatctatccttccttccatccattctgtccatctacctatggaagcatatatccatccatccatccatccagatttctattgaggacccatattgttaaaaaatagagctaataatcacctaaaatatttaataaaaccttaaaacacataaatacctaaaatactaaagcctggcaaaataacaaattattagaataagttcaagaaattctaattaatgtttgcaagattatgttatcattagcttcaagacactcctagcctcaggctcagggtataggcaaaaaattaacacctagtacttgacaatgagcgtccgtacctgggctgtgattatgagcagctgcttctgattacaatcagtgaatcactaatctgcagtctgctacaaaacagctggactccatctattattcattcttgatgtggagatatccagaatggagagactagaattggactcctaggatccctgttgtcttcatcccccaaggatgttctggtttggaagttgtgtttctgaggcccctgacatccaagactacaggttagatcatcaagttcatatgacaggcaaggactggtgaagttttcagattttctcactcattggctagcattcctttgaactcttcaaaggcttgatatatatagtctaccttaaacatctggggatttgatgtcctgagacttaggttttgatcacatcaagcttttccctaagcatgaaaattttgctcaaataattcagataccctaaccagcctgtgtctctaaggggaatctggagggcaaagtggggaggaggttgaatcagtccttcgttccacagctgggtatgagacagacagagaaattagaagtgttttttcctttttcctccttactctagagatgagcagatggactggctcaaaagtggcctggacttcaagccctcatagagaactgatgcatctcaagtcaccttcgctctgccatcagtaacaatccccctgaacccagcgagagcacacggccccagagctcagaccgtcagtggggtttgtgcacagcctcctgtgaccctcctgaaggtaggagctgaccacaagtcctcctcccaaggcaggggcgagctcagcttgccgacggctgccagagagtcaccctcctgaaggtagaagctgaccacaggtcctcctcctagggcagggggcgagcttgttgtgccgaccgctgccagagaaccacaagagggccttcccctttgcacctgaagccttaattagcaggtttgtcttgggatgttaaggatgggaggcctctgtctggtgccccacctgtccaatgggcagcagcttcccgaggacaagtgcatgctgtccgtggattctctgtgcctgcatggcgtgaggtgtgtcactgacactcagggactctttgctgactcaaggctgccacacaggcccccggaagaactcggtaggaactctggactgttggcaactgagcctcccgcaaaatagggaatggaggctgccccattccggagggacatggtgagacctggctcgacaggaagttctagaggacaggcatgcttttgggtcactggctgtctgttggtgggcagaagagtctttgggtgtgaacctggatgctacactgcagtgacccccaactagtgctgtgccccaaatacttgggcagaaggcaacactcctcagagaaagggtgacctgtttcccgtgaggcagaacccgcctcgccttggctggagcagatgatggaaccacttccacatgctgaatgaagccacaaagcaggcggatcacgagcggcacccagggcccacattagggctgagtcatgctgggaaaactgagggcctggggagtcagccaatgtggccccaaggaccctgcagaccccaccccatctcaaggcagcttggctcagggcaaacgaggattcttcaccatcccaggcctgctggtcttcctctgcttccttggagcctctggtctgtagctggacacgtggatgaagtttctctttcccagcctttcttgaagctggacatgcgactcggttctggccaaggcaacccaagtgagagttgtgtgctgctttcagggagtgtctcatggtgggacgcgcgccctgctcctcttcttcccccttcctgctggctgaaatgagacctggatggtgggatctccagcagccatctgggatcatgaggagcagctcagggctgagggctggagcggcaggagtagaacaccttgtttctgggacctcagaggctgcaaggtcctcagactgcctcccccccagacttcttccacaggaaatgaaagtgcatttccagctcatttaagccacttttattttttattttctgtcacactcagtcacactaatcctgactaatacacacgtgtttgccagtgaacagattatcctctcaaaagtgtcaaaatgccacgtcagtgtatgaatcacacctttgaacaatgaaggctcccgtgttaagaggacgagtgagctctgctgcctggaccactgccctccacatttgttcatgtctgagttcacacctggggctcacacaggtatctctctcgaggcagacctcaggcgccttctctgcagatctgagaaaacctggctggatcccgggggagcagcagcgctggccccagccccattcagcttccaccactcagcttctctgccgagctcccaggcactgttctggagacctcaaggctccaggagacaaaaagtagcatcactgtagagagcttctggatgtctgtggcttaggggtgcttgaaaagttacagatgctcttttgtacactgagtcaaggctttggagaagcgcaagtgctttattcaccactttcactttgttcccccgtgcatgtaaggggtcaggcaatcccctctgctcaagccaccaccagtaaatagaacggcagcacaaccgtgatcaccacagtcatcacaatgagcgccatttccacgcgtgctgtgctgagatgacaacacaactgtgatgaccacaatcatcacaacgagcgccatttccacgcgtgctgtgcaaagacagcagcacgaacacgatcgtcacaatcgcgagcgccatttccacgcgtgctgtgcaaagacggcagcacgaacacgatcgtcacaatcgcgagcgccatttccacgcgtgctgtgcaaagacggcagcacgaacacgatcgtcacaatcgcgagcgccatttccacgcgtgctgtgcaaagacggcagcacgaacacgatcgtcacaatcgcgagcgccatttccacgcgtgctgtgcaaagacggcagcacgaacacgatcgtcacaatcgcgagcgccatttccacgcgtgctgtgcaaagacggcagcacgaacacgatcgtcacaatcgcgagcgccatttccacgcgtgctgtgcaaagatggcagcacgaacacgatcgtcacaatcgtgagcgccatttccacgcgtgctgtgctaagctgtatttcaccctcacgccaggcaacaaggtgggcattactcttcccagttcacaggtgagggccctggtaatctcagcggagcctggcggggacttgggggtgtcacaggagcaagtgggagtcctgattgcagagggtggggaccatggcatcccagagggtgggcagaacatggctttaggatgtcaccgtcctcctgtgaggtcatggggcaatggggagccaggaaaggcgcccatatatcctgcgcacggggcagcgaattcatctgcccaggagcacgacttatcccacaggcaccagaggggtctatactgacccggctcctgcacaggaccctccaaatgtcttcaagttgtcctgcatctccgaccgtgtccccagcagacacattgcactagagatgatgcttccttggtcaaaacactaggttctctggtcctaacacaacactgccagacatctgaagttactatattttctaaccaagcagactggctatgagtttttctaactgaatgtcatccaaaacctaaccctaactcctgtataaacattgttttcaaactcatgaagcatcaaaggcccttgtggttttctggagtttccattctctagagcttttcgacaacaccctgcatttgggttttcatcttgagccctcatattatctcattcgattcctgcagcggttttgagaggtgggcacccatttatggatgaaggaagccagagaccacaacacaacacaacacaacacaacacaacacaacacaacacaacacagtgtgggccgtggctgtctggaggccaagctcgatcagaatgtccctgggcactgtctgggggcctgagaaagcgttcgggctgtgtgggtggtgggggttggacctaagacctccagtgaggcgtgacgtcctccattcaattcacttatttcccccatgggggctgagttgtccttcaaacccagtggcccagggagtgggcactgcgtccacaaaggacccctccggcatttgggggaacccagtgtgctctgcagatgttccttgagcgaggactgaggaccaggtgctggggtgccttggaggagggcggttggtggtgtctccactacgactcaccgtgccggggtggatgtggcccctgagctgccggccccgccctcgccggctgtgatgctttgactcagggacggccaccgtgtcacgggctgttcccagagtctcagtgccttcctcgggctgcacgttctgattttgtttttttttgaaaaggtaaacataaagaaaatgcttgaagccccaggacacagttgggctgacaggtctccgcaaggcagctgccctggagggtccctcagacggcagcttggggtgcagctctgggcgtccccaccgtgggacctgcctgccttcacggccacggaagtacatttcgtaagttctggttttcctccttcctgacattaattttccccacatgcagatggagctgggaccagcctctgggttaaaattcagcatcacgtcttactcagaggaagatggtgggaggtcctcatgcttctctgagccccttccacgcgtgtggtcaccacagtctcccttttccaacctgtccggatgcccctgctgtaggctgtagacagactgtccaccttgctacagactgtagatgctgagctgtgtcttcacgagcaaccacagaagaggccacgttgactacagagcccatggacggaacagcgatcggatacaagacttgcccccacttccgcaagccctcggcacccacagctgtgcccctcgggaccacttccctgccccagagccatccgtgtcatcagcaccaagactatatggtgaaggaagagtctggaaagtggcagcagctcacagcaagaccctgagagacgtcctggttactgcaggtatgatcacagcaagaccctgagagatgtcctggttactgcaggtatgatcacagcaagaccctgagagatgtcctggttactgcaggtacaaacagtcaaatcaagtatctgtttatgagacattcaacaaaaccaggtaaactgaaatctatggcaaagtaccaacttcctgccaaacagctgacaagtaagacagggtctgtctgtgttgccgactcccgaaaatgcccactttggctaaaaaggtccagtagtggagaattttaacaacgccactcagttttatttgcgtaaccccctataaaagtgacctccaagggcaagccgtttggagtcaccaattcaggaacgaagatggtgtcactgttttctccaactgtatttctttatgcatcatggtttttataattttctaagggaaattgatgacatccccatcttaaaaccaaacacaatttgaatttcaaatgcacttggagttcttccttccaggacacgtctgcgatgccagcgcggggcgcagccgggcgcgggatgctcgtgagccgtgagctttgattctgaaatatgtaatacatttttaataaggacaactaaatttgtttccctagaaatgtattttgaagagtccataataaactgtcttctacaatgaggagctatttaaagtcaaaaacaaaaaggcaagggtcccgtcttgctgcgagtgttggggcaggtgctatctgaacacggtggcgcaaaagagatgaggcctcgccactgatcaaacactcggctggtaagtagaagtccttaaaaaagacgaacatcaaacaggtcctcatctggggcgctctttttgtggggtcaccctgaccgtgaggccacagatgcgggcccgtgtgcaccgcaggccatacgtggggttaggtaagtttgaaagtctggacaaggctgtcattaaagcgtaggtgatgctaaacggcgtgaaagcctctgctttctagaggctccagcaagactgacacggaaaagctgaggacgaggatgttggtgaagactccttacaaaggcggaaggcgccacactgtgagctgagccatctctgcaatggaaggacagagcatgaccgtgcacccacctgctgagagcccaagtggctgccccagcaccaccccgtccagagggccgggagagcagccgcattgaaggtcgctccaggaaaagccctggcccgactcctcaggcatgatggtacagatgttgacttggcggcaacacgtttgtccctgggcaaactctgtttcaccctgaatctcatgatggtgatgtctcctctgccccatggcagctgcctgccctgcacctctgcagtggcagctccacctgtctgtgggccgtgcttctagctgcactgtccctccatgcttccaaagacattgtgtcctggtcaccagaactcctggtctgcagtatcctctctcccccgtgttaccaccccctcctgccccaccctccctcccactgtcctttctggatggtgtccttgacctcctgtcttcctgctcttggtcccatgggaagtgccaaccctggaagaaaggaggggctggcttctctgtgcctgctcactggcagctgagcacccccaggggcatctggggtccctgaattcacagtcctcatcctcagactcaggggcatccagcccacccttcttccctactcagcccttaaaaagaggcacatggtaaaaggctgctggtaacaagatacccctaagttctcaaggtatcatcctgcaaatcaacgatgaattaccaagggaagaatttacctttacaatggagtgatgtggcaggtgcctcttttaccaaagcgactgcacttggcattgtcccagcagggaggggctggccgtgcacccgctgtggctggaggcacacacatcaccacgcggggaggggttgaccgtgcacctgctgtggccggaggcacacacatcgccacgcggggaggggctgaccgtgcacccacagctgccggaggcacacacatcaccacatgctgaagacctgcatctgaatctagtagtgtggggcaatccaacaggcccaggccacaggatatcccacaggacaagcctggtttctctaacaattgcaatgctagaaaagaccaaaactaaaacgtaaaggtagaagtattctagaacaaagaaaatccgagatgtcacaacaaaacacagcattcacccttgattggaatctggattaaaaataaaaagcaagctattgggacaacgggaaaactggccacatacgaacgtgtgctaagtaacgtcactgcttccaggctgcacgctgggggatgatgcagacactcccttttctgcacctcacggggaagttttgtgatgtctgcagcaacctttgtgacttccatccagacacacaggtaaatgacagagttgcaggcatgactgagagctcaaagttggtgactctggaggaagagggtgcaggtgctcattttactcttctttcaacttgtttgacagtgtggagtttgcaaaataaaattctgggataaagggagaagcacaggaagagggactccttgctgtgagcccagctgtggggaggaactgctcgggccctgcagcatcttacaaggggtgcagggaagtccagagacagaagcccccatggtgcaggcctgtcccagcgacctgtagcctcatccagcactgcggccactcctcctccaggtgtcccgccatgtgcagccgtgaatatcctgtagtctaagccttctctcgttggggttttctgttatttcttcccgaagcatcttaactgatgcgggttctgtgtccagggaagagcagggcagggctgggtgcatttggagttgccctggggctggggctgggagacggagctgccctccccatccctgtccacggcccctctcaccctgcagtactgagcagggtgaggcagggaagaggaggagcagaggagtggctgggagggtctcagtgagcatttcagagccatctccacctgtcagaacgagcaggaagacatccaacccttattgggagtctacacaggtgttctgcactgagctcccctctacttcgggcctgcgagaagcagggaaggtataggctgccgtctccctcccccaggcagctggggctgtcctcacaccagcacagcccagtcctatgacaagcctggccacgttagaccctcacgagacgtcccacgaatggaaccctaggccataaaatatatggatattccagggtttaattcatagccatccttaagctgggggagggcagttatggagctccagagcggggtaagttgttggaaaacggaaagaagtttgtctggcagttgcttcgtctgcatgaggagtgacggctgggctgctgatggccctgaggggtcctcccggagcacctggcacctccgctaattctccggggtggaggcacttgcacaaccatgtgatgaattcttcagcagcgcccggaagctcggaggacatgagaggtggcaccaaggctgtggcagctgctcagccggtctcacaggctcaggactcgagctctgtgttaagccgcactaccactgtgattggcaccaggctcgatgctgcatctcaggctctgtttcataaacaggaggattatttcagaccgatcagaggcggctgcattctgcaaattaccgtgtgctgtggctgcgctcacacattgccaagtggctcctccgacaggcggcactaatccatgttggtctgttcaggaaggttgcctttgtaaactggagacagaatacttttgtttttgttttaaacatacatttgggaaggtggaagtcaagaaatgtagcggttctgttgagttcaaagagaaacacaggattcctaagtttcacccacgctttgcctgactgaccaacacactgaagctcccttcaaacccagagacttactgcacttgcttctagatgccacaaaaattgctgttaaaaagaaaaaaagaaatggaaacacgaaggagctgcacgtgtgggggaggtgagggtgagaaggaaggaaaggcacaatctgtcacagtttccaaacacatatgcttcgcgtgggaatctggggttgattcaaaggctgaatggatcttcagttactggaaggcttggcccaaaatatttcagtatatggagcagttctcttccttctagtagcaaaagcaacagcagagagtgactggatttgtgatcagaatggggacagtgggaaaagttaccaaaccaatttactcaatggagaaaatagccaactggtcaaagaactgtgatgagatggcgggattctccaggaggtgcgtgatgtggctggtgcccatccatcctgtatgatgataaactcgtccaggagcgagatgtggccggtgcccatccatcctgtatgatggtaaactcgtccaggaagtgtgtgatgtggccggtgcccatccatcctgtatgacggtgaacttgtccaggagcgagatgtggctggtgcccatccatcccatatgatcgtaaactcgttcaggaagtatgcgacgtggccagcgcccatccatcctgtatgatggtgaacttatccaggagcgagatgtggccggtgcccatctatcccatatgattgtaaactcgtccaggaagtgtgtgatgtggccggtgcccatccatcctgtatgacggtgaactcgtccaggagcgagatgtggctggtgcccatccatcccatatgatggtaaactcgtccaggaagtgtgtgacgtggggggcgcccatccatcctgtatgatggtgaacttgtccaggagcgagatgtggccggtgcccatccatcccatatgatggtaaactcgtccaggaagtatgcgacgtggccggcgcccatccatcctgtatgacggtgaatttgtccaggagcgagatgtggccggtgcccatctatcccatatgattgtaaactcgttcaggaagtgtgtgacgtggccggagcccatccatcctgtatgatggtaaacttgatggagcatagttccgggagcagctctcctgggttttaggaaattggggagggtgtggagatgcagccgttagtatgatgatcttatccgctgcttcaatttccttccagataaatttcaatattttgcatttcttctggtcacaactctcatccatggacattttaggagtaacaagccgctcatttccataaatcagcattgtggctttctgagtcgaatcggacaggacgtgggcagctggcgctgttggtctccactcctcactgggctgaggcgcactgaacccagaaaccaacactgcagccccagattctctctgacctggtgccgaaagaaggagctggcggatttctcctctgccaacgtccttcgaaactctctgtagtactttctatccgccaatcaatgagccagcagcattccctgtgatcaatccatcaattccacccaccaatcagtgagccagcagcactccctgtgatcaatccatcaattccacccaccaatcagtgagccagcagcactccctgtgatcaatccatcaattccacccaccaatcagtgagccagcagcactccctgagatcaatccatcaattccacccaccaatcagtgagccagcagcactccctgtgatcaatccatcaattccacccaccagtgagccagcagcactccctgtgatcaatccatcaattccacccaccaatcagtgagccagcagcactccctgtgatcaatccatcaattccacccaccaatcagtgagccagcagcactccctgtgatcaatccatcaattccacccaccaatcagtgagccagcagcactccctgtgatcaatccatcaattccacccaccaatcagtgagccagaagcactccctgtgatcaatccatcaattgatcagtcgacccacccgctggctaccaggggcacccagcgcagctgcgctcacagggaagtcagggcgagcgggcggctccagacagaaacgtgggtgtgcttgtgtgtgcagagtgcacgctcgcagaggggaagccacggggctgcgggcccagcctccagtgagcctggagccggcctgcagggaggaccccaggcgggtgtggggacccaccttaggaggacagacgcacatgaggctacggggcttgttgtcatgaaccccaaatgtgttgtcaataagagcaccggacccagctttcaatgcttctcttagcaaaaccagggattttcctgcagctgtgaacattgacctgtccgcctactccccgagccacagatctggggaaagaatgcatgtagcctgctgtgggtggtgaatggagctggggcagtgatgagctacttcttgccttttgtcaggaaaagaagctggatagatttctcttctcttcctttgagaatgagtgaagagggaagataaaagccagcaaccagggacagctgaaaatatggtttcagtaagagacaggccacagcgtcctgagccccctaggacaagcagaccttccaggaggatttcctaaggtggctggaagagaactctgctaccctttccaacgaagatgcaagacacacagcctctctaaaaacaggagcagaaacacacaacacaacgggaaaaacagggtgtcataaaaacagaaccgttaccaagttatgaaggcaaagagctggaactgggagagatgagaaataactgtgaggaaattaaaactacaatagcagagttaaaattcacattgaggcggcagagcagaactgactacagttcacaaccgaacccgcaaagctcttcgagaatcacgagcaaagcacaaaagatgctaaaagaggggatattagagacgtacggcacaggaaagagactcgtcctaaggatgggggagagtttgcaagaagaagctagaatgactagtaggaagaacaggaaacagggatctgcagcaatgcctcggctctcagggcgctcgggagggtgcaggggcgaaattaacaacatagccgaagggtgcactgcaaatgcgtgggaaacaatggcttattcaagaaactagagtttacttgggggaaggtcctagtttatccctcacttcacacacattacaaccaccagaaatgatccagatacattaacacattaatggaaccataaaaataacaaataaaaacttgtgtttcactgatgacaggatgagcaagcactttctaaacatgagagcgattgacaaaatcttaaaggaaacgactgtgcatttgaatccaccagagctcagcctttctgaacttcagacagtacaacaagcaacgttagacacagacaagcctggcagaacattggccaaaagtaagaggcaaaaacaaatatgaagagtactcgtgagtctatttcagaaaattcacactcccataggaaaattcatgaagagattatcccaggaagcagaaccatcaataatcaagtatgataaaatgtttaaatctacaataaatcaaaaactataaattaaaccaatgataagatgctatcgtttgccctaaataattgcatgcacttaaatgaagtcctaacccttggtgttaagtgagtggatgatggcaggtttattggacttgccagatgcacctgcatttgttggagatattagttcaactggataagaggaattgaggtatttagaagagcttgcaccatttcacatagtagttagatttctaggagtgtatcctaaagaaacagtaagccacatagattgaatgtatgcccaaggatattaattgcagcaagacttatgataatgaaatactagaaacaagctaaatgttcaacaatagcacatgggttgaagaacttacagcagaaccacataaagaccaaagtgttcctcagaagcatattttaaagacaatttgataaggcacacatacaaactgaaaagcaaaataaagacacacacacacacacacacatcctaaaagaatatcaaatagtaagcattttctaagttttccacgctaagtgttcaatagacacaaaacaagtattttaacaaaaatatgatttcctgacagataatatagaagaggtttggcctatgtcatgaccatgtcctggcctggaccatttttaattgctccagagacttccaaattgtgtcaccaaatctacaactgtgtgtccattcatccatccatccatccatccatcccccgaccaaaccacccacttactcatccatctacccacccaccctgcactcaccaccacctatccactcaccaccacctgtccactcaccaccacctgtccacacgtctgcccttccatgcatccctccatccacccacccatccacccaccaccacctgtccacccacccacccatccacacatctgcccttccatgtgtccctccatccacccacccatccacccacctatccactcaccaccacctgtccacctgcccacccatccacacatccgcccttccgtgtgtccctccatccacccacccatccacccacccatccactcactaccacctgtccacctgcccacccatccacacatccacccttccatgtgtccctccacccatccacccacccatccactcaccaccacctgtccacccacctgcccatcgacacgtccctccatctacccacccacccagagaattgctcgcttgttgtgtgctgtgggccaggctctgaggtttatggacggctaggacattattaatgcccatgggggatgtagtgtctgatggaagaggtggtggaggggggaggctgttttgatgcagagtcatccgagatggctcagaaggggcaccatgaggagccagggccatgtaccacattctgtggaggtcgactccccagcacacgcacccaggaacaccctgggcttgacagcctctgctgggtcatgccctcttgctctgtgcctgagtccttcgcactcctgccgtctgcaaggacacggtgcatccagcccccgcagggcagggctcacatcctccatgaccctcacaaggacacagtgtatccagcctccacagggcaggactcacatcctccttcactccatgacccttccttgttgccgccacacgtctgttgcacctgttagacacggagccttggactcaggggtgggtcccgtggatctcacagccctgctgcccagcataggacacacaagtgactcagtggagtccgacacttgctgagtggatggcaagggagaaagctcctctccaccgtggctactccagttcctctcacagtggatggcacgggagaaagctcctctccactatgcctactccagttcctctcgtagtggatggcacgggagaaagctcctctccgccgtgcctactccagttcctctcatagtggatggtacgggagaaagctcctctccactatgcctactccagttcctctcatagtggatggcacgggagaaagctcctctccactatgcctactccagttcctctcatagtggatggtacgggagaaagctcctctccactatgcctactccagttcctctcatagtggatggcacgggagaaagctcctctccgccgtacctattccagttcctctcgtagtggatggcatgggagaaagctcctctccgccgtgcctactccagttcctctcgtagtggatggcatgggagaaagctgctctctgccgtggctactccagttcctctcatagtggatggcacgggagaaagctcctctccaccgtggctactccagttcctctcatagtggatggcacgggagaaagctcctctccaccgtggctactccagttcctctcatagtggatggcacgggagaaagctcctctccaccgtggctactccagttcctctcatagtggatggcatgggagaaagctcctctccaccgtggctactccagttcctctcgtagtggatggcacgggagaaagctcctctccgccgtggctactccagttcctctcgtagtggatggcacgggagaaagctcctctccgccgtggctactccagttcctctcgtagtggatggcacgggagaaagctcctctccgccgtggctactccagttcctctcgtagtggatggcacgggagaaagctcctctccgccgtggctactccagttcctctcgtagtggatggcacgggagaaagctcctctccgccgtggctactccagttcctctcgtagtggatggcacgggagaaagctcctctccactgtggctactccagttcctctcgtagtggatggcatgggagaaagctcctctccaccgtggctactccagttcctctcgtagtggatggcacgggagaaagctcctctccgccgtggctactccagttcctctcgtcttccctggggtggctacagtgttcttgtcttcgtgaagttgcctctgattccatcctctaaaagccaatgacttatatttggcacaagacagattaacacgtaattgttctttactgaattggtatctgactgtgtgagttgactgaagcatgtatagtcgtatgtgtatctgagtgtgtttgaatgtatgtgcatgactgtgagtgcatgttcatcactgtcagtgtgtcactgtgtccatatgtgtggctgcatgtgagtgtatgactgtgtgtgtctgtgtggctgtgtgggagtgtgtatgtggtggagtgtgtgtggcgtgtgtttgtgtttgtgagagagactgtgtgtgtgtctggctgtgtgtgtggttgtgtgactgtgtgggagtgtatgtgaatgtgcatgtgtggctgtgtctatgtgtctgtctgtgtgtgtgactttgtattactctgtgtgtctgtgtgtgtgtgagagattgtgtgtgtgactgtgtgagcatgtggctatgtggagtgcaagggcctgtgtgggaatgtgtctgtgtatgactgtgtggctatgtgtagtgtgtgtgactgtgtagctgtgtggaatgtgtatgtgcaactgtgtgggagtgcatgtctgtgtgactgtgtgactgtgtggctgtgtgaagtgtgtgtggctgtgtgcgtgactatgtaaccatgtgtggctgtgtggccatatgtgactgtgtgaccaggtgtgactgtgtggccacgtgtgactgtgtgactgtgtgtgactgtgtgaccgtgtggagtgtgtgtgactgtgtaaccatgtgtgactgtgtggccatatgtgactgtgtgactgtgtgtgactgcgtgtgactgtgtggccacgtgtgactgtgtgaccacatttgactgtgtggccgtgtgtgactgtgtgtgactgtgtgactgtgtgtgactgtgtgaccacatggagtgtgtgtgactgtgtaactatgtgtgattgtgtggccatatgtgactgtgtgaccgcgtgactgtgtgactgtgactgtgtggccgtcactgttaccacatgtgactgtgtggccctgtgtgactgtgtgaccgtgtgtgactgtgaccgcgtgtgactgtgtggccacgtgtgactgtgtgactgtgtgtgactgtgtaaccgcgtgtgactgtgtggccgcgtgtgactgtgtgaccgtgtgactgtgtgactgtgtggccacgtgtgactgtgtgaccgcgtgtgacgtgtggccgcgtgtgactgtgtggccgcgtgtgactgtgtgaccgcgtgtgactgtgtgaccgtgtgtgactgtgtgactgtgtgtgactgtgtgaccgcgtgtgactgtgtgaccgcgtgtgactgtgtggccacgtgtgactgtgtgactgtgtgactgtgtggagtgtgtgtgactgtgtaaccatgtccaggcagggtgtgggagtggagagggtacgggacgggagctgcagacaacatccgagccggctgaagcccacagagcaggccccgtgttggggggaagttggaatttagggagtggtgctggattctggacagtggatgacccgatgctgacgctggcacctgatcactcacagccgccaccaggcagcatccagagcctccagcgttttcacccagtgggttgctgctgctcagcagtcagggggacaggttgtttcttcctggtctcaggccacaggacccctgaagaggagccccgtcctcagacccctccaggagccagaagtgtttcttcttggagaggtgaggggctgggcgccctctcaggcagtgcccagggagaagcaccggcgggggctggagccaccacctcaccgcctgcctgccccctcctcctctctcaacgtccagtctgcagggcaacctgcaattcacaacggccgctgcctggcctgggagctctgcagtgccttctgctggaagtgccagccgtgtccgccctgcactcgctcccagcacagggcagaggcggtcgcagagctgcatgatctacttttaagttctgtgaaagtccttctgcagtaacagttcatgcgctggccacgatggcagcaagggcagctttaagttaattcaggctgtttttggaacaggctatggggtcttgaaagcttcttcaccgccttcactccccacacgctccctgtcactggctgaacatcggtgaagagacaaaactgtgaacgaggacattatctaaagtgcagagccccacatggtgggaagctcaaatgctcactaacaggtcggccttccttttcctgatggtttttcaaacttaccgtattgtacgtggctttaagtgaaacttgagtgaaggatcctccccttcccaccccacccgcaggtgatgattttgaaaagctcccccaaaggaaccctaaattagtcttaaacacacacacaaatctatctgaggcagggaaactgcccattaagggccagtaattacccgaggctgctggggtgcctgcctggaagggcccccaccacggggcctttgtgcttcctggcctggcggactctgaggctcatgcattattcaggagcacgtgggacaataaggaagccttccatagaaagagaagcaaagctgggggtaaataaaggttgcttgagaaacactactattttttctacatttatgaaaatattgcagcgttcggggtgctggggacgtcctctctggttatcaggagaacaccctggattctgcgctttccttcctgcgggcctgcagcctgcaggggcccacaggacagcatacagtacccggggactgtgtcttttttcctccctcctctccctttctctcccccataatgcaaagctttgtcaagctaatactttaaggatcaacatcaaaattggaactttctctttctatagccacatccaattgaaagtatcttagacctcccagtggcttccctttcggggaggcctggctgtcagagcactggaaccatgcatccattttaaataacaggaaggtccccaacccatacacaacattagaaacggcattatttgctggcccctttgtgcgtggggctgtgaatcggtgctgctgcatcacatggtcaaaccaggcctcccccacacattcctgctttatggggtcatttcagcgcgctccaatcagccgcctcgtccacctgaccatctcttgattactgatctatctgctcttattttccctgggggaagggaggagatttaaagtgcaaatggtacaaaaggggctcaaatgccgctttgtgtgcagattcaggagacttttttttttttttttttttttgagacggtgtctcgctctgtcacccaggctggagtgcagtggcatgatcttggctcaccgcaacctccacctcccgtattcaagtgattctcctgcctcaacctcctgagtagctggaattacaggcaggcaccaccatgcccagctaatttttgtatttttagtagagatggggtttcaccatgtcggtcaggctggtttcgaactccagaccttgtgattcgcccacctcagcctcccaaagtgctgggattactttctcatctggcctcacaagggcacgttaagaatcctgtgcccctgtctccgccacagtgcacacccagccctttgatttcagatcagagggaatggaatctccaaggaacttcacataggaaacccaacagcaccaaatgctttctaactattcttgggaaagaggcaaggcacaagtaaattaaatatattaacaagtcggagtaaagggtagagtgattaggaatatcttcctcagagaagggatgtgacagcccaatccacaccgcagacacagatccattggacccggcctcctcccatctctaaagtcatgctctgtgaacatcgttatgacagtgaaaaccacgacttttcccctgtaaaattaaatgtcactcttgatagcataatatctgaaacatcatcttcccaagtccacaccaatactttacacagaaaattaaactctctctgtttattgagtggataatgtagccttcaaatgtgtgagaacccctgctaggtgagaaattacaaaagctgtaccataaagcctaatggtatgtatgaaatacacaaaaaggtaacctaattggtaatcagaaatcataaaactaatcatgcaattaatgtcttcaaaagcaagcatttgaggtgtgtataattacaagaaaacaatgcaatggtggtttccagcattaatgaattaattgtggtggtaggggggccggcgtgggggtttatgggctggtttcagtccatgcccactgcctggctgtgcgttctctgccttcctccacctggagctcctcagcaaaggactgtgcctctgagcctcccctggagaagtcaagaggtcccctccttccagacccaacttccctggccactgactgtcgggattccctgggggagggcaggtggagagacggctggtgcagaaaaacacagaaggcccagagccgctcattgagtgcaggtgtcggaaaaaaatttgggaacacacattaacctacgcaactctcttgctttctttccagcgtgccacacaatatcatgatacttacggttctatgattcacactcgcagtttcgaaggaaacctctgctctgtgctgattattccaggaccaaggcttaatgcgtgggatgttaatttgctgatagaaaggggaggaggaacaggtcggggctgcatggcattccttccagacaactggagcaaacagggctccacattggggtcctttcgatgtggtgccgtcaccagtgccaccccactgcaggcaccgggagctcttccacggagaggaaaggtgcagagaaagactctgaccccctgcacggaggagggggcggcgcaggcccctccacgtcatcggtgtggaacgcaggcccctccacgtcgtggatgtggaacgcaggcccctccacatcgtgggtgtggaatgcaggcccctccacgtcatgggtgtggaacgcaggccttttgaacataggagtgtgcaagccccacacacaggaggtggtgtgcagcacgtgtctctgcaggaaagggaacaggagggactggccttggcgggtggtgagacggccacacactctctgaaggagattctacattcccacttctctgtagaagccgtccaggccccagccccatccccagcctgcaccctccaggcagctgaaggcctgggcacagctagcgaggccactggcatgtgggagatggaggacagtggggagaagaaagaacactagagctgaaattcgaggaagaaaccggacatctggggcagaggaacgacccaaagccactgaggaaactgccaggtgagggccaggaggagagggtgaggctgacacggggacaggagcccagcgtgaccagcctggggtcctgaagcaatgctctagaaagagaaggccttccacagcacgaccccagggtggtgatgagggcacactgctggagatgaagaaagcattattactcctccacttctagtacgagaggcttgttcacgtcctaagttgctctgtgttcccggcaacgtacccggcactgagttctcaggactggtgcaggtcagcggctccgcaggggtgagctgggcgctgcctgcatctgacgagatagcagtatgttagcatctgtggtgttctgtctaccgcagagtcctgtgagcctccgggtgctcgtgtccgtgcactgtgacggcctttgtctcttttgttttgttatttcaggggcgtttttcttattctggcctgtgggaagatgccctggagccctggacactggttttccagcaaaccctacagatcggttgggatccacctggtgacacctgccttatcttccagggtttgcccttggtgtagagatagacaaagggagaggtgagcacaaggtcacagggacgcagccctgacctcacgttggtccacgacgggcagagagcaacttggatggctgcctttgttgtttttcaaatggactattttattcctagaaaaagatacacaggctaatgtaatgaatacactagcacccttagccagctgtaggaaaaaaatgcatggcagatactcgatggcctttctgtcctccctgcaccacccagaggacatacacagagtgatccgccctcttttccctggtgaatcacgcagcctaactcaccatgttcccggccacgccacagtgaatcacgcagcctaactcaccaggttactggcctaactcaccatgttcccggccataccccagtgaaccacacagcctaactcaccatgttcccgaccacaccctggtgaaccacgcagcctaactcagcatgttcccggccacatcccggtgaaccatgcagcctaactcaccacgttcccggccacacagggccaagaacagcccaggcaatgttaaggagcattgcatggaggagccacttgcagatgcggtaacccactgtgcggcacagaacctccccgcggggcaggtgggtgcacaggaaagaaaccaacatggagctgaggccccagagaggtccctgtgctcatgactcacagagacggggacggcagcaaggacacagcagggccatgggcagaggaaggacaagcaacgtggggccatggggagggacggaagacagaagtggatcccggctctccacaaaacacaaaaattaaccccaggcagattaaagcctaaatggggggaaaaaacctgtaaatgttttgaagaaaacatttgagcctctctgaactcagggcagaaaacagtttcctcaaatcctttcctcaaacaacacaaactacggaggaagggagtggtaaaatttgatcaaatcaagtgaagcagcttctgtgcttcaagaaacactattaaaaagtgggaaaaggtgggggtgagccacccgccaggaagcgagattcacggcacctctgtcagatgaaagggctgggtctgcgtccagccaggcaatgaagatgagccgccaatattctaggaagaaaagcgggggtgggagtcaccaaaacaagtcttctgaaaactggccaaggtgtgatgtacgtttgcatcctaggaaattaaagaggtaaaaaaacccatctggaaaaccaagagctgcttgattctatgaacctaagaacagtccgtttctccttcagagacgtattgagagaactcggtatcattatgaaatctctcaggcctccaggaaatgacgctctaaaaatgcaaagctctgaaccaaccaccgagaaacaccctttcccctcccctgggtgatactaagctgctgtggggcgtccccacaattttggggccggaacggagggggaacaggcaccagtttgtcactgccctgagtgcgctgccccaacaccctgcctgctgctgtctgagagaaaatcgtgtcatggatcatcatccctgtgctgcaggtgtgtctgatgtttacagagacctctctcgctccatcatgcgtgcccgatgtctacagagccctctctcactccatcatgcgtgcccgatatctacagagccctctctcactccatcatgcgtgcccgatgtctacagagccctctctcactccatcatgcgtgcccgatatctacagagccctctctcactccatcatgcgtgcccgatgtcgacagagccctctctcactccatcacgtgtgcccgatgtttacagagccctctctgactccatcatgtgtgcctgatgtttacagagccctctctcactccttcatgtgtgcccaatgtttacagagccctctctcactccttcatgtgtggccaatgtttacagagccctccctcactacatcatgtgtggccgatgtttacagagccctctctcattacatcttctgtgcccgatgtttacagagccctctctgactccatcatgtgtgcccgatgtctacagagccctctctcactccatcatgcgtgcccgatgtcgacagagccctctctcactccatcacgtgtgcccgatgtttacagagccctctctgactccatcatgtgtgcccgatgtttacagagccctctctcactccttcatatgtggccaatgtttacagagccctccctcactacatcatgtgtggccgatgtttacagagccctctctcattacatcttctgtgcccgatgtttacagagccctctctgactctatcacgtgtgcccaatgtttacagagccctctctcactccatcaggtgtgcctgatgtctacaaagccctctctcactccatcatgcgtgcccgatgtctacagagccctctctcactccatcatgcgtgcccgatgtctacagagccctctctcactccatcatgcgtgcccgatgtctacagagccctctctcactccatcatgcgtgcccgatgtctacagagccctctctcactccatcatgtgtgcccaatgtctacagagccctctctcactctgtcatgcatgccggatgtttacagatgtttacagagcgctctctcactccatcatgtgtgcccaatgtctacagagccctctctcactccatcatgcgtgcccgatgtctacagagccctctctcactccatcatgcgtgcccgatgtctacagagccctctctcactccatcatgtgtgcccgatgtctacagagccctctctcattacatcatgtgtgcccgatgtttacagagccctctctcattacatcatgtgtgcccgatgtctacagagccctctctcactccatcatgtatgcccgatgtttacagagccctctttcattacatcatgtgtgcctgatgtttacagagccctctctcattacatcgtgtgtgcctgatgtttacagagccctctctcactccctcatgggtgccgtatgtttacagatgtttacagagccctctttcattacatcatgtgtgcctgatgtttacagagccctctctcattacatcgtgtgtgcctgatgtttacagagccctctctcactccctcatgggtgccgtatgtttacagatgtttatagagccctctttcattacatcatgtgtgcctgatgtttacagagccctctctcattacatcgtgtgtgcctgatgtttacagagccctctctcactccctcatgggtgcagtatgtttacagatgtttacagagccctctttcattacatcatatgtgcccaatgtttacagagccctctctcattacatcatgtgtgcctgatgtttacagagccctctctcactgcatcatgcgtgcccaatgtttacagagccctctctcactctgtcatgtgtgcccgatatttacggagccctctctcattccgtttgatttgcaccactgctgtgagatgggcaacagttcctggctttacaggcaacaaaatgctcccaccagtcaatgaagccacagagcttgccaggagtgaatggggccccacctgacagaaatgacggcttccgcgggatcccatgaaggttctgtaagccagagctgaagtgagtggggcccctgtccgcaggctgccacctctggcaggtcgtccacaggaacgcttgtcctgaatggtggcccgcaccctgcagtgagcccacggctatagtggtgcagccagcagccccgacgcctctgcagtcccagacccagggaagccccgtgtgcaccacggtgtgccctggaccactcacttggccgctgccaccctgggaggatcacaggggctgccttctggacatatgtcaggctctcactgccccagtgagaggactggctctggtcctgatccacaagctctgaaccaatagcgggtcttgggatgacgtctgcggagcccctcggtcccagcgtggctggcgtccaggaccccagcacctctacacccaggtccttctcagttcccaccggccgggctgacgctggtctccagggtgatggagctgattcttcgggtttccctcagctcagatcaaatttaacacagcaagaggacacccactgttcccaccgaagaggcagaaagctggagttcgcggtgcctttctcccccaggctgggatggaggaggcagcatgaggccaccgtcattcccagtgtgtgagctggggccatccggaagttgcgattcatgtcagacactacggggccgaggctcatgtgggtgtgcgtcctctcagggtcacacctcagcaaggaagctcagcagaaggtctcccaggtccctgagccaccgttcctctgactgcttgtacccttcccgagatgctgctgcagccccacgccactcagagtgaccagcctgggccaacccctgggttctgacaagatgtgctgtttaggactaaattcagctgcatataacagaaaacttctgacaaggttggtgtgaacacctgaggcttttcttccctcccacacaaaacccatctaaatgggcagtctgggtcccgcatcctggccagggacatttacgggaaccacatcagcctaggatccactatccaggtggccgtcatttcccatcaagaagcctttctgcccagagtactgtacagccacagctcatggccaggtctcactcagtgaccacatctaagcacaggggaggccaaacgtgttattttagctaaacttagggttcgatcaccatggaggaggggaagacggcacagacccttcaccgctggccctgatggcagctggggcccgtgtgtgccgtgtcctggggacgacatgagatagccaggctccccgtccctcagggatggtcttccaaggattggagcatcttacacgttttttatttcagtttaaaccactttctactcatatgcttttggtttaaataaattgccagataaaatttgcttgaaaatcttttatgggaggaaaagagaacattcataacaaacagagctcaggttatcccctctccacccaacaccagcatttccaggcctttgaggaactggggagaaacatgatgtggtcagattccaaatttccgaagtgcggagcctcaggctcacataagggatcccaggtctccaaatttccgacatggggtgcctcaggctcgcgtaagggatcccaggtctccgaatttccgacgtgggtgcctcaggctcgcgtaagggatcccaggtctccgaatttccatttccgacgtggggtgcctcaggctcgtgtaagggatcccaggtatccgaatttccgacgtggggtgcctcacgctcgcataagggatcccaggtctcccggggcctggtgtgtgcaccacagactacatattccacaaggaagctgtgagaaagaagcacagacagtcctgcaccatctcacatccaccaaatccagaattctcctttctcaaaccatccacagactaacttattcagctccccacaatatgagtctgttttgaggccagggggtgggtcctggaccctccaattccttgacagacaaaaggtgtagaatagcctgggattccaggttcctgggagtcctgcagggcaggtgcaggctggggcatggaggcggaagcttcttcacaccacaagcggccacggtagagttgacgggagaaaccaactttaaattcatgcaggatcaggaatgctgtgccacatcaatgtgtaaaatacaatcttcatgtgggagaacgaatggtcatctctgaaatatgctttgcacattaggatttttcagatcttccctattcttggtttacccaaagcaaagcgagttcttgctggggtgaagggtggaagagaaaagcagcggaatgggcgggctgtcgaacaaaaggcggcgagggaggtaccgtgcagagcctgctgggccttctgtcccatggccccgcacaccggactcacccagcctccagccgctcctgtgcctttctgcctaataaatatctgtgataattaccaacccccaaaaagggttctctaacgagggtgcattttatcagtcccttaacgaggctgtttgggttcctgcctcctatagagtggcggttaatgcttaatcagcaaatgcactgtttaaataataacaagaatatcagcagagaatctaaattatcccttaacttctcaaaataatcataacaggcatttgaacattcatacaaatatggctcatgaataaaaatgcgctttctttaatacaaatatagtctgatggaaagtctctgaaacccaacctacggaggcccctccctgtcatctcctggtgcatggaacagcgactttgccatcactgaggttccgggcacagaacctgcctcagtccagcgtccctatccgctgtaagaaagggtgaaggatccagtatgggagatggagattgtccatatcccgagggagggactggccagggcacacccgccaagggcaccttgtgtccctgctctgcagagaccgcccagctctaggtgcctgagtgttttctgctctccacatttgaaaccctaacaaaacccctgagcaatcaggccgtgtggaggcaaagagcctctcctgtaacagtgtggtccttccagccttctctcacatgcggaatttggcagacagtgatgtgagacgctcacatggcaaactttcttttctgtttctctttggcacaaagcctcagcgctcccgcgcctgccctaccactgaacaaaacagcctcttccgggcccagctcacttgtgcctccgcccacctcgctgcgggcaacacccgttttcctaaagattgacaagaggacgtgttactcaaataaccacccgctcagaagaaaaaacctctgtgcagagccttttgtgttgaaaacgacaccttcacgttatcagccttagaggcaggtctgtttgcagcggtgcccgctgaggagtctggatttttaaaatacgccagaaatgacttagggtctcagccaacagaaccaaggaaagttatatttatgtgggaattattttgtcaaaaaagttccaaaatgttggcaaactctgctcaattatataagctttcacctgaaggcacagtatttttttaaaagtcagtttgtgtatctctgttgaaaacaattatgaaaacaagcattaaataacctgactaaaaaaagtagaatgaggttcacttccatggaaataattttattaacaaaattcagaagaccaagctgagaatggagatctgcatgttttaatcaaatgctttctaagccaagtctcctaccctctaacagacgaccatttttaaattgaaagtttaaataggttgatcttaaaaacacattcaatggtgaaggagtgtgtgtttaaaataaaagtgtttatatttttcagattttgttttctcctgcttccttaaaaaatacactggccgggtgcggtggctcacgcctgtaatcccagcactttgggaggctgagaagggcggatcacgaggtcaagatgctgagaccatcctggccaacatggtgaaaccccgtctctactaaaaacacaaaaattagctgggtgtggtggtgggcgcctgtaatcccagctactcgggaggctgaggcaggagaatcgctttaacccaggaggcagaggttgcagtgagccaagatcgcaccactgcactccagctcggcaacacagcaagtctctcaaaaaaaaaaaaaaaaaaaatactagcacagtggaccctgaagcgccagcagcaaaccctctgagatgtgcgtccggagtggccatgccaccagctttttctgcccactgttttggaaaagtgttgattttggaatgtggtttcccatcactgtgtggaccatgggtgaatggggagggtggatggtctctggggccgtcctctctccgcctccagatcagcaggcagtggatgggtatttgggtctttcttgtactcacacggatgcgatgtgtgattcctggtaggaaacaagaagcagctcactggcaacaccacactgccccttgcattccgaggagtcatgtagtcatgaggggcatgagcaagatggagacccagaggctcacgctcacatgatgacggccgagccgggcctgcaacggaaaggcctgtggcatggggtaacttcagagccttcttctcaacaggcacggcccgcagagccactggaggtaaggatcctctccagccagggaggaagcatcccgcaccgtgcccactttaaaccctggagaaccatgtttgcctctgtctggccctctccccacccccccacctccctttgccgtcttctttgtgtgtaacctttgtgtacaggctgaagagaaaagtcccaaaatccagcacaagccccgtgaccctttctcccaggcccacggtcttggggcactttctcagggcctgaccttggagcagacaagagctgagcgctcaggaagggaactgtccgaggagcctcctccacggcggaactggtgcatcatgtagaataaccgagccacacgtgcggagatgctccacgccccactgcccgtaggtctgagggagatactccccgtgttttgggatgaattgagttccccaaattcgcatgccaagccctaagcccagtacctgtggacgtgaccttatcggggaatagggtctttgtggaggtaactggctaagtttcaatgaggtcattagggcgggccctaatccaacaagacgggggtccttatcaaaggcggagatgcggacacggggcagccacagggaacaccgcgtgaagacggagacggcacccacaagccgaggagagagatctgggacagattcttctccgagggcctcagaagaaaccagccctgcccacacattgaccctggactcccagcctgtgagtggtgggcgatgaatctgcggtttgcgccgccccgtctgctatgctgtcacagcagccaaggccactggctctgtgcatttccctgcctccgcctccctctcccatcactgacgatgcagcactgactccctggacagggcctacattgggtgctgctgatggcgagactgtcatcccccgacatgaaggcaagggctgggctcagaagcctggataccgtggctgcctctgccccaccctcagctctgggacaaaccttcagtcccagcctgtctgcccacgtctctccagctgtgcaatcggcacacccacgtccacgtggctcctcatggggccaaagagcagccgtggccaggaaagcagtcagagaggcccagggttgaacccaaggtcactgcccttgtggttgagcaaaatgaagacagttcctcttcttaaatccggctctgtgcctatgaagacggaagcagcagcattccgcttgcaggtttttgaaaaaacaaatggggcaagagaggccaggaccacgcctgactcaggcgatcggacgggcagggaggctgcaaggcatggcatgagcaggtggagctgtcaggactgccccagcccctggctcaaagatgcccgaccccaggaccctgcctcgctggatggtgaaggccaacttcccctctgttggagctggcctgggcgttgtgggaagggctgggaggaggcccaggacaatgcagaacagacaggacgtttcacagagcaggctgccatgtccctcggggccttgggggctgctgaggccctgagaaaggtatgcatcggggaggctggctgtgctgttgcagggatgtgtgtggggctggatcggggaggatggctgtgccgttgtaggggtgtgtgtggggctggatcggggaggatggctgcaccattgcaggggtgtgtgtggggctggatcagggaggctggctttgctgttgcaggggtgtgtgtggggctggatcggggaggatggctgtgccgttgcagggatgtgtgtggggccggatcggggaggatggctgcacggttgcaggggtgtgtgcggggccggatcggggaggatggctgcaccattgcaggggtgtgtgtggggccggatcggggaggatggctgcaccattgcaggcgtgtgtgcggggcttgctgactctcgtgctctgcggacgcccagggagcggccccaacccacgcgccggcttctcgagctcggcctcttaagtgacagactcaaacacctgagcaacaagtttcctggggtcacctaataacgattattttaacaacagtttccaaacaacaaacaaacccatggagcacgaaacctctggggaccttttgaagctaaacgctgagtggtgccgcttcttggggagctcaaggccagcagggtccctcctacagcgaccctggacagtggtttggggattcacttgatacaagtaattctctaattaggataatctggatgcggcctgctgtgatgtagtgatggggcttccctggaaggggggatgtcaggaatagccctcactgcatagagcacatcccggcgggagcgttagagctgagggatgcctgtggctgagccgagggagagccggagccaggaaagccactgattgggcccaggggggcggcgatacaaagtcacttttagaggatgaggaaaagatgaaatgaacatctaaaaactaacgccctctatgatttaatgaactttcctctctctaaaagtactctggtgattatttcagggacagccacccaactgcacggcaccatcattttttctgatactgagttgatattttgccctacaggtcactggaggcctggccggaagtgcagggttatctcagtacttgatttaaggctcctgcagctgaaaagctgccccacacggcggaccgggtggaggaagtcagctgtgctgcttaaccgtggagtctccgtcccggtcctgctcaccagctctgcaaaggccttgtcctccctgcctgattctcggcaccatttttaacacggtgggatgtcttggatttttatgataataatttcagtatatgttcaacccatggaaacatttcatttggaaagatgtgaagtgggttagaaaatgtcatttccatgctttttagagtcgtgactgtggatgactttataggagacccagttgtctgaaacatttcacacggcaatgaaactatttccaaatattcattttcaaaatgtgccacagctggctgttttttgttttcgcttttcaagcacacacattttctcacacacagctcagatgtctattttacactgaaggtttattttactggggagtgtttgctggggcgtcccgttcccaccacaggccggtgcctccgaggctcagccttcaaccctcttacatgagtttgccgcagacaaccagcaagccgtgtgtggcacacagttctactggtttctcctggctttattacaaaatgtatcacaaaggttaactcacagtagtgcaaaggtctcatttttataaaatggataaagtgacaaaatacattaaacatacaaaattcacttcttgcacactgagcttcaggtccttgctgtgctgcaatgatgtgtggggtggatttcatatgacctgctggttccctcacctcacccagaatctttttcgtatgtctgtcagtcaaagtggtcacttcatccatagttattccaatttttaaaactttttttgacctgttaagtattgcttagcaatgagtgtacaccaagaaaggtttgaacaacctgtacattcacccaactgtgtagcagacttccacggctcatgatttattctcaaatttttctccaaatttttagcagcatcttctatttatcttccaagcattgctgacaagggaggtggccaggtttgcaaagctgcagtgccatcagcttgggcgccatgagtgggagtcacagccggggccacagcacgagggcatggccatcggcattgctggtggagctggggatgctggagggggagggaggggaacgctggatggggagggagggggacgctggaaggggagggagggggatgctgcaggaggaagctggggctctgctgtgcccaacactgaagctgggcccgtgtggggcggagagttgatttcaccgttcctgttttccctcaagcctatggagaggccacgttgagtccagaggtccgtgcgcctcatggccacatcacggcacccgttcacccacacaagggccaggagcatcccctagggaggaggagatggcagatctgcacaggctctgcgctcctctctctccggagcgtcctctcctctgtgtggcaggctcggcgcgtgatggaggagccccttctgcagggctctgtttagagggtgcccgccccacagcctgtggctgctcctactcatgccaggtgaggctcctacacccaccagtggccaccggggagtcacagctccttctgcatcatccgcctgacctgtttcctcatctgggatgacaaccagatccagctctgaggtccgtgccctgagtagaaaagttcacacagcaaagtttccggagccttccctgacgcgccacgtgtccgtccataactggtcatcctccacatcctgtgaggcacgtctcagcacctcttcgtgcaagcgcccgcactagacgtttgagaaacagatgtgagcaggcgtggtcctgacctccatcccgaggttgggggtggaatcacaaagcaggagtgtctgccaggagcacgtgtgcccacacagcaggcctggccccagtggctcagatcaggaacagacacgtactcaaagacggcgggtatgagaaagccttgtgagggaagggagccctttgtcggggggcctgaaaagaaacacggcctttgctggttctctgagtcagccccccagctaccacccacactcctgcagggagaaccccgtcaccacccacactcctgcagggagagcctcccagccaccacccacactcctgcagggagagccccgtcaccacccacactcctgcagggagagcctcccagccaccacccacactcctgcagggagagcctcccagccaccacccacactcctgcagggagagccccgtcaccacccacactcctgtagggagagccccggccaccacccacactcctgcagggagagtcccccagccaccacccacactcctgcagggagagccccagctactgtacacactcctgcagggagagccccagccactgtacacactcctgcagggagagcctcccagccaccacccacactcctgcagggagagccccccagccactgtacacactcctgcagggagagccccggccaccacccacactcctgcagggagagccccccagctaccacccacactcctgcagggagagccccgtcaccacccacactcctgcagggagagcctcccagccaccacccacactcctgcagggagagccccccagctaccacccacactcctgcagggagagccccccagctaccacccacactcctgcagggagagccccccagctaccacccacactcctgcagggagagccccgtcaccacccacactcctgcagggagagcctcccagccaccacccacactcctgcagggagagccccccagctaccacccacactcctgcagggagagccccgtcaccacccacactcctgcagggagagccccccagctaccacccacactcctgcagggagagccccccagctaccacccacactcctgcagggagaaccccgtcaccacccacactcctgcagggagagcctcccagccaccacccacactcctgcagggagagccccgtcaccacccacactcctgcagggagagcctcccagccaccacccacactcctgcagggagagcctcccagccaccacccacactcctgcagggagagccccgtcaccacccacactcctgtagggagagccccggccaccacccacactcctgcagggagagtcccccagccaccacccacactcctgcagggagagccccagctactgtacacactcctgcagggagagccccagccactgtacacactcctgcagggagagcctcccagccaccacccacactcctgcagggagagccccccagccactgtacacactcctgcagggagagccccggccaccacccacactcctgcagggagagccccccagctaccacccacactcctgcagggagagccccgtcaccacccacactcctgcagggagagcctcccagccaccacccacactcctgcagggagagccccccagctaccacccacactcctgcagggagagccccccagctaccacccacactcctgcagggagagccccccagccaccacccacactcctgcagggagagcctcccagccaccacccacactcctgcagggagagccccccagccaccacccacactcctgcagggagagccccgtcaccacccacactcctgcagggagagcctcccagccaccacccacactcctgcagggagagccccgtcaccacccacactcctgtagggagagccccggccaccacccacactcctgcagggagagccccccagccaccacccacactcctgcagggagagtcccccagccaccacccacactcctgcagggagagccccagctactgtacacactcctgcagggagagccccagccactgtacacactcctgcagggagagcctcccagccaccacccacactcctgcagggagagccccccagccactgtacacactcctgcagggagagccccggccaccacccacactcctgcagggagagccccagccactgtacacactcctgcagggagagcccccagctctgcagcacagaccccagagacagcatgcggcttcgtgattcctgtggagcagagtggggacagcctgctatggagcagcagcccactgggggagcctcgagacttgcaacgacccagacccaattccctgaggccccagcctgtggtggcagggcccacagcctgcgatctctgcataccctggatttcagaggtcactgcagtcaggccacctgaggacacacacctgagggtggtgcccaagccaagactctctctagggatgtccacgtgaccccagagaagcagcccaccccacagtccacccacagccttcgcgcctctccaggagctgggccacttttcacacacaggatccacgtcttggttattatcgaacactcttggagcttcccaagactgcagttttaaaagaaatggcggagttggcagtatttggaggtagtaatgaattttcatctttgttctcctataggaacgtttcagagctgagtccacatatctaattgagtgctgtgtgaacgcgtttccacgctggaactagataccactccatgcaaatctcatttctgttctttaacgatgccttttaatatctaatctgggccttaatatctcgctcactaaacgtgttgagataattagatgatagagctagacaattactctgtgggtagagagcagacagtttcttatatttatacaaatacacatagttaaaatgaaacagaactggcagcattcacggtccgtccaaccagggaaggccactgacggccggggctggtcagctcaggcagcagctggccgggtgcatttctatttctagtttttcacggaactgaccaggcaattcagtcagtagctgtcaaaactggagtccagaacaggcacagatgggctggcccaaagttaattaaaaaccaagaagaggataaagaaatgtggcccagtccagggagctgtggagaggtggggggcagggtgaccttctctttcttgtgggggttggaagaggaaccccacggcacagcggacaccatgtgggaccccagcacgggcgctttgggatgtcggcagaggcacgcatgcctccagggatgtgccagctcagggaggcaccctgtgcgtgctccatggtgacactgccccacggggtccaaatgctgaattcctgtaccttttacatacgtgaagtctatacaataatggaaccgaagccctctgtggggaatccgtgggaggatgagaggcctggattgcaccggaagcacctccggctggagctcggccaaggagcccgggtcccttcagtctgcgctccctgcggtgggcagtggcttctgtgttttgccgtcgaggtgcaacatgcagctggtgatgccctgtggcatctgcctcctgccctcggacatgctggcccgccctccctgagtcttgcagggcccagccgctgtgcctctgtgtggcctccccaccttacctgcagacacgctccctgtactcaaagccgagctgtgtgaggcttttggggctgccagaacaaaggactccagacggatgggcttgaaacagtggatgcctgcagtctcacaggctgggtttggagaccttgcttggaggtgtctgcagggccttgaaggggacaccgacccttcctgactcccagcctctgcgttgccagcagccctcggcccacagacacagcgcttccctcctgcctccgagccacgcagacggcttccctctgcatgccggagtctgtcctctccgtcgcagggacacggatgcttcgaggactctgtgtgccggagtctgtcctccccatcacagggacactgctgcttcgaggactctgtgtgccggagtctgtcctccccatcacagggacactgctgcttcgaggactctgtgtgccggagtctgtcctccccatcacagggacactgctgcttcgaggactctgtgtgccggagtctgtcctccccatcacagggacactgctgcttcgaggactctgtgtgccggagtctgtcctccccatcacagggacactgctgcttcgaggactctgtgtgctggagtttgtccttcctgtcgcagggacatggccgcatcaaggacctactgcagcacggtgcctccttcaccaagcgaactgtgtctgcaacagtcctatgtccacggaaggtcccattctgagctgccgaggtccaggacttcaacatatctttctgcggagacagttcagcctatagcattagctcatgtgccctctgttaggaagttccctgacagacttgagcccacggctaggggattcccttctgaacacagaatgtcttgcttatttcacacgtgtgctaatttgctgtacaccaccggcttatttaattgttgtgcatttattgtatttctccactagattatttactaactggggtcaggatccatgactttttaacattgatattcatctctctttttagaacagaaatgggtgcccagctggtcaacatacatttgttaccttgctttaaaatgccttgagagtggaaccaccggtgcaggcttggctggtcaagaatcatgttctagaaattatttccagtgctgagcacagtccctgagatttaaaaacgcttatgggatgaatggaaaatagcagggcctcttaccggcctgcaacgcctttagaggcacggatgccacgtgcacagacccagctccgggaagcacaagcctggtggtgtgcgggaagcggcgaggtgcgcgggaagcggcgaggtgtgcgggaagcggcgaggaccggctttaaagtcacagcagtttcctgaaagatgagggggaggaggacagtgacgctcacagcacagccacttgtcaacttggacatgacacacacaaagcccagagctcggacggcaccgcgaggaggctgggattcacgtcaggcggcacttggtgggcagttacaagaaaggacggcagccaagccagtgcctcctgtgctccggctctggggccctggacacacctggggattcagttttgcatggaccagcattctccaagcgctctgatcagtcttacaggagaagtaggctgtgtggtctgggagccttgagaaggttccgctgtaatctgtcagacttttggacaggatttttctgccttacgtggctgatgtacgtctgcaggagggtagcacacggcaccctctcggcctgctgtgccacaaaacctttgcttttacaggtctcacggagccagtgggctgcccaatgccccagtgcagagtggagacgaggtcttcccctccttcccagcttgcctgggcggcgacgcgtctcagagacctctgccagggtcaatcctggcccatgctactagctcggggtgtgaagtcacagttgatgctgaacacctggctgggccagacttgtgcccaagaaaccttataccaccaactggttttcaaaagaaaaaaattaaaagtaattcaaaactttgagatataaatataattctttaaaaactgcagcgtggttcactggccctgtgatgggctgaatgcgcccccaagttcatgtggcagccttgacccccaggacctcagcgtgtggcgtcttggagacaggggctttacagaggcgatgaaggtaaaacaagctcttatggcgaccctgacccagcaggaccggtatccttatcagaaagggatatctggacacagagacagacgtgcacgtgtggagacacctgaagatgaagatggcatctaccaggcgggggagtggcctcaggagaaacgggctctgcccacgcctcgacctcggacttccagcctccagagccgtgtgaaaagaaacttccatcatttaagctgccctgtctgtgggactttgcctcggcagcctgagcagacagtacaggctccaaaaacgctctctgcatgtgtgattctggccaggaccaccctgcccgaagccacggctatgtcgaagctaattgtgcgatttctgccggccacgtggttttgatccaaaagcatttgaaagctgctctgaagatgcagaaaagctgagtcccggcatcgctgctccttccaagcgactgttcacacacagggtgtgagtgcgtccccccatccagggtccagcctggcctaaggctcactgggcaccatccagatctgtgactgggtccccccatccagggtccagcccacccgaggttcactgggcaccatccagaggccccagatgccgacacctggggacgggctgtatcaggcagatgtttcctcccgggctccacctggggacgggccccggatgctgacacctggggatgggctgtattaggcagatgttcctcccgggctctagttttccaggccgacaggaggaagtcctgttggggccaggggaggcattggggatgagattgagaggatggtggggtcgcaaaggtttacattgcctgtgccactttctccaaggtctggggccgccaccctgtggtgcctctggaagctgccatgtggggctggcccacggtgactggccacggcggggctgtgtgtggtatgcacctgtgagctgctgaaacgcagcctggcggccaggaaccagctgccccatcctctctgcaggaggtcaggtttgagcacgtattccctcaaacgctcatagacgtcagtatctcaggacaaagtgcttgtctgagacccaggtttgggccccaaggtggtaccatcgagggaggcatgttctggcaggtgacagcccctcctctgtgcctgaacctgcagtttctgcccccgcataaaatgccgccatctcaggccctccctgacccccaacctgcacaagggctcacagctggcaggcacctgtgtggggtcgtggtaggacctgtgtctctgaggtccagcccaaggctgtgccacataggcccaaatccaagcactcccctcctgggcacgtggctgtgtgtgcatgtgtggctgggtgggcaggggggttgactctggccaccgaaatggagaggagcggtgcactccctgggtctggcccacgcaggctccttcccaagtgctgctgccgggaaatggaggtccctaggtgagacgggagccgggcactgtgggggtggcccctgaggggctgcaggttggcactgcccagctgacgcattccgcagtcctgcaccaggggatgaacgaggaatcggcttctgctctgctgaacatcccactggttcatgtccacttgtttgggtgatcctaactgatctgctacctgagtttgaatctcagcgctattattagtcaggggtcctggaggtgggtgaccccacctcacctaaaccacagagatgctcatcctcatgcatgcacacgtccatctcagcttcagctcgcaagcaggaccctcaccgtggggccacgacggaccctgcaaagctggtctgactgtgccgagcctgtcgggggttgggggaaggaaggcgggagctcggcatctggagggcagtggagaccctcagcgagtgccaggaggatctgctgtcttcccagtgttgtcttcacagtggagagatgagttcacacagccttatctgtgtttccagtggcctctgtgtgcaagacgggccacgggttttgtgcggtatttgcctgtgggtcacagccaggtgaatgggccctcctggggctgcagccccaggtcctgatgttacttgtgccagcctggccacagtgcccggcctccagaagctgctgtcagaggagcagacgggagggcagggtggacggttaacagggtcaaggccccagagccccacaccctccccagcagccagcacaccctctgttctgtgacctcgcccctgcattgcggcaactgacagatgctccccggcctccttccccgctgccgcgcaacctctgacagccacgtgtactctcctgctttagaacaaggacctttcccttttgtgcatgaatacgctctcagcagatgcgagaaaatgggagtcaaatgcacctttgtggtttcttttccttctacacaaacaccacttgagtgaggcccgggttctgcaaagggaaagtagtcgtcactttctaggccccaccatgagccggggctcaaatcccatcctggcctgctgggcatttgtttcatcaattaagagtcagtgagcaggaaacaacattgcatattcacacaaacacacgtgcatatccaaatacacatacacacacatgcatatgcagagttatatacatatataagcacacacatacacatgagcacacacacgtccacatgtacacacatacatacatatgcatgagcacacacacgaccatatgtacacacacgaacatgcacgatcacacccatatccctcgtgtacacacacacacacatacacacagtgctcatgacctactaaacagcgcatgtgcctctcagcccttgccatgacaaccatgaggtctgcaggaaacacgtccatagaggtggagctgaggctggtgtgcattctcccaggcacccagcatgagtgcccagctcagggtctgcaccgaggctgtctggcccgagtcccaggctcgccccagtgcttgccacacacaccctggggtctcctcagaagcagtgcctgtgccccgagatgcacggccaccaccccgcccctgaggccctggatacacggccactaccccgcccccgacgccctggatacatggccaccaccgcccccccccgacgccctggatacacggccaccaccccgcccccgacgccctggatacacggccaccaccccgcccccgacgccctggatacacggccaccaccccgcccccgacgccctggatacacggccaccaccccgtccccgacgccctggatacacggccaccaccccgtccctgacgccctggatacacggccacctggatacacggccaccaccccgcccctgacgccctggatacacggccaccaccccgcccctgacgccctggatacacggccaccaccccgtccctgacgccctggatacacggccaccaccccgcccctgacgccctggatacacggccaccaccccgcccctgacgccctggatacacggccaccaccccgtccctgacgccctggatacacggccaccaccccgtccctgacgccctggatacacggccaccaccccgtccctgacgccctggatacacggccaccaccctgtccctgacaccctggatacacggccaccaccccgcccctgacgccctggatacacggccaccaccctgtccctgacgccctggatacacggccacctggatacacggccaccaccccgcccctgacgctctggatacagggccaccaccctgtccctgacgccctggatacacggccacctggatacacggccaccaccccgcccctgacgctctggatacacggccaccaccctgtccctgacgccctggatacacggccaccaccctgtccctgacgccctggatacacggccaccaccccgcccagactgaagggtgacaccagaggcaaaaagagtgaactagattcacgtaaatcaacatgaataaacttcaaaacagaacagatggaaagactggaaaagtccacgcactaatgttcattcaggcagaaagagtgagggtccctcccagaatccagtccagggagactccttctcttcctttctgcatgggcccgaggagctggtccctagactgctcagatccaatccacagtccgtgagcaaagggccgcaggcgtggtggaggtgtgcccaggcccagcatgcccccagagtccacaagagcaggactgggggcaccgtgcctgcgccagcccaagctgcccagacttcctctggacagcaggcctcctgagccctggagattaactcactgccgcaggtaggatcacctgagtcctctaggaacccagcccgcatcctgggcaagaggcccacatgcaccttagaaagggcccgaaacagttcacgagtggggtgtgggctgtgggtccagacacagttatcctaaggccaggcacaggaagggttcctttcccgatggctccgacagcccagtggtgcacctacaactgcttcccatcgaggtggtgggctgggactcggcaagcccatctgaacagggctctctgcaggcagccccaggcctggagtttgccaagtgatgagttttcctgtctgagcttgtttccatcatctccacgatgaacgtaggacaccaggacattggatctctgcggggcagcagctcatggcccagctgtaggaaagcagacccagcctctggattaaaaccatgcctggaggaaactggccttgtgagtgtcagggctgcgctgctgtcttccaggtcctccctggtttaatttagcaaaactaccaatgccaagaactggttaaattttttaaagggaagaaagtatgacacatggagaaaaaggtgcagcccatttcccagcctgaggactggccggggaaataactctgagccctcgagatgaggggctatgccttcccttgctcactccctccctcacccacctgcccactcgcccatccactcaacagcggtcgttcttcattgtattgtgagctccctctgggctgtgcactccgggccatgcgtggctggtaactgggaaatgctcgacatggaaaattctgcttgatcatctgagatgccacctcagtcttggggaactcaaggccaggagggtcacacaacccatttagcattgcctagcaccagtggtgaggccaggcctcccgcgccctccatctttctgccaccacagtcgtttggggactcagttccatgtagaaccagatgaagattcataaaggccagtgggataaagacttcccaatgtcccgaaacaccctgacacgtgtaattccaaatctgtaagtactaagttttaaaatgcgtgtgagcaagtcaaatttctgatgtttccctggatgacaagatgttttctttattaaaatatcaaggtctttctacaaatctttcctgatacctcaactttgccagggtcctaagcgtgtgcttaggtacttgcagagcctcccagcatgggaggtctgggtagggccttggaggcctgctgggaggtctgtggactccaggccgctcacttatccccatgcatataaaattcctagggataatttcatttgatgacagagttacacttaatgccaaagtaaagaaaaagtttacatttttcctgagttagcagacaaatataaggggacttcaaaaagttcacagaaaaattggattaaaaggtaaaaataaaaatataaactttatttctcaacataatctccaccagggccaagacacttttgcaagggatcaaacccaccatttagtccattcccaaggcactgaggaccttgggaatttagccacatcaatgcagtctttttcccattactatctaaggaaaaatgggtaccctctggatatattttaagaatggaaaacaaaaagaagtgagaaggagccaaaccaggactgtagggggatgcctcatgagttctcatcggaactcttgctaaattgcccgtgtttgatgagaggagtgagctgaagccttgtcctggtggagaagggctctctggtgaagctttcccaggcatttttctgctaaagtttttataactttctcaaaacacccacataataagcagatgttatttttctctggccctccagaaagtcaacatgcaaaatgccttgagcatcccaacatctactgccatgacctttgctcttgatcagtctgctgttgcttcgatgggaccccttccgcctctcggtagccactgctgtggttgtgcttggtcatcaggatggtactggtaaagccatgtttcctctcctgttgcaattcttcaaggaaatgcttcaggatcttgattccgctgttaaaaatttccattgaaagctctgcccttggctgcagctcatctgggtgcaatggttttggaacccatggagtggaaagtttgctcaactttaattttccagccagaattatgtaagctgaaccagccgagatgtctatggtgttggctgctgtttctgctgttaattgttggttctctccaattaggatataaacaaggttaattttttccttgcaaattgatgagggggtctgccactataggattcatcttcaatatcatctcattctttcttaaaatgagttctccatttgaaagctgctgatttctttggggtgttgtccctataaacttttcataaagcatcaatgacttcatcattgttccacccatgtttcaccacaattttgatgtttgttcttccttcaattttagcagaattcatgttgctctgataggggctcttttcaaactgatatattctcttcctagccttaaactagatcctgttcagacatgttacaacaagttagtatgagtttattttggtgcagaaagatttttgaaatccatgcatagttttccatgatccacattttccatggaccttcttcagaatctcttccataacaagcctgatggctgcttggggtgctggctgaactcagagtaatgcctgtgagccgccaggaatcctgctctggggccaggagctgcatggcctcgtgccagcctcccgcacctgcacccccaccttgatcccccagagcacctgggttgcgtaaggggctgcacaccacagtcatctgtttcttaaagtactttgatgttgatctttctgtgagactctggaagtggagatagctttgggtttattgggcgttcgatgttggggattggatggcctggctcagagatgttgaaatgtccccgacctgaaggctcttgcagtgctggtgctgggggcgctaggccatgagctgcacagctggggtaggggcctcagggctgcctggacttccttacgaagaagctggctcccagagcttccaaagttgacggttctgaactaggcaccaatctttcctcttttctcagctggggaggcccagttgctcaaagctgtggttctcaaagtggggtccccagactggcagcacccagggagcttgttagaaacacagatccttgggccctgcctcggaccccctgagtcagaggttctggggtgaaccagcaacctgtgtgtttacaagccctgcaggtgattctgatgcaggctgacatatgagaactgtgggcctgggggatttgggttgttctgcttatgggaaagggcaggcgtgacctctgagagaacttgtaagatgtgagagtccaaaagcttcctctaaattggactcaaggtcgcgttcatcggcagctgtgatgtaggaggcaccctaggtgtttgccaatggcatttgtctctattggccgacaccaccccagggcccctgaagagcaaccgggactcactggcacaacttcaccctcctccttttatttttttttgtaatacaaaggcttgaggtacagtattatttttggagggattttttcctattataaactagtaatgtcttagggttaacatttccctaacacacatatacacatacatacacatatgccttcccacacatatgcacacatacacacacacacacagacccctaaatacctacacacccacacacccacaaaaatgcacacacacccatgtctacacatgtgcactcagctccagaacacaggatgtggccacgcatacccagcacctccccacacacaaatacccagcgtccttcccatacctgcatacccagcactttcccacacacatacccagcgcttccccacacacacatacccagtgtcctccccacacacacatacccagtgtcctccccacacacacatacccagcgcctccccacacacacccagtgtcctccccacacacacatacacagcgcttctccacacacacatacccagcgcctccccacacacacccagtgtcctccccacacacacatacacagcgcctccccacacacacatacccagcgcctccccacacacccatacccagtgtcctccgcatacacacatacccagtgtcctccccacacacacatatccagtgtcctccccacacacacatacccagtgtcctccccacacacgcatacccagtgtcctccccacacacccatacccagtgtcctccccccacacacatacccagtgtcctccccccacacacatacccagtgtcctccccccacacacatacccagtgtctttcccacacacacatacccagtgtcctccccacacacgcatatccagtgtcctccccacacacgcatatccagtgtcctccccacacacgcatatccagtgcctccgcacacatggatacccagtgccttcccacgctatgtcctcacagctgtttcccctacccaatgcccatgtaactgtgtcctgacacttggtggcctccttggtttcccggtataactaagcactgagaggcgctcttgcgcccaggccgcctgtccaactggggcaggctccatcttgcaggaggtagaaggagggtgcagagtccctgaggccctcagtccacatgcccctccttggagtgtcccctccccgccctgtcagggctcctgagagtttcctcagcttcctggcggggtagaggggtgacgggtgctttctgtgtgggccctgtctgctgctgcctctccacagctccccttcaagggccacccatgtccgcaggccacctccccttgctgggagcactcatttcccaggtggtgcttgtcctcttcctgggacacttttctgtctgcactagaacttgacagaggaagccacaaagcttcctggccatggaaagtgggaactggccacggaacaggggaactgcccctggccgtgtatgtccctcacccgagccctgtctcctaggctctcgcttccattttgcactgagacctctgcctcattccctctgaccgggcctcttgcctgccctgaagtcctgcttcctcgctgcttgtgggagggggaggctccgactgtctctcctttatccaccaatgtttccgccaccagcgagtgctgagcaagtatctgttgaataaatgaatgtgcaccaggaaagaaagcagccgcctggcctgacctcgtctgaggctctggatgggatacgcttcccagtttgctcgcttccctggagaaacccccggagggccgcgccccgaggctttgctccgacgtgtgccaaggacatgtgctgggagcgtctgcaaggtccgtctcgccgtgggggccgggaggagaacgtaccgtcctcaaggtccgtctcgccgtgggggccgggaggagaacgtactgtcctcaaggtctgtctcgtcgtgggggccgggaggagaacgtactgtcctcaaggtctgtctcgtcgtgggggccgggaggagaacgtactgtcctcaaggtctgtctcgtcgtgggggccgggaggagaacgtactgtcctcaaggtctgtctcgtcgtgggggccgggaggagaacgtactgtcctcaagcagaatttcctgcgctggtctctgggatgggcagagggccctgctttcaggtactgaggagagcgcagcactcggcatcacactgggggcacaggtcagcagggggcacctgggagagaagaggaggtggaaagcggaggaggagggatggacgaccagctgggcacaagaggggcttcagggcacggcaggagggccgtccggggaaagttgtttcctgtcccactgactttgacggctctaggtctgccacaactccggcaaagtcccaggaccctgagcagcctcgggaagagctctcgggacctcgggggagtgaggtggcccaggcctggcacagctcagtggtggcacgtcacatcacacatcttcagaccaggccttctgcaacgattctctggcctctctgctgctctgcctagctccagccttgtcctgcggaaggtgctgaagcggccctcagtctgcctctggcctccctctgtttccccctccacaactgggcaggctgctcccttcaccccaacactccatggctccccatggcctgcaaatcagatcacagcccctaagcctggactgcagtgctccacttggcctcgcccacctctcagcccattttcaacgtgacacacgcaggtgaagtggacctgacccagctcctgctttctgccccctcctgtcccctctctcctgccctgccccgatcctgcctctgcttctgtccacatggccccagccacagtgccttcctgccagccaaccatgttcacaaggaagttcatgtcccccttaactcgagcttttatttcagtgaagcttcggggtcacctgcacggcctctcgtgagtagggggatttcctactcgctccacagacagctcccggggtccggggagaagcggaggggggcagagaaggccgtgccacccagcagcacaaggcaggggtttgcttgcaggtagcaaagtaacccaagcagacacacactcatgcacacacacacagagacacactcatgcacatacacagacacacactcatgcacacacacacgaacacactcatacacatatacacacagagacacactcatggacacacacagagacacactcatgcacatatacacacggagacacactcgtgcacatacacacacggagacacactcgtgcacatacacacacactcatgcacatacacagagaaacacttgtgcacggagacacacttgtgcacatacacagagacacaggcacacacaggcagacgcaaacgtgcatgcacacagacacacagacacacgcagacacacacacgcgcacacacagacacacacacacacacgctcactcacaggcaaacagatgcccttgggtagacttgtggtctgacagccgtacaggaagtatgtcccaggaggagcccaggctgtgtcggggtcaccttgacttcactattttcgaaatgctgaattttgctgcaaagttttcctaaagggcttggaaacggtccagaccgtgctgtcctggaagtctcctgggggctccttcttcaaacaagagaaagctggggagtttccaggcgttccgtgagagccgagggagcgcgtgagggcttcctcctatcagcgtccgtattcatggtgggaggtggcaaacctctatcggcagtttctgataaccttgctccgggtcacacgttatcttcctgaagtggcagccacggaagctgcaattcaggcaccaatatcagaaaatgagtcattgccgggaacttcactgtgcagtcccagaagtcttaattccagcagacagggtgactccaaagggagatcgttccagccacttccaaggtgtctctttctccatctcttcttgcagccctgattgtggggccatggcctgtgcaggaggcgagcaagtgtgacccctggtggctgcagcagcagcagcaccttgggcctcgggggtcaggaggggctgagtccccaggtcaggcatccccaggggggcacggggctgcagagggtcaggaggggccgagcccccaggccaggcatccccagggtgggcaccgggctgcagagggtcaggaggggccgagcccccaggccaggcgtccccagggcaggcacggggctgcagagggtcaggaggggccgagccccaaggccaggcatccccagggtgggcaccgggctgcagagggtcaggaggggccgagcccccaggccaggcatccccagggcaggcacggggctgcagagggtcagcagggcaggtatgccttggccatcaccactgcagtggcctagaggtgttcctggctgtctccatctggggcagcacctgcagctccttggacagtgtcagaattcacgactccttgcaaacaatgcagtccacgctcaccctccctcctctccacgagacctcagtgccctggaccatggactgggtgcccgagtgggctcatccaagccctgtttttgtgttggtctcctgttgtgacccatcccctgctatttctgctgggcctgaggtaaggcggacagggctgaccctgaaggcaaagcatcctgggggccactcttctggaagcgaattcccagcatggagaagcctgaattaaccagcagcggccccaggacagagtctgtcaccagagcctggagacaggatgggtggctgtgtctaaagccacagcattttcttttcctgtggcaagttatccctttccttagaaaaaagtactgttggatgctgacaccaccacaaataatctagttccttggcaggtcctctcatgagtaaacggccctagaagacgtttctcccaggaagatgcacagacggccaaggcaggcagacggcggcaatcagcagcttccacgtccaccagggtggccttgggaagaccagcgcccccacgtggggctgggagaggccgcactgcaccccaagagtgaggatgggtcgggggcagcgggaatggtgctctatggggcttcacatggcccctgcaccccagggcggagaactttctaagagggaaggtcggggcagctgctgtgtgggtgccagcagccacctggggacagtgccagcacgggggcatgccgggggagcctctgggagccgcaggaggcactagggacacgcagctcgccggccctccaggaggacgacgttctgaaatgggccttgatgccctggacggcctcgctagcctttacccacaggggaaggtgcaggatgtggcagtccctggaggaaccccaggcctgagtgtggcaccagggtttcctcggggaccccatatctgagtgcagcaccagggtttcctcggggaccccgggtgcaagtgccatggtcagggtttcctcggggaccccggctccgagtgccatggtcagggtttcctcagggaccccagatctgagtgcagcaccagggtttcctcggggaccccgggtccgagtgcagcaccagggttttctcggggaccccgggtccgagtgccacactagagtttcctcggggaccccagatctgagtgcagcaccagggtttccttggggaccccgggtccgagtgcagcaccagggttttctcggggaccccgggtccgagtgccacactagagttttctcggggacccgagatctgagtgcagcgccagggtttcctcagggaccttgggtccaagtgccatggtcagggtttccttggggaccccagatctgagtgcagcgccagggtttcctcggggccccgggtccaagtgccatggtcagggtttcctcggggatcccaggtccgagtgccctacccagggtttcctcggggtcctctctcctcccctccgtgcaccccgcccacgtcacaaagaggaaggtgatgtctctggacccagcatcaaagcccgggtcttggtgggtggtgcagaaggtgttcctaacagtgggctggggaacagccaaccctccctgtgggcctcagagccaggtctcaggaacaggcactgcacagctgggagcagcagggacaggagaggagggagtctgctcagagacgtcttcttcagaaaccacattccccaagcccttcgccaaaatcatcaaaacatcccacgatcagctctgcttgaccggggagaagaggaacaggaaatatgtcaggggtgagattttaaaatgtgtgtgaatataaacattcagctctgtaacataattaacagcgccccaaggaaaatcccgcgtatgtcagtaggaagcgttcttgatgcggagcgaaggctacttggcggtgttccggctctctgactctgaagggcctgcccgtgttccttcctgaggctcagacaagcccatctcagctttgctgtctaggaatttataagtgtaagagagcaaagattcagttccccaaaagataccctcttggtggcctgtggtccacgggagacctcatgcaccagggatccccgtgctgggccggccagtgctcaagagcacggaccctgaggctccttaaaggggctggaagggtcagtgtgataccgtgcacccacacttactcaccgaggagctctcggattccgtggggctggaagggtcagtgtgataccatgcacccacacttactcaccgagaagctctcggattccgtggggctggaagggtcagtgtgataccgtgcacccacgcttactcaccgaggagctctcggattccgtggggctggaagggtcagtgtgataccgtgcacccacgcttactcaccgaggagctctcggattccgtggggcttgacgggtcagtgtgataccgtgcacccacacttactcactgaggagctctctcagattccatggggctggaagggtcagtgtgataccatgcacccacgcttactcactgaggagctctctcagattccatggggctggaagggtcagtgtgataccatgcacccacacttactcactgaggagctctcggattccatggggctggacgggtcagtgtgataccgtgcacccacacttactcaccgaggagctctcggattccgtggggctggaagggtcagtgtgataccgtgcacccacacttactcaccgaggagctctcggattccgtggggctggaagggtcagtgtgataccatgcacccacacttactcaccgaggagctctcggattccgtggggcttgacgggtcagtgtgataccatgcacccacgcttactcactgaggagctctctcagattccatggggctggaagggtcagtgtgataccgtgcacccacaattactcaccgaggagctctctcagattccatggggctggaagggtcagtgtgataccgtgcacccacacttactcaccgaggagctctcggattccgtggggctggacgggtcagtgtgataccgtgcacccacacttactcaccgaggagctctcggattccgtggggctggaagggtcagtgtgataccgtgcacccacacttactcaccgaggagctcttggattctgtgttttcaagcctgcccatgtgtaggaaaagcacagcctccatgagaacagcaggaacacaccccccaacacgcacacccaaacacacacgcatgcacgtgcatgtgcacacacacacactcgtgcacgcacacgtgcacgcacacacacacagagcaacgtcctgcagctcccatcttttctttttaaaatcatacatatttcattaagctccatgcagagtgtcttctgatttatggtaattgtcaacaaaagcaaaaacacagacaattttaaccctgcagtagctgggagttaaccggcatgaaatcatattttttttttcctttaaaaagggagggggctccaagcactcccttgcattaaactctgaggatgctgaaccaagagagacagtgtgaaccccagcattggtggctgttgtctaagaggcccatgccagaagcgacatctgatagagtggccacctcaccccacgtgagcccggcttactcgtggcctggaggactttgagtgagactaatttccatatcaaacccaatttagatgaaacgtctttgttaaaaaaaaaaaaaaaaaaagccagagcttcaatagccccttgattagattttcatctcctgagcagacaaatatgaatatttattaccatgaatgcatatttttctctttccattgctctgatcttgagtattatccactgctaatttttatgaaaatttgggcaacataatgttttcacataaactgacagtccttgagataatcccgttattgtctggttgaaaatgacagcttccgcttattcatgtgttaacgagggattaaatattgtttttcatccccgtaatctaagacggactggaaattaaaaattgaacattgtatattagcagggctctgaggaccagaatttgtttgcgttcacttagagacgatctgtaaattagcagcttcacaatcaggccctgtgatgttgctgctgaaggtagcatcataaaatgccactgacatttctaaaataaattcattactctacccgccgcacaccaaaatgaaaaggcttctatcaggaaatacatcgcaaaggaaaagacaacactgccaaagaagtaaaattgcaacacaagttatattgcttcaacatcaagaattttttagggtccccgtgctagagggggcaccggcagctcctgggaggtgtgagtcttggtcatcatgtggcgttggcagaaggaggaccctgtacatcctccctgcaaaatcacccaagggacccggcccataggcagatgcagccacgtccttctccagctctgagggcaggcaggccatctccacgctgagcatcgttgacggtgacacatttgtaccatgtggtaatttttactttattgctatggctggatggctcagactgaaccgtggatctgaagggtttttggacaaaactatcctattatccttctaaaaatcgcgctaaattttattcatgtatttattcattaattcactctccctgattgccttggtagaatttttcactttttaatttattgtttgatatggtgcaggaaaatggcatagatgtattcctctgaagctagcttgacccaatgctatcttttggaacaaatgataaaaaggcactctgagttaaatgagacactaacagggtcagagtttagagctgaattgagtctctccaaagtgcctatgggaagctctaatcccagaacttccgaatgtgactgtatgtggagatggagttgtctataggagtcattacggtaaaatgaggtcatgaggatatgtggagatgggggtgtttacagtagtcattatgataaaatgaagtcatgagggtatgtggagatggaggtgtttacaggaatcattacggtaaaatgaggtcatgagggtatgtggagatgggggtgtttacagtagtcattatggtaaaatgaggtcatgatggtatgtggagatgggggtgtttacaggagtcattacagtaaaatgtggtcatcagggtgagcctgatcccatgtgactggcatccttgtaggaaggagatgcagacacaggtgcacacagaggggtgaggacttgaggatgcagagacggcatctgaagcccaggagagaggccttgggagagaccagccctgcccacaccttgatcttggacttcagccaccaggattgtgagcaataaaggtttgtgactgaagccccccactctgcagtattctgttgtggcagccagagaggacgcacatggtcaacatggcaacaccccctcagtacaccctagacatctgaggccaagcccctgtgactgcagggatgcgtctctgcctacgagaaaggagaggatttcctgttttcgtggaacgttaagtccaagtgcttgtcaacagaagaaagttacttcttaagaatgttctttttgctttatgatctcattaaaaaaaaaaaaatagattggcacttcagtaaaagggtttgcacacacacaaccctaattagacttttaatagatcctttgtttcacaggaatgaaagtgaaggtaaagtttgtgcctgtaaactactaaagagctactagggcccagtgtctagggccctccaccatccatcagtttctaatgtaggagatgagaacacatcaccccaaaaatgactgtcatacatcagaacatgccaccccaaaaacaactgtcgaagaacagaacatgctgccccaaaaatgactgtcatacatcagcacatgccaccccacaaactactgttgaagaacagaacacaccaccccaaaaatgactgtcatacatcagcacatgccaccccaaaaatgactgtcgaagaacagaacatgccaccccaaaaatgactgtcaaaggctagaaaacaccactccaaaaatgactatcagagaccagatacaccaccccaaaatgactgttggagaacagaacacgccaccccaaaaatgactgtcagagatcagaacacaccaccccaaaaatgactatcagagatcagaacacaccaccccaaaaatgactgttggagaacagaacatgccatcccaaacttgactatcagagaccagaatacaccaccctgaaatgactgtcagagaacagaacacatcaccccaaaaatgactgtcggagaacagaacacaccacccccaaaatgactgtcggagatcagaacataccaccctaaaaatgactgtcaaagaccagaacatgccaccccaaaaatgactgttggagaacagaacacctcaccccaaaaatgactgtcgaagaccagaacacaccaccgcaaaatgactgtcagagaccagaacacaccaccccaaaaagactgtcagagaaaagaacacaccaccccaaaaatgactgtcggagaacagaatacaccaccccaaaaaactgttgaagaacagaacacaccaccccaaaatgactgtcggagaacagaacacaccaccccaaaaatgactatcagagaccagaacacaccaccccccaaaatgactgtcggagataaaaacatgccacccccaaaatggctgttggagatcagaacacaccaccccaaaaatgattgttggagatcagaacataccaccccaaaattgactgttggagaacagaacacaccaccccaaaacgactgttggagaacagaacatgccaccccaaaaatgactgtcagagaacagaacatgacaccacaaaaatgactgttggagatcaaaacacaccacctcaaaatgactgttgttggagaccagaacacaccaccccaaaatgactgtcaggacaccaccccaaaatgactgtcagggatcagaacacaccaccccaaaaatgactgtcggagatcaaaacacatcaccccaaaaatgactgttggagatcagaacacatcaccccaaaaatgactgtcagagaccagaacacaccacccgaaaatgactgtcagagaacagaacacaccaccccaaaatgattgttggagatcagaacacaccaccccaaaatgactgttggaaaccagaacacaacaccccaaaaatgactgttggagaagagaacacaccacccaaaaaatgattgtcggagatcagaacacaccaccccaaaaatgactgttggagatcggaatgcaccaccccaaaaatgactgtcagagaccagaacacaccaccccaaaaatgactgttggagatcagaacacgtcaccctaaaaccgactgtcagagaacagaacacaccaccccaaaatgactgttggagaccagaacacaccaccccaaaatgactgttggagaccagaacatgccaccccaaaatgactgtcagaaaccagaacacaacaccccaaaaatgactgtcagagaccagaacacaccaccccagaaaagactgtcggagattggaacacaccaccccaaaaatgactgtcagagatcggaacgcaccacccaaaaaatgactgtcagagactagaacacaccaccccaaaaatgactgtcagagatcagaacacatcaccccaaaaacgactgtcagaaactagaacacaccaccccaaaatgactgttggagatcagaaaacaccaccccaaagtgactgttggagaccagaacacgccaccccaaaatgactgtcagaaaccagaacacatcaccccaaaaatgactgttggagatcagaacacactaccccaaaatgactgtcgaaaaccagaacataccaccccaaaatgcctgtcagagaccagaacataccaccccaaaatgcctgtcagagaccagaacatgccaccccaaaatgactgtcagagaacagaacataccaccccaaaatgactgtcagagaccagaacataccatccaaaaatgactgtcagagaccagaacatagcaccccaaaatgactgtcagagaccagaacacaccatcctaataaatgtatgcctttttggcataaggattattttgagaaactgaagatataggagaagctctgaaaacaagttgattctcttctataagagagatctatgtttataaaggagtcctccatttgtaagggtggctcctctctgcacctggaagaggacggctctcgtcactggaaaccccatcaatgcagagggctcgactgagggtgcatgacaggccttgcccttgctgaccggcttctctggtcccctcctgtgttaatctgttctcatgctgctgataaatacatacgggagactgggcaatttatgaaagaaagaggtttaatggactcacagttccacgtggttttggggaggcctcacaatcacaaggcctcacaaggtcagaggcacatctcacagggtggcagacaagagagagcatgtgcagggaaactgccctttataaaccatcagatctcatgagactcattgactgtcacgagaacagcatgggaaagaccagcccccatgattcaatgacctcccaccagttccctctcacgacatgtggcaattgtgggagtgacaattcaagatgagatttgggtggggacacagccaaaccctatcacctcctcattgctcctcctgctctgtctcagcagatgatggtgctgaagcctgagtctacacacctctttgtgattgacccgtttctctgggtatggctcatggatgcaggaggtgcacatgtgaatccacttcggcttgtttatctcttgtgaatcggttttttgttacaggagtccacccctcgtaggaactcagaagaacagagacactactttttcttccccacacagagtagtagcttgaggccactggctcaagcaaaaggggtacctgagttggcctggatgctcagtggctgccctgataagtgattatggaaaatgtgatgccagggcggtctcaaggctggaacgacagcccccaccagggtgggcttggctccatgttcactgtctcgggagcaaggctgcccttacacctgcagcacgttcctccactccacagtgcccaggtgggcctgggctgggggcattggacacaatgcatcctggcagccacccaggcctagcctctccagggcacctgatgcccacctgggcagagaaaggcacctgagcagaagggcatggggctttcagaaggagggtccctgaaggggatgcagatgcacccgcctgacgctggaaacaagccaagttcctcctgctggccccaacaggagagtttcccctgacagacacacctctgggctctgctcatcagcgtccatgtccctagctggacaattccagggttgaaaattagggtttcccacctgtatctcatgaactctgccaggtaaaagtttcatattcatggagtataccaggtgcgaatgtgctatagatgtagctaaggacatttcagctttcaggaatctccatgagaaaaggaacttaatttgatgtggggctcagtgtagggagtgcgacctggcctgagtcaggctgcctggtgctggcaccggctgccggttctgccatgtcacttctcctgcctcagtctcccctctgtgaaatgttgcctcctggggacaagggagatgacatgcatgtgaagtgtggaacacaccccgggagggggcgagcatcacaactgttgctgccactgtgctgctgccgttctgaaaaagctgcagcaggagctttcagggtgcaggatcctgttaattttcttcatctctttaagcaactccaagtctgatgggttgacccactgaaaggggtttctggattattacacactgagggaccttatgaacatccctagagttcagttgtttaaataaaaatgaactttggtgccacgtgagccaggctccctagggaacctgcagggacaatcttgccttccactaagacccaggcacaaggcgggcctccgtttcttcagcgggagacatcaccaagtccccacctcagacaataagccgtgtccctgcgactgaaatctatattatgcatatttttataaaaatgcagctgaaaatgttagaaaagggcacagggagggagggaagcatgtcgagaagcagggactgccgttgccacaggcagacatgacttatttcatcttatgtgactatttactctgatattgaataaaaattgaatgtgttgctatagcaacagccacatcacacagcacctctcctgcctttaagtcacaggaaagtattgagaaggcatccgtgagccagcgcaacgtggaaacctgtgtgccattcacaattccaggaggaaaagatgttgtttcatgatgaactcctatttgtcaatacgtcaagtgcagttaattatatcgaaaatacatttttgtgtttttcttcacttttgagaaatagaaaaagagtgagaagagcagtaagcagcaagcaggctgatggggtgcagctgagcccaccacagtggggctgccccagggccactgaagtccttgtcacagagacaaacccacagcgggtctatcctggggccatcgaggtcttcgtcacagagccaagcccaccacggtggggctgtctgggccatcgaggtccttgtcacagatccaaacccacagtgggccagtcctggggccatcgaggtcctcgtcagctgagcccacccatgacgggcctgtcctggggccttcgaggtccttgtcacacagccaagcccacagcgggcctgtcctggggccatcgaagtcctcatcagctgagcccacccatgacaggcctgtcctggggcatttgaggtcctcaccacagagccaaaccagagaaggggctgctcctgacctctgacctcccaccaaccaaaggcttatctggggtcctcagatgggctgaatgcagagctgcctgggctgggctgatgcaaatattttaatgcaatttcatgcagatttccctttcagacgcaaattaggaatatttaccagtaaacaggcttttcttaggactgaggcacttttgcatttaggagaaaaccatctgtcaactaatgcatattagaataaaatagagtgacagtgcaggaaatgacaaaagatgcccactccccccagtacccacttcccccagtacccactcccccagtacccacttcctccagtacccgctccccccattacctgctgctgccagtacccactcgtcagtacccactccccccagtacccgcttcccccagtacccgctcccccagtacctgctcccagtacatggtcccccagtgcccactccattacccactctcccagtacatgcttcccccagtacccaacccccatacccactccccagtacccactcccccagtacccacttcccccagtacccgctcccccagtaactgctccattacctactccccccagtacccactccccaccatacccactcccccagtgcctgctcccccagtacctgctcccccagtactcgcttccccaagtacccactcccccagtacccgcttcacccagtacccgcttccccaatacctgctccacccagtatttgctccccccagtacctgctctccaccatacccactccccccagtactgccagagcccaccacatgcactgagtgggcaagagcccacacaggcaccaccgccccctgcctcccacccttggcagagcttcccatgtgctcttgggcttctggggtgagatgccacaggctccctgaaacgcacgctgtcttggggggtgtgagtgaatgtttctggagagacagaccctggtttttcttgggctcacggacggtctgagattgctggagtgttacaccccagtcactgcagcctggttctttaggctgagccggcactagggacaagccgtagcatgagatgtagggttcagtggtccccccaggcttctatccttggtgtgacccagcattaccatcaaacgcactgttaccttcgcaagctcagctcagtcaccttacccaaggaaccccgtgaactctgacacctcaggctttttagatccactgtccagagcctcaggagctgtgatctcttccttcagatactgctgaacccaccgctttcgctccattctgacaaacctacctctgaccacgtgagcttctcttcctcctgggagctgctcctccaagctcctgctccaggggccccgtcaggaacgtgtggccgtgctctctgccccaccagcccatcctgcgcccccccaccccccaacatccaatgccccttctcttgaatccccaaacacaggccctcatctaaaggccagcagtgattttaaacctttgtcatgtactggcctacgcgcagcaccatgccacgcagaatcttcacggatgtctgatgactttcgttactgtgagcgtttcccacagcaaccacggtcaatgggtgacgggggccgccatgtcccagatggtggctgctcccctcaggtccccacatttgctaatgtgtgtgtaaacgcctttcctttggttacatattttctctttatttaggttgtaaaaaatggtactaaaggtaaaatgagatagaactagacacacacattgttccaatatcaatctcctggttttgccataattggcttttataattacccagacgtaaccaccaggggaaaacctcactgggtaagggatacatgagacttctttgttataactttgcaattccctgtgaatctataatggtttcaaaataagaagtcagaaataatataaaaacttttggacaaaggaaaaaactcacttgcaattccactgagaaaaataaagtccaaagccccaactgacggaatgacctactcttgaccaagaggaccccagagaaaccttaaaactgagttgggaccgtgacaggatgaaggtcagacccgcctggttacccgcccccatcattaatcatcaccaggcttccttccctgggttcagacccgcctggttaccgcccccctctcaactaatcaccaccaggcttccttctctgagggctgaacagaaaccagcccttttaaaagactccattcctgatatccaccaagtgcctgaaactgctcttccttttatggtttcgacccaacaaccaatcagcattccctcctcataagagaccccattcacggagtgcctctggctagtctgtggaggctgcacagggagggccttcatgtcctcagcttcaccttttgatgcagaatgcctaactgtaatctgtttacatgttaagtctccatgccccagtgaacatgggatgcattttgcaaacattagctgaccatgcatgcccgtgtctccccttcacaaatattcacggctcctcccataacctgctgaatatgtatacttagccacccactcagcataaattcctgttccctttgcctctcactagaagtgcctgtttctggcttctggccggaggctacgcttcccagctggtcaggttggctgtcctgcaggatgcagctctttataaggaataaagctctcctttcccaattacgagcctcgtcattcttctgctgccaccatcaaccccataagagctgctctcttattcacctgttacgtacatgggcttctaacatctctgtgcacacacatgtttacacagctgcctttaagtttagagttctcaaaattttaaatgaaatcacagaatttgatttatttgattgttaatgatgagttaccttgctatagttttatattttaagtcagttttttttttttggtgaaggttttgtttttctgatttccttgctcgatggagtgtcttcttaggatacatttctcggagtttgattactgagccaaaggggaagagtttttgtttgttggtttgcagatgaccactgctgtcctgccttctaaagagttagactcattcaccctgcctaccatggagtgtacgtatatgagttttatcacatttggtctttatttataaaaccaaaactgttgttctcaagcaaccttcagtactaatcttaaaaataagacttcaggctgggcacggtggctcaggcttgtaatcccagcactttgggaggccaaggcaggcggatcatgaggtcaggacatcaaaaccatcctggctaacacggtgaaaccccgtctctactaaaaatacagaaaaattagctgaacatggtggcagaggcctgtagtcccagctactcgggaggctgaggcaggagaatggcgtgaacctgggaggcagagcttgcagtgagctgagattgcgccactgcactccagcctgggcgacagagcgagactgtgtctcaaacaacaacaacaaaataataggactttagacttaggatgtgattggaacatctacggatttctcaccccactgtagctctgacatttcacctgcccccagcaccacagggcctccggtctcacacaaatcattttggctggagagccctttgcaagtggtctgcttgccagctctccacctcacctgttggcatttcccaaatagcatttcttccagccaagagcctcatccatccacctggatccacctgaaacatttaatgtgcctgacaaaggcacggtcctgctgctgggcaccgcagagcaacaacagctgtcaccctgacaagcaggggcagctcctccccacctccccacctccccacctccttactccggctctcttcacctgtgggcaaaggcccccctctgtcccgtcctctcctgggtcacacctgggtgtgcagaaccaggcatctggtgaggcgggcaggaaatctgcatcttgacaagaccccagggagaaggtgcatggccatgtcgagccatcacagctgatatgttcctgctattgatttggccaaagtctgcattcaatgtccaggctcctcttggtaatccccaagcaaccgggtaggagctgtgtacagtagcaaacctctttgcacagacaggaaatgacagggtggaagtcagggggaaatgaagctggtttcgaacacatccgtcacccatctcagttctgcccactgcttgctccctgtgacaagtgctgagcatccccacaccccccgccccccaccccaggtaacaaacatcacacagcaaattcacattattcatggggcggattcccacagccccccaccccccatcccaggtaacacacacatcacacggcaaattcacattattcatggggtggattctcacacccccaccccccatcccaggtaacacatatcatggcaaattcacatttttcatggggtggatgcatgaccataggttcatagacttttaagggacttttgggatccacatattcttggctacagaatcctttcttggaacaaagtctcacccagaagcccagtgagcagcaggcaacagaagcctggaccttgctgagccggagtgtgagggtagcgtgagctgagcagggattcacacccaactgccttggagcccccagggctccttgaataaccatctgaagacctctgacctcatcccacactggacagagagaaggctccctcagcagagatggggggctctttgccacccagacagcccccagtctgagcagctcttcccctcagcttcttctcagattcctcttgttcacgctcctgagcctgcaggggctctgctgagactcagggtcggccacttctcactgacatgctgggcagggcacctctgtgtctatcacgacgcttagaagctagaacgctgggcaggggacctctgtgtctatcacgacgcttagaagctagaacgctgggcaggggacctctgtgtctatcacgatgcttagaagctagaacgctgggcaggggacctctctgctctatcatgatgctaagaagctagaacgcacccctaactctggacacaactgagaaggttggagccatggatctgcctttatccaaattatttttcttccaaacttttgagttttgctttttggtgattatcactttcctttggaaaaaaacatggctttattaatttgaataaaatgcaaatacttttcaagatatcagaaattagattttgaaatacatcaaaatgccacccatctatgaggggtgtgtatctgcactgtaatctgttcatttcctttaaattttgttttgagatatttccatttggcttaaaaggttttaattccactatctgtcatcacttgcattaaacgcaagcgcaggggagagatttagtaaatgctattagatttctgtaatcaaactctgctttatattccagagtcagggattagaagaattttaaatacattaaaaatcagaatcgtcaaattcaggcttaatactgaataaggcaattaaaattagaaaaaaaaatcattagctgttaaataatttatcaacttgtacccctttctcccattttcaccactgcaaatctactccaaatatataaacctcccgaaactacagcagtgaataaaacagacaaacccttccatcacagagctcccattccaggtgaagctggagatgcatccaggaataaggcccattgtttcctctgaaggcagaacccagccgtcacctgcattgctttctgcactcacttggggcaacaggagacacagatgctgggcttgagggccctctgggcacgatgtccgtggggtcaagagctcgagaagaaccatcttttgaaatgtaaaatggccacgtggagaaggataatgctccaggagctggtctccagcatttggtggaacgagaacaaagaaatgtctggagaaggccaggaagacaggcaggtcagggtgaatgagctccttgtggccagatcgtaaccagtgggtgaaataaacactctagcgtttggtaattttctgtcccagggatgacggagcctctgcccctgggaatggcaaggtccatcctctgctcgctcaggggccagagaggacacaggttggatgtggatggaagcagaggtgtggtgctgtgcaggtgagctcctgcctctgccctcagcccccacggtcccccgcagtctagggagaaccttccttcccacatatgagatgggtgggcatcaggagtgggcagaggccaattctttccagagttaaatagtccacttcacagataatctgagcagcaattcagatttccatgcattgaatcaatctacttcctagacagagcttcacaaggagcagtgatgccatttccattaagagataagaaaacctgacgggagaaacaggctgcggcaggaagatcaagagccctgcgtggcccactttaagtgtgaggctcctctacagatctcccaggagagaaaaggaggacacctgtggccatacacacctgttgctcggtgaatgggtcagggctggagacgtaggcttgggatcatcatcgaacagataacataaaaagccagggcccaggtgagttccccacaggagacagcaccggcagaaaggaggagggagccaggccctggagagtccaatctgtagaactcacggaggaggagctggtcgacttgaagggaacagagatggccgtcgcgcccagtgagagcagaaagcaatgcaggggacggctgggttctgccttcagaggaaacaatgggccttattcctcgatacacctccagcttcacctggaatgggagctcgtgatggaagggtttgtctgttttagtcactgctgtagtttcagttcttaaaacctgcctgacgcatataaatacctaggaatgaatgaacgaacagctcactaaactgaggctgagcagggaccctcgcacacgcacatcgaaatcccgcatgacgcatggcatcaactctgaggggcacaaagccgagagcacaggaagaaagtggatctccagactccaaaactgagaggagcaatcaaaaccgggcgtgactgggagctgctgctgaagtggctcctggacgtttggcatctttctgtggatccaagtgtgtggaagctgagagctggggtgtgagttcctgtggaagctgagagctggggtgtgagttcctgtggaagctgagagctggggtgtgagttcctgtggaagctgagagctggggtgtgagttcctgtggacgctgagagctggggtgtgagttcctgtggacgctgagagctggggtgtgagttcctgtggaagctgagagctggggtgtgagttcctgtggaagctgagagctggggtgtgagttcctgtggaagctgagagctggggtgtgagttcctgtggaagctgagagctggggtgtgagttcctgtggaagctgagagctggggtgtgagttcctatagtcacacgaggacagcccatgtggccttggggtggatggagatggggactccacatgaagcccaggaccttgaggacctgcctccctcaagattgaagcccaggaacagaccacctaccagctggggaagtggggagggggctgaaccccagatctgtgcatgtgccagagcacggtccacactttattgaatgaagcagaaactcccaggtgggcaattgacaggaaagtggatcggctgggacactgagggcagaacttcttatccagaaactctcacatagaaattcacacttcagtatcaccaatccctgctgagggtaagctcacaattctaaaaaaagacttcatcaaccacaaaagaggacccctcccccacaggagggggtcagcagatgtgatgagcaggagctgtagaaagcgaagactaggaaacggccagagggtctgaacgagaccataaaataagccagagggtctgaacaagaccataaaataagccagaggatctggacgagaccataaaataagccagaggatctggacgaaaccataaaataagccagagggtctggacgagaccataaaataagccagaggatctggacgagaccataaaataagccagaggatctggacgagaccataaaataagccagagggtctgaacgagtcaataaaataagccagagggtctgaacgagaccataaaataagccagaggatctggacgagaccataaaataagccagaggatctggacgagaccataaaataagtaggtttaaaatgattgaaaagataaaagaagatatcaaacacataatcaaagtagaaggcaaaataacagatttgataaattactaaataaaaatttttttctaagtgaaaaatacagtaaccaagagaaaagtacccagcatttgagttttacagcagattagacagaggaggaaggaacgtgggagacaatttcaggaaataatctgtcgtgtagcatcgagggagggagaggtgaaggcgcgacagagggtgctgagacagggtggatggaacaagaaggtccaaccctgcctaatcaaatgctgtggaggcgtcaggaccgtgatgggaatgagagtgaatgtttacgcgtgcccactcatccgcactctgccaccccagaaacctgcacacgacccagtggtgcgggtcctgggatgacccccatttgacaacacaggaagcagagtcacagggtgagcacagagactgcaggaggcccgcgtgaaagagatggcgaggggtagctctgcagagtcaagaaggggcctgagtgaaagggagcaccaagtatagcacaaaacccagaccccccgatccaagcagggagtgcctggacatcacaggtgcccaggggaggacgggaggagctgggaagatgaaacccagatcccccaatccaagcagggagtgcctggacatcacaggtgcccagcggaggacaggaggagctgggaagatgaaacccagatcccccaatccaagcagggagtgcctggacatcacaggtgcccagcagaggacaggaggagctgggaagatgaaacccagatcccctgatccaagcagggagtgcctggacattacaagtgcccagcagaggacaggaggagctgggaggctgaagccacagcgaccaggccctgtggctcctccagcgtgggaagagcagctctgtcctgaaagggtggccatggaggtgctgtcctccaggctcaggtgcgtgtgggaaggagctccgttgtgagtggggagccagggaggtgctgtcctccaggctcaggtgcgcgtgggaaggagctccgttgtgagtgggcagccggggaggtgctgtcccccatgctcacgtgtgcgtgggaaggagctccgttgtgagtgggcagccggggaggtgctgtcccccaggctcacgtgtgcgtgggaaggagctccgttgtgagtgggcagccggggaggtgctgtcccccaggctcacgtgtgcgtagacaacagcatctgaccttccatgcttaagaggcaacctgtggcaaggcacatggcagaagccacttgggctggagctgcccagtcagtggctccacctgtcaccatgtcctgcctcttttctggagtggccggagtccaggtttcaatgaggaaggtgtgtctggacaccaggcaccacacttgtcacctcccagatgaaccccagagtctcccattccccgtcccccacccttgcccctccagccctctcagggcagagcctccctcatgtccacaggacccacctccccacccaccacagccgcttctcacggggcctaaatattccacagtacagcagagggtcccagcctcgacgcgttctctgaccaggttacagagatggctctaacctgagtccatctagatttgtcccaaattcctggacaccattatccctctaggaatgacttagcaccaaccaccaccccacgtgatgagctcggaagggagaggaaagacaggaggacaccacagctccttgtacacgcaggagacgcacctccgacatcacatcttccacatgcaggagactcacggcccggtcacagccacccccggctgactccaccttgcaactacttggcccctccgcatcggtcactgcaccttccgtgggatgcaggtggctctcggcagcccccaagactcttggcttctttctcacccttcactgggtgctaaagagacagcaagctcccgggaaagaccagggcatcaccagctgcccaacacctcattcatccggcacgagccaggaaggcatcgagaaacaccaagaacaggagcacctgtccgggacgtgcacgccagtttccatcagtcgccggctgctctcctctcccacaccctgcccgtcatttaacccagacgcagccattttcaaagcccttcaggctattcttaagcaggctctgcatgggaagcgcaagaacctctgtttgggaagagcggccaattaagcagcttcttatttcaagagcccgagtctggggcctggtgaggacgagatttccccacagaagcagcttgtctttaagtggctccgcagagggcggctctgctgtgcagcgagcacactcataaataagcgctccttcacagttaattatctctaatggcgagcgctgtgaaacccgaaatctcgaacgcgggagcgcagattggcttcggtccacactgactgacgagtggccacacgccattcctcagaggaggcgcgtccgcgctctgtgtgcagttcattaagttgtcatgtcaggggacagcggccatcggcgcggtgcggggaggcgcctgcggctccagctgctggaggaggctggccgagcgcctctctgataccagcatggtaaggtttggacacacaggggcttgacagattttcagcgatattatggaagcattgcctctctgataccagcatggtaaggtttgcacacacaggggcttgatagattttcagtgatattatggaagcatttcctgttttatattgcctctcccaaatgtgcgtccttcgatattgaagatacaagtatgtcccactgagtcccaggaggaaagagtaatccctctagcccatattcattttcacacacttggcaactacaaaacagctgaagaaggaaggaagcacctattttctgaaggcttctccgttcttcttagccatgaatgctttttcttgtggggatactaaatcaggacttcaaaggccctaagacatcattgaactcgccaggcacgtttcgccaccgtttcccacccgcagaggatgctcctgctgcagcccactggtcctcccaggaaaacaggaccttggctgaattaacctgcaggtccagcctctgttctcacggtgttcgccagcacccagacagcactgcagatcgcagagcagacggcaccccttctgttactcaccgacccgactccggtttgaagaattttcagtccagaggtttcctccagtttgtctttgttgtcaactgttaggaaaaatcagaaagcacaagagtcaggttggagaggtcctcagtctccgggcacctctgagtattttcctccattgaaaatttcaattacatgactgcttgacccgcctaccttaatggaagggtcatgaacaggcacagaattagaacctgcacgaggccccattttcccactgacccagtgtgcgtccacctcgggccggcacaactgtgcgcttttggtttcatctagaaaggggtgtcccacccgggtccccaggactgctatgaatcactgatgagaaatatgtagagacattctgcaaactgcaacgtcttattttaaaattacgtaatcgtttctagctgtataattactgggaaatatgtttcattaaccagcattaggtgttgataaaagactccgtagaaggcaaagctgaatgtgtgtatttctgccatcagcaccgccagctattttgcagcctcttgttcatgccctgacaggaacatcctataataatttcgctccaataaaagcctcaccctggttttctcctgatgtagaatgaggaagactttcagagaatgaattgcactcgatggcaaaccaagggaaatgagctctggaaacaattagcagatggaaatgaaaccccagtaatcctagcaccaacacagcaaacccacctgccccacttcacagagaggacgggtgtcacaaggcaattgaccttggcttacgactctgtggaaatatgcgtttgcataaagcccttgtcactttggagatgaaaaccagaaaaaaatggaatttcactgcaaaccctatgaatgaagagtgccttgcaattgtgattaatacaggatgagatagcaggaaaatatcaattactctcaccccttattgtaacgcccctgtgttaatctggggtaatgaaattattcctttcggagagggacgcgatgagatcttgttacagcctgccctccctgctgttggggcctctccattgtcttatggaaagtttttccctttgagcaaatgcatactattttctacatataactaattacctactgcgctgaaagaacaagacagacagaaaacagtctgggctaaagcaaaactcctttaatactttatgatggggtagagccccaggggaggggaggacacaaatgtaagccttgggtggcaagagagctataaggccatcggtgctgctgtcctcccgcaaacagaggagacatctgacagattggcaagcttctctcaggagggtaatagtggactcttttaagcaggctgaggaacagaaagtgagtacaaatgcaaccttagaaccaccctggtcactgctgcagaacggtcaccgacgtcagggtcaggaatgaaaacggcagccccagcccatagtaatgagaaaaatccaatctgccggggagcgcccttttcctgtgaagggcaggtaacaactgggtcaggctcggcaggcccacggctctgtcgcagctactcagccctgccttgcagcgtggaggtagctgcagaccacgcctaagtggatggtcatggctgtgttccaacaaacctttatttacaacagcagacagtgggcctgacttgacctgcagactgtggttgccaagaggttgtctggctctagtccattctccacactgtgcccagggtgtcacgagcagtgagtctaagggtgtctgtccatccttgacctcaacatccagacctctggctccaaatccagacacttcggtggcccttcaaagcctttcaatggtgtcccctgcaggcatggagaacttgccttgctggccctgaggtccaggtggcactccttgcccagatattgggcttttcagcacatttcaggcattctccgtcccctgccaggatgctctgagctcctcagtctgacgaaaacgcagtcctcctcccaggaagctcaggccctacatgtgctcaggggcaccccctccctcaacatcctcagcacggccctctgtgtctcacagttcatggtgtgcaggctgcctgtcccctgcataacagaattgtaaattatggcactgggtaatttctgctctgtgtaaatgctcccatcacagttgactttagtgctcatgtgacactactaaagggaatggggagagatactgtcttagtccatttgtgttgctgtaaaggaacacccaaagctgggcaatttacaaggaaaagaggtttatttggctcacagtcctgcaggctgcacaagaagcatggcacaggtgtctgcatctgaggatgccccaggctgcttccacttgcagtggaaggtgaagggagccatgcagtgtgcagagctcacatggggagagaggaagcaggagagggcggagggagggccaggctcttgttaacaatcagctctcacaggagttaagagagcgagaagtcgctcacctccaccctgggagggcatgaatccattcacgagggatctgccccgccccatctgtccctcccccacatccaaagccctcccaccaggctgcacctccaacatggggaccaaatttcaacatgaggcatggcggggccgaaccaaccagatgcagagtcacacatggggaccgaatttcaacatgaggcatggcggggccgaaccaaccagatacagagttgcaggcgtgcggggaagagttcccaccatgcagacgtggaggacagaaataatctcaagggtgccgatgacagtaaaatgtagaaaaccagttataaaatggtgagctttagtatggatcgcctctgctcttaacatagtttatttaagtgcatgtttttatcattcaatgtttcacaatggctgtactgaataatgggctcacaaaattcctgagaaagtaaaattagttctactgagtggatgcaaactgtcccctgtgctggcacagtgctttgtttacacccgaagtggggccttcccgtccgtgtttcctgggtcctgaggtggggccttcccgtccgtgtttcctgggtcctgaggcggggccttcccgtccgtgtttcctgggtcctgaggcggggcctccccgtccgtgtttccttggttctgaagtgggaccttcccgtccgtgtttcctgggtcctgaggcggggccttcccgtccgtgtttcctgggtcctgaggcggggccttcccgtccgtgtttcctgggtcctgaggcggggccttcccgtccgtgtttccttggttctgaagtgggaccttcctgtccgtgtttccttggttctggagtgcacacttcccccagctgaagtggggtcgcagcacgggccagcacggtagtgactaggcaactcccgccaccctgaattggcagtgcagcaaggtgcatccttggaggccttggggagggaatgagtccttgtttgtacttaagcactttccactgggcctcctgtgaggccaggaacgcgctgcagcagaacttccggaaagggcgtcagctgcggccaatagtgactcagaggatgatcttgttggctgcagtggaacactcatgagaagtgtggtgccgccaaccctgcagtggcctggagagcacgtggggaccagccccgcggtggcctggagagtacgtggaaatcaacctcaccgtggcctcaagagcacgtggggaccagccccgcggtggcctggagagcacgtggggaccagccccgcggtggcctggagagtacgtggaaatcaacctcaccgtggcctcaagagcacgtggggaccagccccgtggtggcctggagagcacgtggggaccagccccgcggtggtctggagagtacgtggaaatcaacctcaccgtggcctcaagagcacgtggggaccagcattgtgctgtggaggcactcagtggaggggttccgagtgtgacgcgcgtcaggattctttaacccattgatcactaaaactccttttagatgccgatgcgagagtgaggctgataaacgagtctgagagagtttgttcaataaatacaagatcatctgaggtgattccaaagcacgtgctgtggttcaacggcaccgtctctgctcttcagtggacctgagctgagaaatggcttccaagtcagtgaaacaggcatcgtggtgagctcctagcagagctgcctcccaagctgattgtgagcctctccaggacaggcaaggttcttcagggtctatgactgcactttgatgcttaggggcctgtgttctttcttcaacaaatacatccacgttgctgcaaaggacacaatttggggccaccatcctaagcaaattaacgcaaaagcagaaagccacacgctgccacacactctcacacggaagcaggaaccagacatcatcagagagccacacgctgccacacactctcgcacggaagtgggaactacactcatcagagaaccacatgcgctcacatggaagtggggaccagacatcgggtacttacagccatagagatgggaacaacagacacgtaagagggaatgtgagagggaatgtgagagggaggtgggagaaaagggctgaaactccctctgggggacgtgctcactacctgcaagacgggagcaagcaagacggtaccccaaacctcagcatcaccagtatgcccaggtcacaagtgtaccccaaacctcagcaccaccagtatacccaggtcacaagcctgcacatgtactcccagattctaaaataaaagctgaaaattaaaaatacggataagtgaacagatgtgccaccgacaaccctcccacatgccccacggtgctgcctctcgaaactgactggaccttttaaaatgtagttcagtcggtttaaatcagcgattgaagcaaacaacctgaattagtgtttggttttttctttttccttttttttttttatactaaaaggttttaagagagtacaagggacagtttcattctcgagctaatctgagactgcagtgtaagtcaaaatcgaagtcacagagtaaaataattgaaaagtaatgaagctggcagtggctacattcctgccacacaccaagtgccggcgcaagcgcttcccacacttcaatccgtctccccatccaggctgtggatttccatgcacgcttcacaagcagctgtgaggaccacgtgggagcctctgagccagcatggcccaggtctcagcacacagcaagcgactaatccatgtgccctcgtgacagcggctgttttgctgcatgtctcatggccgggccactgtcacttcctaaggagaaagtgctgtatctgctgcgtgtctgagactccagtgtgctctggtctcttatgctattaactcgccgatcagtgcttctgcttgtgttttgaacatcaaacatcagctgaagcatcgctcaacgactttgctctgggtgactcagctatcaaggtcttcctcccacagtggaattgctgtgtgccccactaacagcacccacagcaataggataaaggtcaccaggattctcctgatttcttgtttcccaagatagggtctcttccttcccccacaggccggttccttcacaggaggagtcaggggctccgcaggccgcttctcagagcccatatgctcccggtgtcactgctcccctcccgtggccctgcacagggtctgctgagtgatgccctccagcactgtgctgggcactgacatccaacctgccagctcacgtcaagaaactccaccatcctctggaaagcccgacagtgccctgagcaggtgccggggagtctcacaaagcacagaatccgggtcccggagtccccagagtccagcttcttgccagggaaatctctttggagattgctgagtgcttttcgggggcgtctacgcgttcccttggcgctgtggaacgagccagtgtctgtggggcgtcagctgacttcacgcggccctgtgttccggccgctttcagcgatgcctgtccttgctagttcactttctggctttgagatttctcactggcagagagaatcgaaacacagagaggcccgcacctccctcctcctgcatcgcgaacgctgcacaagggcagcctccagggcacaagggcagcctccgcagcacagccctgcggtttgttgcttcagatttttttttaacctcaaatatgcctaaaaggaaaaacaatgcctcgtggtccccggcatcctgtgggtctcagggcacccccgacacctcccgacattattcctgcacccttgatgctccgccggatttctctaaatggccgcgtggattcccttttccacactgttggtggaattgtgacaggtgctgagctctgatcctgacacgtctgcactggggagcccgccgtcctctcgcgggacttttgcccacacctgtgtaactgaggactcacacctactccttttaagtctaaagtaaatacctgctgattctcagtgtccttttgttcctttttatgaactccatgacaatactgccaatttttaagtctctgctgaacatgttgaaggaggaaaagaagaaaaagcctgcttcagccagatgtccatcaaatgccaggtctgagttatgttttgagccaagctctgggcctcccaagtctgtcaggccagggcgtggagacagttggagaagctgccttaataaaggcacagaataacagagaaagcccgtttttatcttcatgggagacaaaaagggtttccaaacacaaaaaagaagtcctttaaaattaaattcactagatgaaggatatgcaaattacctgaagaagcggaaccctataatgttctcaaaattctgcaatagcctatttaattagtattttaatttatcagactaattctttgcacttgacaatttatgcagcattccatataattaagcaggcagctacagtggaataattttgcctactctctttatcctcgttattttaacctgaaagaatgtgcagaagtctcttctgtaatctaaattacaatggggatcacttaatggctttgctccattagaaggtgggaggggagggagagcacccaggcccggggtgaagctgtcacctggagcctggccagctttctggacggcaccactggcttccttaggaaggatcctcctcccttatggggtggagcctggtttctggccgagctgaaacgacgtcccctagggtaagacctgcatcctgtgcctcacagccaccgtaaacaagctgcctcaacgctgccactttccacccagggcccccgtgcagggggtcagcatctccgggtaatttggggacctctgtggactctgcccctgccctgaggtcagccttcctgaaactggaagccactggtcaggattccccgtgcatgtcagcaaggtgcccagccgagggctttccttaaagcggaagtcattcctgggaagaggaaggggaaagagctttgaaggaagttgattcagtgattggagctctggtcccaaccggcacctcctttcctttttgggcatcccagggtggccacagagccactgggagtgcagaggcctcctgggcccaggcgagctgccgtgtcgccgactaacatgaggcccacctggtcgcagggctgatcacaattcctgtaaaggaatcttttaaaaattagcaatgtccatactttcctatttcagcccattctctttccccatgtcgttttctgaaaagaactctagcagggccatacgtgaggcccatgaggggccccaccttccctcggagtggacaatcccggactgggctctcccagtggtaataggtattctatgaaaaaatggggtctttattcatacaaggttaagaaatagcctgccagtcactcaggccaaacctaaaactcctaaaaaaaaaaaggtttaaacattgcaaaccttcttaaagcttctcactcactactgtgcactgtgagcctttcactcaccctctgggcgctggggcacacgctgttctcccaggaccacgggcggtgtggaggatgggctaggggctgagggagaccttagggaggggcagggtaggaaggacccacgtgtcctgagcccctctagactgggggctcgccagggtctgaagcttcctggagaaggccctgctctaagcttctttggttctgggacctctaacatgtcttaacatcaaacacgtgcagtgacacttcagtcttcatttcagaaccaaagactctcactcagcaaatcctgagatcccgagatcctgacaccctgacacctgttggaaaggtttggaagcagccatggaagctgtcaccagtgttttatgctcagatctgtgctgatgtcacactttggacagccaagggggcgggaagatgaagcataaaaccaccttcaaggtgggtgtggtggcatctggggtaccccgtgaccgagcagtgtggcccgagggtgagaacgtgggctcggagaggaccaggccacagctctgtgcggccactggccagctgggcaccacgggaacatttacccctgtgtgtggtgtgtcctgcgtggcagtatctccttgtcccgtgtgtggggtgtcccgggcggtggtgtctccctgtcccctgcgtgtggggtgtcccgggtggcagtatctccctgtcccctgcatgtggggtgtcccgggtggcagtatctccttgtcctctgcgtgtggggtgtcccgggtggcagtatctccctgtcccctgcgtgtggggtgtcctgggtggcagtatctccctgtcccttgcgtgtggggtgtcctgggtggcagtatctccctgtctcctgtgtgtgaggtgtcccgggtggcagtatctccctgtcccctgcatgtggggtgtcctgggggtggcagtatctccctgtcccctgcgtgtggggtgtcctgggggtggcagtatctccctgtcccttgcgtgtggggtgtcctgggtggcagtatctccctgtccgctgcgtgtggggtgtcccgggctgggcctcaggcttctcttttccaccctcttctgcccccatgtgctgtgttcagtcctcaggccctgactggcatctgttcactgatcagagccattttctttcctccagccccatcctttctgtggatctgatatcccacctgtcttcttgccacttccactaggacgtccaatggtgtctccacccaaattcctgacctcaccgacttccccaagcctgtctgtcccccgtgaccccagcctgccaggagctcaggcccacagccgcagagccgcctttattctcctcggacacagcacagcgcgcctggtgaggctgcaggttctggcctcagggtgcacatgggaccggccggcgtctccgcgtggccaggtgcgtccagcatctcattctctgctctggatcttgcagagaccccaactgcgctgcctggctcttccatccatggtgccgggcccggcctgggaggggctgcacaggccgagccgcagcatgatgtcccctgcgcccagcacttctgccatgcgagccttgaaagggcctccacccctgcagcctgcattctgtggaagccacgtgttgcgtgaggcctttcatgcctgggagagggaggtttgaagagcagaagcacttaggcaggagaaaagacaaattaatgaacgtgtcaaatcctgctgttcaggttacagaaaagccaatgatttctgcataaagaagtatccgttcctggcagtgccaggtgcccactcttgcgtttctttgcacgtcggctcacagctctagaagtactcacggacaaatgtggaggcgccccgcagcaccccacaatccctttcacttttccacgtctgtcgagacaggacatgcatgactcacgcaaccagctcatgacatcagcaactgcagggatctcagagccagaattgcaaatgtcttattcttacaaaaatatggactacaatttgattaaattgtcacaaaatacaatttaaaatacagctctatttaaatacttttgattgaaaattttgatattttgtgaattatatttggctttagaattttaataattcacattaaatctttttgaagaaaaatagcttttgaagcatagttttagtttacaattttaagtgcatttttatttttaatgaaaatacttctacatcttgtaccctgtgtgcaattacagttgaatcatttctgtctaaaacaccccaactttatgaagatcgtcattaaacaatctaattagtgacttcatgaaacaaggggaataaaatgcatttacaaataaatatacaataatttacaaaattatgtatgtcattaatttattactcagccaaaccttaccagcccatcgagagaacatcactactcacaggattataatccaatccactgtctttttcattggattaattttcagaaataaaaacaatagctttatgcacatttgaataatttttttcactatgaacatatatttttcaaagtatgaagcatttttttagcggctaatgagcttcacatagacttttaaatgtccagaagcccagcatggaatgccacttgccctctggccttgggcccctcgacagctggacaggggctgactctatacactgggggggggaggatgctggccactcaacacacactcaagcctctcctcaaagccctgcgctggcgcatctcacccacagtgaggtctacagtccaggccacagacacaaggcccttcagaacctggcccttggctgctgccctgacatcacctccaacagccccctcgcccctgctcagccccttcagcgcgggacgccccggccagctcctgcctcagggcctttgtacctgctgtttgttcctgaccctcaaatgcctgcctgcagccatctgcatggtcctcctgttctcacccaacatcgggccctcatcccatcacctgtctgtgccctcatccagcttcattctttcccaaaacatttatcaccctctgacatgatgcatgcttggttattatctattttttctctagaatatcagttccacaaagcgaggatttgccctagtgcttagaacactgtccagcacattagaggacctcaacgattatctgttgagggaatgaataagtgacttataggaagcatgagcaaattaactccctagtggcagcgttaaagcattactatctctaggatgatcatgccaccactgttacctctattactaagaccagtggtggcactcactagtggtgcagggagggagtttcctataccttccacacccacagttctagttttgaactaaagagccaacgataaaaggatatctgaggattcctgatttgcagtctcatgattctcttccaataccggctgccagccatgagcacgggtgcaggatcacgcatgtacgccgtgggaatgcgtgcaggatcacgcacgtacaccgtgggaacgggcgcaggatcacgcacgtacaccgtgggaacgggtgcaggaccacgcacgtacgccggatcacgcacgtacgccgtggggacgggtccaggatcacgcacgtacgccgtgggaacgggtccaggatcaggcacgtacgccggatcacgcacgtacgccgtggggacgggtccaggatcacgcacgtacgccgtgggaacgggtccaggatcaggcacgtacgccggatcacgcacgtacgccgtggggacgggtccaggatcacgcatgtacgccgtgggaacgggtccaggatcacgcacgtacgccgtaggaacgggcgcagaatcacacacgtacaccgttctgcacagctggcggacgcttcctctttcccacatggtgtggtgtaacctgatcgtttgtatgcaaagcaaacccatgcacagctgactgtgtcaaaacacagccagaaagatgccatgcggcagggcacgtgtgtgtgtgtgtgtgtgcgagcgcgcgtgcgcccctgcgatcagcccagcagacagagcacgttcctgtaacgtgttgtgatccactgcgcggcaacaacacaaaacacaagaaaatgttttgatgttaatcattttacatcaagtcatctgaaagtagcatgttgccccaatgtttggatgtttaattttgctaactgtcagaaggaattaaaataaccctggaacataactgctttcctgacaattatttactaaaaccagagatgccatttaaagcttaattcccagagagggagaagagaaggggggtgcccttgcctgtgcctgtgctggaagtgggctgttcatcatctctcttttcttctttggcggtgaggccaaaggcactgtggcacagcaagccaagaagaggctatccatgaagatcggtctccgtgctatcgtgaacgggggctgatgcctgaccacccgaaggaagagaggaggcaagatgctgtgcccacaagacccaccccatggagaaacgtctgcatggtgactgggcttgcaatgcggtgatctccaggatgaaaagatgcccccttagagatttaccacgatgcaaagacgctcatttctacctgaacagccagggtcccatcctgcttagtatagaaatagcaaagacgtttagggagataaactagatgtgcacctactgacatgtgtataacgttcagtgttttattaaacatgtatatatcacgggctcctggaaatgattcctctcaccaactcagatgactttctcttgaaagttagaagttttggggttaatttgtaattcaaaaatattaatattttatatttatattccattaaatattaggaagataccaaagaatattataaaatatgtgttggttccaaagaataataagacagcaaacatccaggatacctgacactctgaaaagagataaaacattaaaattatctttgatactctctgtgagctcttctcggtcctatcaaagctaataactttcatgaattctgggtgcatagtttctgtatgtagactttttttttcacctatgtgtgtatccctaaacaaaatactgcataagatgacataataacatacacgttctgtgatgtgccttccgtcttctgctaaccctgtgttctgagactcagattcggttttgcatgtcatggtggctcatgcattttcattgctgtgtgactgcattctatacacatggagcatcacgctttatttttccaatcacttacccagtccggtgggaaactgggttcttatttttccctccatatctgaaacagtatagccatgaaccttctcacacgtgtctccaggcccatgtagagaattttctccagtacaatcactaagacatagatgtcccaaagggattctatcaatttacactcctgtcaccaacacacagagttcctagtgctccgtgtgctcattggtttaagctttaaacactttgccgatttggtagatttacgttgtatctccttgggcttccaatgtgcatgtctttgataattcatcagtttgtgcatcttcgtgtatgtttattcatcattcatgcttcctcttacatgaaatttttgttttgcccatttttctactgggttatttgtctttttcttactgctttgtagaagttcttcaaacattctggataccaaaactttgtcagttatgtgggctgcaactatcatatctcagtttgtggcttggcttcttaaagttcctggttttaatacagtctaatttatcattttctttaaggtttgcatttctggcatcttgtttaaaaaattctcctttagctcaagatctaaagatatctatataaagatatctatataaagatacaactctgtttttttcctaaaagatttttgtccttcacatgtaagtctgatattgaagaactgatttttgtatgtgattcaaggtagaggtcatttcatttttttctcattgaataccccatttccccatcaaagtttcttgtaaaggccatccttcccactgatctgtaatgtcaaccctgttatcaatcagttctatttaagggtctactcctgggttccctctgttcctggcccaggtgtctctccgtgcacagatccatgtgatctttcttactttagtgtaagtagtttatgctgtctacacacgaaggcaggtgttggctctttgtacttatacattttggaatcagcttgtcacgtttgtaaatgaatagtttttggatttttgttaaaattttattgaatctagaagtttgattgttattaatagcatcattattcccaatctgtgaacatgtaaatctctccatttattgtcttcaacatcttttaagttttatatttttccccataaaagtcttatatatttaacatatgtatatattcccgggactttaaattttgatgctattttaaatgagtatcatttttaaacagcattttctaactttttttcctaaatatacaaatacagctgacttttgcatgatttcatatacagcacccttcctaaactatctaattccattagtttacctggatcttcttctgtctcttctgagtaaataatgaggccgtctgtgaataatgacaggcttgctccttctctcctaagtgcaccctttatctctccttcctgcttcactgcctgctgaacggatcctcctacaaatgcttgtaagggtgagagcccacatccctgtcttatttctggtgttcaagagaatatttccagtgttttgctgggaagcatgatgtttctgtagggtctttaaaaaatcaaaataagaacaaactagtcttactttattcaacatttttattatgaatgaatgttaatatttagcaaatgtttttacctgtatctattgagataataatttttttctcttttcattaatgtgatagactacattaattacagctttaattgctcatgacattttttaaaaataaattgctggattttaatttgctattatttggcttttacacctatgtttttgaggaaatttctctctaattgtcattccctgtactgtaattactgagttttggtatcaagtttatgctaacctcatgagctgtgtagtctgggatgttttgtgtatgagtgcatgtgtttggatgtatggaataacttgcttataaaatatgtgggcctgatattttctttgtgggaagacttttaactattaactcaagttcttccttggctacagggctattggagtttttcattctggtattttggtcatgttatctaacatttcaaatatatggccataaattgttcatgatgaccccttgttattcttttatatgccaaagcatctatattagcattccaattttaattctcaatattgtttatgattccctcctctcttttttaaaatcacttatgacaaaggaggtttctcaattttgtaagctttttttaaaaagacaaaaaattttgctttttaaacaaacagagagattctctgtctttgagattctccaacttcactgtcaggaatcgaggtgtagagcctttttcactccataggcttctggaatctgagtactggtgtcttacatcagtggtggaaatttttctgccactgtatcttcaaatattacttctggagtgctctgctggaatgcttatgaaccatatgtaagattccaactctgccagaatacttatgaatcgtaggtaatattctaactctgctggaacactcatggatcatgtgtaagatgtgtaagatgatcctcgatggtgatagagtgtgcctcttccccggcaatggctttcccaataaagttggctctcaatgtagctaccttttttttttttaaattagtatttccttaggaactccataggcttctggaatgcttatgaaccgtgtgtaagagtcttctactctgctggaacacttatgaatcgtgtgtaagagttgcctaatctgctaaaatgcttatgaactgcatttaagatcctcctactctactgcaagacttatgcattgtaggtaagattctcctactctgccctctatggctcctacccttactttcatattttcaatttatttgtctctgtgggctgcgttttagaaaatttcttagttctatactttacttctctaattctctcttcaactatatctaatctgctattaaactcatacccttagtttagaatttctattattatatctttcattaaaatatatttcttcaaaaattgtggtctcttttaagactattgatctgtaggttatatttagcttcctcctatgttcctttaatcatattaaaatatttaaatttatgatctatgtccaatagttacaatatctgaggctttcttttgttgtccattctttcaattaacttttgtcctgttacctggtatgttttaaaattttttattgtggactcaaatttcttggaattttacttgcaggtattctttatgagtagaaggggaaagaaaggattcctccagagaggatctgcctttccctctgccaggcatctggaggcccgtgcacctgggagcgtttgaagctgaattccctgcttgagatgttgtggctgtccaggcagcatgcagtgggattgtacatccctgtgaagcttggctgtggttaatgtcctaagggaaaatgccacccccccacccccgccttccccgccacacacacacacatccaggaacagcgctgaacgcaagcagtttaccatcctccagcccaatggagagctgagaagacactctatcatcggtcaccattaccctgcagtcatggttcttgggggtcccagctccatgtggcatgtcttctattagccttaccatatcaggatttcctagtgcctcctgccctctatagaccacaagatcatgaatgctgaagttcaggtttacccggtgtggagaagattctcagaataaaggccaacatcagtcatccactgatgtccccgggttcctgctctcacttggcttgggatctccaataatttaattattgccagatgtctgatgtgttaaaattatctctatgtcctcatattctcgtagttttgtttttggaatgagggtgagtcccaatatttgtttcttccagcgtaccagcagaaatgggaactcccacatctcctaagaaatctctgccccgccccagctgctttgtgcttatgaagtaaaactcattttaattcaggtttgggcaaaacctcaggggaggctaaatatgaaataatctaatgattttatattatgctaaatataactaaacacagatgtgtatataaaattgctaattattcagtgttttatggaatctgccgtgactcttgctgggactgtgaactagaaatggcaacgacaccttttctttgtgtggtgctgcgtgtggacgctggtctctcctcggccccagtccacgctttccccaggttcttcatctctaaccctcctggcagcagtgctgggtcagagggtctcaccccaaatggtcccaggctcctgtgcagggcctggtggttatggtcccagatgggcggctggagcctctgggaggtgttggcccagggctactcagttcaaaatgggggctctgggaaggagagccaggtctctcgagcttgaggtggctcctcatggactgtgaaggggtgcatgttttaacacaacaaactgctctcctctaattacctgtaatccataagacagtgtgaggacagttctgggagcaggtgagttcgagaagcaccaagacgcatcatttgcctgtcctgtgtgtggtctaagaggtgcctggtgcttcactgcagagcacgcagctccttgctccagccacctgcaccacaagcactgcttctgatgtcataagcgtggcctcgaggagatgcttaggagcccccaggccagtgcacgtcccctccccggctgaaggtccccaccatggcaggggctggccacgcaccccggccactccgggacacgtccaacacacgtccccctccccagctgaaggtccccaccatggcaggggctggccacgcaccccggccactccaggacacgtccaacacacatctccctccccagctgaaggtccccaccatggcaggggctggccacgcaccccggccactccgggacacgtccaacacacgtccccctccccagctgaaggtccccaccatggcaggggctggccacgcaccccggccactccgggacacgtccaatacacgtccccctccccagctgaaggtccccaccatggcaggggctggccatgcaccccggccactccaggacacgtccaacacacgtcctcctccctggctgaaggtccccaccacggcaggggctggccacgcaccccggccactccaggacaggctgccgcagctggggagcttctggttccccttctttgctgttgcaaaccgctctctctcattttaaaatgtcctgtatgaagcgaaggcactgaacacactccagcctgcaacgcagaagtgcacattggcgtggagcatttgaaaggcattttctccttggaaactgaaaggtcaatttgtcaaactccactcctcagggttccaagaaaggttcttcagcccttgttttccagccataacagggtaaataaatgagactctcatctgcgggtctcctgtggattctgccggggggcggggcttcggtggaaagggagcatggctgcgcagtaataatagcggcaggctgggaaaagctaatgtcagctccaatttccaagtcatttttcaaattattttaattagatattgtttcaatctcacttacattaatttaatatctgatatcaacatttcagttttcaattgttcaaatgattttttttcagtctgcctggttgcctggagtaatttaaaatacaatgtttatcttcagcaattttcaacgcgtggtcctggacaaactgctatgttcaataaaagtgacaaggaagggacggccccaggtcctgcgtggcgacgaggaaaaatggaaattgtctccttattgttcatctctagacatcagagtcagcaggccgagctggggctggggctgggataataagattttccacccatttcacgatgtaattggctttcccaacgcaaatttcagtgaaatttgactaagatttttttgtattaaaaggcatctgaataaatggccacattcccccatctacacattttctgagaattttcagtcacagccctcaaacctacccctaaaagattcttcctggacgcactgccacaaatagccttaggttctgcgttttcttagtttgtccttttcttcagacattagcacggatgctggtaaagacgtgccttctgaaatggtaaatgtaaagctgaaccaggccttcacctccccgtttataaaatgtgggagaaatgaggtatcctgaagtgttcttctaagacaaggaaattagtattgttcttgaagttgataatgagaaatctgaagatccttactgcttttgaaaagtgtgaagaacttaaaacaaattacctgggaacaacataaaaccaaactataacatcatccacatggcaacaggtaaaccatcgaaggaacaggagggaagctgaggagctggaaggcgtgggccggtgtgattaacgagaaacacacacagtgaggacgacgcgtgggagcaggggaagtcatcttcctaggacaggtgccttcactcgcatcaaactactcattatctacaagcaacatatcgaaaacaacgccgtccagaaagattacaaactgacgcggccgggaaaatctatcagacatacgaatggaaggagagaaggcgtcatggcgtcgacaccaagaaaatgtgcaatttgtttaaaagttattgattaaagtggaataaatagactaatgttagattagattataaaattccagacaacgatatagggttaatgaactggtgtgtgccaagaaataaacatcgaaattaataaggaagaagtgatcacagtacaaagagatgccactcgcagcctgagggacggaagggcctgacggcggccatcctccaccagccacgttccggggctgcgcttggcactttaactgcacccggcactaacccccacaacagccacctgaggtgcggactttaaatgcccccatcttattgataaagaggactgagttttccagggggttaagcaacttacctaaagtcacagggctagtaaaacacagagccttattagaaacaagtctccctagctcccacaagggtcctacagcgggcccgagaacatgacaaagagaattcaatagcgactgatcaagctctatggtctagaaaccagaatggaaccgatcagatattaagcctcaaaaaaggacttcatgttttttaaatcataaaaatcataaatgttgcattctctaagcaaaatctaataaattagaaattaataaacacagaaaacaaaactctctcatcatttgggtattaaaaatattattttcaataattcttaggttaagaaggaaatggaaactaaattacaaaatagttagagaataataaaggctgtgggagataccgaaatgattccccggaggtgggtttcgaatactgagagcttccatgatgataagagagaaggacagtaaacaaagtaggcactccatttatgacgtcaaagtaaataggtaacaaaaaacttgagggaagaaattaagtaataaaaatataaattaaactataaaagggaatacaggattggtgaataaacccaagagcttgattttaggggaaaaaatcataaactcttagaggtaatcaagaaaagtaaaacacctcaaattctaaaattatcaaaaattaataattaggaggacacataatcacagatgcagtggaaatttaagacttataagcccttaagaccatttatatatctatttatagtcatgcaccacgtactaacgttttggtcagtgatgaaccacatacacccacaagtggtggtcccataagagtatgacggagctgacaaattcctgtcaccttgcgacgtcacagccatcgtaaagccacagtgcaaagcattaccttttctatgtgcaaatgatacacaaatgcctaccgctgtgttacacctgcctacagtattagtatagtaacatgttgtgcaggtttgtagcctagcagcgctgtcccatacaacctgggtgtgtaggaggctgtagcatctacaggttttgtaagtgcaccctgtgatgctcgcacaacgacgaaattgccagatgaaacatttatctgaaggcagcctcgtcattaagcaacgcatcgctgtctaagaatttggaactccaagaaattgaactatgaacaaagaaaataaaaattactaacctggctaagaatgaagaaagaaatattaatagatgaatatgaaaatacaaaacgtttttcaaagaaacttccttccagaaaagcacaaggccctaagtgtgactggaaagttctctcaaaactttgaggaataaaagattctcaagtcagcacctcccaggagcgccagcaccaagcgcagttcacagtttacaaggacacgcttggcaatccattggtgggtctgaggatacagcaaaggctctgagcctacaccaaggccccccatgttgtctgaacgtcctgcctgcttcttcttttgaacatgaagttctagccagcgaggacaaatgctgagatgtttgagacttcccaaaccacttgtgttttatcaatacattttataagccaaaagttaagagtcagccgcacaaacagagctgcccaatccttggcaaagcagcaagggaactcaatggggaagggaccagcttttcagcagatggtgctggaccaatgggatactcacatgcaaaaagtgaatccagacatcaaccctataccctccacagaaattaatgcaaagttagatgtaaaatgccaaactatacaacttctagaagatacaaagaaaatctaggtgaccttgggtttggtgatgactttttagagatacaacaccaaaagcacagttcatgaaaaaaacaactgataggcaggacttcatgaaaattaaaaactgaatatattattagtatatgacccagcagtcatgccctttggtatttgctaaatagagttgaaaacttatgtccatacaaaaatatgcacatggatgtttattgcagcttagttcataattgcccaaacttggaagcaaccatgatgtccttcagtagatgaatggatcaaccgtggtgtatccatataataggatatcattcagggctaaaacggaatgagccgtcaaaccatgacacagggcttgcaggaaccttaaatgcctcttgctaagtgaaagaagccatcctggaaaggctacacactgcatgattccaacgctaagacgttctggaaaagaacaaaggatggagacagtgtaagttgtggtggaggtaatgaggagttgggggaagagagaggtaccagcagagcacagaggctttcatgacagggaaaccactctgtttgatgctatgatgatggatacgtgtcatcatacacttgcccaaacccacagaatgtaccatcctgctgtggctcaaatatggtttataccatctgaaactcatgctgaaatttgattaccattgtggcagtgttggaggtggggcctttaagaggtgattaggtcattaagagggactgatggtttcttgcaggagtgtgataattcttgtgggagtgggctgccgcaggcagggagggctgctgtaaggcgagcccagcccctcatgcttgtcgtctcattatacatgctcattggcccttcttccagggcatggcgcagtaagaaagcccttgtcagagctgctgccatgccctcggacttcccagcctccacaactgtgagctaaataaacttcttttcttataaactaccctgtctcaggaattttattatagcaacaaaaatccacctaagagaacagcaggagtgaaccctgatgtaaaccatggaatgaatgtgggctcatcaactgtgacaaacagaccatcctaatacagatgggagcaatggagagacggggcgtggagtggaaggcagggcacgtgggaaccctctggactgtctgctctatttttctgtaaatgtaaaactgcactaaacataaaatctactaaacacaagtcacaaacaaaggttaaaagttgcttgtttttatttgaagtgcagatgtccctggttagatgttcaaataccttaaaaactgtaggtaaagggcattctccatgtgtacaaagattattactgcagtgaaactttcaggagaattttgaagagagatgattattttctgactctactgaccaggattctgttcaacatcttcatacgggatttttggtttttaaatactgggtgacggggccaaggagtggtgacttgcagaaggaagtctttcctgggcgatggggccagcactgcatcctgacttggaacagagtgcgtggaaagggaaatgggggtctgggtctcagtcctgcagtcctgcagtcctacagtgggtgagaccacacctgcggcaaagctggaattgcactgaaattggaattgaattgaaaattatgcagaattggaattgcattgaaaattatggatggaaaacaagagcaaacttaccactgctaagtgctgatttaaacaagataaatgttctctttagttggacacaaactagcaagaatgactttgttcccatgggtttctcaatataagctccttttgctgggaaggaaaaagggcatctgcagtaaggttggttcttttccttccacatcaccagcggcaatcgtctttattattcattagcaagctcgatgtcacggcacgctgcggcaccgctgaaaccagcctgagttgggaaaatactttcaatatttcaactgactgctttctaagtcacaaataacacagctaatcctgaggtcactcgcttacaaaaacctatttgctgtgcttcagagcaaaatgaaaatatatattacaaatgatgccaccagtggcaagcctgctctgggaccagccatccttccactgtctcctaccactggcagctaaaaacatccctccttctccttaaagccattttaataaagaccccagaggctgtttactcaggtgaacacatttatttgtaaccagtgtttaatgtaaaatttagcctaggctgtgtgtgtcaataaaggtctataaataaaacatcactctgggttttttatctttatcccaacaccctacactgcatgcttttagagacgccgttccactgggcctttttattcttaaccctgacctataaaaatcacttaagtcaccagaagcttttcctatgagccagtcagtgcaggtgaggtgggagcagctagccataagttatgatgcttgtgactgagaaaacaacaggtgggtgtgttctggcagggcaagaaggcagccagccccctgggaccatccaaccatgctccacctgcctgagcctcgggaaacgccacctgcgcgctggcctgtggaggggagctctttcccctcgcgaggcagagcacatgtcactacatcacattgagttggaaaaatccaaagaacatcatccccgtctttccacctgtgtcagttccttcaaagacaggcccgagacctcctttggaagactttgctcaaattatttgggggcaaacgtccaaatgtcagaccattgatggcttccatcccattccctcaactgacggataaaaccccagaaactcagagaggctgtcactgctgcaaatggtccaggaagaaactctgatcccagaaaccaacaagaggaaattttcctgagataaagagaaatctctgcctttagataagaaatgtgttttcaggaatcgacagtgttagtgtaggatgttagcggtcacacccgagatggttcttttgctaaactcagggagattttagttgaatttgcaaaatggttgctaacatatctacctgttcctgagcagaatttaaaaaagcaacctgtcctgaattagaggaggctggctttggtgtgctgtttgggttggaccgtatctcagcactgtgttccattctggataccgctgtttgggagaccccatgggcacccatagcagacggcagggatgggacaatgggggatggcaaggttgtgtgtcacgctggggagctggaggagggggcccggtcctgagtgtttcagaaggcagggtggggccatcacatccatggcctcttcacttggacaggatgagggggcgcggccacaggcaggtagaggggtggcagaggaggtctatgtggcttcctggggctggctccattgaagccacactcgttctccttttctcctccacctgtaaggaaacactgtccattggaacatcagaaagggcggccctgggctcaaagctgaggacgccccctctgacctgcagctggcgaggtgcacagcccctggaggagaaccgaggccaccagccctgttgccagagctcagctgctcctcccgacactggttctgagtcatggaatctccctaccctggacgcctccaaaggccccatccacagggccctgctcaccactggcccaggtgccacccagagtcagagctggttcctgacctctgccagggatagcaattcccattcttgagctggaaaacaggtcatgtggaatctacaggatgcacggggaggacacctcgctttatttcaggtacacagggtaagaagtccgctgcaggtggattaaagacttgccgagtcagccaggaggccactgcctatgccacttggcacggtaccctctgctcacccaactcccatgactgagatgcacagttctcaccagctttaggtgatgaaaacacctccactgaagctcaaacaggcaaatgcagttattgaaatgtagtcaggatgcaggcacctgcatttagcacgtcaggcaaatgcagttattgaaatgtagtcaggatgcaggcacctgcatttagcacgtcaggcaaatgcagttattgaaatgtagtcaggatgcaggcacctgcatttagcacatcaggcaaatgcagttattgaaatgtagtcaggatgcaggcacctgcatttagcacgtcaggcaaatgcagttattgaaatgtagtcaggatgcaggcacctgcatttagcacgtcaagcaaatgcagttattgaagtgtagtcaggatgcacctgcatttagcacgtcaggcaaatgcagttattgaaatgtagtcaggatgcaggcacctgcatttagcacgtcaggcaaatgcagttattgaaatgtagtcaggatgcaggcacctgcatttagcacgtcaggcaaatgcagttattgaaatgtagtcaggatgcaggcacctgcgtttagcacgtcaggcaaatgcagttattgatatgtagtcaggatgcaggcacctgcatttagcacgttgctttagtaggttaaatcccctccagaatcttccagaatccccaaaatctaaatgcccacatttgctacgtccaaatcacggctgtcacaatagcccttcatgggttcaccttcctcgtggtcccgggtcccaacctggcctggcccctctccctccagcttcctttggctgcaggcaaacactgcctgttctgaggtggtcagcagtggactcggtcaggccacgtggaaaccgcatggggccacagagtgatgggcctcagatgggcagcacacccaggagccgctggggaccctgttaaaatgcagaccctgatgcagaaggtccagctgttcaagccagcttgcaggtgaacccagagctgtgggtcagggtcagtcctagagacgcgtcacagagaaacgacgctgaatcaccagccaccgagacaatcaggaaccagtgacgtgatggtaaacagaggaaaacacgggccactcttcaaagcgcggtgcctcagaaaacacttccacagacacctcttcttctgtgtcgttctaaaacccttctcccagagataaggaaactagttccctgcaaaatatattttatggttttgttatcattttcagtatttgcactgtaattatggaaaattagtttagactttattaagcttttgagtctacatgtgaggcgaatggatgaatttaatttttatccatgcattacctccctctgtctatctaccactaaaccacagccacaggaagctgagggtccacgcgttacctccctctatctgtccactgataaaccacagccacaggaagctgagggtccatgcattacctccctctatctatctaccactaaaccagagccacagtatgctgagggtccacgcattacatccttccatctatccaccactaaaccacagccacagtacactgagggtccatgcgtcacgtccctctgtctgtccaccactaaaccacagccacaggaagctgaggatgaaaatcccctttctcagagcatctactatgtgccagttctgtattagaagtttcaaatgcatctcatcaaattctgagtccatgtgagataataattgccaaattaaaaacaatttaaagagcaagaagggattctggagatcatctaatttattttaatattacctaaatgagaagtggaggcagggagggccttgcccacagctgtgtgttcctgagtaactgggcgggactccctgcatcccaggcctcctacgcaccctccagtgccccttcctctaaacactctgtagctgcattcactcacaaacacccacagaccctgtaaaatgctgctcctttgcttcctgcttagacctgagaagtagcctctctccctgcagccctggagatccttcaccctgatcttgctggacactccatggcccccactgctgttgggtaagagtcgcctccccctgcatctggacgtgtggctgcagggatcctgacaccggctcactgtctgcaagcaaagccctgaagacaggaagccccagggacccgtctgagagcagagacctcacgtctgctggggccctgaacacaggaagccccagggacccgtctgagagcagaggcctcgcgtcttctgggaccccaaagacaggaagccccagggacccgtctgagagcagaggcctcgcatcttctgggaccccgaagacaggaagccccagggacccgtctgagaacagaggcctcgcatcttctgggaccccgaagacaggaagccccagggacccgtctgagagcagaggcctcgcgtcttctgggaccccaaagacaggaagccccagggacccgtctgagagcagaggcctcgcgtcttctgggaccccaaagataggaagccccagggacccgtctgagagcagagacctcatgtcttctgggaccccaagacaggaagccccagggacccgtctgagagcagagacctcacgtgtgctgggaccctgaagacaggaagccccagggacccgtctgagagcagaggcctcacatcttctgggaccccaagacaggaagccccagggacccttctgagaacagagacctcacatctgctgggaccccgaagacaggaagccccagggacccgtctgacagcagaggcctcacgtcttctgggaccccaagacaggaagccccagggacccgtctgagagcagagacctcatgtctgctgggaccccgaagacaggaagccccagggacccgtctgagagcagaggcctcatgtctgctgggatcactcagtgcacacgggcatgtgtggtgtgtgggaagcaggagggaagcgaggttttattaaagcacaggtgctttacctccaagcaggagtcagcattttccatggagttctgctgtgaaccctctggggtttgtgaccaggtcaggctgagcagactgggatgtttacgagttcttacgcacacccttcacagctgagggtctacaattcacgcttgtgggcaattcatgaagaagagaggtgcacatcactacctccattttgcaaactagggctggggtcaggagagctgcccgacgcttagagggactgtggagctctgtgggcaatggacacgtgacaggtggcatttatagagcacttactgggaacatgacaggtggcatttatagagcacttactgggaacatgcactgttgcagcactttatgtgaattcacacgtttaactctcaccacaatccagaaggaaggtgcagatgaggactctgaggcccacccaagaccgtaaaaccagggcagggccataggcagatacaggacccgacccagagcccacactcagccatgctgcccccgggactaactgcctggcttgggtggtccttagtagagcgggcggcatcaggcctctctgctcttggtcgcctggagatcccacagccagcaggatgcacccagcctccctgagaaagatagaactggtctggttcctttccctgggtttagggggctggggccaaagagaaaaatggtaggccctgaacactcttcttgtgatggtgggatggacctgctattcaggaaagcctcaactggctcccccaggtccactgtacccaaaggaactggctgcctgaacacatttggtaaaagagattgcgaagccacccaggacactccccgtgtctcagcgtcactaccaggctctcacaagctgatcaatctgagaccacctgagtttgaagcaccagggctgggagtgcaagttccgactatgaagagagggcagcacagagggcgggataggggtggggtggggaggggggcagagggtggaagatgagagggtgggagatagggatgggagagagagcggggcagatggcagggcacagggatagagggcaggagaaagggcagggcagagggtgggagagagggcagtgcagaggataggatgggggggtgggacagggggcaggagggagggcagcacagaaggccaggcagagggctgggacagaaggcagcacacaaggcaggacaggctgcagatgatgctcagaatgcagccaccccacgtccagaacgtcagggcaggaggggacatggagatggtttaacctcacatgcccactttagaggcaggagagtggggtcccggggtgccaggtgtcttgctgaaggttgtgaaataaggatcagtgaaacggtgagaccattccttccacccttgtgtttccctggcatatgtgtcagccagctggtcaacacatgctgcgttagcaaatgctgaaggcagggtcgtccctggcatgaccccctccccataacccacagcccctcttccccagtacgccgtggcagcctgccatccgctctctgctcctctgactaccttcagcaaccctgccttacggtggggatgctggacaggcattcaggagacacaaatgtcaactcctctgtgggttcctgcagcaccgggagaccctggcgcgactcctgagggcttcagtcctcggtttgttccttttaggaggaagccaccggatcgtttcccatgcttaagctcagacgcccacccagcacagcctccgccgcagcctggcagcccaacagaggctggtcatagtttttgccctggaattcccctccttttaccacatttgccacctctggtcccatcttcctttcagggtccaggcagtcttccccctcattaaatcaaatttattcccaatcctctgatctccattcaccagcctcctctgtctctactgtaagacttccctgtccctcgggtgggggcggcatcctcacaggggtgaggagctctgtgctgctgttgagatgaatggtgccagaagggagtctttccaagtgccctgtaatgcagaacctttcccagtgcccactggtggtgttcccgggacaccaggcactggaggtcggcacgcttattgtaatgaatctgaaggcagcccccaccaacgcgctggctgccttggggccaggcatgaagcgaattcagtccacatcagcgggtccaagcctggacctagacacccgtcccagctcagacgctcagctctgggccatcacccgtcgctcagcctgggtgacgcagactgtaataatcatgccatcgtgcacactgtttttcggagcctgttgaatcacatcacaaatgcaatttatagtttgcctcaagatgttttccggaaccttcctgcagagatagcacgaggcccacagaggggtgtcttggggcacctggcaggttccagggtgggagctataaactagaagtcccacgcttctcctcccccaggttcacttgaccacaattctaaaatattaatagcatacagcgtgttaagtgatggcaatgaaagtctggttcactcttattttatcacaaacgttgcataataaaacattcctggtgcccctcgtgattcgcagcctcctgagagggggtctctgttcagggtctctcagctgctgcttttagctcctttgtggggtgcaatcatttcccaggatgctggagtcaggtttctgcactggcaccagctgaagtgttttccatttcctgtgtgaagctcagggggttgtaagcacacacacgtgaccgtcgtgagcaccatcagccctgcctggagcaccggagggtgccaaggggggctttcttttctttgcttctcctgctgcccctggccctgaggtggtgcctgaaatccctgccaataccatccctgttcctgagagcctccttgggcaaagctgggtctggggcaggtaagcgggcagcttcctggggcaccagccccacaggtgagccaacatgggagtgggcgtgccacacttcccaggctgctcacaggcactgctgcttggggatgaaatgtatatttttatggaaatgttaaaaattatttttggctgcctaaattatgtatattgccttccctacattttgataattttttttcgtttttttttgtttttcgcaagaggcagaaccagcttcccgctgtagcagctaagaggctgcactgaagggcagccctctcccctgtctcacctccagtgcacaggcctcctgtggatcagaggctcccacagactctgagtcaagaactccttctgccgctgcaggagctgcagccagacgaggtttctagaagccatggctccagcactgcagcatgagctgcggtgcctggcattgtgcagaagggcacccacgcacggatagggtggctggcatctcccaggctgctctgagctggttccctggctgtcccagcaattccacgagttaactaatacattttcataagcacatttgctgcctaggccaggtttctgtcgcttgctaataagaattaattgtgactcatgcaggattcttggggtaggggtgagggccccagtgggcactgctgcttccaggcaggtccagtgaggaggcgtttggcccgggaaagggcaggcccaatcaggcctgagcagagccgtcagcacaacagaggcacggaacccagtctacttccgatcacacgctgagtaggcactgaaagaaaagtgactgaaatgtgagctcaattcttaatctaaccctgttctcaggaggcacatgccttcgtgtggggctagagcattaactctaaaactgtttcacaagcctctgggggcttcagaggcatctcagtgagtcacaaatgcatcagaaaaatgcaggtaagctctggctcttacatgacgaggggacattttcagtgagttaccgagacagttagaggtgtagctttggtaagctaaattgaataaatgactagagcttagcatagactgcggtctgggcttcagtaggaattacggctgccgtgcagggcggggcaacatggcagagcttctcctgagcatgagcatgtgcacaaaattgggattctaccaccgccaggagaaattattttaggttggtcatggctttctattgttactctaagttgcttcccctcccccctttaaaaatatgttattttaacatacgtcagatttatagaaaagttgtaagactatcatacaagaatctcagacactcgtcacccgattctccaaatggtaacattttaggctttactctcacctgcaaaatctctctctatatttatatttacactgatatttgtgctttattattctgaactatttgagagaaacttatggacatgattttcccttagttctaaatacttcagtgcttatttcctaaaaacaaaggcattctcctacataatgagagtacagttatgaaaaccaaaaattcacactgatatggtactaatatctaatcaacagaacttacacgatttgtctacttctcccaagaacatttctagaacaaaataaatgcccacatgaggccctgcataccgacgtcatgtctctctagcctccttcaatttagaaaatccttcagttcagtctttcttggtctttgtgatagtgacaactttagaatggggtgagtcactttgattgacagtttcagattagaggtgacttactttgacatttttagagtaggggtgactcacttgaattgacagttttagaggaggggtgagtcagtctgattgacagttttagagtaggggtgagtcacttggacatttttagagtagggtgagtcactctgacagttttacagtagggttgggtcattctgacagtttgagagtggggtgagtcactctgattgacatctttagaggaggagtgtcattctgattgacagtttaagaggaggggtgagtcactcggacagttttagaggaggggtgagtcactcacagttttagaagagggatgagtcactccgatggacagctttagagaagtgactcactttgactgacatttatagagtaagggtgagtcattctgattgacagttttagaggaggggtgaatcactccgattgacagttttagagaaggggtgagtcgctctgattgacagttttagaggaggggtgagtcactcattgacagttttagaggaggggtgagtcactctgactgacagttttagaggaggggtgagtcatcctgattgacagttttagtggcggggtgagtcagtctgactggcatttttagaggagggatgagtcactctgactgacagttttagaggaggggtgagtcactcattgacagttttagaggaggggtgagtcactctgattgacagttttagaggaagggtgagtcactctgattgacagttttagaggaagggtgagtcactctgattgacagttttagaggaggggtgagtcactcattgacagttttagaggaggggtgagtcactctgattgacagttttagaggaagggtgagtcattctgattgacagttttagaggaggggtgagtcactctgattgacagctttagaggaagggtgagtcactctgactgacagttttagaggaagggtgagtcactctgattgacagttttagaggaggggtgagtcactctgattgacagttttagaggaggggtgagtcactctgattgacagctttagaggaagggtgagtcactctgacagttttagaggaagggtgagtcactctgactgacagttttagaggaggggtgagtcactctgattgacagttttagtggagggatgagtcaccctgattgacagttttagaggaggggtgagtcactctgattgacacttttagaggaggggtgagtcactctgattgacagttttagtggagggatgagtcaccctgattgacagttttagaggaggggtgagtcactctgattgacagttttagaggaggggtgagtcactctgattgacagctttagaggaagggtgagtcactctgattgacagttttagaggaaggatgagtcactctgattgacagttttagtggagggatgagtcaccctgattgacagttttagaggaggggtgagtcactctaaatgacatttttagagcaggggtgagtcactgatttgcatttttaaagtaggggtgagtcactttgcaccatgctccttggctggtataccgtggctgcctcaggaatagactgggttttgctctttgtcgagaacaccagggacatcatcttttgtgttctttgtgcatcagctcaagggcacgtgtgcggatccatcttgccgctggtgacgttcactggtatcacttgttaagcgctgcctgcctggtttctgcaccgtgaatgctgttttcttctgatcctatcttgtggtgagagctattctgtggttctccagaatatcggccgctcattttagcatcaatgattcttatctgaatcaagtagtactaagaattgatttgactttaacataaagaatttccaatgtgagaagatttcagtattcatggctacagatgccaagtgtgggcaacttatcttttatgcgccttcaacaaagccatgggagcagagagagggaaagaaaatctgaaccagtatgagtcaactggcacatcggctcacctcgatagcatttgcacatttgactggaagcctctggcttgtagaattttttcccactatagtatagaacactccacttcaatttttacttgtttaaaagaatcacatttgtttaatttccactctgacctgatctttgctctgccacagggactcttcacttggcgatgatgagcaaagcatccggccttggacctcctgcttcccagagcctgcagggctgtctcacttcctccagaagctctcagtctgctgccatttcttgggttcttcatccttcctgtggacctgggtctccaactgctgtgatttcccatcagtcagaagaggtccgcagcattttgtacagtgcaggtctaacatggcagattctctcgggatgggctggcacgaaagcaggtttctttcacccttatgctgaaacatgtttttgctggagatagaactctgggcttttgttttctcccttgcagaaccttaaagagttgtcaaattgtctcctggtttctgctgtttctagtgaagaatgaagtcagtcctcatgcatatcattgctcctgggaatgtaacgtctctcctcccagctgttaagattttctatctttggtattttagcaatttgactacaaatgtgcttatgttaattttctttgcacttaacttgcttggggttctctgagcttcttctttttcaccaggtggagggtgggtagggttgctggttttgaatattaattcttctttttttgtgtcccacctttcttggctcatcttctggaactgtcacgtgggtcagaccacttgactttgtcctagaggccacctgggctcttttttgtttctggcatttttctctgtccttcagatgcgatcatttctgtgcatctgttccaagtttgccaattcattcttctgcagtctctgatccgctgtaaagcccatgcagtgaatttcccatcttacaagctctcctttctaaaatctacacgtggttcttctgcacggcctccatctttctgctgaggttcccacgtgtcccctcttctccgtctttccctttacgttcttgaacagatctggaattgttgttaagtccttgtctggttgatttcagtgtctgtatcattgggactttcttttctcttctttatgggtcctaatgtcctgtttcttaacatgtttagcaattttggactgcaagatgaacattggcgggtacatcacaggaacctggtgacagtccactccttgcttttaaaattggagctccctgggaggcatcggcatctgtgtcactccctcaggggggtctagccatcctcagcatctgtgtcactccctcaggggggtctagccatcctcagcatctgtgtcgctccctcaggggggtctagccatcctcagcatctgtgtcgctccctcaggggggtctagccatcctcagcatctgtgtcgctccctcaggggtgtctagccatcctcagcatctgtgtcgctccctcagggggggtttagacatcttcagcatctgtgtcgctccctcaggggggtctagccatcctcatggtgcagcaacgccattctgtcctgtgtgcttcgcaatccgaaagtgaaccgatcgtaggtgtatgactacagcaaatgcagacacattctccccactttccctccctgccatggttctctagtacaagatgcttgaattttttctcactgagcttcactgctgccactggaggtctgaattgattttgcctcaactagttagagaagactgagactgactgagccgaagctctctgctttcttgaggtgacgagatgctatcgattatgggctctgtgcccctgtcacgttcacacgacatcccaaaccagactctactgggctcattcctcccctctgcctgtgtccctcactccaccaggccccgcgagcatcctccctgtagctctctggccaccccacctgtttctcttccacggaggcacctctgtctcctggattcccaccacctctccctgttctcccgagcaccactcaatctcacttctagtgtctcctccactcggaagccagggtgggggtctacagtgcaggtcggacacctcccgtgtctcctccactcggaagccagggtggggttctacagtgcaggtctgacacctcccgtgtctcttccactcggaagccagggtgggggtctacagtgcaggtctgacacctcccgtgtctcctccactcggaagccagggtggggttctacagtgcaggtctgaacacatgtgcagccctgtgcaaagctcttcagaggctcctcatgccctctggagaattttcaagttcgcagggagtgtatgaggccatcctttcggtcattcatgccattttcccacctctcccctgtctttccgccatggccagtcatgggaattttcctaaacatagcctctttctcatctgtaaaaagtattctttctgcaatattctgtaaaaagtattttttctcttgtagaatgtctttctgcctgcccctctcacccgcatgtcaacccccttcactggggcaatttctcttcatctcccagacttggcctgggccaccttctctgggaagccctccggacccctgaacaccgtgggtctgacaatatctttatgctccttctgcatctgggcacctggaacttgccgtgagcatggctgtggtgggtccttagcccgagtgaccacgtgaacttgcagctggcacacataggtgagtaaaggtccacacggggctggaccacctagaaaaacagcttttgcttatttacccaaagtaagctgtgctggggaaaggaagaggaaggttttgaaggtggatacagaatttccgtctaactgagcacgtggggactggagcaattcactgaagaaatgaaaggtgcgggaataggcaagcccttgatgtctggagcagatcgcatcagctactactaagccgctgttgtcaggcacagagaagacactcagcatcggatgagagaataaagccgtgtgcggtgtggcttcatgtctctcacaatagcgctcccgagtgcggccgctccacctttcccacccaggagaagccgcttaaaaagccaggcaggggctcttcagtgcaaaggttctgccccggactctcaccagctgctgagagcgggtgcggcctctctgagttttggcttgagccggggcctggaaaggccaactgcctgttggcctaaagagctagaaaaggatgaatggattcatatttacaaagacaccacagagtctgtctgaacagtcctgcgtatctgcaatctgctcgtcacccatccccttgtgcctagtgacgtgagccccaggacagtctgttcagtagcaccatttgcaacccctgtgatgggaatcttcgtgactatgtgacatgttccccatctctctctctgttgttttattttcctttgacaatgtcaagctggaaattagaagcaatgtggcatgcggagccactcagatctgaagcagagtgcatggtggggccatctaagtatgtttttctgcacaatgtgaaccccggctgttcaaagctaagagccacccactgcagggcacagtgctctggtgagaggaggtcacctcgaagtgggccccccgcatggtgctgccaaatgcacgcacagattacactttatgaaaggtttcctttgctttgaatagttggctgtctcagaaaaactgcagcacccactggttggaaattacatctgaactgcagtggagatgcaggggagacatcgcacaggagcgtcagccatgggacagctgcacatgcctgcagtgtcatccctgccagctctcagaggcacctgcttctgccctggggatcctgctgaaaggttcttgagctgctgctcagcagggacacaggagagggccggatgtgaggggtagacactataagcagacctgcaggcccagccatgccacgtgcagaccactgcccaccctctgcagatgggaaggagaggcccagggaggctgcctgtctgctcagggtcacacaacaacacccaaaggcaagatgtgaacccagatctgctttgcactgaagacctcaatttttactattagtcttaccacatagacaaattaaatgtgacgtgtttaagttgcattaaactgatgagatttgaggaagctcttttccaaaaattctctttaatatcaaagatacattgtccttgtagtacactaagcatgattgtttttgagtaaaaagaaccaccctttggggtgttggtgcttatgtaggatgatccaaccctggcagtaaaagggagggttttaaatctaccggagtggcccacagaaaacaacctgccggtgtcaagatgctcatatcagtgctgaagtaaggagtggggctctttgggagcatcagagcaaacttcttgtccatgatccacacgggctacgagcccctgcagtgccttgtgcatggtggcagccacatcaactcacacccaaattccgaattacagtcagataaagtaaagtaaagcatgcaggtccccacctcaacagcaaggtttccagcacccaaattccgaattacagtcagatacagtaaagcaaagcacgcaggtccccacctcaatagcaaggtttccagcacgcaaattctgaattacagtcagataaagttaagtaaagcacgcaggtccccacctcaatagcgaggtttccagtatccaaattctgaattacaataagataaaataaagcacgcaggtctcctgtctcactagcaaggtttccatcactgagcggccacaggggctggtggctgtcctgcaggacagcacacatgtgggccattctgttgccacagaaagtgctagaacagagctgctctagagaccaggcctctggctgcaggagaggagagctggacagccatctgcagaccaggtcactctcagtgctgtgtgttgtgggtggagctcaccaagtgccaggattcaccctgtggacacagccacatccccagtggggccatcatctgcatatgaacctaatttgccaaaacccataatgttgggttagcaaaggtgaggccctgaggcctcaaccccatcgtccagtgtctactgaaactcagcaccagacagacagagttggcctcagaactcctcagtccagcttccctctggcatatcttacaacctgtgttaataccagggcttttaagatgtgtttgcctagcagttggttttgctaggcccttggataggtgcatttggctgggtactgggcacccgagaaggagaaggttgctacgtatgtgtctacaaatgccacaggtctctggcctgtgagacctcagcacagagcagagtggaggcaatgcttcctgaatgaactaagcaggtccaggaaggtatcactgcacaggcggggaagagcagggagtacccaggtcctggaaggtgtcgccgcatgggcagcagagagcagggaggacctgagtggaggaaggcgtcgctgcatgggcagttgagagcagagaggcccccgttggtatgaccatgagcccctgtcaagagttccagtccaggtcctgagggacatgttctctgcacatttccttctgggcatcatcctcagagttcccatctagtggtctgtcagcgatggtggtgttcagaacttggttataactcagccccggctcctttctgaagcctcagtgcagattcttttctctccccttcctagtgttattattaaattttataaggtctgtgctccttactttcaaagcaaactcttttttgtgccatcaagaggcaaagttataaacagttgactctgtgacattgaaatactgaaattaagaaatgaagaagcctagaaattctcactgttacagaaatctaatgccctcccctgtgacactgcaaatctaatgccctctcctgtgacactgcaaatctaacaccctcccccttgacactgcaaatctcataccctcccctgtgacactgcaaatctaacgccctcccctgtgacactgcaaatctaacaccctccccagtgacactgcaaatctatcaccctcacctgtgacactgcaaatctaacaccctccccaccgtgacactgcaaatctaacactctccccgaagacactgcaaatctaacgcccccccgtgacactgcaaatctaacgccctgccccatgacactgcaaatctgacaccctccccaccatgacactgcaaatcaaacaccctcccccatgacactgcaaatctaatgccctccccacagtgacactgcaaatctaacactctcccccacaacactgcaaatctaacgcccccccatgacactgcaaatctaacacccccccgtgacactgcaaatctaacaccctccccaccacgacactgcaaatctaacactctcccccgtgacactgcaaatctaacactctcccccgtgacactgcaaatctaacaccctccccaccacgacactgcaaatctaacactctcccccgtgacactgcaaatctaacaccctcccccgtgacactgcaaatctaacaccctcccccgtgacactgcaaatctaacaccctccccaccacgacactgcaaatctaacaccctccccaccacgacactgcaaatctaacactctcccccatgacactgcaaatctaacaccctccccaccatgacactgcaaatctaacaccctccccaccacgacactgcaaatctaacactctcccctgtgacactgcaaatctaacaccctccccaccacgacactgcaaatctgacaccctcccctgtgacactgcaaatctaacaccctctcaatcatgacactgcaaatctaacaccctcccccatgacactgcaaatctaacatcctccccaccatgacactgcaaatataaccccctcccccctccgtgacactgcaaatctaactccctcccccatgacactgcaagcgattcttcagtagacccaggtctctgggtacttgaaaccagagcagccacagcaagccactgtgtaagagttagcagagaggggctcctggccatctgtgcagggacatacgtccatgcatgtgtataaaagatctctgtaatttttatcagggctaggaccatcctgaaagtgcaggtctcccagagccagccacactccctatgctgggctctgcatggagtggggtcagcatgtggccagctgctgccaaggtctccctcccaatagccctcccagaggcctctgcccaccttcaccacctaatctccatgctcaagcctcactgtgtggccaggctgagtgcccatctcctcacaggacacagcgctctctgcaggacttttgctaagtggttggtcccctgcagcaacacacaggggtccacggcacaccctccacacacgggggtccccagcacaccttcaaatatgggggtccttagcacaccttcgcacacgggggtcctcggcccaccctccacacatgggggtctgcagtgcaccttcactcatgggagtccttggcctaccctccacacacgagggtcctcagcatgccttccacacgcacaggggtcctcggcccaccctccacacacaggggtcctcggcccaccctccacacacaggggtcctcggcccaccctccacacacgggagtcctcggcacgcctttccagaggaggtgatcttgaggcaccacaaaagcagcacctggcccctggccgctcccagctcagagcccacggtggggtcctcagccttcaccctagttttgctcccgcatctgagggctgcgtgtcacctcactgtgacttctgactgcacagcaggtgttggtgtggggagtcaggcagcctcagcgaatgtcctgaaaatgctcccacagaatgtttatatctttacagacacaaaatgctgctggggtaatactcttgggaagtatgcaaatgagttctttttcagatgtcaagcaggagcgatgatcagagaatcctctcattgagactgggagctggtggaatatgactccaccagctccagaccccaacttctccgcgttcacctgtacatcgcaagtgtctaaaaatgatgtgtatcccctcccagtccctcactgtctttccccagatcacacccccacaaccctgtgctcacggagaactgcccccaccttttctaggaaggagggcttggttatcagtcatcctcctgccatctctgatgacaggcagtggcaggggctcaaccttgtccttccttttcattcccactggtgccaccccagccaccttcatctgcgtagcctgaatcactgtggcctaactgggccctgggtctccatgcttcactcccaaagtcaaacacaccgtctcccatccctggcatttccatgccctcacttgacgaggatctgcaagagccgagctctgtgatgggcagcaggtgtgcacagcaggagggccgggcctggtgctcccagcatcttcaggcttaaaaatttggccccaggaagcctttgcattcataactgtagctaccactattcactgctccaaaattcaaaggaggagttctcgagacccaagaacacacaacacacattccactagcctcgaagccgcatcctcgcacatctcacagcctggggaagcgatgcagaatctcaccagaggataaacaggcaaagaactttggggctttgctaggaaaatgtcttactctgcggacccccagagggtctcagggacttcccatgccccctcccatgccccagacggtcctttctgaatggccgacttagacaaaggctacaccctttaaattcagtgacagccaacagaatcacttcctgcccttgaaatccaacaatgtctccacaggaagcatctgctggctcagcacagcaccagcttcagcccccacctccgccccatccctgctcctggacctgttggttccgaggaggccctggacaccaagacacccaccccagatgcccagactccctcaacatggaggatccccagactgagtcctccacaaatgctgaaaccccctcccaagatgccaaggaagccccccacccccaggatactgaagtcctccccagatgccaaagctcccagaggccaagcgctccctaccctgacgccaaggcccctctaggacaccgaagcccccgcctcctctgctgaggaagtgccattccatggaaggcccggctcagcctccctgggtcaagctcctgtctcctttcaggaagatggaagttcacagaggccgcaggtgtctaagggtcaagttgatcactacaccatccccttttagtgtttttgtatctgttttgactccctattatttttctggtagttcatctttttatgtgtttttaactaaatccattcagacaatcttgttcttcctctgccacttttctccacgttgtaagggttttaaaccaatgtttctaagggagcactgggcttcatttgacatttccagtaagtatcaaaagctgctatcacttcaattacagacactccgagcccaggacaggctccagatgcccggccttcatgcagcaaacaccttcacagggaaggaaggcggaactctctttccttgccacagaaaaggattctaacggcatttgacaaagattgagcatggttcgtcgcgaacgccagcctgcccccacggtcatgtccagcttaaccaacacacggcccagcagtctcggtcagtggagcccaccacccaagcgggggcggtaccactcccaccactgactgaaccttggaatcaatacaatgcagggtagagcaattcatttgaattaatgtgttaagtggcacaaatatgtgtttatcgagagaaacctaagtttgtgagaaaaggatctattggaaaattcttctttttaaaaaagtttcatggaaaaagcttcctgcaagcatccgcactgctgcaaatataataattgtttgaaagcataacatttaaatcagaagcatccctagacatgttgattagaaatagtcttaagagggtcaaactatgtccacagaggctggaacaccaaaatagaggcaaaagtcctgagaagggagttgtttttagtcaccaggccagtgaccactgtccagcaggtccacgtgcatggatgagagctgtgcccctctcttctctaagccaaggggctgttgggacaggcagccgcacctggccagctctgcccttgctcatcagctgggaagcagcatgcttcttggggggcaggcattgtctacaacacagactacacagtccacagtccacaactcctgaatcctgcctagtatttatacagtaaacagagactctgaaataaacaccgtgccgaatggagcctgtgcagctcccagtgctgtgaccccaccatgatcgctcatctgctccagctggagcactctgcctctctacccattttcctgctctcaccgagtcaggcctcggaccagcccctgtgtgagatggagatgtgtttagtgtgggaggaacacggtgagaggtcagagacagagcagggatccgtgcagggatgcggaggccccagtgctgggtgttcagggctgactcctccctccccaggcacctcctgccagagtgacctcatgagccctcatggtttcaaccccacccattcgcagcagccacatccccacctgcactgggttctccttccagactcacagcctccgcctgctagctgctcccggccaacccccatgggcacactgaccccgtgtgtcccgaagaccccccgcctgcctctgaaggcccttccatcctactgctcctccatcctggcgtctgacaaatcaatgtatctttccccgtggatgtttctccaacccattcactcttctcccgctcagtgacctggcccctgaacctgccgttcccaactcagacaaagccgtctccaactcggacaatggcgcctccaactcgaacaatgccacctccaacttggacaatgtcgcctccacctcagacaatggcgcctccagcttggacgatgccgcctccaagtcagacgatgccgcctccagcttggacgatgccgcctccagcttggacgatgtcacctccaacttggatgatgccacctccagcttggacaatgccacctccagcttggacaatgccgcctccagcttggacaatgccgccttcccacctccacaaagtctgcttcctaaagagcaagtccagccacaccacttcctggcttcagttgtcccatcagacgacgggtcaccaacagctggggcattctcaggagccaagctgggtgccttcccccttcctggacatccctaccctgcttgctgggcccagtccaggttctggaagattctgcctttctgttcagctgtcccacctctcagttccgacagtgtgagcctggtggctaaagattcctaatctggcccttgaagactcaggcaaacttagaagctcctggtttcaaacttctctttcccactttgcctcttgtcttgaggtggcagaaacagctgatggtgaggcaggataatacggtctggaggcaagaagcaaccacacttttctagtcttgtgaaacaaccaaagcaactgtctgaagcctcttcagctggcccatgcctcatgggagttttgtagctctttctgcgtttgagaagacactaaaaaaaaaaaagtaaaatccagctggtcctgagagacaagagtttcctcaatcctggaaattcagcaggaaaaatactgtttatgcactgaatgaaatcactgaggccaagaatagttatttgttcacaccatttcatggatgcctatttttgtcccaaaataaagactctgcatgtcaccatgttgatgcatctggaaacaagtgagaggctttgttatcagcatgcagcccagatgtgaaggcccacagcagctcctgagggcacgtaagcttgcaggaacaggatgatcctccaccggctgcctgggccatctgtgtaagggccctgtggactgagccatttacatcagttaggccagcagccacagggatggtgtcaccactgtgggattcaacactttgaagaattaaggcagaggttacttttgtccacaaaatcacatcctgcagtaaggatgtgggtacaagtaatttatttggaggatgatcccagaagccaagtgagagaacgggacagtaagcctgagaagggcggaagccatgaagtacatgcacaaaccaccagtgtggacggccggggcccgacactgccggagaccctctgagaggcatgtgggatgtgccttgaatcgtctgagggtcaaagaatcaggggtctctatccattgactcccatcccttgctctctgaagaggtgaactcctgagcagccctggcctgccctgggtgtgggctagtgtgctgcttagctcagacagaccaaggcaggtgcttaaggctggagccatcagcatagatgggagctgccctgcagagctgaagggaggcacagggtgggcaactgggatgtgggcaggatgcgaaaaggtctgtcaaaggggtacttcttccaagtgggccaaagactccatcaggtcgagtagtgacatggaaatcacagagcaggtggctccaaggatctgtccctccactgaagtaacaagtaagctgacaaaaatggacagaagtgactgttctgggattctgtagtctaattttaaaaatcagcagtaaccagggggtgctaaattgagaaagagaatgctaaattttggttaaaagacattctgtggtttttgcttgcccacctattattccccattccccagttcaacagcagctacaggattggtggcctaagttcctggtgagatgtggtggtaccagggggcagtatggatcttgttttcaaaaaactgtggctgtgtgttttgagctgtctggtggttccttgagaaaccagtgcaaagaggaaccctgttttagcacctttgggcgagactggctttccaggaggaagctgacgaaatcatgtatagagttatactgaccaatactatcccaaatttgatgaaagacatgaatatacatatccaagaagctcaactaactccaagtagaattgattcaaagagatccatgctgacatattatcatcaaaccatcaaaagccaaagacagaaatttgaaagcagcaagagagaggcaattcatcttgtacttgagatcgtcaataagatcaacagcagtttttcaccagaaaccatggaggcctgaaggcagtgggatgatgtatttaatgtgctgaaagaaaaataactgtcaaccaataattctgtatcaggcaaaactatcctttgaaaatgaagccaaaattaagacatccccttagaagcaaaagctgagggagtttgtcactagtagacaagctctgtaagaaatgctaaaggtgacaggctgaaatgcaggtcattgaggctgaaattctaaacagtaaccagaagccatacaagaaaataaagaacttcagtaaaattaactacataggtaaatataaaacccagtattgtagctttggtttgtatctcctccttttgtcttctatatgatttaaaagacaaatgcataaaacaataattataaatctatgttaacagcatacaatgtaggaagagataatttgtgacaataacaacataaagctgggaaggaagctattcagaagcagtttttgtgtgcttttgaagctaagttggtataaattcaaactacattgtgataaatgtggggtgttaattgtaattcccatggtaaccactaagaaaataacaaaaagaaatgtgcaggaaaagaaaatgagaagggaatcaaaacagtacactaaaaattaaatcaaagaaacaaaaaaaggcaatatttgaggaactgaggaggaaaaaaggtgtaagacatacagaaaccagcagcaaagtggcagaagtaaatccttccttaacagaaattactgtaaatgaaaagggatcaaactcaccaattaaaagagagactgacagaatacatttttaaaagtatgaccaactacgggttgaatatccctaatccaaaagtccaaaatctaaaatgctccaaaatctgaaaatttttgagtgcctacatgatgttcaaaataaatgcccattgaagtattttggatttcatatttttggattatggaagctcaactggtgagtccggttggccttaaaacaagatgtgtttgaatcatgcaggtccacttatatgcagatttttttcaaccaaatgtgaattgaaaatatagtactcgtgggattcaaaacccatgtatacggagagctgacttttataaatgtgggttctgcagggccaactttgagacttgagtatgcgtgaattttggtacacattgcagggggcgggtgtcttagaaccaatcatctgcatatatgagatgaccacaaatgttccaaaatttgaaaagatccaaaatctgaaatacctctgtcccaagcatttaagataaggtatactttgtatgtaagataagggatatatgctgtcggttagggactcacgtaggatccaaagttgaaagtaaaatgatgcattttgggatggtgaaaatgttacatacaggtggcagttgcacaatgttgtgaatgtaccaagtgccactgaattgttcatttttaagtggttaattttatgctatgttaattttatctcaattttttaaaaagactccctcaatttagttttgtttcattcatctattccctatttatttgcctctctagattataaaattgttgagaacatggacaggagtttattcctctttgtgctacccagcacagtgcctggaataataaatatttactgaaggcatcactaagcatggagttgaacatcattgaggggctcagacactggcggctgagtcaatgccatgcttgctgcaggacagcctgcccaggccatctcagtctcaggtatttcttcatagcagtatacgaatggactaatacaggcccatattccaagacccttaggaacaagtggtaattgtttactatctagacgggactctcctacttgataaaagtctcctgctctatagctccacaaacagtaaatttatttgaaatcaataaatgaatgattaagcactgtgactggagagggccgaacagggttccatttccagatgtttcccaggcactgatgattcacttcctggggccgggcaagttccgaggctcctcagggtctcctcaaacaattcaggcttctttaagcctccagcttgcaactatctgactcattaagttgaagttggcaggaaagttataaaggttgtacttgaatcacagtcctgagatcttgggttgagatgctttttatttagcttgtgcatcaccaacttgtaaaaaatatcttggtaaaaaaatttaaaataaaactttaaagtttgtgttatgacagattaaacatttaatgccacatggtgtgtatatctcaatggaaacactgttcttgtgtgttcagtatctgtgtgcatgttaatcttcctgtgagatcataaagctctgtaagggaaagggtccaattgtctcaccttgaaaattccaaacctagcaaacgcctggtgggaaatacaaacccgcaggcgtttctgagtgaacggaggttgtgccaggtcaaatgctcactgctggtcccgtcctgctctaaaatgttcagatgcataatgggttatttttgttggtatttgggtgggtcgaatgctcactgctggtcctgtcctgctctaaaatgttcagatatgtaatgggttatttttgttggtatttgggtgggtcaaatgctcactgctggtcttgtcctgctctaaaatgttcagatatgtaatgggttatttttgtcggtatttgggtggtatttttgctctatgacctcccatttctctgacgtctctagattcctttgttatttgtgatttctgcttctggtggtgacaacaaaatctgccattgctgtgcagccgcctcacccatggagcaggcttatcctctacaactattctacagaaaagacaagcaaggtctgcgtggagtgaaagcgccttctttccatatcggatgctggaagctgtgatgttggcaaacggctctttgcatgaagtactgtgtactgaaccaggaaagtgaggtgcagacgcggaagtcaggtgcagatgtgttgggcagatgagctatggtgatggcgggtggccattccctataagagagtggctcctctattattaacaaaataaaaattaaagaaggtttccattgagtttgctagttcttcactagcaatattcccagctggttgaccttcatttgttttagtttgatttcatccaacacagctttatcttacctgctgcccacaccctactcttgagagcacgtactcctggcaggaccccaacccaggaaaccctcccatgccccaggtgccgtcccctgaccaaccagcctcactctcagagacaaggatgaaacgcatatgaatatccactctaatacggttcagagaaggatgatctgttatctgaaacttttactgcaaaagctcttttaatcaaaaccttcagaaaatttgaattttactccttgcaaagattatttggttaaaaaaaaaggacactcacaacaattaacatatgactggggatgtgtaagaacagcgaagagaactggacaggctgtgtcctgggaacagcgcccggtgcacacacccctttccatcttccctattggcaccttcagtccccggaggcgctgctgatgctcataggaagggactaaggccttcacagtctgtcaacaggagggtcccatggggctccatcacggtctctgggaccccccttccactgcagcaaagtggacaggtgcactgcatcaacatctcaacaccgggtgaaaagggaaacgccttactaaacgatgttcccgtgatcagaatcacgggctaacgtccctccgcttccgcagtcttcaggcctcaggcactgccagtgacattagctgctgtgcgtccctcctgccggactgcaacaccgtctcaggatccacctcccaccatcttccctgaccatggccctgctccatctgatttgtttgtcctctgatcaggtggggcctgagtccggcagtggatgccagtgagtcagccatggttggcagggactggctggctgcccccctctcttcattggccccgcctgtctggcctgggcgcccactcactcctgctgcacctgccacaactgccggctgatcctgctgctctgatgccccctcacgtctccagcctgcgccccgcactgcgttcgctgcccatcttcctcccaagctcacagtctagctccaggtgcctgctctccttgttctgtgtctgtttctgcacaccctgcggggaggccaggctcacccaagaaaagagtcaaggctgcaccatgaagcctctcgggctgggcagggagtccaggccctgggagccccccagagccccccacagaatgtgcagctagcctcgccagacgcgggcgatggggccgaaccccgcaggacaacttaggaggagtgaagagtggaagagtgcccggtgcagggatgggtgggaggaacctggggtagtgtgcacgcctgagacagggtgggggacacgaagggagacaggcgagggtgggacaggcaagggtgggtagtgtgcatccctgagacggggtgggggacacggggggagacaggcgagggtgggtagtgtgcatgcctgagacggggtgggggacacagggagacaggcgagggtggggagggagacgctgactccgtggtggaacgtgggtaggtgataggctggctccctgagcagcccctcccctgtggtgcagagctgtgggtctaggggtgagggagccatcatctcatctcacgccatggagacacaggtgtggcttctgttcctgtatctctagtaaatgtttccttctgagaaactgggtctgtcagcctctttctcaggcctcttggttccctcagacttgggggtaggtgtgcacaggcctgcctgccaggggacaggaaccccaggggaaataaaggtgatgctcaaacccagaccaccgaatgctctgaacacacttgcttgctttcaggtggaaacattcacagtgtccctgggtacagcagacttcatatcacagagacttccctctccaggacgtgaagatgtccatcaccgagacgtcagcacggcaggtgggagaaagccatgcacacagtgaaggggacggcctccattggcccacagggtgagctatccagttccaggagccacctgaccacagggtgagctgtccagtgccaggaaccacctgaccacagggtgagccgtccagtgccaggaaccaccggacccacggggtgagccctctggctcgagaagtcctcagcgacatctgggggtcctgtgcatgcaccatgttgactgtacccgtgtgcagcttgcacagagtccccagcagctctggggagggctccgtgttcaatatgtgatgagctttcgggaaggacaggagagccgggtgtgagaagcctccttcctagggcctgtgtctctggagtgcacgaggcagatggatggagacgtgggagcaggggctggcagcactccccgagcacagtgggaactcaggagcaggggctggcggcactccccgggcacagagggaacggcctgggtggcatggagagtgtcctcccaggatacagcggagtgcccgtcaccacctgcccaccttcttcacaccatgaggctgctggcacgggtgcctttgctgccggctgctgtctgtgctgccctgcaacctggatccacatggctggaggtccggtgtccctaaagacttctatgacatcctgacactgccctgcttggacactctctggacaggagacacctcacccctcacagacatctcattttttcagagctgcatcatcagagcagttgggggacaggagggccaagtctgaggactcagacccggggcagctggtggaagctggggttaagagtggaatacatggccaaaggatccctcctgagggtgagggcgaccgagaaaggaatgagggcataagagcggtgctggagaaatgtaagcaaatccgcatttcgaagcagaaatcgctggtttaaatattctctcctttccctcaccatggaatgcacaaacgcttgaagatgcatgtgtgttagagtctcttccacagaactctctggaaaggccgttccaagagcttcaggtgttcaggttcgtatctgaggctgcaacaggcagagccacttccagtttcctgactaaaaagtgaaagttccagaagcattcctagatctgtggtgtgtgtggtgcacgtgtgctgtgtggtgtgtgtagtctctgtatgtgtgtccatgtgggtggtgcctgtgtactgtgtgtgctgtgtggtgtgtgtggtacatgtgtgctgtgtggtgtgtgtagtctctgcatgtgtgtccatgtgggtggtgcctgtgtactgtgtgtgctgtgtggtgtgtgtaatctctgcatgtgtgtctatgtgggtggtacccgtgtactgtgtgtgtgctgtgtggtgtgtgtggtgcacgtgtgctgtgtggtgtgtgtagtctctgcatgtgtgtctatgtgggtggtgcctgtgtactgtgtgtgctgtgtggtgtgtgtgtggtgcacgtgtgctgtgtggtgtgtgtagtctctgcatgtgtgtctatgtgggtggtgcctgtgtactgtgtgtggtgtgtgtgtgtggtgcacgtgtgctgtgtggtgtgtgtagtctctgcatgtgtgtctatgtgggtggtgcctgtgtactgtgtgtggtgtgtgtgtgtggtgtgggttgtggtgcctgtgtgagaggagtggtctcagccggggtgatattaaggcctgcagtacagctccagaccccagagcgaggccccgcctccctgccgagccccagaaacccccttttcaggggtggaagtgggggtggcctctcccatgcagttgagtgtcctgggagggaaagcacagaagttctttctggtatctttagaaccaaatcaggtgaggtgtttaagtatctcatatgttttttggtcatcatttctatttactcctgcaaaattattttttaagataaattaaaagaataataaaccgaaatactagacttaaaatttaaaaatttagaaattgctggcaatctttttgtttttacaaaatgccacttcctagtttgtttctgggtagtgtgggagtgaagcgggtggggtggagggtgctgggccagtgtgcctctcaccgtccccaaggagccccctggagatgcagtccagaaagacggatccaccggccatcccaggtaccaggagcagcacacacgaatgctggatttgtgcctcacactaaaaagcagcttggtgtagctgcgaattttctatccaggcacatctcttcactgctgattaagctacctctttttgccaaacatactctatatttgtgctggatcacaggtaatttggtggagaaaagcaattccaaggaacacaggggagggtaccatcatgtttgtgatgcatggaattccttgcagctgggagacctatctagaatgctgagccgggctcacatccccctgggtgggagctatttctaggtctcatcagcagccaggggagggcttaccagtaatttttaagccatttcaacttctctgaaggcaaaacctgggaaagcaccgcaggcccatcacagatcccctgagagaagcaactcctcaattctgcacctgcgtctgcttccagacagcacacagcaggagggttatccaagcatttgaagaaatgctctccaggatcaactctcttcttcagacaactcccaaccattgtggttttaagtggcagggcacagctcagaagagaaagacaaggagggcaaggcggcaccgcagctcagccccgcagggtgctagggcggacaccctgcggggtttgcctgggctctgcattcccatcccttcattagcccaggggtgtggaacagtttgcacccagctctgggtcttcatacgtggaggtcaggagagtctcaaatagtgcatctgagaaaacccccaaattggtgcgatttccaataatacgtagcctttgcatatttctaaagagagtcagaggttggaaggaacccaggagaccaagggagaaacccgcacattctgacaggtgcgttttctcatcaggatgtcagctgctgggacactgccccaggccattcgtgtgctgctgaaactaggatgtgtttctcttgtgtttggatgagattttattcttcctacgtgctggcatttagtacactgttgtttatggctgtttgatgagaaaagcctagggacggctggtttaaggtaagaacattcacagtgtgttatctgcatgcccagggctgtgagggagcagaagacacagggttggctccctgacgtgttggagacagcaagagacgtggagcacatctggagggggaggctgggctgctgctgtagccgtgatcgctccggtccacatctgggttcatttggtgtgtggacacaggtgtctaccgagagggttttacctaagttagactaaacaaggctgcgagccagtcccagtctgtgactctaccagaagaggctgggtccctggctgaagaaatgctgaaaaatcctcagacacaaatgaatctgttcgactcaatgtgcactcaacaattgactggctatccctagccctctttgggtctaccagttgctatttcttgcgtgggcatcagcctgcacacagtgaacaaaagcagctggttcagagctgccagtgctccccaggggaaggactgacagagtgatgccaagacagggctgccctcctccctagggaatgtccaatccatgcatggccaccagaatcaagggcccacagaggaatcaagtttcaggggtcatggtgggaacctcactttcccagaggataaactgttacacagaaggcctgactgcttttggtttcttagcctgtgagttggaattcatttgtgtgactaattcatgtttggaatttacaaaaagaagttgtttcaattgccaccaagtaaagggttcatttaaatctgcaaccttgctagaatgcctggctcatgccactatgaaaacctgcatctgagcccattctgttttgaatggtggacacctagagagtaagaaggaaaagggaaggaaaggtcctacccaacatcagaaccacatgagcgaatggccacttgggaaatggaaatacatttgacctccatggctcagagaggttcagaagggttaataaacagctcaagcacttgcacctgagagcccactgttactctagagcaggggacaagagtcacccaaggtgactataagtccccacaaattcatctgatgtgcacttcccagaatctgcagcaccctgtaccaacccccatcccctctccacagcaacagtgcatcctaactgtgagcttaggagacacgtatttttggcatctaggacttaagtattaatccctgggggggtgaattccataaattaaggaggggtacagtaagaggatgagatgtttaaagagaagcatatccatggaatcaaaatgcgatcagagcattatggccaaataatccctaagaaaaacactgatggtacacacaacagatacaagattcaaaataaatcatcaattaatacttttaaatagtattattgtattctttttatttatctattactattaataattattatttgatggtacaaagtgaaaaggattataagtgagtgtgatgagcatttgcacacctacaaacaggataacacaagaaatgggaaaattcctagaaatacgcaacctactgagactgagtcatgaagaactagaaaaccgaccccaccaggagtgagtaaggagactgaaaccgtagtcaaaaacctcccaaagaaaatcctgcagtcactggtttgatggataaattttaccaaacatttaaagaaggattagcaccactcctcctcaaacttttccaaaatattgaagaggaaacaatttctaactaatcctgtgagtccagcattactctgacacgaaagccagacagacactacaagcaaacaaaactaagaaccagtatcccttataaatactgatgcaaaaaatcttcgacaaaatactagtagacaaaattcggaagttcagaagcatattaaaacgattgctgtaccatgaccaagtgggatgtattcctagaatgcaagaatggttcaacacataaaaaataataaacgcaatacaccccactaacagaatgaaggaaaggacccatatcatcatctcaactgatccagaaaaagcatctgacaaaattcaaccctctttcatgataaaaacgctcaacaaactaggagtaacagaaaatcacctcaacataataaaggccatatatgaaaaatctgcagctaatgtaacactccagggtaaaagatggaagacttttcctttaagactaggaacaatatgaggaggcctgctttcaccactgttattcaagacagtattggaggtgccagccacaggaattaggcaagaaaaataagtaaaaggcatctaaatgagaaaagaagacataaaattgtttctgttcacttatgatatgatcctataggtagaaaatcataaagattttacacaagagatctgttagaacttaatagaatttattaacaaatttagtaaagttgcagggtataaaatcaatatacagaaatcatttgtacttctatacactaaaataaacaatgccaaaaggacatttaaaaagcaattccatgtacaatagcatcgaaagaataaaatatttagggtaggcttaactaaggaggtgaaggacatgtacactgaaaactacaaagtgttgttaaatgaaagaagacacaaataagtggaaagacatcccatcttcacgtattataaggctcattattgttagcttttaatactacccaaagtgatctacagattcaacataatctctaccaaaaatattgatattttttcagagatagaacaacccatccaaaaatttatatggaatctcatgggaacccaaacaaccaaagcagtcttaaagaaaactggaagacttgctgatttaaacttacaacaaagctatagtaatcaaaacagcatggtcctggcagaaaggcagacatatagaccaatggactataaaacggagcccagaagtaaacccttttgtgtacaaatgctttttgacaattgtgccaagaccattcaatgaggaaaagaataggcttttcaacaaatggttctcagacaacttgcaaaagaataaagctggacctgtaacttacatcatatacaaaacttaaaactgatcaaatatctgaatttacaagatgaaactataaagctctaggaagacttagggggaagcttcatgacactggatttggcactgatttctcagtatgacactaaaggcacaggcaacaaagaaaaataaacaaattgcactttattgcactttatcaaaattaaaaccttctgtgtattaaaaaacattatctaaacagttaaaaagtaacccaaagaatgagagaaaacatttgaaaattacatatctgattaggagtatctagaacatatgtaagactcctacacccaacaacaaagaagcaaggattggaatagacatttctccaaagacgacgtgcagatggagagtgagcccatggtgagctgttcaacatcaccagccattaggcaaaagcaaacaggagccatgagatgccacttcacactcctcaggacggccatcctcagaaaaccagaaaacaagggctcatgagggtgtaaagagactgaaactcgtgtgtactcctagtgggaatgtaaaatggttcagccacactgggaaatagcttgagaattcctcaaaaaattaaacatagaattaccatttgaccccacaattccacgtgaggtaaacactcaagtaatgcaaaagcaggaacttgaatggatatttctacactgacatgtatagcagcactattcccaacagccagaaggtggaagcaagctgagtgcccatcaggggaagaacagataaaaaacatgtggtctatacacggcggggtattattcagccctaaaagtgaaggacattcatccaagctacaacacgggtaaaccttgaggatattatgttaagggaaatgagttgtatatataagaggacaaatattatgatcccacttctctgaggtccctagggtcatcagatccataaagacagaaagtggaacggtgggtaccaggggccgggggaggggttgaggagttcttgtttagtgaatacagagtttcagtttgagaaaatgaacaagttttggagatggatggtggagatggttgcatgacactgtgaatgtacttaatgccactgaattgtacaggtgaaaatagttaaaatggtaaattttactttatgtatattttaccataacaaaaacatcattgcaaaagaagcatgggaagaatcataatcaggtgctgttttaaactgtaaatcaataaaacctttctgaaaaaggagttgggtggcacatgtcaagaacagataaaatatagatacattttaaccatctaatttcaattttaaaaatacatctttaattctttccatttaaaaaatgtgcagtaaacattagatatagaaataaaagctctaagaatagggaaatagctaagtaaatatattttcatggatgaaaaattattcatccgttaaaatgatattacaaatgttgaaaagaccaagatatttttatgatacaatgataaatgaaaaacaaaaacaaaaacaaaaaaacatggtcaggcatggtggcttacgcctgtaatcccagcactctgggaggctgaggcgggtggatcacctgaggtcagaagttcgagaccagcctggccaacacagcaaaaccccgtctctactaaaaatacaaaaatcagccaggcatggtgatgggcgcctgtaatcccagctactctggaggctgaggcaggagaatcacttgaacacaggacggggaggttgcagtgagccaagaacatgccactgcactccagcctgggtgacagagcgagactccgtctcaaaaacaaaaacaaaacaaaaccaaaacaaaacaaaaaacaagcaaaaaccaaaaccatggaagtgaaattctcaattatattaaaatatgtatctgtaacactcttgaaggaaatatgccaaaatattcacagtagttatagtttattagagagattatgaagaaatatttttctttcctcttttgattttttccaaaaatttcacaatggcacacaatatagatattaagaattattataaggtcaggcgtggtagctcatgcctgtaatcccagcacgtcgggaggctgtggcaggtggatcacttgaggccaggagttcgagaccagcctggccaacagggtgaagacccatctctactgaaaatcaaaaaaattagctgggcatggtggtacacacctgtaatcccagctacatggaaggctgaggcaggagaattgcttgaacccgggaggtggaggttgcagtgagttgagattgtgccactgcactccagcctggatgacagagacagactctgtctcaaaaaaaaaaaaaattataaaaagtcgattaaaacaacaacaattttaaaaagagggcaggaaagtggtctagtgcccaagagacctgtctcagcattaaagcatccatttaataacggtgtaatcttggctttgttatttagtttctctattcttcagtttcctgatttgtaaaatgaaattttcaggtgactgcctttcagcactcacactcgaaggcacttagtaaattcggcactcatattctaaggcactaaacacatgtgtctacttatgggagcccgaacatgagcctctgtcaggtttatggaggatgagttccagtgggaaagaggcttcctgagtcacagtgagcccaggagacccggcggcggccgcaccgggacccggggtgtgtggagacccggcggccacacctggacccggggtgtgtgggaggctctggaagagccactctgtgtcccaccctctcactttccctcctgctgaagaggcctcagtgcccggcgggtgcacacaagcggcgcagtccctactctggcgggaaacacaggatgtgaaagtattttatgaaacagtttcagtgaagaagaaagtgggtcattttctaatttgaaaaatccagagtcttctatttttctttgaaatttaaggagaagcaaagtgcttttaaaatgtttgcgtattagcataaacgattacaaatatttgtgtgtttcctggtcgatgaaaacacgccgctgccagcaggatgagatccgaatgtgaatggccacacttcagcaggagtgttattccaccagcgggagcgttattcccccagcgggagcgttattccccttcccgtttcctgttccttggtgttgactttaatgcatatgttcagatacacagaggaatagaattgtcaaactcggtcaccagcaggtctctcattattagaggacaccctgatccaggacagcagaccaagggtgcttagtttttacactatttaatacacagattattttcatcaatgttaagactacagcttcctgaagtcagaccccaggccttttattggtacctacacacccggggtcaggtgcagcctgcacatggcaggtacttgaggaacacctgtggacaagctggaagagtccggtgggaagggttttcagtgacaagcataggaagggttcgtgacacctgttcctattacagacatggggaggttcaaagtgaaccagtcaggaataatctcagcctcaccccagaaggaatttacaaatgaggaccatatatggcatggactagagggtcatatcaacccacagactgtggcattcttggttccattccccactatttggataaccttgagcaaggtagtctttgagccctgaaatggtgaggaacatgcccttagccatgggatgctggcaggtcattgatactgtcctatctatgaacggggttttcctgtctttaaatggggtgatgaggccacctcgcaaggcagcatgcagagaagcaagtccacacggcagacactcagccagcgcagcgcccagcacagacgtgctcagcagacgcacactctcagctctgacagccacggtgcaagtcagatgcaagcctgcaggctgagccgggcagtctcctggcctcaggtggacctgcagtcagagacagtccctcccttctgcggcatcctttccttcctgtgtgcacgctgtagaatagcgggctgggggtgtttaagaccagaagcagaaaactgacaactttgttgcctggaaaaaataaggtggacaatactggaactaatggcagaaacaaggttttggagcaatctacaatttattgaaagcagccctgagtcccaggactaaaataactaagaattggtttggttttattatttcttgttaagcaccatgtctgaggttaagacccagttcttaaaagtaatcacatagatacgtgttacacacatcagttcagttgctaaccagcccatcagcttggatgtaattacttcacacgttctctgagaatgtgttccacacataaagaatttccataatggccaggcagccttgagtggaaacaggccacagttcgggcctgggagagaagtctgcaggggggagatctgtggtcatgccctcaccccatccccagggcagacgatgccgcttctcagtgaggtccccttggcttcctgtcacagcacctcggtgctagtccacccgggagatgccagaacagggctaactcgttcatctttccagtccaatggccggggttgctacatttctcaaacttaatttctatcattaaatccttttgttttgttttatttttggacagacgagttctccctatgttgctcaggctggtctcaaactcctggccttggcctcccaaagtgctgggatttataggtatgagccactgcacccagtcattaagtcctaattacatgttatttgccctgttcaagttcaagcagtattttttttaataaagattattcccaatagatcttagtcttcatctgtaagaggctgttgagggcacgaccacctcgcagtgacctccctctgtgtgggacccccgttcccactggcacaccatggggacagctgggtggggtagtgttgagttctggtcctggtcccaccgacctgggctggagctcccagatgctccacacacccacgtctacagaaacactaggccagactggggtccgccccacacgcacagaggatcactgggggcgatgtagagatgtggaagctggaccccaccccccaggctaattcatcagcaagatgttggcaactgctgggctggatggttattagcatattaggatgacatttgaccctaacattccagttttgtgctaccaaaaaaaaaaaaatcacctgaatgagtcaagacagttaaacttgagggtgatttgggaatgaggggaattcatccatttgaggttaaatgtttgccaatctaatttggtcaaaacagttcatccacaaccccgtgcaggccacaacacaggagcaggtgcagcagggcccttgagtctgtctcacgccattaacaccctgtgatggccttacttggcgtgtggagctgtgaccaccagggccaacctgaggcagcatcatggacttgaccgactcacctcagagcttggcactgggtgctctgattcccttcctcaagcttcccacttgaaggttggtgtgaaaccccaccccactcaaccctggctgatccccatggcctgttctttcgacgatcctcctcttgccccaatttctccaccgcacagactcgccagggctttggtttgtgagtgccctgcactctgtcagttgggccatggtataatttatgttcaacagagacctttgggagtgagtgtcagtgccgtagcggaacacagggatctgaggcacaaggcagggctgtcccaggcaaacagggacaccggccccttcatcagtaggtgacatgctttcattcaataggaaattccagaacaccaagaaagggatctccagacagggacctgaaaacaggatatggaggtagatttgtgggagagagttggaaagggagctagcactctttgagtacccactttgtgctaaatacttagtttttgactccatatgtatgaagattaccatatttcatcaatttcaagacgaaccctttttcacagtgtaacccctctgaagtcaagatgcctcttatgaacactggcaagagagtttagctggagcatagccctttcctgatagcacataaagagacggtgcccctcaccagggttcctggcttggactggacagacgacagcaccgcaagcatctcaccatcgagagactgagccttcccaacaccatttggcattcccagcttacacagctgagggggtgaagcaaggttcaaatcaaagtcagcactaataaaaatttctaggtttccaaccctacacacccatttgggtcccactcaaacatcaccacagggtggctctccccagtcacccctcaggcctggcccagtgccatgagaactgggacctcaggagggtcagagccccagcaggttccagctctcagatcaaggtgttcttttcttatcatcttctttcttctctttcccctctcctaaatcactgctcactctctgccccacacccaactcaacatttagatgctcagatagcatttcagagtcttattttatgactttctgaagaattgtgctgcttcaaaaataagagccccctcattaccaaaaacttaacccaaaagtgcacttcccaaaatgcctccaaataagtgtgggaaatccaggaagccctcgagagccactgaacgcctctgtgcccagcactttgaccagcaccgtggaatcagcttcccaaagcatgcatggggcactggaatcccagtttcacagacacagagacacagaaagcttgattcacaggcaggtgccaggagaactgcagttttatccctgtaaagtctaattccaacaggagtactcagccacattgaacttcttctcactaagaaaagttatctcggtggcctataaactctttggaaattgctttgaaaacatgttctaggctggtgttttattatttatgaagcaacactgctgtcctggtttaactgccttcctgtgaaagaaaaggcttcctgttttgtttcctgagactcctctttctccttcatgtcatcaccatcaccaccatcatcttcattaccaccatcatcttcaccaccaccatcattttcattatcaacatcttcatcaccatcattaccatcatcttcatcactatcaccatcatcgccatctttatcatcacctttatctttattatcaccatcaacatcttcatcaccatcatcatctttatcatcacaatccccattatcaccatcatcaccatcatcttcatcaccaccatcatcttcattatcaccatcacaattatcactatcatcatcaccatcatcttcatcattaccatcactactatcaccatcaccatcatcatctttatgatcaccattatcttcattatcaccatcaacatcttcatcaccatcatcatctttatcatcacaatccccatcatcttcatcaccaccatcatcttcatcaccaccatcgtcttcattatcaccattaccattatcaccatcacaatgatcactatcatcaccatcatcttcatcaccaccatcatcttcattatcaccatcaccattatcaccatcatcacaatggtcactatcatcagcaccatcactgtcatcaccatcatcatcaccatcatcttcatcaccactctcatcatcatttttaaaaaggattgcattctaaaaagttctgtgtttgaaagtatatttgttttctttggctgctgttgtaacaaatcaccacaaacttagtggcttaaaaaacccacaggctggctgggtgcagtggctcatgcccataatcccaacactttgtgaggctgagacaggaggattgcttgagaccaggagtttgagaaccacctgggcaacatattgagatcctatctctattaaattttttttaaaaattagccagatgtggtggctcacacttacagtcccagctacttgggaggaccccttaagcctaggaggtcgaggctgcagtgcactgtgattgtgccactgcactccagcctgggcgacagagtgagaccctatctcttcagaacaaacagacaaacttattgttctgcaggttagaagtccagcccgggtctcactgggctgaagtcaaggtgtcggctgagctgcactcctttctgaatgcggatgacggtaaatgggatggaaggtgcaggtagagactctgtgtggcaggttctatctcatttacgtggctgggagttgtaaatgccatgagtttcttctgtttgttggaccgtaaagcaatggaggagtgggtgaaatctgactgtgggctgagagggctgtgtgtccccgtcctcactcagaggcagacaaatactccatgacatggggaaaaggagaacgatgctgacccattccacaagtcatcaactcgcacaagttatgtatgtgcagtttactgagagtcagtcatacctaaaaagagaaaaactcaacaaacaggagggtggacattgaaaagtatctggctgaccctctgtgagtgaagatgtatttaccttgggatgaatgatcaggaaaaataaaggctgaatccagggagaaggggtctgggcagccacaaagctatgggacacaagtccatggaggtccaatgagctcatctcatgcacggttctctttttgtgatgaacaccagtgtgaccagtgtaaatacaatattagttggatcatttgttagtaacatacctttggacactggcttcattcttcagtatcttccctttatagacttggctttctgggagctggatgtttacccagtaccacctagcactagtaaattactacagcggagggcaggggaggacccactactccaggatcatttgtgggggtggcacctgactcaatattaaaaaaattcacatggtgttttatggtttacaaggcagccttgaacatctgacaccatgtaacaagcggtaactgtgagaagtggggatacaggaccaggccttctctccaaaccttgaggttacctttcctaggaatgcagagctttcagaatggtgtccattccactcactgcatttcagcctctgtggccttgggcagcacctgtgatgcctgtgctgactggcatcgtctgcagtaagtgaggagggcacagagccttccatcaatctgttcagggcatgatttgctgcaaagtgagttgtgaaaactttcggttttcaagagtttctgggtctcggggttgtgtgaatggatgtgaaccagcctccttctgtttttccaggggatctaacaaggctcgaacgctggagccgcatgtctgcgaccactcagcaggtgccggctggggctgggctcctcagacctgaaacactgacttctctatttggcacatctccagggtcatccttgcagatgaagaatccagcctgggtgtctcctgacccatcatacagcctagaagggtttgtgttttgttttttccaagtaaattcctgctatcattttacttattttattgctgtgtgtagagtgaagaagatgctgaaaaaaaagagtgagagaaaaaaatcccgttgatcctggtagatgggatatatgggaactaattttatatccatgcatgagttaaaacgagcagtaggcacatttcccatgggcgatggaagtgacctctgtcggctcagtggaaggtgccgaagaaacagcaagagacctccttgtccaggtagccacaaaggaatttccttttgaaatgtatactcgttgaaatttttaatccaggataaattatgagagtctgtactgcacatgtcagatgctgcacatgaagggttaacatcttgcaatatccatggcatcaatgtttccttttttttttcatcttgctctgtcactcaggctggagtgcaatggtacaaccatagctcactgcagccaccacttcccaggctaaagcgatctgcctgcctcaacctcccaggtagctgggaccacaggtgcataccaccatgcccagcttatttctgtattctttgtagagacgggatctcaccatgttgcccaggctggtctcaaactcctaagctcaagtgatccacccacctcagcctcccaatgtgctgggattacaggcatgagccactgtgcctggctgccagtatttcctctttgcacacatcctgcacttgtcagtggccacttgcccacctctgatttctcaagtgaaatcatcatgagaagggcatgagtggggagctgggaggtggtggcaggctgggtgctgcctgggtttcatcagaacctcctgaggtgggggccaggggtagccatggagttgggagttgtggaggaggcgagatgcttggaaggaagctgtggacagggtctgaatgggggtggctgagcctgaagctggagttgagtcctggtgggagcagaaaccttgggcacctgggagtttggcttagacagattgggctgtgcatggtggagaaaggcccaagcagaaaagctcctgaacaggcctggagcttgcacaggagaaaggctggagtcacagacctggatgttgactctcctgatctcctaagggagagaggagaggaagaaatgaacggagggtcttgggggaaattccccaagaaataagtgagtagcaaaaacaaacactgccagactcctgaggccaacgggatccctgaaggtgcagggacttaacacagccaccaagaaaatgcaggtgagaggatgagtccaggaaaaacatcactgggctggcctggggaaattggtggccctggcaaggaagttgcagaggctcagttccaggaacacacagggaaaggtaaaagacatttgtttcccacagggccagggctctaccagctcagttttgtattagacactggggccacactgttggaaataataatttagggataactgcacaatatacttgccacctttgccctatgaactccccaagagctcaggacacacattgagaaacaccagcacacaagtacccaaggtcatctgcaggcaaatagaaagcatcgtggaagcaatgctcattagacccacacactgtcccaggtgctctgctcagcagaaccgggggacagagacagcatcccaactagcagggaggtgacaatcccaggggaagaaagaaggggaaagtctctattccagcacaagggtctgaagtcatgaaaatagagcagagcagggagtgaagctgtgccagagccacgctgatggcgtcctcaccattggtgcgggtgggtggccagatgcagctgcgcagatggcaggggcatgtttcctcctctcactgtaactggcagcagtgtgcttcattgtcacgctcagagcggacccccccccccacaggttgcccaccccagggcaagacctagatcctggtgagccttggtgggacctgtgcccagcacaacacacatggacagcccagcaggggtagctgtgcagccagtggagtggcttctgtgcccagcatgccctctctggggctcattctcgtgtttcctaccctaattctaagctcattcttcagagctcacagtgcccctgacactccctggtccccctctctgcccagtgaccaaagctggcttgtccctgcacgcacgaggcaccactccatcacatgacttccatctgcctggcaaatctgcaccatttttggaagcagctgaaatcccatttacccagtaaagtcagctgaaataatcctagagaaagttcaccacctcttcctctgcctgtgcctctatcacagatttaataacacacccttgtaattcatcttgcttatgtgggtgttttctccatgagttcttcaagaaaagagctggattctgttcatctttgttcttacccctgagtatccaactcagagctttgtacatactaaatatttgtacttgtactgaatattttttggaatgaataaatgcatttttgaagcatcagaccttcaataaaaaaggttatttttttcttatccatcacgaatccgtatttgaagatttctggaagaaaaatgaatcagaaaattcagaatatccaggtgagtctggggatattccaccccagtgcagcatagacacacctcaggacagagaaattgaagttggtggggtttcttaaagctcttgctgtaatgagcgccacttggaagtaatggcttaatcgttattaatttctttggtatttcctatgataacattaatcacagcaaactcatttgatgtaatggagaccaggaacccccctggaacgttccccagcaattccgtgctaattaactgaagcatcttgtaaaactgccaccctgttttacgattaagtgcatttcttgcacactttgattaagacacaaatcccaagccaataaaaaaaaaagtgggaaagaaagaaagaaaaaaaacccaccgttttagaatgcagtaatgagagcattggtaaagtaacagagacttcactgccagaggcgacaatagctactacttgaagtgaagcaaaaagaactccccagggatggtgtagactgagaaaccttcttctgtaccttaatttatccactgcatatgtacagaagcaattttaaaatgcatattaaacactccagtgaaagaaaagagaataattcacaaagatgtcagttctgcatacccaagtgagaactatgaaagcagagagtcctatgcaaacttatatcaaggtatggaaaacaccttttaccacttaaggtaaatgttcaatttccagagggcaaatcgtgcgctgcctcattcagcagcagaatttttctccccaatgattggcatttggctatcaaggcagaagaaaatggagcatatcacaagattgcacagcttggaagtgtaaaaggcgttcactagaacaggttctctggcacccagcatgccaaggtcctaacgaaaatcgtgtcaaaactcacgtcagtcattctgtgttttttctccactggttcaaatgcacatcattctaaggatgacagacacatgcagaggcacctggaatgaggcaaatgggacctcgggtcttaaaggatgaaaccagagcacatgggcattaacctgctgactgacagcagctcaggacgagagaatgcctatgtcacccaagagaagggggtccaggccctgtgggagagaccacaggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggcactccacaccacgagagcagggcttcagagaccacgggcactccacaccacgagagcagggcttcagagaccatgggaactccacaccatgagaacagggcttcagagaccgcagaaactccacaccacgagaacagggcttcagagaccgcagaaactccacaccacgagaacagggcttcagagaccagagtaactccacaccgtgagaacagggcttcagagaccacaggaactccacaccacgagagcaggcttcagagaccgtaggaattcacaccacgagaacaggacttcagagactgcaggaactccacaccacaagaacaggcttcagagacctcaggaattccacactgtgatagcagggccccactgaagccaggggtgacataagcctgcactctgggctgcagcggcctcactggcctgcaggagaggccccatgagatgccctggagcagcagtgggtgggaggaggttgtgcaggggccttcgagggatgaagcagctttgctggcagttttggggaagacagccctacttggcctgcctttagttcatgggctgataggacagacacaggatttaaaggccaaatagaaccacataaaacctgcagatgtaaaataacaaatagcatgctgtggggaggaatggggaaagggtggggggaaataacagggggtaggctcttcaatatttaaaagttccagacatccacagacttcttatgtcattttcctgatgggagggaaatgaatttccaatatttatatacaccatttaaataattttgctaaataatcagaggtcttagagaaagatgtgcatagagccaaacaagctgtctacatgagacacagccacagccgggtggggcttaccctgtaaagaatatccttctgcacagcagaggatggcctcactggattagatggctctccttgaatcaaagccctaattttcaggtaatggccaagatataagatgtaaagcactgttgtaagatttttaaaatctgtactattttttgtaatggcaatgtaaaatttaaaaagatgaaagcatagcaacaaagataaaataaatagcatgcttttagaagaccacgcggcatggaaagcagtctctagcgctgtctttcttccgttagggtggactggaaccacagggtatgaaaagtggcctctcgcgctgtcctccttctgttggggggactggaaacacatttctccattcattgtcagtggtgttacaagccattggtgagcttccttccagagtgaatgccaaatgatacatttatattagatctctctgaccactgctgttgacgttggcggggtagcaggtgtggccataacatggagcacaggctgagctgcctgacttgcactgctggacggtgggttggcggtgttgacgctgcacaggtcatgagcgccggccctgcggatccggcgatgatcattgtggaaagaatggacagcaccctggttgatgtgcagagtgaccctgcagtcaagtctgtttgcctcccactagcattttctcatctccagcacggtgtcaatggtgccactccagccgggccaccctgcccacaaggtcttccacggggctcctccccagctcacggggaaatcccctttaatttcaaacagggcccttccacctgcccttgattccctgtggcaccttgggagcatggggctgccctactgtggagttagtgggtccacttcgagaagacagagacagagtgaagcctcaagaacagtgttcactggcagtgggaaccgtcggtcctgccatgggacgatgtgactgggggctcgtccatgccttgtcgtggacatctctggtctcagccggcaggggtgggtgggacctcagacctcagcgggtgatggcagtgggagcctgggcaggggcgggcagggctctgtggtaagacacagagggcaggggctggggtgggcagggctccatgggaagacacaggtagcgggtcaggtgctggggaggtgttgctgggcatggtggatttgcaaatttccagggcggtggggggtctggcaagtgtagacacagggcagaagtgggcgcagtgtctgtgggtgaagagctgtgcgggcgggcactgagaagaggtgcccacgtccatccccagcccctcaggcatgttcaccatcatggcgcacatgtctgggagtgagcagaggaccagggtatggaacaagccctagtcagaaatgcctcctgacgcctgtgacctctgggcagggctagtgaggggctggggagagcagagggtgtttctggataagaactcacactaaaggcctggcccggaccctgcctccatcagcagggtgcagcccaggcccagcacattctcctcctcctgggacctcgatcttggcttcccctaggcctttctggggccccccagttcctgccaacactgctgtccacgctggggccctccagttcctgccaacactgctgtccactctcttgtccaccccatgattccaaccactggatccgagcatctgcaccctgtatccgtttctctaacccagatttccttcaagtttcaatcctgtactttcggataaggactggatgccagcccctgtctcctcatgtctgagagcctctccatctccagacaccccaatctcctcgtccctgtgatgtcggctcaggtcaccattgtgtcctcttgctctcctgggtcaggcacctaggagtccctgaatgcaggcaaatcattcctcagctgtcagctattcatattcccacggccccacgaggagacgtgcttcattctacacaaacttgggcgagctccctagacccgaactgtgcttttcagtgagtgtcacagatgtcacatgggtgtcagattcaaggatgaggccagcccttggtgccaggcttggcataaatcagccccaccagcccctgcctgccctccgtgtctggtattcatgttcaaaggagtctaaaacctcactgtcttttccatgtgaatttacctttttttttttccattgcatgtcctttaaataaccaccaggtacctactgtgtgccctgggcactggggatgcagagggtcccaaccacaatgcctgtctgcaggagttcccagggtggaggtccagctgctctgagcctggtccaaggacagccacaaactagagataggctttggacaaagcagtgtggccgaggtggggtgttgtaccccatgcgatgtggagagagggaacttctgtcgaggatggcagagcagagctgggcagcagcccagcacagggccctccctcacctgagtgctcaccatccaagtccttgtagcacaaggtgagctggaagcaaaagccaccccagctcagatgtcctggtgaaacgccgggaaaggggcctcagccagggccatggcagcttagggctggttcccatcgcgttatcagcaaacgaatcttcccagaatcaagctctgatctttcttctctgatgtgaggtgctcggcgattcccaggaggcgctgatgagttgctcagcctggcagccgagttccagcagagttgagacccagcggctcctctggctgttcctgtgttgggcattctcctgctcctagcaccggctggcactctcctctgtggcctctgttctctttattgttcagttatgaggcttcttcctcagttccatgggttaaaatccagatgcaagccccccccaccaattaccccttcattctacagagttcccaggttctcgcccactctgcccagcaccttactggagcctccaccatgaggcctcccgtgctgcctcctgggatagtcacgcatgtgcctgtgcggctgccctaccagaccctggggcctccaagatcgcaaactggtccatccctctccctgcctccagcgtctgccgaccatgcttgcacgtagccgtggacttgtgccgcagattggggtaaataatcctagagcagataactaaggtacactcttcaaactgtaattcatcacaaaactaagtaatattttgtttttaaatgtacctaagcccatgttgtcttgttgatattaaactgtgggggtatagaggtgtggtagcattttactaagtcacagaggatataaacacttctgcttaagctcccaaatcgtcaaagccaggcatagtggaagagaagttgaatcaaatcgaagtttattaacaaagatagctgtcatgccaggaatcgttatagatttcgtcaaatttcagaggtatatgtaattatgaaaagccataaacacagtagtttccatgaaaaactatgagtaggtatggaaaataaaacagatgcaagggtaggaaccacagctaatagtccatgaatctaataattagttaactgattaacgaaatgcatattcattaagcacacctgtagagagcctattgcgtacaggtgccgttccagcaccggggactccctggtgtgacccacaggtagggtggctgtgccccatgaagcttgcatggaactcaccatctgtggtggcactgatccaaattcaatgaacaaggtgatttctgatcagggctctgagctctgcgtcaagtgggaggggttaatgtgctctggagtgacaggggtgggaggggtttatcagagatctgggagccaggaaaggtctcctgaggggatactcaagctgatgcctgaatgccaagagccacctgggcaaatgtgggattgtgcctggcaggtggagggcccagagcgtgcaaggccccaggtgggatgacgtgagtgtgttcatggagtagtgtacaaggccccaggtgggatgacgtgagaaggccccaggtgggatgacgtgagtgtgttcatggagtagtgtacaaggccccaggtgggatgaattgagcatgttcagggagcagagagaatgctgctctgtccagtacctgtgagcaggggaggtgggggcgggaggaagtgagaggtaggatctggtaccatctcgagaggctgcagcagggacacttgaagatctagtgacacctaagagctccctgttgctgctgctgggggagcaggaagggggatcaccctgacaagactggtggcagctgggacaagagtcgtggctgaggaggagggaaggaggtcagcttcccgatgtgtctgtgggccggcaggactcaccgccgcaggcagcaggctcaggcacctttggtaactaggcccacaacagatcctgaactccctgtacgtcgcatgcacatctacagactaaataccaaggagttttctaaaaaggccaatgacaggtcaggtggacctgaattgttaccactaattaggataaaagaggtttacagatgccttgggccagggcagtttcccggaaagtctgaaaccagctctcaggtgtgttttgtggaagacacggctcctctggcacagggctgtgaaactagctctcagacatcggtgaaactctgcctgatctgcttctcaaacagctcccgtgtggtgctgccgccatctccgccgtcaggagtggctttgcaaagacgtcttatgctgaccgcatgtcttttggcctttcttttcaagagccaaacacttcctcctagacaagacacagcaagatactatggcttcacgtccttcctaagcaaagccagggaccattcgggaaattgtttagcaatgctctgagtcttttactcttttgaaagcttttgagctcaagacagtttctggcaaggcaagtccattcattcacacctaaagctacagcatttgtgaaaataatgaaaaggtcttaatgctggcatctttaacaaacccttcaaagtcacaaacactcatgaaagcagaagccagaactagactttgctcagaggtgagcagctgatccagctcaggggtccccagtgatgattctttctgaacaagagtcctcagctcccccacttccctctgggactgcacactttctgttcccttcctcaagggaagccttttcccctgattttctgtcacagtgaggttgcattcgtggtgaagtcggtcctggttttggggccaacctcactgctcgtggggctgacagacgagaccccaggaagcatagcgccatgatgggagaaagacatcccctgggccttcctggcgactcacaaggctggatgttcttgtctacgacacctgcccagcggaaggcccagaggggggtggctctctggagttgactctgcagagcactggcaaggccaggatccagagctgcatacaccaagggccgccctcccccaggcctactgcacctgcttggccttgcctacctgccatctcccatcgcccccgcggccctggcaggagggattgtttctctttctgtgtacaaccagaacctactacagggcccagtccacagcagatggctaatgaatgtctgctgaatggatagaaaaaaaaagaaaaatgttttaaatgttcaaaatacctgaaggagatgagaggacattgcttaagttatcagggaatgaaattcccaatagaaagacatgctaactctcagtttagaaaatattatcctttaatccatggttttctctggaaaaaccaccaaagttaagaacattccacatctgagaaaacacttcacgtcgctgtggctgcagcagcaatggtggtgatgacggtgacactggcaactgcacgttgctgagtgtccgctatgcactggtcatgattctaagttctcacatcacatttaacacatgacagtcctctaatgcagacactatgggagcccacattttgcagatagggaaactgaggcagctggtccagatgacttggtcactacacagaagagccatgcagcccggctccagagcgacgctgcctccggttcctttatctacctctggtgctcccggtggctgacaacgcctgcttatgtattctgctctctgcagggggtgccgctgaatgccggtccttggaggtatgggctggactttatgactcgcatccgttgcatagaatacagtgcgtgatgcacaggcataagaggtccctcagcttcctgctcaatcgcagcccaggccagcaagccaaccataccctcatgtgagtcccagagccagagcccccgactgggcagctgggggatctgtgacaacaggaacgaagctggtgagttcggggtagtgtgttgtatagcatcagataactaatagagtctatttcctcagcaatacaaggatcccccaaaagcctcataaagataatcactgaggactccttagtctttgaaatgtaatcctcatttcattaagtttcagtgaccatcacattttgatgacttggtaaaaattcagtactgatggaaatcatgaccatattattacatcactgaggtttctctgcaaaacaggaacttgttgatcagggtattcattttatgcaggctgagatgcaaacttcataggcaggctgcacaccagagggtaattcagtatctctgcatctgagtaagaaagttcttaaaccactgtctctttttatgtcaacttacagggaagaacattctccaaatatcttagaaattcagtcaagtgtttcaaagccaaactaaattactccagctatttgtcggagttggaaaagaaacttctaggactgagcagccataagatacagccatagataccctgtgattggccgggcacggtggctcacacctgtcatcccagcactttgggaggccgaggtggggagtcacttgaggtcaggacttcgagaccagcctggccaacatggcaaaaccccgtctctactaaaactataaaaattagctgggcatggtggcacgtgcctgtagtcccagctacttgggagactgaggcaggagaatcacttgaacctggctgggcggaggttgcaagtgagccgagatcatgccactgcactccagcctgagcaacagagcaagactccatctcaaaaaaataaataaataaaagatactacgtgattgtattagcatcacatctgcccacagccttggaaagtaggcagacgctcctccctttaagcctgaggaaacccaggcttaaagaagtgacatgatcagccagttcccaccaagccccacctcccacacgggcactggggacaggggagggataagtagccagttcccaccaaaccccgcctcccacacgggctctggggacaggtggggggtaagtagccagttcccacggagccccgcctcccacacgggcactggtgatgccctgcgcactctggctgtgttgtcaggcactcacacagttagatcagtaacttgcagaaaggctcctcatataccaaagttgagtggataaacagccttttaccctaagagtgacctcagagtttgcaagaacccacacatttcttggtccttatacaaattcagaggaactgcagacagtggtgtcaccagaaccatttagacaataatgtgtgtggacgagacatggagaaggcttccatagtcggtgatgctattccaggacaggtgaaactgctcaaactcctgctattccaggacaggtgaaactgctcaaactcctgctattccgggacgggtgaaactgctcaaactcctgctattccaggacagatgaaactcaacttcaactaaaccaatcaatatattcaacacaccaacacacacacaaatttgactccagtcattgataaaatagtaaaaacaatagtttctttcctgttttaaaaggagcttttccctttcattcagttaatttaacagggagtgattccatttttttttgtagtaattcagtttactttattttaaaaaataactcagtgtaccaaatgatttaatgacttcaatgtatcaaaattttattggctcataacctacatctatttcataaaataaggtttgatctaaaatgacccttgggcgtttccaagttaattaattagcaatacttcggaaaggcacaagctatgatgtgaaggctttgagttaatataacaccagttccctatcatatcagcccattcttcaagggctttgcaaagcagcagttctccaaatgcagcccttacgccaggtgccacctggaggttgttagaatttgtagaatgtggggtccccccaaacccctgagtcataaagatgaggaggggaatgcagagtgcagggtaccgcccagaacccctgagtcatagagacaaggaggggaatgcagagtgtggggttcccccccaaaccccaaatcatagagatgaggaggggaatgcagagtgcagggtcccctctaaaccccgagtcacagagacaaggaggggaatgcagagtgcagcgtcccccataaaccccgagtcacagagatgaggaggggaatgcagagtgcagggtcccccctaaaccccgagtcacagagatgaggaggggaatgcagagtgcggggtccccccaaaccccgagtcatagagccaaggaggggaatgcagagtgcagggtccccccaaaccctgagtcatagagccaaggaggggaatgcagagtgcagggtccccccaaaccctgagtcacagagacgaggaggggaatgcagagtgcagggtcccccctaaaccccaagtcaaagagacgaggaggggaatgcagagtgcagggtccccccaaaccctgagtcatagagatgaggaggggaatgcagagtgcagggtccccccaaaccctgagtcatagagacgaggaggggaatgcagagtgcagggtccccccaaaccctgagtcatagagacgagtaggggaatgcagagtgcagggtcccccctaaaccccgagtcacagagacgaggagggggatgcagagtgcagagtccccccaaaccccgagtcacagagatggaggggaatgcagagtaccgggttcccccctaaaccccgagtcacagagacgaggaggggaatgcagagtgcagggtcccccccaaaccccgagtcacagagacgaggaggggaatgcagagtgcagggtcccccctaaaccccgagtcacagagatgaggaggggaatgcagagtaccgggttcccccctaaaccccgagtcacagagatgaggagggaatgcagagtaccaggttccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggagaatgcagtgcagggtcccccctaaaccccgagtcatagagatgaggaggggaatgcagagtactgggttcccccctaaaccccgagtcatagagatgaggaggggaatgcagagtgcggggtctcccccaaaaccccgagtcacagagacgaagagggtgctgatcacatcccaccccagcttccaggtgcttctgacacagctgaaacctgaacccatgactttcagggctgtggcctcccccgcccccgcccacatgtgtccaccagccctgggagtgagtctgaggcagggattctcagggacgctgcctgcatgccccggaggagtagcgtgtgtgtgtgcacacgtgagcttgtgagtgtaggcttgagaccgtgctgccgacccagtccctggaatccctgtgctgagttgttctcatgtggctgctggcccagggaggagcgttacggacaactgttaagtggaaattgtctggacgtaatgcagttcatcagctcaaaagctgtgggtctggctgtgtgagccaacagcgctagtgtcctggtgcctggacacacggatgttctggggctgttgctgaaactgcggcacagtaagccctgcagcctccctggaatccctgaggaggagccggctcacccagcgccgcgagcatctcttcctgactcgcagggggcccgtgagatggagaatctgcctgacagggtgcacttgcacagccaagcaccaagaaggaaaatggcatttcattagccatggagacagccgggaacccagcagccttctttattctggctcatattttctcatcattctcagggagttgtccaggtaacaatgaccttgtgtaaaccagcgtccctgcctgagtcctcttcacctgaaaccaccgccccacgccaggctccacctccccacgccaggctccaccccccacgccaggctccaccccatcccacgccaggctccaccccatcccacgccaggctccaccccatcccacgccaggctccacccaatcccacgccaggctccaccccccacgccaggctccacccccccacgccaggctccaccccatcccacgccaggctccacgccaggctccaccccccccacgccaggctccaccccatcccacgccaggctccacccaagccagcggcaccggttctggctggaaggttcccaaacctaggccagggtgtgaatgccaggggccctgtgagtggtgagtgatggttgctgggtgctgggggctggcgctgttcccgccgcgccctccatgaagctgactctcagtcctgctctctgacaccgggctgtgctcagcagccacgagctgaccacgcggtgaggctgttcacttttctccctgactccagctctccccacatgcagctcatccccgacatgggctcttatcccaccaaccgcttctaaagacctgcagaagctccctagtcacaggacgtggcgagcccaatactcacgtctgcccctgacttctgcactaggccctgcctcagccactggcctcctgcccctcactgtcggcctcaggcccaggctctctgtgtagaggcctcctggcttccccaccccgtgctgctccccacccggtgctactcccctggctgagcgcccacacttctttccccttttccaaatcccacctgcaggtggtggtctctagcactcctcttggttcatgggccttgactgacagctttctcctgcagccatcctctccacaattctgggagcgtcgactgtgctcactcaacactccctttaacaaagtgacatcagatgtttgggccctacttgcatttaagccatccagtgcattccacataaaaagcgtgcacctggaggaaactaaataatcacaaccaatcactctttttttagaaaaaagcagcagctctctcaatgtagaccaatttatcggtctaaactagagagaccgggcaagccacttccatcttgcgagtttagcatatttgcctgttgacacctacacttggaggaagccattctgtgtgtgtggtgtgccttcacaagtaatttctatggaaaacagccgtcagacagtcatcctggcccaaggtgacctcattaccagaatttgttctagttgtcattagacatatcacactatgtcactcaaaatgggaaagaaagagaagatactgacatgccgccccagtgattagagatgaaaatgtagttataccatatatgatccctgcttggagactatacggatagggtttaagattcaggcccccctcagatccatcactgtggtcctgaagcctctgtccttcttctgttcttttaaacttctctgtgtagatacagcaagtgtgttttctactcactgcacagccagcgctgctcttgaacaaactcctgagggaggtgcacggaaaccatgcatccaaatccggagagcagggagaccagccggatagcccacctggctgacgagacccggcctcgctcagaaagctcctccaagatgccaccgcgtgtgaaatgcttggggttgaatctcgagagcagggagaccagccagacagcccacctggctgacgagacccggcctcgcttagaaagctcctccaagatgccaccgcatgtgaaatgcttggggttgaaatgtaacgaatctctcactactgacaagagaaaggccagaacacaaacacacttcctgcttccagatggatggaggtgggaggagggaggggttctgaccatcttctctggtgctcagtgaggcaatagcatgagatagataccctcatctacagccccgctctcgtatgtccgggggaagctatggagagggtgctgcaaagctgccagcaagtatgtctgcctctgacgagtcactgttggatgtgaggcaacgtgaaggctccaccactaggacccaggcaagactgccaagcggatgaggcttcgctttaggaccatggactctggcggcagataatggcctgagaggtcagctagtccaattgcttccttgtagacacgcagaaactgacgcccagagaggcagggcaccccgtgtgtggtcaccgtggtcagtggcagaggtggggctggaggtcagaactggctgcatccgtctccatctccccaagcacaggccatgcctgcctctcccaggtggcatctcctctctgtggtcctttccctcctgcctgcctttctgcgacatctgcactattcagacatcacgcttcctttcgtcctcactcaaaattcccattcactcagcattaccacggtttgatattaggactgcttgattcaagccaatagtgctaaattagaaataatgaaggcttcactcttccacggggttctgcccttggaagaactaatgaaacccaaggaccatccagttggcaggactggaagtaactgggcagaggagacattttggagcaggtggtcggtgcccacccactgacaggagctgccggtttctgacccactccacccctcctccaggaccctccagagtgaatctggagcgagggggcccagtgactttggggtcatttgcacggtatcagctatagccgcagtgagagggaggctgctggacacgctggggttcacctgtgtcccaggagaaccccgctttaggatataacgggttcatgcactggagtagctgccggtacacatctagggagtgatgatccccctccaccagccagtggggaatgagcccgtgaaggtcacagccagccatgaaacagctgcactgccccagcacgccgcccacgcttggtcggcaacacagagattccatttcttcctgggattaggaagcacgaagtgtccagatctgcttctgaaatctcttcctcccttaaggtaaggtgctgtgtggagcttactggaacctaaacgggggcaagatgaccggtcactaaagggggcgaggttaccagtcactaaagggaaagggggcgtgatgaccagtcactagtgggggtgagacaaccggtcactaacgggggcaatatgacccctcactaatggggtgatcggtcactaaacggggtgagatgacaggtcattaatgggggcgtagtgtccggtcactaatagggtgtgatgacctgtcagtcattatctcttgcataagagacttcccaggggcagagcagacccggtggacagcaggagctgcctggtcccactgctgagttttatgtctggatgctgaatagctggaggaagcggcctgctggttttgttcacactgggtgaacagttggaatacaggttcctcgggcctgtcctaaatgctatcagtctttctctagagatggggcagttattatgcagtgtgggatccacagttacagagcggatgggggactaagaacatccattctgcagaaagtgggacattcagggcaatagggaatctgcttttcaatgcagcatcccagtggggtggccccatcacttctgacacctccatcactgatgcccccagctctccccacacctgccattccccacgttaatgcagcagggatccagagaagggtctccggacatcactgatgcccccagctctccccacacctgccattccctgcgttactgcagcagggatccagagaacactgtccggacatgcaggggaccggagtcctcaccactcccccttttgtcttctccaagccagggtcaaagctgcctcatgcagacggagaggagaagctgcgttccctgcctttcccgaattgtttgtggactgtgagtgatgcatgtcctgtggcaccatgggagcaccagggaacaccatgctgtctctccccggagcccccactggcgtcctggccatttccagcttgtctcccaaagacaggcttctttgtgctttggtcacacggagaattatcagtgcagtctctgtctctctctctcatttccccctaaattgccacatgttgcaactcccaggcgtgcccccagctctcctgaggctggtttgcagtggccgggcccagctaaagcaactgaacctccagagcagaggacagtgtcctgcctgcacgtcttgacatggccccacaggagggttccctgtctttcacgtgctgatagaccaaacacaccaaacgcattcccgggcaggtgtgtacatcagaacagtgatgaatcagggacccttcttagtgctactataagtaacaacagtgagtcagacgggtgcaaaccctttggaagactcagtctgcaagccccagggagcacaggggggctggagggaaccgggggagggatgcacaggcgagaaatgcccatgacccggtccacaggtcatgcacgtccacactttctaaaaaaccacctacaagaaaggggttgtttcctggcccccagtggggtgcagaatgtcagtgctgggctgcaccctgggcagggctgctctgggcagcatcgccacacccgtgtcccattcttggggtgcatccccttctcacatctgtgtctaaagccaggaatgggcagtgtgacctgaggaaaatcagggacaccctctgtgtcctcatatgcaaacatgtctctttcatgccagttaaatgaagaaaaaggcaagacctaaatcctgaactcctaccgctataacacattcctctgcgctaaggaactgacattctaaaggtgcagatacccccgggctggaggctgaatgggcaagaagatcccggcacagctcaggctgagtcgaaagaccgtggtttttggccaggcacagtggttcatgcctgtaatcccagcactttgggaggctgaggcaggcagatcacttaagcccaggagtttgagaccagcctgggcaacatggtgaaactctgtctctactaaaaatataaaagttaagctaggcgtggtggcgcatgcctgcagtcccagctactcgagaggctgaggtgggaggatcgcctgagcccaggaggtctaagctgcagtgagccgagattgcactactgcactccagcctgggtgacagagcaagaccacaccttagaaaaaagaaaagaaaagagaaaaagaaaagaaagaaagacagcggttttcataagggggtaagactcagagggcagaagaaagcggagtcttgtggggggcaccatctgtggctgggtcggagggacgagggctgctgtagccctttcctttctgcaccgctctgaccaagtgcgtctaaggggtggagggatgaggggggtgggtgccttcgtggctgcttagccatgattctgctggacaccatggtctgggggaggcagcgggggcgggtgccacctcaccttcgggtacctgacgggccggaatgacacatccttgtcatgtccaccccacttcacagatgggaaaccggggctcaggtaactcaagggaagcagcattgagaggtcagggcaggccttctgcccaatcccccgcctgctggctgtgttccttccacactcggccaaggtctctgcccccgcatcccaccccgccctgcccagggctgcgctgacctgccttctccccctcctcctcattagctgcaaagaaaactcttctgggggctgccaaatgcagagctgcttcgtgtcccttctttgacagtaaaagttgttttcttggaaataaatcaaatttgtatttctcaacaaaacctgccctccatccctctatgaagaaaaatgcaagttgctcttctgcgctccaaatacaccgagacgaaaacaagcccaggtgaagctgcagctggggacacgagttaatgtgagtgcgagcccagggcagagcgggcccagataaataattcatgagcgccaccggggaagaccgggcactcgtggagttcaacagatcataagcaggatccagggtcgtgtagcgacacagcttcccaagcaggcgagtgacctggagcacagaggggagggacggggacaggtgcagcagagattgggcacgggccaggaatgcatcacggcacctgcgcacaggggtggcctccaggggctccaagtcctctgggatccaggttctccttccttcagggcacccccacccaccctctccccaaggcttgggccacactccatgccaccatgcccaacggtccccgccctgcacccacctctggcaagttctgggcagggggagagcgacacaaggcaagggaggagacatcggtggatgggggagcagggcaggctgggggtcagggctcagggcggtgctgacagtaggacatgctggtccccttcccagtgaagtcccaggaaacagcctctcatgttgctgggccggtgctcaggagctggggctgcctggggcacaaagcacgtggactaggacactggaatgtcaccgagcttccctccgatacagtgggagggaggacttggcgcacagtgggtgagtgaatggacaggcaggagtgaccagcccagtcccagcgcttaccgaggaggactggggaggggggccgagtctccagtcaggcagagagagctgctggtgtcaaccctgccagcaagatgtgccccagatccccagagtccagcgaacttccctggccctggccagagtccacgtctgactctgaaggtgtgcggggtgtggacatgagggcactgctcatctccactgccaggctttggggtgtggatgcaggggcactgctatctccactgccagggctgctggatatgctccagcctgtcacaagccaaggcgaccgagcttccctgagaggcacccagcctgatgcagcacagggcaacaggctggggcatgacgggctctgctgtttctcagtctccctgtgatgggagtcgcaatcccatcctcggagggtggctaaggggatccccaagaaagtacccggacaattcctgccacagagacactttaaaaagggcaatggccggcatttctgaggtttccttttcctaaccaggaacagattctctttgacaaatgggtcttgccacttgttatgaacccaatgccgtgggcccggcctgcacttcctggtggagtcctggccccacccagctcctctacacgtcctcttcactgaaggaaactcacagagccctggtggcaccgggtgctgcccgtgcagggcacagaaactcagggccggtttccctctggctgagggagggtgagggagggcgagggagggcggacctgtttcctgttaaaccctggagctagcacagacttgcagcctgcctgggacccagtgaggatctgtggagatgggctacagggagtgttggggtgagagctgcacggggctgttctcagcagatcccagcaagtgacacacccaaggctggggacccaggacaaggccaagggcacctaagcaccaagcaagagtgagattagaccctcccagaagtgatgcacccaaggctggggacccaggacgaggccaagggcacctaagcgctgagcaggagtgagatcagaccctcccggggctcaaaaaaggctcccagcatcggtcacagcccgtgcccctcgcaggcctgcatgacagtcagggcctccatcaccatcaggccagcacaggcacagcccagacatgcaggaggctccagccagtatttgagaacagacgcctgagtgccgggactcggcccacagcccattcgcccagggagactggtggtccccatgtgccacccgagctgtcaggcactcagtatgtttttaaagcctcactttttaattatatcatctaatacatggaaaattgtgtatcactactgtaaatgaaaagcagaatcattgctgtgagaaggccaccctaaaggtgagttccatgaaaacaaaacacccaaattttgttcatttaaacgtgatcaaagactgcatggcgacacgttctctggaaagaggggctgctcatggccccgagtctctcgctctccaggatgagttgggagtggaatcgccatggccacggagtcccttgcagcctctgagcttctgcctgtgggaagagctggcaggttgggggaccggccacacggtctgtactgagtgggtctctcagcaccacctcattctaacaggagggctcctgaaatcagcgccttatggtgctaaggttttaataacacattagaatacacagaactaaataaaaataaaacaaaacaaaataaaacacaaaagctgtagaggattttctgctctggaaaacaccagtgcacacaagcctttatctgggggtcccctggaggggttggggtggcccaacagagagcagggagcagaggcagatgtggggggtcacactccaccaggagcccccaggcaccgtggccacaggacagccgagcttgtggactgtcctccagagtccagctggaatcactgcccacgcctaaatctaagaagaagtatgcgatgggaagaccttttggctccttctgctcaggaagcatagacagtatcttcagttttgcccacgcaggccccttgaaggggacacacagacgccaggagacagacgcgtggcggccgggtcactcccagtggggagctgtggtttgggcgcctgagcctggagcccccgtcttactgggaggtgttcccttatgacggagcccacggggtctgcccaggtcacagtcccctcccacaggccacgcttcaggaggatcatcgcaggtgggtggcctctattgaggtgtgagctgcaactttccattttctgatcacgagctctaactcattttcccacaacatattatgggcggctcataagattttctatcaaaacgtaaatagattcggatttctctgaagagcaggtttcctatatcggtgcgtacctgtccgtgttcacattaagaccaaggacaaaagaggaaaatagattttttcctaggttgtatgactttatgaaattaaaaaaaaaaaccacctaagcagccctgagcctccgcaaaaaaagaccccacggggacatcccgtacctggtcagagccaggacataccccatgtgcttttttttcctcccctttcagaaatgtaatttccatgacgcgtccacccagggccaggaaccacagaagagaaagagcagtgggaagcttccagaaactcccatgagggctcaggaaacatggggaggtggcgatcggaatcatctgccaggcctggagagccagaggtcggccagccgggaggtgtcctgtccctgagtccccgccctggctccactttcatgcaagagaggggcagggtgggccacagagctaggtcctggagagccacccccaacccagcacgggtccaggacagcaggaagaacccatcctaggtcggaagttcaaatctctgatttgagatgagtgttgaccctacgggggttgaaggcctctctggagagcgtcgattgagcagacaggcccagagctggacgatctctccctaaaatgccaatggcctcggaagacaaaacccaaggggggtcagtggccccccatgcactgagctcactgggtctccctgcgcccgtgtctggagtcatacacaatgctgttattttactgcctaatttcaaaatgcacggctgcagtttacaccctgagctgtggcttgaataatttatcgcaaagtccctgtgtcagtgaccagtgtgttgggtgttgctttgaaacccacagagaagacctaatgtatcacgttgttttcctcctctttaaatattattgacacagcgatacttcactacaggccattaatactggtctgcttctagaggagaaaataccgatgcaggtcagggcaggtgactcgctctgagccacttaacactgggtggcaatggtaacccgccactgcttcctttttaatttaatccacgaagcagcacagcaaagtttcctcatatttctcctcttaaagctgacagaaaataaccagcagaaaacaaacaacacatcttagggaagggaatttagacaaggacagagaccagggagcgagaggaagatgcctgtgtttcccacagtcattgggatgaatctgaggcagcgttagagcgagcgccttccactttggcccacagctccttgttcctaaaatcagcaccgcatccccagcttacagctccttgttcctaaaatcagcaccgcgtccccagcttacaactccttgttcctaaatcaatgccgcgtccccagcttacaactcctggttcctaaaatcaacgccgtgtccccagcttacagctccttgttcctaaaatcaacgccgcgtccccagcttacagctccttgttcctaaaatcaacgccgtgtccccagcttacaactccttgttcctaaatcaacgctgcgtccccagcttacaactccttgttcctaaatcaacgccgtgtccccagcttacagctccttgttcctaaaatcaacgccgcgtccccagcttacagctccttgttcctaaaatcaacgccgtgtccccagcttacaactccttgttcctaaatcaacgctgcgtccccagcttacaactccttgttcctaaatcaacgccgtgtccccagcttacaactcctggttcctaaaatcaacgccgtgtccccagcttacagctccttgttcctaaaattcaacgccgtgtccccagcttacagctcctttgttcctaaaatcaatgccacgtccccagcttacaactccttgttcctaaatcaacgctgcgtccccagcttacaactccttgttcctaaatcaacgccacgtccccagcttacaactccttgttctaaaatcaacgctgtgtccacagcttacaactccttgttcctaaatcaacgctgcatccccagcttacaactccttgttcctaaaatcaacgccgcatccccagcttatagctccttgttcctaaatcaatgccacgtccccagcttacagctccttgttcctaaatcaacactgtgtccccagcttacaaacgctgtgtcacactctacggtttctatctggttttattttcatccaactctctccaggcctgcctgtcactcagggagagatctcaccagtccagccacatctgggagataaaaatgcccaattcaatgagcatttgttaaacacaccccaaggtttgttgccatgaattgtaaattcctggaaggcagcaaacctgcagtcttagagtaggatggggcctttcagcccctgaacgtgcatctgggtgtggaccaagggcttgccagccccgcaaagggcatgggcagcctgctttgcctcagcgtccacatgagcaggcggcgtagcacctcctgtcagaggggaggatccacgtgtgcatgtggaggtgcagaaggaggggtcatccatggaaatctgacttctacggcaaactcaagtttaagcaaaagtagactacccttcggaaatgcacactggaacgatagcaaaacatgaaatcgacgtaagtgtccatcagtggatgaatggataaagaaaacgtggtgtgtccacacaatggaatactactcagctatgaaaaaggatgaagttctgtctgttgcgcacaatggaatactattcagccataaaaaaggatgaagtcctgtctgttgcacacaatggaatactattcagccataaaaaaggatgaagtcctgtcttttgcacacaatggaatactattcagccataaaaaaggatgaaatcctgtcttttgcagcaacatggatggaactggagccattatcttgagtgaaacaatgcagaatcagaaagtcaaatactgcacattcacacatttaagtgggagccaaattacatgcgtgcatggatgtagcacatgggacaatggacgctgcagacccgggacgctgggaagggagaggagggtgagaattcgccgctcgggcccatctatgttattcagtgatggctacactcaaagcccagacttcaccactacacaacagatccacgtagtaagaccgcacttggaccccaaacattcatacagtaacaaatattactaagagaacctactggtcagatagatctttgctttcctgccagtcagtgccaggggagctttggtctctcacacggcttagagcccttccttccaaggcgggcagctcctgcgtgcacatgggggctcccaccaccccgagggccggtcccccatgcctgttggagggtggtgtgggtttgctctggctggtgtggacaagcccttaactgagaacagggtcaggggaccttctagctttcttctctagctttcttcgtctctagcttttctttttttaaggcatttattgctcctgaaaataatctgtgcttgcaaagaaaaaaagtcattttgtttcaaatccagtgataaagaatggatcttttcttctcctagcaaaccattttcccttgccccaggggaccatgtatgacctgagccatcttcccccacgccaggccctcaggagacccaacctccctgacacatcctaggcccggggcgggtgtggggaggcacgagcttctctggaaaccagcagctgtcgcctgcttgcccatctgtcaccaagctctaagtcctgctgtctgctcaacaggcatgaggagcagtcccacagtgcaatgaggccggcacgggggcccagggagggctcggccccaggtcccctgacgtggggtgtctgccctccccaggaggacggggttgggggcacatctgatggggcctgggtcatgcctgccagttctgcacagagctgcctcctgagtgcccacgtgccctgcggggctgcctggcggctccatttgctctgtgtctgtggagcaactgcgcccctgggcccgcctggcctgggctcccactgaggtcacagcacctgggtcattcagctccaaggatggggcaggccccacagggcaggaccccctccagcagttcctgcctgtcctgggaaggccacggagacagacccttgacttcaggacagggggctgctctttccataaatccccctggctggcgcctggagcccaggttcctcccacacagccagtcattcctgccatccacactggccctgcaagggctggaagggccacaggtgggcctcactcaagagggaaggaccagggaggagaagggagccacattagcctggctgggtgggcaaagccacgtcagcagccagaatgtccctgcagataaacgtggggggaggcatgacagaaagccgggtttctacagaaagaggaggccagggaggggcagagcctggggggaggagtgcagggaggggcaggcagagaccagtgggtcatagggaccctgtggagcccccagaccagcccctgcacagaggagaggaatgtggggccggaggaatggagtgcaggggagatgagtgcacgggagaggagtgcaggggagtggagtgcagggctgggggagagtagtgcaggggagagtagtgcagggcagggggagaggagtgtggggctgggggagaggagtgcaggggagaggagtgcagggaggtggggagaggagtgtggggctgggggagaggagtgcaggggagaggagtgcagaggagaggagtgcagggtggggggagaggagtgcagggtggggggagaggagtgcagggtggggggagaggagtgcaggggagaggagtacagggcgagggggagaggagtgtggggctgggggagaggaatgcagggcccgggaaaaggactgcagggccaagggagaggcccagggcccgggctgcagcctggcttcagcttttacccggcagcctcagagctctacttttaattaagtgccttaccaaataattaatttgtactcctctgtggaataggaaaagagccatgaaataattaaagaattaaaacactagctcagagccaggagcagcagtcagggctggcccggaggctcctgggctctgaccacgccatccatccgctgaggacagcagaccacctgcgtgagacgcggaggagcagcagctctgccgtgagaggagcccgtgtccagcctccaacgtagatgctgtgttggacagagtctaaatgtagaccgaataagctacctcacatttcaagctcagtaaatgtaatgtttaatcacacctgtaatcccagcactttaggaggccgaggcaagtggatcacctgaagtcaggagatcgagaccatcctggccaacatggtgaaaccccatctctactaaaaatacaaaaattagctgggtgtgttggcaggcacctgcaatcccagctactcgggatgctgtggcaggcaaatacttgaatctgggaggtggagcttgcagtgagcagagattgcaccactgcactctagcctgggtgacagatactccatctcaaaaaaaaaaaaaaaaaaaactctacttcaagttgtaattctgagattttgaagcacgtttggctggactccatccttcatgccccacgtaagagggttgtgttctgggtagagaagtcatctttgtgcggggtgcgaggcatccgggggccaggggactgtgagctgcagcaacagtgacccctacagtgctgacagtgtggggcggtcccgggtccgatcctggctgttcctccgagcggccgtaggggtccgccctggcccctacactatgcccaccaagaggacctcctgtaaacgtgagcctcatgccagagaacccacagccagcccctcacacccctgcactgaccggcttttatttccagcctaaaagaagagaaggcagatttagttgcctgaacacaaaccctccttctccctcgctcaagccatcagggggttctagtcggcttgtccactctcatctcctttaaataaacagcaaaaccgttttcacaactcagctcccaatgtgaaattagtttcatggtgactgagcaccgtgtgctgcccgaatttctcaccaacctcagacgctctcgttttcacgtgccacggagctacacaaagataaagcagcccaataaagacccggctgaaggcttttgtgttctctcactcttgcccacttaccctgcgttttccaccaacacaggcaggggaaagcttggcctgggaacctgagttctgggacctgctccctggctggacttgctggcacccaccggagatgaggcctccaggaaacctgtcatcgggagactcgtccacacgacgagaccagggggaagaggtgctgtctgcagctgttctccgcgagtccctggcccacctgataacgagttccgtaactggaaacatcaaggtgggggtgtgggtctgagacttcactgcactttattaaatctcagccactcaaaggtggggtgcagactggggttcgcagctccgacataccacacttgatctcagatgtttacctgatgaactttggcctctggtttttatttttactttttttttttatttttcattattattttttgagtcagagtctcactgtgtcacccaggctggagtgcaatggcaggatctcagctcactgcaacctccacctcccaggttcaagtgattctgatgcctcagcctcgcgagaagctgggattacaggtgagtgccaccatgcccggctaatttctgtatttttagtagggatggggcttcaccatgttggccaggctggtcttgaactcctgacctcaaatgatccacccgccttggcctcccgaagtgctgggattacaggcatgagtcaccttgcccaacctagtttttatttttttaattaactgcttgcctcactaataaaacttctcttttgccaaaggatgcttctcaggttgcattccccagtcaggggaataaccagaggattaaaacaaaaggttaaagtgatcacttcaaaaacaattgccaaggcccgtaagagaagggtttaaaagccccagggccatgcttggtttcaggccagagggttctcagctggaatcacccaacacgtgaaagccgtggagaggccgggatgaaagcacctggtcaccactaacgccctgcacacctttccttcttcctcctcctctttatttcttaacaggaagctgcctgacatttcggctttgaggtctactgggaagcatgactgaagttggggtgcagggtgggggctggtgtccggccgcaggtggggagcagggtggggctggggtcgggccgcaggtggggagcagggtgggggctggtgtccggccgcaggtggggtgcagggtgggggctggggtttggccgcaggtggggtgcagggtgggggctggggtttggccgcaggtggggagcagggtggggctggtgtctggccgcaggtggggtgcagggtgggggctggggtttggccgcaggtggggtgcagggtgggggctggggtttggccgcaggtggggagcagggtggggctggtgtctggccgcaagtggggtgcagggtgggggctggggtttggccgcaggtggggtgcagggtgggggctggggtttggccgcaggtggggagcagggtggggctggtgtctggccacaggtggggtgcagggtggggggtggggtttggccgcaggtggggtgcatggtgggggctggggtttgaccgcaggtggggagcagggtggggctggtgtctggccgcaggtggggtgcagggtgggggctggggtttggccgcaggtggggtgcaaggtggggctggggtttggccgcaggtctggtgcaacgtggggctggggtcgggccgcaggcggggtgaagggtgggggctgggatctggccgtaggtggggtacagggtggggctgaggttcggccacaggtagagagcagagggccttctcccacaggcctgctcttggctgtgcatgtcacagaggggaccacactccacactcacagcaacccagaggtagagttcacgtgcaaagaatgggaagctggagccttaaataatttgcctaagttcaggcagcagcaaaagccagagccagaatctggaagcaggtacagctgattccaaacctacctcctatacccatgacccctcaggaccacagggcctgagtccacggctggggacgtgcacagcagggggacctgaggaccgggagggcggcacttcagcctcacgggcgctcccaccatgcagacagacgcaggcagtgtagtagatggtaaaacggccgaaaaccatcagcagcctcaggaccgccctgtcatgatgccaactcccaatccgtgctgagagcccggcactgcctcagggagattagcaaacacttttcatctgtttatacacaaacagcaggcatgggcccgctggccttccaggaacatgagtctgcgtgactggctgttgtgccctcacccggaaccgtgccaggcaccgaggaggtgctcagtaaactatggggttgcatcgtatttgaggtcatccggaggcacccgctgctgcactgggactcctggagatcctcctccagccggaagctggccaagctgtctccaggtcctgggatcacgttgtttcagtggagacgatggccgccagcttcagattcagaaatggcacttagtgcctcttcccttggagtcacctcgggtgacatggggtggcccccatggccagcactgaccagctctgccccccaccgaggcgggagccacatctcaccaccaaatgcccttttatgggaactgaggtgcaaagcgggggcttgaggcaagcagcccccgcgggaaacacggcgtggtcatcaggcgagtgctgccttagagacccgccccctgcagaggctgtgctctggatggtcactcactcacccctttattaagagttggttctacggaggatgagagaggcagggacgtgttttgggagaaggtcatatgaaaaattagtgccacagagtttcggcccctaaaaagcttccagtttcacggtgaggggaaatgttgtaaactaaaacctctggtggggagagtcacttttgttgcccgaatccccagtacagtggacggcgcctcgtgagccggatggcaacctggccagcatgcagtgaaggaacaacggggccaaatgccgcaggtgtggatgagggagaaaacaaaagctcccactgcgcccctccctccctggagcttagggttcatctgaggggtgaagaggaggatgtgaaggacaccacgggggtcagggagcctgggaaatgtccaggaatcctggggccggggcctgctccctggaagcagatctgaggacgtttcgggcaggtcagctgcagcgagagaaatggacttgccggggaggaactcccggctgcctcaaagctcagcaggtccacggagcaggagccacacaaggctcttcaacaagccccgtgaggtggggagctggcctggaccaccctggcgtggacacggctgggctggatctcatctgtggaactcctggcaggagatggagtgccctggtcctggccggggtttggcagcacaagtgggggtctgctacaggccgcttggatccaggggaggaggaaagagcacaggagagggcaggagatgtttggcttctgtcatgagctgacctgtgtcccccaaaatccacaggggaagccctgaaccctcatgtgactgtacttggggacagggcctctaaagaggtaaaggtaaggccgggcgcggtggctcacgcctgtaatcccagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcgcgccactgcactccaacctgggagacacagcgagactccgtctcaaaaaaaaaaaaaaaaaaaaatgaggtcctgagggggccccaatccaataggacctgtgttcttcaggaagaggaagagacacacagcctgcatctacacagaaggacagcccctgaggacgtggccacgacgcagccaccgtgagccagggaatgcggccccaggaacaagccctgcccacaggcgtcccagacccaggccttggggactgcagaggatggatgtctgccccacctgtggggcttcaccgtggccacccgagctgactgacaggggtggggaagcacgccatccgggctccagccctgcggttggcgggatccaggtttcttggtggtggcgagcttctcacatgggcttggcggcacctcccaacacgccaaggccagtggtaaaacgggcctctgctttttttaaagaatagcttgtctaatgactctgagagcatctattaatttcatcactgttgccgacttaatcagcaaacttcatttacaattccacaagctacgaaaaatcatttgctactgtcatagcagtataggaaacgtgtcagcaccttgggagcctggccagtgtttcatttcactgagttccagaagactccggctctcggatgggagcagcccccatggctgcttttcggctcctcgtttggaaaacttggtgactctctaaggtgataggaaaagcaaaaattgctctgttaatgcttccagtgcccaatttgggagtaaagaatgggttttatcaccaaaaagaagacttcacatgatgtttctgcctgagagaagtaggcagggtctaggggccatcctagcctcctcccatcccagaggatgagagagggaaccgcccacttcctgtgtggccccaggactcagagctaccctcaatggcacccgaattttattcctaacccctcccagatgcttcctgtgtgtccacagctgggtggtggttctagttttaggttttttatatttaaaaaaccagcagattaaaaaattaaccagcatctatttttaaagaactgcatgcattcctttgctataaataacaccttagtggactctaaaaaaagtaattcaaaacaatcctttttcactgggtttgctgcttgtttacattatatttctctgagataacagaaagaggcacatcttatcactttcctgacagtttcattttcaggatctgataatgctatgtgtgcttatatggaaaatattgatcccactatactctgctcttcctaaatttttcattttttaaaaaattcatgacagtatttgattcccagaggttttacaaaccatctccttcaagcaaatgcatgtaaatttcacttctgtgactctgagttcatttttaaagaatggttttagaaaatcttcttctactttgccaaatttcatctttaaaatgcttgtttctgttcctctcatgataatggtaatgtttatgatggctgattttaaaacctcttagggtatgaagtgtgttgtagaaatgctaaatgctaatagatacataaacagtaagatggaagcgggagaaacacacacctccccctttcctcacaagcctcagcatttccggcttgagaaaatcggcctggcacccatgaagtacctgcggtctgagctgtgtggccactatttttttttttttttcgagacggagtcttgctcttgttgcccaggctggagtgcaatggtgtgatctcggctcaccacaacctccacctcctggattcaagcaattctcctgcctcagtctgccgagtagctgggattacaggcgtgagccaccacacttggcgaattttgtatttttagtagagatggggtttctccatgttggtcaggctggtctcgaactcccgacctcatgtgatccgctcaactcagcctcccaaagtgctgggattacaggcgtgagccaccgcacccagtcgtggtcactcttaaggtgggtgcagcttatggtggcgaatatggaaaggttactattggctttcgctgatttctttaaaaaaaaatgcaaagagaaaggtcactaagcaaaagacctaagctggtttggaattcactaatctaacactggctagagtttaaaaagtaggggctagtaaagcccacttgatatgcacaaaataagattagctgcagcgttttgctgtccacgttgtcttagagagctggaagatggggtgcagggggaggtgcagggcaggaagcatctgcggtgaggcctctggtcagtcactgcacagctggagaaggctcaggtggtgctcgtggcccacgaggggttctccccagaagagacaggaagggcccaccgtggtttcccacagcaatgtcctcatgcacgctgaggcacacatcttacgtggatgctgttagtattcagtacactgcgtctaaaatgcacgtgtgtgcaaatgcgtgtctctagtgcactcagagtgggaagtctgcacggctccttttaactctatgggatcatgaaggaaagtaaaaccttagaggctgaggggtttctgcctgcatctgaatttctttggaatgctcatgtcaaatctgatggaaaggtggtactagcagcagccactgcccaaataaacatgttcaaagctccttttcaccaaggcttctgctgtgaacctctcccttcttggggcacctgctgccccttcctcctgcctctcctggggcagcacaggcacctgcaaccaacttacggagttttgcagatgtgacaccctaagaaagcagccaacactgtgttcctcgtggaattactgagttcacatcccttttcctttttagagagacagatcctataggcagcatgaatggaaatgcaaagactccatcgatttttaccaacttttccaaggaaagtccaaatcatgtttgctcctccatggtggtacagttcagtgccagcctggtctggccctggagccttcttttggcatccagaacatctccctgacaacccagaaacacagctgacctcctgccatcctgagcctcacaagcttgctggacacctgcggtgagtcccagcaagggtgagtcccagcgccaggcaaagatctggcgagggaagagccgcccgggatgcagacacacttatcactcacttgccatttccacaacctcatttctttgcagctgtggacggcaatggcttccttaagggccatcccacccctatggagatagatgccagggcttgggagccacctggtgtggctgtgcacgctgagtgtccttgtcactcagaggaaggtaggcccagggtcccttaggccaagagacttgtttgggtctgactggggccaccctggctgtacccacatttccaaaagtaaacctgtaacgcatcatgtctcaaagacaggaaaccccatggacaccccagctccatcatgcggtcatgacattttggaccaggagggcctcctgtgtggtcctctggcgggaagcctgctagtctccctagggctgccctaacaagcctcacagcctgagcggctcaaacaacagaaatgtactccgtcacagttctgggggctgaagtctgaggtccgggcttcggtttctcctgagactgcgcaggctggcgggcggccgtctcctcctgtgtcctcacgtggcttcttctccagtgtctcttctttcaaggacaccagtcctgctggagccaggcccaccccacgacctcacataacctcaatcgcctcctgaaagacactttctccaaatacagtcgccttatgcggccccgggtgttggcgcttcccaggtgaacttggggaacacacgtcagcccatcccaggtggagctgcggcagtgcggggtgtggctggtgctgggggtgggcaggaagggtaagcaggggacgagggatcagaggcaggaggtgtcctggccctaacatttcctttgcttctcgtaaacctcacctgagcccacccaacaccaaggccacatcaaggagagaggacaaggggagagtgatcacagggtgtgacagtgatggaggggacccagacgcagggactacggagggcagtggggcctcacagggcacctcccacagggagcagagagcggacgatggccggtggtgatgagatgtggccctgctgtggaggaagcgccaggtgcatctgatgaaggcatgaagacacagaaggggacaggaaggggctagaaagaaaagtatcacagtcagcctggtccctatgctgtgtgcacgtgcatgtgtgtgtatgtatctgggtgtgtgcattgcatgtgtgtgagggtgtgtgtggctgtgctatgtgtgagggtgtgctgtgtgtggctgtgtgtgggtgggtgtgctgtatgtgtgtgggtatatacatgtgggggtgtgtgggtgtgtgtgtgctgcatgtgtgtggatgcatgcatgtgcacgtgtgtgtatgtatctggttgtgtgcattgcacgtgtgtgagggtgtgtgtggctgtgctgtgtgtgggggtgtgggtgtgtaggtgggtgtgctttgtgtatatgtggggtatgtacttgtgcacgtgtgagtgtgtgtgctgtgtgtgggggtgtgggtgtgtgtggaggtgtgctgtgtgtgggtgtgctgtgtgtgggtgtgggtgtgctgtgtgtgggggtgtgctgtgtgtgtgggtgtgtacatgtacacatgtgtgagtgtgtgtgggtgtgctgtgtgtggggtgtgcattgcacgtgtatgtgtgtgggcatgtgcatacacactgcctgatgggttctgaggaatgaacggatccatgaatcaatgattacacccaccaaaatttctactgattgcatgatgggaaaatatggaataattgcccattcttattttcattttcaggagaaagaaaacaggagtgagacaccaaaacgcagggctttgtttacagagaaggccgcgggggctccccgccaggtctgtgcatttcaactcagttctgtccttcctcataaacagatgaacctgtcccgcgcgcgtggtggcggcttacacggcggaaacaccctcaggtgctttctcactatcaaagagcagcttagcatttatttcatatttttgtcttccactgattcttatttattttacaaattgcacctgaacaataaaggaagtcattccaaaagcagcagcctgccccccaccagcaggcagcagtgacgtgtctccatggggccttaaaccttcagggccacgttgtgatttatcttcacacagcgcttggcgcatgcgggcctctaacgaatgtttagaatttcagtgactctagtatcaccgttttctttctatcttctcttccacgcacgtgtctgtctttctcatggtctagtcattgtaagtttgttttttaaaaagttttactaagtacatatgctactaaatgtggtgagtaaatgtttactgttcaattttatcacgttgatatactcagacttcttctgaaatgagacacaggctttctcctttcacctttgtttccaagatgctcttcctgcctctagctccccgcactccctgcacttccccgaggtcactgcactcacagagcttcctatgtgatcagttccaccaggcatagcaggaattcttctcatttgtccaaacgaacagagccccaggaggccccacctggtgcccgtgaccgaccccctcagtgaacctgcaaaggttcccatgcacaaggcgacgcttcagacatttcaccatctcactctccaggtcggacttgaaaacgctctgatcaatgatcaaatctgcttccacccaattcaaatgcaagcagttctgaggcacgattatacacaatacgtgctatttattaaccgtcaccactcagctaggttctttgccaagaatttcccaaaagaagtcttcattctacatagcaacttgttcttatccatgggaaagatagtgtcttattttaaatgcaaatgaagccgattcagcatgtacaagcagaacccgcaaatgagagaaatgttggtatatgtgatttgtaaataacagcatattaaaaatataatagataaaatgtttccaatgataaggccaggattcttaataattggataatcttaatcaaaaatcttagatgagtaaaattttcccacttaatataaaaaccacgacatcaagctgagtataaggacacatttaaattctggccaaaaagcaaagcttatcctgggagttccaaacctccttcctgcctgggcacagctctttctgggtatatagcacatgataaagagatcaatctttgagctttgttggaaacagcacacgaggtaacaccaaccaagcatttaaatttctgatttggatctatgagcattgctaatgacacactcactgcacacttgaaactcttggatttccacactcatcatcactgatctacgccacgccattcccagaattccccatgccatcctgccccaccatgggcaccagccaaacccactgagtaggcactgtctcccgcccatccttcaagaccaggctggcctttgcctgccccagaccctccaccctcacttccagccatgcccctgcaggaccccgtagagcacttcatcttgtccctgtccttgtggaggaggcaggggcctgtgtgaactgccctgcttactccggcatccccagcagccctcagcaagctcagcacaaggtaaagcctcaacacgggaggacggagttcattttcctccactaccacgagatcctggggggccaggatcctccaggtccgtcctttccttcctctgctcacccatccaccagctcagcacctacttcaggcctcagacgttgtaggtgctacagagacatctagagagtgaacccacagacacacaaataacctgtgtttaaaagtgtgttaacagcattgggtggttcccagtggggtacacactacatcatttctacacttgaaaaagtaagaattccaagatggatggatttactcaaaacctcagaaacaccactgaccagctacttctacaaacatcagttctgttttgtcctgcccactgtgcatttaggctaacaggcaatgaagaaatcttgaaactatgagaaactatggaaaaaaattcaagttttaaggaagatacagtagcaccccatttatatagcaccagtaaaagttattccaaataaatatattttcagggtaacttaaacttacccacataacaccagtatgagaagtttatatactttaaaaagtctattttttaaaaaagtattgtttatttctctgctgccttacacacagtaaacaaaagttaatttattcctgatgactaagactcctcctttaaatttcagtgaggccttgggccccccatggagcacctcagatgctgcaaagaccagtgggtctgctccccccactccagatggtcccaggtgggcaggggaggaagagccccattttaacaagatctttccacttagaataacaatcgcctccacggagaaggttttagaagttaccagtttgtaaacacagacggaatcctgaaataggactgtcaccttgcaccttgcacagagatcccagcaaacaccacaaaggtgtacaaatgacaggaaggtgtgcagatgacagagtggtctctgctaggatctctgcggtgattttacccacacaaaaccccacctgggtctgtacgtcattgctaaagacatcagatgtgcctgtttgatgctgtgaaagtttttcacatcagcccgtcttctcacaacatagaaagaaggggaaatttacaaaagagcatgccagagtctatgtctcccggtgattgttaaaagttggtagaggcctcttctctatcatctttgtttcaaaatcccttatgattttaacaaataccaatggcctgaatcaaagatgcacaaaagatgcacaggtgtttgatttcattccagtttgaagcatccattcaaccagaagagggagcacatgtttaaaagaaacccccaaaccgtcagaccatcgtcaccgacgatcaccatattaagtggtagaaaatggtacaaattaagaacatatcatgatgcttaggttcttaaggagctataagcaaaggaagatataaaattatataacactgaaagtgaaaatgaaagtaggaaactacactttatattttgtcccctctgtggtttttgggaacttatcctacaaactaataatcggggacaaggggtttgaaaaaactgtcatctaattttctgtctcacagaggagttccctcggacccacagagaaagtgagagcagatatatgcgagatgagttttgtttttaaaaagagaaaaagaacaatcttactcagaaaaaatccagctggattagttggtcatagattgttattttacactgaggtgctttttccccacagttctttcttggtcaaatcatggtttctttctttttttggttgaaaaactacaacaataagagatcaaatattccataactcaccaaagacttcagaatcaacttgggtgagaagagcatccttttctgaatgtggatgaagctgccccgatcccgagtttgtaggagagccattcgtcctgaaattgttggataactgctccctcccactccttggctgagagagtcccacgtgttgggggcaagaaccacacatctttgtgcactgttcttagtgtctgacacgtgcctttcggaagcagatgtttaaaacaatctgctcagtgagtgcgtgaataggtaaaaggttagggaatgaagggggaactgccgggggctgatacatagatgacacgacgctggctttacacaccacatcacggtgagactgactccagcaagcttacatcactcagacggcaaatatttcaaagaaaaaatccatagtgtttagtaagccacagaagaacattttaaagtaaggagtaacaaatctgtatggaagaatttccaaaattcacaaagcgtagaaagaagattgttaaaaagtatgtccagtgattgacttggagtgggtacggaggcatgggcagtggccctggactgctgcctctgctggcaccagctcttattaccaccgcttgaagaacatggtacatttgtttctcatataaaaatgtgaaagcaggcaggtcggggctaatatggggactcatccatgaagccctcctttctcccctcttgaaattcccaggtcacctcttggaccatggtgtagcatcagctccggccatcacatctgcattccaagagcagggatgagaaagagaaatgaaggagcaaaggcacatacctaaccttctagctgagatccactggccacacctagatgaaagggagctggcaaatgcagattttactccaagtaggggtgactgtgacccaaatcaaaccctcagttctatctctccagaagaagaggaaagtagaccttaggctcagccacatctccatggagagtggaggtggtcagacagaagtagagatttagaaaagttcatgtgcccatccttccacccacaggcgggatgccaagcacttccatgtttgtcctctcatatatgactcgtaaggccagtgaacacctgtaagaatctgaaggaaaatcaaccataaaggagaaaagttaatgttaccccctcaagcttaggagggcttccataagctgaagagcaggctccttgagggagatactgggttccttgaattccacttcagaatcatggccctgtgccttcttttcctgcttagccaggcagctccctgcacagacttggcaagtttccaagagagtgttcattaatcagagctattgcaattgctgaatattctccagcaaaccattcatctatatatccatccatcatccacctacacatccttccattcatccatccatttctccatccatccctccagcctgccttccttccttccttccatccacccatccacccacacatctacccatccatatatctatccatcctccaattcatctgttcatccatccatccctctatctattgacctaccatctatccaaacatacattaatctaccaattcacttgttcatctatccattcattcacccatctatccatccatcatacatctatcaatccatctatcatccatcattcatcatctgtctatttacccatccatctctccatccattcacccacccacccatccatccatccagccagccacccactcatccacccacccgcccatccatccatccactcatccacctatccatccattcacccacccaccccatccatccacccacccactcacccacctacccatccatccatccacccacccacccacccactcacccacccatccttgcatccacccaccagtttacctgttcatccatccatctatccctctatccatccatccaatcacccacccattcatccatccaccaactcacctattcatccatccatctaccccatccatcatttgtctatgcatccatccagccagccacccatccatccacccacccacccactcacccacccatccttgcatccacccaccagtttacctgttcatccatccatctatccctctatccatccatccaatcacccacccattcatccatccaccaactcacctattcatccatccatctaccccatccgtcatttgtctatgcatccatccagccagccacccatctattcacccattcacctgtccatccatccatccctccatccacccatctattcactcatctatgcattcatcaaccagcatccatccacccatccatccctcatccatcattcagcatccatctacccacacacccatacatccatcactttacctgtttgttcgtccatccatccacccattcatcaaacaatccacctgctcatctattcatccatccctccatccatctacccatccatcaaacaattcacttgttcatccagtcatccatccctccatccacgcatctttccaactacccatctatccatccacctacccatccattcaggaagccagccatcttttcacccattcacccgttcattcctccttccacccatccctcatccatccacccacctatccatatccatcatccatcattcatcatccatccatctatttacccatccatttctccctctgtccctccattcatccatccatccacccatccggccagccagccagccatctcttcacccattcatctactcacccaaccaaccatccctccacacattcatccatccacccgtccatatacccacacatccatccaccacacatccatccatctacccacccattcacctgttcattcatccatccatcccctacctatctccatctgtctttcctcttgtttcaaaaaagatttgattgtttttatcaagtatttttagtgcaaaagcttactttcatttcctaatttttaagagaataagaacttctcctgaatatcatcttttccctttttgctctctcatttgtctctctttttcttcccttgtatcttgcaaatccctcagataaaagtgggttgctgaaatgagaggctcagatagagcagagggaaacaattcagctccagatacccagggggtctaggcggtcagctgacctttcttcatgagcactgcagagtgccagtctgtgcctcatttctactccacgttgaatctttgaatctagtgatttggttgttgatctttgaacttctctaagccattatacctttagttccctcttccccacttgttctctgattgttcattttgtttttaacctaaaatgaacaaatcccctgtctaccgattaaaaactctgaggtctttttagttaatgtgtgacaaatagagaagagatggggagagagagggaaaaagtgagaggaggggtggtgagagagagagagagaggaagagagggagagagggagagagggagatagagggaggggtgggaggaagacagaaaggtcctcaccgcccccgcccctcacccctgtatgtgcatctggaatccactttcaggggaaagcagagccctttctctttactcaccagcagttcatattgttaatttttaactaaagacaactgatttttgccagtagcagagaacgtacgaggtctttcttcctattttctgcaattaagcaaccagctattattaggagttcaaaacaaatcacaaacatgtctgtctattacaattgtctaatggtcccaggtccaacactaagggaaacacatccattcactacagcctagtaattaagacaaaaatagacacggaagccgcgatcgaggaggagggggaacaaaagggtcagcttccgctaagaaagcctcagccacgtccctggggaagtttcatgtctttcctcacacgtggcagggacggctgtggggtcccagtgtgtcacctgcgtggccttttcaggttctgggggcctcggtggaaaacacgcacagtgcatggcctgacacccgctgtttttcctcgttcagggaataagagccactcccaagaactctcattcagactcgtaatcagcaaatcaacacggatgcctctcagagaaaaaacgatgcttccgatttcaggagccccctgatgattccgagtctctcatacaagggaggtggggaggatgggcagggctcgggaggtccggatgactttccccacggacacgggcagagtgtcacacttcacaagccacagatgccttgcgtggcctgtgtgtgtttagaccccgtcctgtgccccgccgggcccacagcacagacgcgcctggctgaagggcgagggggagtgggctgtgagtgtaagaaagtcaccagagaagggccgagtcgagaaggggccactcaggggcctccctgtccgaggcgcggagcccagcatggctgacttcctctctgaaggtcattagagatggatcccaataaatacacacacacccatcagattagcagacccaacggtctccatggcaacaattggacaagcaagtcgcctgcaattggcattaatttaaaatatttttccccgagtctccttggagtcagttccgtgaaacacaagtgcttgccagctctctaatctgcggcgtcctttgaaattccatccagcgtgtgctgaagctgagccaattaacgtggagagaattgggtggatcgcagagaagctggcaagaccgtgtttaccaattaggttttttttatgatgcaaatgttgcacaccatgcggcaggaataaaagctggctacgctgaatatgaaactgttaattgcattttcagagacatagctacaaggtgaaactaatcatacacatgataaccgggcttcaccacctacagtgccctgctgctgcactctcactaatctgtattaaaacagccccacacatccttgcaggaaaggaaaacattgcgtttggtataaccttccaattttaaagagaaaaaaagtgtgcctatgtgggaagcaatataaaggataattttcatttaaatcagattaataacgttaacaaacgccatggcaaagggcccagtggtgcttcttgaaatgcattttttgctttaaaacgatagcaaggtgcatttgcaaatgaacgccagcacatgctgacaagagtggctcaaaatgaaggagcttgtttcagaagaaagggccatggtaattatagaccttggctttcccagctaggaacatcaaagaggccccgctggaatcactagagagaggcttcccagggagtccagtgctcctgaggttcccagtgcccagcccctccctggggaggggaggatgaggcccaggagcagggagaagggtctaggctccaggctccatcccagtgcttgggggcagagaggggtgcccaggagcacctgtgtgcagggagtccaggcctgaactagcagaggcatttctgaaatggggtgtggctactttaaggggtgaggtcagctttcaaaatgccccatgagaatttatgtctttttcctcatttctatgttaaccacacagtttcagcattgatgctgacgttgactaactcagcagccgagaacagggctgggaacaggagggaatgactgactccccagcagcagcccacgtggggacccttgtcagaggggtctggggtgctacaaaggaggagcacccagccagggctgggcggccagcagggacagaaggacgcaggactctgcacggctccacagctcacacctcaggatttcacacacgcacaaggagcttccgagacagaagccacctgaggctgtgcccatcggggtccccttcttttaattttgcattgcagtcagccccgggagttccaatggaagcctctgctcagagatggtcagaagagcctccgagcccatcactgtgggctggggcctggatgtgcactccccagtgttgtgaacactctcggattccatgtgtccctgcacctcacagtttctggggccaagcgagtagtgggtttgaaagttcccagagattctgagccaagatggggtatgtgttgcggacttctaaatggctagggaagggaatttaaaaggaccagcctgattcctcttcaaggaacgtgtggagctggagctaggccacatgcgctgctgaagtggtgggtaactggaacagtctgtgtgcttgttcacaggcgccgctggccatacaaattagcacaacaggacaggacgctgtctgcagaaggaaaaggctcttgcctgtatgatgtttctaacacacggctaaggtggccagagaagacaggcgtagcgtgcatgctctgatggaatttataaccgggagcatataaatccctgtttgtgacgtagaaaaccgtgaagctggatctgcctggaaatgctaacttctgggagcttcacatttttagcctatactagtgacgtgcacttaactttgaaatttgtttcagaaaatgaggcctctacaaggaaaatcatctcggcttgaaatggatctcttgtcccacagtggctgcctcggtgtactgttaccgtatgtggtagagacggttcctaaccaaacgttcagtttgtttctctttaagaatataagaaagtaggccaggcacagtggctcactcctgtaatcccagcactttgggaggctgaggcgggaggatcacctgagatcaggagtttgagaccagcctggccaacatggtaaaaccctgtctctactaaaaatacaaaaattagctgggcgtcgtggtaggtgcctgtaatcccagctacttgggaggctgaggcaggagaatcatttgaacccaggggcagaggttgcagtgagccgagatcatgcgactgcactccagcctggcagacaagagggagactttgtttcaaaaacaaaaaaaaaaaaaaaaaaaaaaaaagagaatataagaaagtataaacagagtgaaattaattcattaacattaggaagtagaaactcactctaacgtgacccacgctagcatgagataccgtgtaactgtactgggtctggatcccccacggaagcacttgcagccggaccaccgaagggctcacgcaggcccatcctcccaccacgggctcccagcactggcaaaatgccactcagaccacagctgcaggggcctccccgatcctggggctgtttctgtaatagagtgtgttttgtcaccaaatgatatttattttgtttcaagcattatttccaatgaacaaatatatgctaaatcaatcggcatgtaattaaatagcacatggataggacatgcgatagaaggagggggcagaggccgtggtgtttctgacgccgcctctctttaagggtggctacaaggacgtgagctggagtgaccgtgtcagacagcgcggtagaggccagggatggggctgcacaggatgcccacaaggcctcgtgattaactgttttttatttgtgcaattacttcttttccttccttagtatctttcttctaaaaaattcaaagaatgaaagagggcgcttaaattattttaaatcagcaggattttttgaggtcccatcatagacaagacctatattgagcaaaccaggctgtagagttagtgttcagtggaagatggtgagcgggctgtgtcccctccaagtcccacctggtctcagggaccccacatctgcaggcctggctgtgcctggcaatgccgggggagccgcgcagcatgaaacggaccctgtgctcggtcttgaggccacagctcggccttggtgtggctggggccgcacagacacagcacagcggcccccggcatccgcaggacacggttttccactgttttaccagtccctcagcttcgccagacatccctggatcccagaccctgctcctcaggtccagccattggccgcggtcctgctccaaaccacaccggccatccaggacccagattcaatgcccagccctgaggcttctgcactgcagctcatcctcttggtgagagcccaagctggggccctgtgtccttgttgagcatggtttgaactcaggagcatctgtgtgatggccagagcccaggtggggtgaccccagccccagtgctgcccgttattgctgccactgtcattatcactgtggctctgtgagttacacctgtgcttctcagctactgcaacttacctccttcagccaacactacacatacatgagctccagggagggtggccttgtgcagccatctgggtagagacgcagaaagacttcttacagtgagtgggctttgcctgaactgagctctcagagatgagggggtgagggggtgtcccaggaacaggtgatgcctgggcagaggccacctgcagctctgggttgcggggaacgtgagggacaagaggagagggaggggcgagggcacagaagtggggtttggcctgcatcctacgtcccgaggtcactgtgggcttgatagtgggtgcggagaggagaggccggcccggggtcatggtgaagccgtcaggacagaagcagtcaggggctggggcagccttgcccaccatgttgggggtaaaatgcaccatgtgctcctcctctgacgtggctgtctcagctcccaaagcccaccagccaacacccaatgattatggtagaaactgatacagaaacggaataggtaagaaagacaaaagtagggatcctgtgtcaagtctaagggagtgcacaggagttgtgttttgctgaataaaaagggaagaagcctgagccactgggatcactgcaataaccttcttcttccaaggccctggtcctgccggaagtgtggatgccgtcctcactcaggctcccccgacagccggagccccctctatagaggaggctgttcctagacggacatcgggtcagacggtttttgcttaaggtaattaaattccctctaccaccctaaaaataattccctctccttgagatttctatacttaaaattcttaaaggcatttattgccctgccttagttgctgctttaccaagacaaacacacttagttcctttccacttttctcacaaacaaatccttcagtctcttaatcatttatgttgcttttctctgaatttcctccaatttgttgacatcctctggtttctaaggttctaatgcctatatttgctttgttagaacacagcaggtattaggaaagaattggatgctattcaagccacagtaattataagggaaaacaagttcaaaagccttgagtgaaagcagcaggtaagagggaggaaacatggaagataatgaccaatgcatataatgcttttctaattcaggacaagaccatgagaaacttcatcagtgatgccggcaaaaaccaaatacctaaatagatacataaatgtgtgtgtatgcacccacgcacacgcacacacacagaggatatcattttaaaaagaagggaatatatcggtaattagcacagaatataaatctccccccgagagatgggtgcagaaggacagcactgtgaggacacagccagaaggcgctgcccaccagccaaggatagaggcctctggaagagccagccctgcccacatcctgatctctgatgtccagcctgccaaccaaggagaggggcctcgggaggagcagccctgccccacctcgatctctgatgtccagcctccatagtggggagaggatgaactcctgttgctgaagctgcccaggctgtagcattttagtccaccagaaaagaccactacatcggccaaccctagtttcaataaaactttatttactaaaacaggtggggctgtccatgggttagaatctacccacctctgtcctagtaagtattaaaataaaaaatgaggtgacctcacaaggtccctgtggagaggcagagaaatggctgctgctactgccctggctgagccgggcagcctcgcccatccaccatgaggcgagaccccacactccagctggcctcctccctgaagggccagatgggtgacaggtccccagaagcttcggtcttgggcttgtcctggtaggaaaggttttcccagccaagtgcatcctctgcttgtcagcagcttccacagacatggtgagaggagacattcaaggatgaatttaaattgtgaaactcaaggggcatcacctgagtgcttttactttccccattgctgaccctacagcatgatgactccgtttcctacacggttccgagcgttttccatccttcctgacggcctccaccacgagacttcaggtcatcctttaatgagggcccaaggaagcacccccactctccagttccatgatttcccacggtgattactgagggaagaccagcgcagcccatgatgtgttcacagccaaggccccggcacctgggcactctggggcagcccgtaatgtgttcatagccaaggccccggcacccgggcactctgtctggggcagcccgtaatgtgttcatagccaaggccccggcacccgggcactctgtctggggcagcccgtaatgtgttcatagccaaggccccggcacccgggcactctgtctggggcagcctgtaatgtgttcatagccaaggcccaggcacctgggcactctgtctggggcagcctctggcttttaatgatgcagcaaagcatcaggctgcccacgccagaaggctttcccccacggaggcttccgccatgagtctggaatgcgttctgagcacccctggagcagggcactgttgggttacttgaaaaataggaagaaaaagaagacaatatccctggaccttagaaacctcaatgatcaagagtagcgtttccctccacggttgcccaatttcaccttgttctgcaggggatggcaagagcagggtcgccctggtgagtctgaactctgtgcactcctgtttagtcctcaatgggaaatgggaaagggctttgttttcagtgtgcatttatccctgataaacaaaaatcacggcacaaagcagaacggtggctgttttcttgtgactcattattaacaagttttaaactcattcatcttggaaaactctcaacaatttagcacagaaaaccactttaatgaattcacctaagcccatgtcgacaaggagtagccagaagccaatcctggtttatttctccaacatctcgctaaaggaggagctcaccacgtaagcgctcccaggcctgtgtcctgggaaacactgacagacagctctctcagaccccaggtgagtctctgctctctcagtccccaggtgaggctctgctcccatggctgcactccgtggccagtgctgctcccaatatctgaagacatcttggcctctactgtggctgtgtgtatttttctttgcggtaattaacactctaaaaaaaatttctctaatctatattttgaaataactcaagcagaagttttcaaacacgcacattctgcagcactgtcccatccactgcaaaggagaagagccgaggagcgagttccttgttctgctcccttcttgcggtgtcccccactgcctggactacagtatttcctgaaactaaggaagacagttgcgtagagaccctgagcttgcattcagcagacacacacattcttaacctatcttgaaatgagtaaacaaatcttcatgcccagtttgtcatctcctccttacccttgccctcatcaagccactcagtcatgtcagtccctcctgagtcatgcacatgcatgcaggcacacacaagcaggcacacacatgcaggcacacacacgtgcaggcaaacacatagggcctggcacagacatgcaggcacacacacgcaggtaaacacacagggcctggcacacactcgcaggcacacacatgcagacacacatgccggcacacacacagggcctggcacatgggttctatatttggtagataccaccattacctccaaacagagctgctaaccactggtatctatcagcagtttcaattcctcttgatgtgtgagggtcattttgtcttctatgacaatgccaaacacaccccagcaaagctctggggtagtgtgaacatgcccagtgcaccccaacaaagctccgggatgttgtgaacatgcccagtgcatcccagcaaagctctagagcggtgaggttccgagtcctcactgctattcagcacttgcacatcagaaacccaggcatctggatggccagtgctgacttaattgactggtcagtctcagcaaacctacagtcagttccttccaagaagcaaatcaatcagaagaacacaggttccctgagctgtccactcagctgaaataatcgctctgcagccctccgtaacttcaagatctctagtgaaacacacacatttagatttttaagaggaaaaaaatgccaaaatgattgccaagacatgcactgggcattccctgggcacacagggcacccgtgcagctgtgattctagggacactcgctgcccacgtcctccacaaggtcataggcattgtaagccaggagtgcatcctaggccctccaagaagacgaccaccaggatgtggctcctgaccccatggggctgatctgtggggcagaaactaagacaccttgtgacaaacaagcaatggaagagaaaactgctttaggagcaggaagggggccaaggccagcttggcaggagctgatgaaggctttccagggaggataaggcatgagcaacttcagttgtgctctcaacattgacctcaattcctttccactgcctctttctgctactgcacttagaaaaatgtcatacacacaggaagttttcaataagcaacaaaatttacctaaaaaagaaaaaggaaaacagaaacgaaaagattgagtggggtttggggcctgcagagtccttgtctgcttgattgtgggcagtgggtggtttgtgaatgtcagaataagcttttcttctcagatgggtaagcgggcagctgggctttgcagtgacaggtgccccgaggaaagcaggcaaacatgcactggacaaagacacatgcagccctattctaagaaggacttgacctttgagtctgaaaaacaccctgcactttaggagctcagaagagaaaggcatcatttcagagtgggagagccgcgcctccttgtcagtgtgatggttggtaactagattggcaggtaaagccacaatgcagttgatgtaccctcatctgctctattattaaacatccaaaatacattgttaatattttaaaaagcagacaaaggcccccatggtatgatacaactggatgggtgtttgttctcggccatgctgagagatactgacatccccaagtctctcctggcacccccagcacggccgccttccccagaaaacaatgtcagattttagaggctgaattgtgtggccaacttggtttacttctttaatagccctgtgggaacacaactgcttatatgtgacaaggcctaactccacacagaacaaacacgagtatcaaataacctcacttaagctaaagaaacacacacatatgtgaccaccttgggggatgatggctggtgtatttgtatttccctgctcagcttatcagttggatatcggcaagtaagatttagaagcagaaacataaaatattgaacaaaaactaaaacacttataaaaaggattcgctgtgtggtgtgaagctttgtgcagtaattgacacaagatcagaaagcaaaccctaagaaaagcggcacccacactcccagcgccaggccagggattaacgagcccggcagacaattccaatccggagtgggatttgctcttccgtttacgttctattgtccgggtcttatttttgctttcaattccttttgtaatggaggtagcagttgttattgacaattaataggggcttcaaaggcagtcatgtttggaaggggcagcggcttccctaagacccctcagctgctgctcaggtgcagctgctctgtatgccaagcacggcccatgccgggccccgtcgaggcagcacagatatcgatttagatggaaaccggggtcggcgcggagggaaggagctcggtgagcttcgcatgctaatgtattatttaggctttgtggtttcatccggagtaagtgcctatttaggaaaaattacagaatcagtatctctgctactgatatattttccctaacagtaattcacaggtaaaataccagggatgatggaaggtatttgtgcaaagattcaggaggagatggtctgatctggtgggctgggctcgctgggggggaccataataacgcaaagcaaacaacatccatgtgggaaggtccactggccgaggacgggcaccaaggctgccctcagatgccagccggacagcatggcgtggattttggcgaagctgagtgatgcatgctatatgcatccttattgatcgaaattattctttttactcaaatatttacaatgtaagataattccttgtgttcatagttcttacataatcatacactaaaacaacttttaccaattaaagacaaaaccgagaccctcttccacgtgagatggtacaggagggagctgcagtgggcctggctgtggggagcaccctggccactgtttcaaagctgccccctgagccccacagaggtgccctcaccccacaaagcacttccactcagacgtacaggacaccgggaggaaggcagagtgccctccacgtataccgtgacaggtcaggtgcaaggaggccccatcaagaggcctgaccacacggccctgtcctctgcagggctgcgtgaacacaggacacacagcagtgatggtccagcagccactcggctctgggcactgtgtcagttggcactgccctaggtatgctggtgacaaacggttcaaatgaccccaccatcgtgacactcgacccttttggcccaggaactgccattcacgggcacagcacacctgctcctcccataccgaacctccatcatctccgctgaccaggcaggtccggggtcctagaaccaacagggctcacccaccccagccccaggcagagccggcccctgtggaaagtgcccagccacagccaggactttacccacatgcctaggccaggccctggtcatccttccacaggtacgtgaaaggtaaatgtaagtggcaggaagtcaaatggaactgaaagccacctcgtctcctggcttccactcagaagtggtggaggaaatactctcaaatgaaatcatgtgatcctgtttaaataaatggaaaattaaaaggcagggcactggctgacccttgatgccaggaggggcagatgtggattgacgtggctctcggcccccatgggctggtattgggcctccttgggagcagcctgagagtgctcattcttggccaaatcgtgagttccagagggaaagagatgggaccaaaaaccttagggagaaccttggggccagctgcagtgggaacacatgggcaccctccacaatcctctatcctgacacgatgctccttttgtgtctccactgtgtttttcactcccatattttcacagttgtgattcaacctcaatgcttctggaacccacaagccacccagcctcactttctaaaaatatgattgagaaagcaagacagagtttgggacggaggtttctccagcggagcagagccctggcatcctgtggaacatattgtgagtgttcacagccgagaaagtaagatgactgggatgtcattttcaaagaggaaatgggccccaccccaacagggccaccgagggagaatcgcaggaggcagctcccccaaaactgggagaaggtcaggcctgggttcccccataccgtcatggtcttgagtcagaaaccagagatttgtaaacagcatcaaaagccttcacttccttctgcagccttaaagtttgaactttacatacattttagacatgaaaagtacaccaagaaagccaccatggtgagttttaggcagagaccctcttgtgaataattcgtctatgatccaagatggccagacaagaatcagggcccaagctttttctccccagtgtcacatccacgctgttgtctcctctccagctcagaccaaaattctctggacattttcatggctgaaaaccccaccagaacgctggccctgacaggaccctctcctcaagtcctgaggacccggctgcggccagccagaatgtaaactacagctcgcagaagcagcaggcatggaggaagaggcaggagagcaagagcagaagctcgaaaccttcaaagggagcctgaagaacaaggccaggagaagcagcggccaggccccaccggtttcctcctttccctcctgaatctaggacagaggccatttcagacgagagaggaaagaacaacaaaatgaactgcaggagaagcagccagagcctgcaaggcccagccagagacggcagaggagagaaccgcaagccaggagcaaggaggagacaggtggactccactaaccaaccgacgcagcccagcggagacaggcggactccactgaccaaccgacgccacctggagaaagtaaatatttaactgtcagaaggaaaacactgtttgaacagtagtggccttaggaagaaggccctaatttttttgaacactgaccgggggccattctttacccagagctactatgtcccgcgcaaggcaacactggctgaagcccaggagggcggggcagctgcagaccctcaggagcctctgctggctcagggagcgtggggagagtccagcgtgcaccagaaggagggaggccacctctccttgcggcattaggagaccagggtctctgaaagggcggggaccacggccaggccagaaccaccacatcaccaggctgaaggctggttaacctggtggaatcagctgtcttcatgttcaaaccagcacatggggctattttgctccagtcacctggtgtgacatgagccactgagactcgaacacccctgctctggagcaaagaagaacccacacctctgtcctgcctggcagcctccccaccactcgccgtgggcacggggtccgtatccactcgccgggggcacggggtccgtatccactcgccgggggcacggggtccgtatcctctcgccgggggcacggggtccgtatcctctcgccgggggcacggggtccgtatccacttgctagggcatggggttcatatcctgtcctctgtctcctctaagtgtcccttaaacttaaggccaatcctatgatttccctctaaaagcattcttccgaattctaccccaaagaaaccagtgacatttctcaacatcaggcttcctaatctctgcaggccgcctgaagaaaaagaagagatatgtgtatggccatgccatttggaaatagaagaaaagcctttaaccgccttctaccttcagctgtttttgccaagcagagaaggtccagaaagcaccttcaaaggggctgggagctctggccctgcccatccacacagcaaatacagcaagcagaaataacacgttcacaggggctggaggctcctgtcctgcccatccacacagcaaacacagtaaccagaaataacacgttcacaggggctgggagctccggccctgcccatccacatggcaaacacagcaaccagaaataacacgttcacaggggctggaggctcctgtcctgcccatccacacagcaaacacagcaaccagaaataacatgttcacaggggctggaggctcctgtcctgcccatccacacagcaaacatagcaaccagaaataacacgttcacaggcttctcctccccactcccaactcagctgcaaaacagctgataaaatgaggatgggctctatgtaagtaaacagtactcgatctaccagtttacgacatcatcaaagacatgtagagagaaaatacatacacaggtaataataacaatgataattctaatactattttgttagattagaagcatttttcctggacagaagcaacatcacctggggtcccagtggaaagcacgggccaggcgtgctccctgtgaccaggtcagagtgcagagcccgcctggtgacctcatttccttagggcaattgtaccttctgtctggagccaggtccctcttaaaggtagaagactgcagaaaataattcaccagaagcaggcatggtgcatccccaggacggatccttcaccgcacccgagaacccgcaggatgaggcagctctgcgcaagcacctgaccccctgcagagctgagatggctgctcggggactatgtcccccagcaaagcacagagctgagccagctgcttggggactatgtcccccaggaaagcacgtctgagtcttggctccagctcctgtgtatgggatgtgatttggaaatggtctccgaagagggaagccagttaaagatgaggccatcagagtggctcctaatccagggactggtgtccctaagaaggagacactggacagagacagaagtgcccagtgggaaggcgaggccagaattcccgagaacacctggtgacccagcagaggtgggagggaggcccctgtaagccgaggaatggcaggggtgtcagggccaccagaggctggaggaggcaggaaggaccctctctggagccttcagagatgcacggccccgctaagaccttgatctcagaccctggggggtgcagggcctggagagctttgcactgttctaagcctgccagtgtgcggggctccgttgccaaagccttgggcactgcacgcgccatctcagaccctctggccccacacagccagagctcagcgatgagccaggcccacagctcttcctcagggccctcgttttctctctctgcaagccttctcctttctaaactgttgttgctaagtcagaaagagaagagaaggcatcacgttgaataatatcctcgagtgataaatctgcagtatctgctgaaggtccacagataatgtgtttaatttgacaaaccagggacaagaatgatgaataaaacactacttgctgataaactggaccactgtggcctttaatattttcccagtcttcctgggttttctaaaatgtaaaaacagagctgaatgtctgttctggaagactgtgtgatctgacagacgacctcgatctcaccgtgatggagacatcaatggtgaggtcatgacttttgcaccttcctgaattttttcctgcatccctgtactcactcatttccagtatctgacatttggggtctatttggttttgaaggaaagacaggtctcaccagagggtggagcaacaaataataaagccacagaaatgctcttaattgtcataaaatattcatttataaccaatatgtttgtgccaaattccgtcactctgtgagaatacagtgtacccaagtgagagatttagaaagccctttaagctgctttttacttgttaaatgaaaaaatataatcattaggcatattcaggaattgggaaattaatgcttattagacttcaggaaaaaaagaaaaagataaatggagggcaagcagaggatattctccaggaagacagcctcagccacactttccagaaggcatcgtaatcttcagtggatgttatactcatttatattttaaaaaaagaagaaaggttaagagctggtaaataaagtgacagataaagtcagaaaaacaatttaaatcatcgagtaaaaaaggtgggcggaagtcagacgcgggggctgtttacagcagcctcaggaagatgcattaattacagtcgctgcaaaactacaaagacggtgctgctctgcagccggcgctccgggggcccgcgagcctctgaagtctctgggtctcctttgtttcttcttcatggtgcagaaggacatggtgagcagcccagctctcactttcaagggacctttggctgttttctccagcactgctgagaaagaagagcagccattctgggggctgctcaggccccggcattccagctgctgtgtggagtcttcggcttccctttcggaaacctgcccccacgcctggccctggctaagcaaaaagccaaatggcattgcactcacatccaattaacttcccattttcagcaattattgcttcgccgggagcagcaagatgccctctgtggggaagcaagggcccaggaaggggtggctgatgctctgatgaaggcccctcctctgacctctaggccacattagagacagcacagcccctggccctctcctgcccctccttccccggctttgaaagcagaggtgctgcatttggggcaagttctggtcagttctcatggtggaggagaattaaagttcagaggagggcaaaggcaaacaaaatgacaggaggaaggccggatgcagtgagtggctcctccgcctgagagacagatgccaagagacccaaggcaggtgaaaaagcgcctctgatgcacagagacgttccgtatgcaatagactcgggctggacaccgagaatctcaactgggtcaattcagagcaaaggacgcattgtgcagtgagcagtgaattcatacaacgctaaatgcagagattctaaaatggcttagacctaaaatcacagagcaccaggcatttggctccactgaccactcagagggacacatgcagggcagatggggcttaatgacatgagcagagtaaacccaggaccacaacggccccacgtccagcaccgtgtggaggacggtacatcttccatgcctccaggttttcaggagaggagctctgctgcaccacgctgggagagatgaataggctaagcttattgtcaaaaggcattactgcagaggaagggaaagtctcattatcagaaacctcaatgagttgtttcttcagatgtgcttacccagtaattttttttttctgtaagtcgctcactgatgcaatcagccaacttctgtctcccaggtgctgtgctcagagaaataagaatttgctctggagtcagaatggtttagggctagaggcatgaatctgaaggatgtcagcctaagcggcagtggccaccaagcctgacagagccattgggggccacgaataaagccttggtgcctggtggtggccaccaagcctgatggagccatcagggccacacatggagctgtggtgatcttcttgactacctgggcagtggaggaggatgtgggacgagagaatgaggaagaaacgagtcggtgattagctggaatgataagtcgttttagccatgttgtgtgataaggagtttggctagccttggtcctgttcctggaagcagcctgagtccttgcagcctcctgagtcacgggagtgaggtcatttgtggtgggcccctcggaccacacctgattgtttatgcaaatgaggtgacaggacgggggctgtccacaccaaaaagaccaacaatgtgatgggtgagtgggggctctgagccgtgggatatagtctgatctcaggagaggggagggctggtgggtgggttaaagcttgtggccaatggttcaatccctcacaccaatgtaatgaaaccttgatagaagctctgcatgctgaggcccaggtgagcatccctggtcagcaatgctgtgtgtggctggctgcacactgagacctcgatagaaactctgcactctgagacccgggtgcacatccctggtcagcaatgctgtgtgtgtggctgactgcacgctgagacctcgatagaaactgcacactgaggcccgggtgagcatccctagtcagcaatgctctgtgtggctgcacactgagaccccattaaaaactctgcatgctgaggcccaggtgagcatccctgcccagcaatgctgtgtgtgtggctggctgcacactgagacctcaatagaaactctgcactctgagacctgggcgagcgtccctggtcagcaatgctctgtgtggctgcacactgagaccccattaaaaactctgcatgctgaggcccaggtgagcatccctgcccagcaatgctctgcgtgtggctggctgcacactgagacctcaatagaaactctgcactctgaggcctgggtgagcgtccctggtcagcaatgctctgcgtgtggctggctgcacactgagacctcaatagaaactctgcatgctgaggcccgggcaagcatccctggtcagcaatgctctgtgtgtggctggctgcacagtgatgtggtttggctgtgtccccactcaaatctcttcttgaattgtaactgccacaattcccatgtgtcatgggaagaccccagtgggaggtacctgaatcatgggggcaggtctttcccatgctgttcgtgtgatagtgaataggtctcacaagatctggtggttttataagggggagtttccctgcactttgcctgctgccatccatgtaagacgggacttgctcctccttgccttccaccatgattgtgaggcctccccagccacatggaactgtaagtccattaaacctctttattttgtaaactgcccagtctcagatatgtctttatcagcagtgtgaaaaaaaactaacacaggctgggaggggcccatgctaggccaagatctggaaatcagggcaggtgtgtgagtgtctcaccctgagtccagcacctcagtcccccaaacacaacagggctgagtcgagttgcatcgtagctgaggcctgggccacttggggtgtaagagctgggagctgctgacagggagcagtagcagaggcttcagctgcaagagagtggcctgaattcggagaagcagactctacttttgtggggtaggctttgtgtgtgcacacaggagcctgcctgtcagccaaaaccctatttgcaatgcttccctgctatctgccctgagcaaaacattagaaagctgggatcaatttagtaaattcttccaggctcactctccatttctttaaaactccaaatcagaacatgtggcctgagcttaggaggaacaaaatttgaaattgtactgcccagaaaacccagtgtggatagtcagtgtgtttacacgcatcgtcacgatagtgtgtttacacgcatcagcatgacaatatatgcacttttaaatactctcacttcatagtcaacaagtgtctcaagtataaaactataagaagagaagaaagtctagagatgtccatttcgagcacacattgtaaaaacagcacagaccctgctcccagtctaatgcataaatactgtaaataaaaagggacaggcacaaattttgaagcattagtaaacgtgaaaggaaggaaggagaaatcccagatgccagaacagagaaagcacagagctggggcaaagagcaggcaagggaggcagctgagtgtggcagtggcaggcaggggggtctgttagggcccagcaggctggggttggggtctgcccacaggagggcagggggcaggtgctggcagcgcacccccaaggactgtgcatacctgccctgcacaaaaggaatgccaacaacccgtccacaggcaggcgggcagaagagcctctctttctcaggctctggatgaaaacacaaatgcctctcattagaaatagaagcctgaacctgtatcccacatgagtgtcaaatcctaatataataaaatactcatatatctaacataacacattgatttgaattgctaattataaaatgttggaggaacctttccaacaatgagagttcttgggacttccacaggattctcataagaaaagaaagacatcaaagacaagcatgtaataaaaaattataaaccacgtagaaaacaatctgtaatgagaaagtgtgagcaaaatttaaaagaaaacgcaaactagagaattaaccccatctgacctggagataaaatgatagcctgagacttactggcagaaattaacaaaccagaaagcagcagagagcacagacatgagcagagttgactgtttaaaaatatgaaggaaatacaaagatgtctgtcaaaattatccagaaaggaaagatgcaaaataaataacactagaaatgaattaggggcataacaataacatatacggagatatgcaaaaccacaagaaactgcaacgcacaacagaaacgtaattggaagacataagtgaaatgaatcatttttaggaaaaaaaacaaaaacacaaaatgccagaattgaattgaaaggaatggtatctgactatacttgtaaccattagttaaatcagtattcaaaaaccaactctcataaacagcactaaagccaggtgacttaaacactgttactaaagcttcaagcaacatctgtttcctcctatgcggattttagatttttcagtctaggacacaatttactttatgagatgagtattacttcgatactagcactgaaaaacagtaacacaatgaaaataagggaattccatttctcaaaaaataatagcaaccaaatataacagagggaaatcagtaaaacaaaaagtgaccaaaaaggtatatcccaaaaatgcaaaactggttctactccatgtaattcactttactaagagattaaagggagaaaaagtccagtaatatcttagagattcaagaataagatttggtccattcaaaattttttaaattttaagaaactaggaataaagcatccttaacccaataaaagttatctaataaaatccttcagaaataatcatcctttaacaaggtaaaatgtcaaagacattttcttaatgcttgggatagataatgaagccttccttgacccctttgattcaacactatttggaacaccctagatactcaatgcaatgacaaatgttaagatatacagcattagaaaggaagaaagctgcagatgacatatttgtttacatggacaatctaagagaactgccaatcaagcaattataacaaatataagattccttcaaagatacaggtcacaaggtcaaaatacaaaccaatgtgcctatatgccagcaacaaccaattatataatatcttgaaatagttagaagttaatttaaaaataatcctgatcatgttaagctacttcaaaaaattttaataaaatattttaagaactttacatttaaaaatactaaaagttcattgaatggcaaaggaatatctcactcagcgaagacacatgccatgtaagtacagaagtggatgggaagaccaaatgtcgtaaatacactctcaggtctcctaaccatggggacatgttctgagacatacatcgttagctgatgttgtgccaacatcacagagtgcacttacacacacccagctggcacagcccactgcacacccacaacctgcacggcatatcactgtactgagtgctgtaggcaattgtaaccaatggtatgtatttgcgtatctaacctgcacagcttactgttactgttccgagtactgtaggcaacgctaacacaatggtatgtatttgtgtctgaacacatctaataaaaaaggtatagttaaagtatgtgattataatcttaggagaccaccctcatgtatgcagtcagtagttgactgaaacgctgttatgtggcaatgactgtacttttgtacagttttgtccaaactaaactatacattaaatcgaaattcaacaaaaaacccaatcagtcttttttcataaatttgacaagctcatctgaaaaatgattttagaataagggacatgtagataatttggggaaagaatgggggagggttgcaattcaccttgtcagaaagatttcacattgtcagaacgattgagacaccaagtgtctactctgtaccacagcaggtgagtatcacagatgtatggtgagttagagaagccagacacatggagtgcatgatgtctgaatccgctaacctcccgctttgggtctcacttgggaggagatgctgaggggagggtctgggctgccaagggctctgtctggagctggatggtgactacacagcacagtcaacaggctctgcactaagatgtgcacactttgtatatgttatactccagtagaaattcatgtataaagtaagatgagaaagttgaattgagaaaagaaaatcatcaaggttttggaaagactgacaaacagaaccagtggaataaaactgaggagggagaaatataagtacacacatggggactggatagacaaccaatgtgaagacatacactgcaggagaaagggtatttcaacaattaaatacaagggccaggacaactccctatctaagtagaaaaagataaaattcaacccctgtctcacaacaacaaaaattcctgacagattaaagattctaaaacttcagaagaaaataagggcaaatatttttatgaaatcactagagaaagatgccatgatgaaacccaaagacttcaaatggaaaacactgattaaaaagacaccataaaaaagataaaagataagctatatctctatttttataacatatataatgcactgaccaagaactagtattcaaatataattacatacattttataataaaatactatgctatatataacacatatagcatttctatataaatatggtctacatatatatttatatgtaacatgtatatttatattatataatatgtagtatttatattagataataaagtataaaatatagaaatataagattatacataatatgtaaaatatgtatttctagaataatgacacagatattaagaatccttacattctaataataaaataacaaaaaaaaacacagcatgaaaattgaagtgttcaaacaagcaattcactaatgaggaaatttgaatggctaacagagctatagaaagctgctccaccttatttgtctgccagatacagacaaatgaaaattgtaataagatacaagtttatggccctccccctttggcataaactaaagagaggtctgataacacctaattaaattatattgtggggaaatagaaaaaatgtaaaaactgcctaaatatcctgcagtagaggaagaatgcataaattatactgtaataccatgccatagttacatataaactagatctaaaggtatctgcgtggataaatcctcaaaatataattctgtgtgaaaaacacatcttgaaaggatagctacagcatgaaaccagtcatgaaataagtccagaatgttgtgggatggaaaatacccaattccaacccatctggccttcctttcacttatgggaggaaaagaaaaagctgagaagtcctcttgaggtcacagcccaggtgtgcaggttcaggctgagacagagacctgatcacagggccagaggatgctgccctccttccacaccagaccaccacatcaataccaacagggctcccacataatgacaggggattacagataaaagaactgcacacatcagactttatttaaggagaagtctctagggaaacccaaagaaaagtagggagataaaacaaggacaccagaagaaattttagcctctgacaattacagctccagcaaacagtaaacagcctaactcacagccaggtaaagataaaacctaatgctaaaggccaatctgcctcagtttcttttatccaatacagcatatctaggtttcaacaaaaaaattacaagccatgctaaaagggaaaaaaatcacaaagagaaaaagaatcagactcagatatagcagagatattggaattatcagacaatgaatctcaaatacccatgatgaatatgagaagtgctctagtgagaaaacggacaatgtgtaggaacagatgggtgatttgagagctggaaactctaagaaaaaatcaaaaggaaatgttagagatcaaaatcactgtaacagagatgaggaatgcctttgatgggctcattggtagagcagacatagctgaggaataatcagtgagaatgaggatctatcaataaaaactccccaagacaaaaagcaaagagagagagagaaaaaaaaagaaaaagacaaaacagaatatccaaggactgtgggacaattacaaaaggtataacatatgcataataggaataccaggaagagataaagagaaaagggaacagaagaaatatttgaagtaataatggctgaatattttcaaaattaatgccagacaccaaatcacagatctaggaaactcagagaacaccaagaagggtaaatacaacacacacaaattcacactcacacacacagatgcacacacacggacacgcacacacatgcatatacacatgcacacacacacgtgcatacacatgtgcacacacttcacacacacacacacacaaacacactgcacatgcacacacgtgcacacacactgcagaaaaatcaaagacaggaatttttggacaaagccagagaggggggaaaaaccttaccttacccatagaaaagcacggagagaattatgctggacttctttttaggaagaagcgagtagagaatgaagtaaaatattgaaaatgttaaaagaaaacacccaacttaaaattctatgtccagtgaaataatacttcaaaactgaagaagaaataaagacttttttaggcaaacaaaaattaaaggaatttgtcagcagttgatctgcctttctttttttctttcttttttttttttttgagatggaatctcactctattgctcgggctgaagtgcaatggcacaatctcagctcactgcaacctctgcctcccaggttcaagtgattctcctgcctcagcctcccgagtagctgggattacaggcatgcaccaccacacctggctaatttttgtatttttagtaaagacagggtttcaccatgttggcaaggctggtcttgaactcctgacctcgtgatctgcccgcctcggcctcccaaagtgctgggatcacaggcgtgagccgccacgcccggtccacctgcttttcaagtagtgttaaaagaagctcttctgacagaaggaaagtgacacaggtccgacactcggatctaaacaagacacagcagataccagggaaagcattccaggcaccaccaggaagagccactgcagaggccctggagaatcctgcttggcatgtttgaggaacagcaaggaagccagggtacttggaagagatctactagttataaagggaagttcacagcaagaatacaaatgcatcatctgtattatcaataatagcttattgctttttttctaagtagttcttaacaacattgcaataaagaaacaattgaggctgggcacggtggctcatgcccataatcccagcaccttgggaggctgaggtgggtagatcacttgaggtcatgagtttgagaccatcctggccaacatggtgaaaccctgtttccactaaaaatacaaaaattagcctggggtggtggtacacacctgtagtcccagctactcaggaggctgaggcaggagaatcgcttgaacctgggaggcagaggttgcagtgagccaagatcttgccactgcactccagcctcggtgacagtctaagcaagagagagggactatgtctccagaaaaaagagagagaaaacaaaaagaaaagaaaagaaacaattgaaggctacaaatagtcaatatttagtctcttgaaaaatctatggccaaagagaaacctgcgtgcttgggtccaaaaaagcgaaacgagtattgcatgatcttggtgattctgaggccagctctaagtctttgctgtcattgacatgtgacccttcccaatcacacttcttcctacccacggctgagtctgtggtgaaaggacagacttccttcagccatgtcaggctcctttactatccttgtatcttgcaacactcttagtaatcacatcattttgaattctttatgtaaaaatgtacctgctttaagcctcagcaaagaccaatgtcaaaagaaagatatctgtatcacaagaacgatcacaggcccagtagatcgtgcggctggacacgcactttctgcccacgaaagagcctgtgaggggcctccatctcgtgatgcaatgcaccaagatgccacgggcactgaaacaccagcttttgggtgcatacttcatacccacagaaaccagagaatggatttccaaacgtccagaaaaaagaagtcaggggagtgaaacgcagagaccaggagctcatccgactgccccatcgtgcttgactcttccccagcagaggggtcgggagttccggtggattcagtgttcccatcaatggtgagccgcttcggagcaaagccaaacacagctcagaactgcacaagttcaggcaccagacacagggtaggatccacgtcactctctgcagcacagggtaatgcactctctaccacacgcatgaatcatttattcagaaagagatgagagatccatggaactgtgaactaatcctaaatataacatttccatttactttccccgcacttaacatcttcgcagtatcccgtcacggctgagttcacgtttttgctgtgtgctgctggtatcctgcctgcaagcttcgggagggcaggggcaggccaggcccagggcttcctaagggacctggctgtcctgagccacagccggctgatagacaccatagtgaagaatccgatgggtgtctgtgacagtgtctcagggccagggtgacgagcatctgctgcccactgtgccagggaagaaagggagtactggcttgcagagacttacggctgaaactactagaaaacaggttttatgaactgcctctgaatttatttgtattatgctgttttcataattaaaagaaaagcttgtaacagtttcctcatttataaattccatatttcaatacaaagcaaaacactcttggaggttctggaatccttcagtgtgcaacgcatctgccattccaagacagagaccaaaaaaatggaggaaagtttgggggaagttacagtgaaaagctcctgatgggcgtggtggccatgcccatagttccagctactcgggaggctaaggcaggaggattacttgagctcaggagttcaacaccagcctcagaaacatagcaagaccccatctcatgaagaaaaaaataccaaaaaaaagttcctagtgataaaagtaatgtgccatgtggaggggaacactttcctctaatctaagggagcaaatcccaggttttaatcccatggacagaaaaaagtgtcacctttactaacaacattcttacctattagttaaatcagagatgtgtcctgggtgtagacatgaccagggacaggaggatcagggatcagggatgaacatcagagggactctcatgaccagggacaggaggatcagggatcagggatgaacatcagagggactcccattctcgtcacctgactttaaagggttggtaagtttttcaacaaaaatactcaccaacaataatatctccccagcaccaagctcctgcaggagagaatggcatttgggtggcagacatggccgtgaatgggaaggagaagggcctgacctcactgcaaggccgtctgcattaaagaggccaatttctgagcacaaggcaggttgccaggaaatgcagcttgacatttataaacctactcaccagcctttgttctcaatgccagggcacccaagtaagcaagccttccttcccggcactgcagacacttctggaaagacccaccatttcttcagaaatgacacttcacagtgtggcgagaggggagaagcgcacagaccatcctgcacagttggctcagcatttagcaattacataaaatgtgtgagactgattgtcatttgctcaaaaaatgtgttgagcacctaacgtacgctgaccacgtcactcgacgtggcagagggagcaaagcataaagagaaaggccacacgccgaggctgtgatgggcagtgaggatatgtaaatcttatgcttatggactacatcctgccacacatgattttcataaaagtcattaactcccaaagcaaccctgcagggtgtttcagataaaaaaatttagaatagctttatctgagttacacaattttaaaagtcagcaactgaagaaatgtccagaaagtcttggttaaataaaaaacacttaagtggcacagaggcaggagggggaatcctgaagctggtgcgtctggggagctcacctctggaggagaaaattgaaccagcagactgtgggcggccacagccctgaggcaggggtggggggcgtcctcactgctgctgaatctgtacaggactctggggccccttctccccgcacatcctgcacctgcataggaattcataaaaacaaagcaagcactccaatgtgtgtgtctttctttttcctactaaatgggaacgtgttggagcttggtctaaattatctgcatcaccaaagagagcacagtctccagggctcaggcagggtcagcctctggctctcaggcaggcacagagagctcggggcctcgatcatttgtaaagactctgctgcaaccaaactcaccagcagaggacaggctgcaggaggccacaggggacaaggagaacccgtgctgaagagaccacagctggtcccaggggaccaagatgggagctctgcctcagaaacagtgtccagggctcaagtggcccaggttaacatcttctctgctacttggaaaagagatcttttcctgcaccataggccgacaggtgccagttcggcgatgactaagtacaaaagagtctgctgcaggagcaacatttaattctcaacgagagcacctggaggacaccaggaggagcatcacagacaggaaaaattataaacagtgaagggcagccccaaacaataacaacaacttctcttccttagacacccttgagagttatgtcaataaccactgctcggttatattttacagaaagcctttctaaattaaaatatggtgctatccacttaaaccctactgggctgaacttacacatatgcatgatattgacccctgaattgatcagagattgatgctgaaaccacccaaaagcctccatgactggaagcttgatatctgacccggctttaaagaaagttggtggctttgggacagcagtcatgtggcgcacagcagcccattctttgtttccagcaggcagcaacaaatccgtgaggctgagctagcccctctgtcgggaagctccaaatggctggagaaataaattttttattaaaaaagtaattggaaagatgtttacattaatcagatttctaatttttcacttctccatggtaaagatcccagctatccagataaatgccactcagagcacccacatctcctggtggtcttggccttgtgtcagcattctaaatactcacatccatagcaagacatgagaaacaggaaggagaggaaagaagaatcagagaggtgtgccccaggacgtgggcgcagctggcacattcagagacggtctctgaattgcagatttcagagattgtttagcacagacatcctgttttatcatttgaaacctaaggaacagagagtgcaaagggcttgccaatagttggctagctagtcagtgagagacccaggagcagaacctgtgatcctggcgtcctgacactgccttgttctgtccaggagcagaacctgcgatcctggcatcctgacactgcctcgttctgtccaggagcagaacctgcgatcctggcgtcctgacactgcctcgttctgtccaggagcagaacctgcgatcctgacgtcctgatactgccttgttctgtccaggagcagaacctgcgatcctgacgtcctgacactgccgtgttctgtccaggagcagaacctgcgatcctggcatcctgacactgccttgttctgtccaggagcagaacctgcgatcctggagtcctgacactgccttgttctgtccaggagcagaacctgtgatcctggcgtcctgacactgcaatcctggtgtcctgacactgccttgttctgtccaggagcagaacctgtgatcctggcgtcctgacactgcaatccttgcatcctggcactgccttgttctgtccaggagcagaacctatgatcctggcatcctgacactgccttgttctgtccaggagcagaacctgcgttcctggcgtcctgacactgccttgttctgtccaggagcagaaactgcgatcctggcatcctgacgctgcgatcctggcatcctgacactgcgatcctggtgtcctgacactgccttgttctgtccaggagcagaacctgcgatcctggcgtcctgacactgccttgttctgtccaggagcagaaactgcgatcctggcatcctgacgctgcgatcctggcatcctgacactgcaatcctggcatcctgacactgtcttgttctgtgcactgcccttcagggactgaggcaatcccgcgatttctcatgtggcaggttctcagcaccacaccttccaccatgacctgaggcccagctggtttctaagaatgcactgttatgcagcagctctgggactaaaggatgtcgagactttaaaatactgtggctgcaggaaccaggagaggatgccgggctgggtgtcagaacacagggaaaagccatccctgttagccaccttggcatgctcttgagtttcctgaagcagatttcctaacctgacattttggagacggcaggacgggtttctcagcaataatccctcatctgccattgaggcgccgagctcttgtcttccttcctggtgtgtgtaccgctagctttgcaccagttccgcccactcaccaaaaagtccatctaaatccatccatgcttatttttaatttaaccttaatcctgcaggatcagtacaggggcaggcaatcaggtttacacaagggaggcgagcggctgcgagggaggcctggcctaaaaacgcccccgcccctcgccccggaatggagcctccagatacactcaactcaaaccacatcccattcctctctcatgcaaactcatctggtcacagagcatttgctgagtgcagactctgtgtgacacacactgctactttctgaggaacacacagatgaatacaacagtccccatgggcaggtttagcagggaagaagcacagtcaccgaagtccaaaaaagccaggctggagcccatgggccatgcagaacaggccaggagccgagggcaggtcactcagttccctttctctcaaggagctttcagctcaggagaataaacaaggagtatacacacatcatgtccaagggcaatcttagtaaccacaaccaaagaggctggagccactgcacacctcagggaaggagaggccacttgtgctgtgcgaggcctgcctgcagtcactgagcgtgtgaggcctgcctgcagtcactgagcatgtgagggctgcctgcagtcactgagggtgcgagggctacctgcagtcactgagtgtgtgaggcctgcctgcagtcactgagagtgcaagggctacctgcagtcactgagcatgtgagggctgcctgcagtcactgcgcttgggagaggaggcacggcacatctggcgtttcagagccgatggcatgttagaggccaccggggagggacagctgctgggcacagctggtgcactagaagcagctgaggtccattctgcaaaggagagctgaggctgggttgcacagcaaagcacagagcaacatgcagccagtcttttctcagtgcaaaatgggcaagccgggagctctcaagtgagtcagcaacccaccaatgtggcattacaggaggatgaacagggcagtgcaaggtgacctgggggtaggagtaccgagcacatggaacacacgtaaggcagctccttgttcaggcatgaggcaggaagagctagaatggggccgaattcagagcaacagggacaggggacccgatggatatcgaaggtggccaagaatggtgcatacacactttcttctaaggacactttctgtctagatagaaactcatacatgaatacacatatgtatacacacacacacacacacacacaggtcagtaccattctttcaacttttctgtttgtatattttcatcataaaatattggggaaatggtgccttttcatctctgcaatgtgagagctctatagcatcagaaactctccttatcttacagaccatgtagaaacatgtggggaaaagtcctacatgcatctataaatcaccaggtcctgctagccacgggcatctcctcttggtcctcatgttacattttcttagacttaagttttcttcatagcaagggaacatgacttgactctgaaaacttgaatgatgtattttaaggtgagtaagttacataggaataatgtatatccctatcatcattgttactattgccatcatcaccatcaataagcatcataatcatatcatcccaccagcaccatcatcaccatcactatcatcatcatcactatcatcatcatcactatcatcatcaatcacatcaccactaccaccatcaccatcaccaccatcatcatatcaccatcaccatcattaccatcaccactgtcaccatcacatcacaaccaccatcaccatcaccatcatatcaccaccatcaccatcatcactatcaccaacaccatcatcaccctcaccatcatcactatcatcccaccactaccatcaccaccatcactatcatcatcaccattatcaccatcgcatcaccaccattaccaatatcactatcaccatcacattaccaccaccatcaccatcatcaccatatcaccaccatcaccatcatcactatcaccaacaccatcatcactatggtcccatcactaccatcatcatcatcactatcatcatcgttattaccatcacatcaccaccatcaccatcatcactatcaccaacaccatcatcaccctcaccatcatcactatcatcccaccactaccatcatcagcatcactatcattaccaccatcgccatcatcagcatcactatcatcatcatcatcacatcatcaccatcaccatcaatcatcattgccaccatcgccatcaacagcatcactatcatcatcatcatcatcattgtcatcagcatctccatctgactggtggccctggaactcctcctttgtcctttcagttgggcatctcccatcattcccccagccatctccactcccgattctctgtgccgtcttcctctacatgttcagccctctctgctacactggtgggtgactccaactccgacactacatgctctgccctgtcttccttcctttcacagctcttcatgctcatctcacctcctgaactgctgcctgagcatccacaggcctgaagccaggactcactctttcggactgaccctcagctgatccttgagctgaagttccttgaggaactcggcccaacattatatttttccatggcaccagcctcacagctgatcccacatggtcctcaaagaatgcaacctgaggccgggcgcaggggctcatgcctgtaatccccagcactttgggaggccgaggtgggtggatcacctgaggtcaggggttcaagaccagcctggccaacatggtgaaatcctgtctctactaaaaattacaaaaaatgagccaggcgtggtggcgggcacctataatcccagctactggggaggctgaggcaggagaattgcttgaacccaggaggcagaggttgtagtgaaccaagatcgcaccattttactccaacctgggcaacacagcaagattccatctcaaaaaaaaaaatgcaacctgatagaaatgtggtgctcagttcttatttgttgcaatgtagctattacctttggttcctgaaggagttgaaaggggcagggaatgatgcaggcacacattaattcactgctagtgacccccattttattaggaaagaaataaaatacatgtagggtaatgggcacattgtgatttatataacaagcgtgttcctgaaaaggtacatcaaagtcagaatgcttttgaagtggcctcagaaaggttactgtttaaaacactgttattagaattactttaaaaagagtgaaaatattcagggaatgcagccttttgtagattattcatgttctaaagtgatcatgcttatatttttaccttctgttagaatcaatgaaaaacttaattcataattctactaagctacaatttgaaaatatcttgggtgcaattttccttcacatttctttggctcagtgtcctccagatttaccagtgacaacaaagtcacagcaacctcaatgccttttactgactcccatctgcagagcctcaagccaactccctctggaaactcctcctgctgttcttagaagtctttcgggcatccagacagtcctctggttctctctgagcttccccaagatgcaggagccacccagcttgcatcccacagcctcccggcttccctcagctgcacaccctcccaggtgccaggagcacagctcgggccccgctctcccccgtcacgctgagctctgtgctagggtgggtagggaaggcctccttctctgcagaagactcaggccaggccaggttcccacaccattctgtcccccacacgactcttccatgccagtctccatctcctcaagtacctgcctaccaagaaaataagtcctgttccttcctctgtgcacacctctttatgcaaagaggcactgaaagctcagaggcctcagcagccccgtctgggttctggctgcactcagggatgcttgcccctcccgctggaagtgctctccccacggcaggagtgaggagcactgagacaacagccacctggagtggaaggtcacccaggggcacgccatggcggtggagccaccccggggatttcttcttcctttgccagtctctgcccaaaagatgaaatgcagagatgtggtgtgtacatctgagaagccacagatgctagcagtgcccatggggggcatctgcagggggcatctgttgggggtctggagggcactatgttgtccccaagggccccatccagcacagagcagtgtcagccagctctcagcagtgtcactttgtggaccagcccagctctggaccagcttgctgaggggagacggcacagtgcagagagaggaaactgcctgatctccgttccagatgtaacccagttcttaggctattatgggactgtggggacattaaaggacaggaagcacagccctcccctcaaacatcagaacttcccaagactcccaaggagctgctggccccagcctgggtccctcccaagtctgtctgccagcagctgcaaaggcctcacataccctccctgtgtcaggtgcaccaaggttcctggctgattagcaccaaggaggacaaaagcaggccttttgcagtagctgtgtctgtctgtctgtctgtctcaggaagctggaaaagtggctaactgaattacatccatgtcgtgctcccccggcgagcgcccgccaccttcatcttttccccttttggtgacgttcagcactgattacaaagtgtctcagctggtaatatgttcacttcattttttttagatgtgttttttattcagttcacagatgaatccaattagcatatcactgtgactgattaaatatgcctcatgtaaatttacatgtcaaaatacacactgtacttaaacaagtaggcccggctgccaggcatctgtaaacagctttgcaggcttggccagctcgaaacacaaaagctaagatttaaatgtgcggtgactacctggtagagagcgaggaagagggaaaaggtagtgttactcatgcatgaggggagggaatgaatatagacatttgtctctctttgtctctgaagggaggccattgacaagagagtccccatctgcataggaggctgccacatccaattagctcaccaggcgatggaaattgcgcctctgatccagaaaagtccctgtgcactaaagtcaagactgtttcaaagagattatattatcttagacagcaggattaaattaatatggcaatgacttctacgggaggaaatgtttttgtgaaacgtgctaatgtttattatgcattctccatcataagtgatcgcctttgatgttctattcatttgttgattggtttccgacttcctcttagaagggagtgaagaaacccaggtatgaaaattggattgcgaaagttaaagacagagagaaagccttaattagattcctctagaagcagtgactactggttctgtgggttattgggggaagttcttaaaataatgaaataaaattaagtgtggtttggccaccaagagcatcagcaccaaaggcacccagcctcctggggaagccctgagtctccgccgcatggatggtagaggggtgcggccgctgctttgcctcgtgggggccgtggaggggcgcccttcggacctcctggagagggtagaggggtgcggccactaatttgcctcgtgggggccatggaggggtgcccttcggacctcctggagagggtagaggggggcggccactgctttgtctcgtgggggccgtggaggggtgccctttggacctcctggagagggtagaggggtgcagccactgctttgcctcgagggggctgtggaggggtgccctttggatcttttggagacacctggccacagttcccagccactcggggtccaccacgttccctcgaggccaggctccacccaggctgtccccagcctaggacaaagctccctgggctacagggacagccctccctggccagtgccgcccttctgcgaactgcacctcgggggctcctgctggggtctgaggctctgccgccttctccctgcccaggctggcccccatcgatcccaccctggcgtctgcttcccaagcacccagtgggcacaacccccagaagcacagtctctctcagtcctgggaggggattttttttcaatttcaagtcatgtcaataaaagtgattttcataaactaacctagaggaatttttatggctggggagacacaggcttacctgggaatttctgagtgtgccttcatggttgggccatctgcagctgggaactaaaaggcgctttaaaaatgactgacactgtaggaaaatctcacaactggagcagatgagccatagtgactgagggagaaacatgagctggatgagaaaggagggcctgcaggcaccactggaagggcccagcatcctctcacagcacagcgaactccgatgtggctctgactgtttaattaacgtgtagctaaagatcacagaaaaggggaaaacagcgaagacagaaaagaaaagaattcagaaccagctttagcttctgatattatgggaaattctgaagaggaacgaatggtatgacaaaatggaaagaaacattttcctggtgtgttttataaacacacgtaaagaggttcaataggtttaatgtggtaaaaggagatgtatttaaacatggcaggcatttgcccgaagctgcttgtaaataagctgtgggacagccgctgcggaagatgcagagaccccagagatgcagagaccccagagatgcagagaccctagagatgcagagactccagagacgcagagaccccagaaatgcagagactccagagacgcagagactccagagaggcagagaccccagagatgcagagaccccagagacgcagagactccagagacgcagagaccccagagatgcagagaccccagagatgcagagaccccagagatgcagagactccagagacgcagagactccagagatgcagagaccccagagatgcagagaccctagagacgcagagaccccagagatgcagagaccctagagacgcagagactccagagatgcagagaccccagagatgcagagatcctagagatggagagaccccagtgatgcagagactccagagacggagagaccccagagatgcagagaccctagagagcatgggggccctagagagaagtcactgacacacaggtttcggctaaaagttactattctgattagggcctgtgtgaagtaggaatgtgcctgtggagtgtgatgtgaacacagctctccgaaattttcccatgcgtgggccgattcgactgtgtgcttgtcctgagaccaagaagaaaactgctgaagtcccaaagtgggacagggttggggacaggacactcctcaggaaagaaaggccacaccctttctgcagacactcaaaaagactgctgtgtgggatgggggacagagcaagagaggaagacacgaaggaaaaacacacatttaccggctgtttttgtctgtgagtcgagtctatgaaacatgccgtgagattattttctgcggttgattattcatgcaacgaacacgtcagaacaccttcaggtggcccatgggtgaggtctcgcaggtgcagcctcctctccagaatctggcaaccaggagaggccctttggcgggcccagtaatgggggtgcatgcacctctctgcccatcccacacctctacacggctgctcccaggcaccagagcctccacctaccccaaaccaagtcctgcccatagtgtgccccgtagcaccgtcagccctgccttccatgattgcagctgatgtgcctgggggcgcgggcaccattaattcctgtatcttcccctctgtccaatccatcaccaaatcccactgctggcacctccaagacacctgcagactgcagcccgcacgccagtgcccaaggtcaggccaggtggcccctgcctgctccccatccttcgtgctctgcccagccgtccccttcactgtggtcagagctgtgggcggtaagccacccaggtgccgaggcaagagactgagggcacgaactgttccagtgtaataaaatatgtaaaataagaatagttatactagatctagatcatagatatgattatatatgaatatcattcatcattagtttgtagcaattactctttattccaatattatcatagtctttgctctataatcataacctaggaaaaaccaggccatacagagatagtagctgaggggacacagtgagaagtgaccagaagacaagggtgtgagccttctgttatgcccagacagggccaccagagggctccttggtctagcggtaacgccagtgtctgggaagatgcccgttgccaagcggaccgtggtcaagcggtagcgtcagtgccaaggaaaaacacccgctacttagcagaccaggaaagggagtctccctttccctgggggagtttagagaagactccactcctccacctcttgtggagtcaggcccacccgcagttatccggaggcctaaccgtctccctgtgatgctgtgcttcagtggtcacgctcctagtccgccttcatgttccatcctgtacacctggctctgtgttttagatagcagtagcaaatttgtgaaagtactaaaagtctgatatgcagaaataatggcgtaagctgtctcctctctcctctgcctcggctgccaaacagggaagggccccctgtccagtggacacgtaacccatgtgaccttacctatcactggagatggctcacactccttaccctgcccctttgttttgtatccaataaatatcagcgcagcctggcattccgggctactactggtctccgtgacttggtggtagttgtccccagggcccagctcttttatctttttgtcttgtgtctttatttctatgatctctcgtctccacacacggggagaaaaacccactgaccctgtggggctggaccctacacagagcgacacttctaacggggccctgttccagaccccactgcctgtgggtggagtccgggccgaggccccttcctctctgtctggttcttgctgcttttttcagtctggaatcttcggaggctcttgctctgctctaatgcagaccttctcccacacactccctccacctggaagctcctcctgccttcgtattggccttggtaactcccgcaggtcctgctaatctcgcctgaaaggtcacctctgccaaggagtgttaccctgccccagacaaggtcagatctccttaatggatgccctgagccatcacagcatggccaccaggcactccccggggcctcatccacacagaggccgggagcaggggggcacacctggcttgttctctgtccccatgggggcggcaggcactggatttggtgctcaaacagtgggtgctctctccgtcctcccatgagcccaggggaaagtgttgggaaaaacacatttgtaaaaatcacttttgtgtgcatttttcaacagaacaaaatacttccacatgtgcctgggtttaggatgggcaggagaagcccctgaaagggtgctcggtttgacgatgggatgttttcgtgtgcatcccgtcaccagccacagcagacccgttctccacaaagctcggtcagctgctggagcaggagtgtgctggactcctgctgctgcttctccagcgtccagtgaggcctatttcttatagctacattttgccaatgcttttgagtgattcttgttcagtgcctacaatcaacacagcaggacagtggctctccctggcagtgcctctcattgacccccttggagtccttacagaagctgcacattaagtcccacgcatcatcccaggtcaggggacggtgagtggccatccagcatggtggaagcaggtgcagctgtgccacccacatcgggacgcgtgctccactcgtggcattccaggctcacaatgtcgcccttatccgatgatcagccacctcggatgtgtccatcaagcttttaaaattcacaaacaaaaacaaaagatgcactagacccacccagcgaccccaaggtcacgccctctgtggttattggcaactcggggacgctgcccagctcccgattccgctcagcacctgtggacgcgggagcatctatcatcaatcctctgcaattctattttatgataaatacagaaatgacccttaacccacctttccctcctttttgctttttcctattgacacctgcccagcacatctgcctctcggcaaccacagaatgaaccagaaactttgctcttctgctgtgcccacaggaaactgaatctcctgacagcctcccatgactgttctgctagaatcgtcaaacttggggaaaaacaggatttgagatgaacttccacgttacaggcagcaaagcccaatgatgatggtctctttttcaggacaagcatttggattccataacacagtcagtcacagaccgagcaggtacacccgaggaatagcctctgcagtctcacctgctggccccacaacagagttctggattctttcctagtctgtgtttgggaaacacacgtaacgctgtggcactgtggcctggagtgggtgaggcagacggccagctgccctcccctcctgagcaaagggaagtgggtgcatggaggaccccagagagcccaggccccacttcctcatgaggaaaaggaccacagcaaagtctccaagaacccagcctcagcatccccgccactccccaaagctcctcagcgtggctgcttgggacccctcatctgcccccatctgccatgttcatgtgcacaaggtccacaacggcagccagaccacacctggaaagacacacagcaaaagcttcccaaggaacacgggccgtgaaggagttaaagtcctcaggtctacgaatacgacattatctttttttccttgtttcctgctaatctgtttaatgggaaagtttccctcctcacaacccatatacagaatgcttccttagttgcaggctttacaaataattatctagaaataaataagtacaatgatctattgtaagtaaatctgcataaagaagagttttcttttcttccatgaaaatctagccacttactgcagtagaatcactacactccatctgcgcacggtgacgcatcactgcagccacactccatctgcccacggtgagacatcactgtagccacactccatctgcccacggtgagacatcactgcagccacactccatctgcccacggtgacacatcactgcagccacgccccatctgcccacggtgagacatcactgcagccacactccatctgcccacggtgagacatcactacagccacgctccatctgcccacggtgacacatcactgcagccacactccatctgcccacggtgagacatcactgcagccacactccatctgcccacggtgagacatcactgcagccacactccatctgcacacagtgacgcatcactgcagccacactccatctgcacacggtgagacatcactgcagccacactccatctgcacacggtgagacatcactgcagccacactccatctgcccacggtgagacatcactgcagccacactccatctgcccacggtgacacatcactgcagccacgctccatctgcccacggtgagacatcactgcagccacactccatctgcccacggtgacacatcactgcagccacgctccatctgcccacggtgagacatcactacagccacactccatctgcccacggtgagacatcactgcagccacactccatctgcacacagtgacgcatcactgcagccacactccatctgcacacggtgagacatcactgcagccacactccatctgcccacagtgagacaccactgcagccacactccatctgcccacagtgagacatcactgcagccacactccatctgcacacggtgacacatcactgcagccacactccatctgcccacagtgagacatcactgcagccacactccatctgcccacagtgagacaccactgcagccacactccatctgcccacggtgacacatcactgcagccacactccatctgcccacagtgagacaccactgcagccacactccatctgcccacggtgagacatcactgcagccacactccatctgcacacggtgacacatcactgcagccacactccatctgcccacagtgagacatcactgcagccacactccatctgcccacagtgagacaccactgcagccacactccatctgcacacagtgacacatcactgcagccacactccatctgcacacagtgacgcatcactgcagccacactccatctgcacacggtgacgcatcactgcagccacactccatctgcccacggtgacacatcactgcagccacactccatctgcccacggtgagacatcactgcagccacactccatctgcacacagtgacacatcactgcagccacactccatctgcacacagtgacacatcactgcagccacactccatctgcagtgacacatcactgcagccacactccatctgcccacggtgacacatcactgcagccacactccatctgcacacggtgacacatcactgcagccacactccatctgcccacggtgacgcatcactgcagccacactccatctgcacacggtgacgcatcactgcagccacactccatctgcccacggtgacgcatcactgcagccacactccatctgcccacggtgacgcatcactgcagccacactccatctgcccacggtgagacatcactgcagccacactccatctgcacacggtgagacatcactgcagccacactccatctgcccacggtgagacatcactgcagccacactccatctgcacacggtgagacatcactgcagccacactccatctgcacacggtgacacatcactgcagccacactccatctgcacacggtgagacatcactgcagccacactccatctgcacacggtgacacatcactgcagccacactccatctgcacacggtgacacatcactgcagccacactccatctgcccacggtgacacatcactgcagccacactccatctgcacacggtgacacatcactgcagccacactccatctgcacatggtgacacatcactgcagccacactccatctgcacacggtgacacatcactgcagccacactccatctgcacacggtgacacatcactgcagccacactccatctgcacacagtgacacatcactgcagccacgctccatctgcacacggtgacacatcagtgcagggtagaaactcccccatctcccatgcagcccccagcggccgccatcacaggtctcactgtctcgccgtgtgtgtgtaacctgctttctccccagctcccacggctgtggcggcacctctccgtctctgtctgcgcatggccgctctctgtgtctgtaccttcacgaggtgatcccctcttctgctaaggacacagtcatgttggattgggacccaccctcatggagtctgacctcctcttattgacatctgcaaagatcctatttccaaataaggccaaatccacaggtagcaggggttaggttttgaccataactttctggaggtctcattatccccacagcaggtgtcacccagaaatggttgacagagtgtccactgcacaccaggcagcctgctagagacattgcattcattacctttgcctatttatgaatatgggaaggttttgcaaagcgatgaatggcatggaaagagaccatgtaggccttgctaagaaggatggcctggagggatgaagaaggacctttcaaggctttttgtttgaatcgaaagtttcctttattaagttattttaccaagtgagcttgtatcaaggctgagctttcagcgcagtatttatgagctgcatttctttcaaaacattctatcaaactgacatttccttaaatcagactgaccttccacaatatggaataaatcaggtggtttaactctactgactaaagagtgttttccccaaccctgagccaggcggctttgtccgtgtcgctcagctgccggctcactgaagggtggtcatggaagagcaggccgccgtcgggcggtgactgattacaatcatttgttgtgatgcatcgcaaattaaagggacaagcccagccaagctgctccgctcagagagtgcgcgtcccgcctctgcaattactgatgtgcacaaaggacccagggaccacttaaaacaaggggaggactgagtccacgcagggatgaagccacaggcacagtccccacgtgcttgacagtggccccgcaacccacctgctccagacacctgttccgagggaatctctcccatccacctgccgctgtggctcagaccccaggcacaacacaagcgctcggcagagaaatggaccgtgccgccaatgcactcggcgctgaaccatcattgaggagagaccagctgctgctgtggcccctggggctgcagcataaacagtcgtggtggcaaagtggtgtccacaattacttgtgtcgtccgtgagcacactggctgtggacggaggaaggctgtggctccaggattgtcatttcagcaccgctgcccatggtccaagagccgtagctgagatgcaatgggggtgtccttcatcaccggtccccaggaccacacctgaaggacctaacaatgatcctgatgagaaggttgttaacctgtcaaagcatcaagatgaaacatcacacaagacgctctgagcaggaacccactagtgacagggcccttcgatccatgtggaagtgcctaatgccacttttttgatgagcaaaaatggcagctaataatttaaggcaaaaaaggaacacaatccagtatgacagtttttccccaaccagagggagtgcccatgcgtggtgtcccacgaaggcggagctgggcatgagcacggccatggtcctgctgtcagagcaacctcattccacggggtgagcatctcgcaccttggtgcggaagcccagagcccacgctgacttctgcaatagcctcagtaaagcgacgggcgacggccatggcacagagcactgagcacagaggttatctgaggtggcttcgcatcagctcacagcagaggagcgttggcccagttcacagatggagaaaacaaggctggaggagaccaacgtgtccaacatcacaggtaagtcaaggctatgggactgaaactcagtcctgtggacaccagccagggctgcaggtgctggctgtattcctgctgttacagtcagtgcacatgtgtgtggggctctgcagtttcccaggtactgtcagtggcagtgaaaggtgatggcgtgctggcagcccttgcagccctcgctcactctcagcacctccttggccttggcgcccactctggccctgcttgaggagcccttcagctcactgctgcaccatgggagcccctctctgggctggccaaggcctgagccggctccctctgcttgtggggaggtgtggagggagaggcacaggcaggaactggggctgtgcgtggtgctcacgggccagcacgagttctgggtgggcgtgggctcggcaggccccacactcggagctgccagccagcgctgctggccccaggcagtgaggggcttagcacccaggccagcagctgcggagggtgtgccggttcccccagcagtgccagcccaccagcactgcgctcaaattcttgctgggcctcagctgcctccccatggggcagggcgcgggatctgcagcccaccatgcctgagcctccccttcgccatgggctcctgtgcggcctgagcctccccgacaagcgccgccccctgctccgcggcgcccagtcccattgaccgcccaaaggctgaggagtgtgggctcacggtgcacgactggcaggcagctccgcctgcggccctggtgcaggatccactaggtgaagccagttgggctcctgagtctagtgaggacttggagaacatttatctctagctaaggggttgtaaatactccaatcagcactctgtgtctagctaaggtttgtaaatacaccaatcagcactctgtgtctagctcaaggtttgtaaatacaacatttagtgctctgtatttagctaatctgatggggacttggagaacatttatgtctagctaagggactgtaaatacaccaatcagcactcttgtgtctagctaatggtttgtaaacacaccaatcagcactctgtgtctagctcaaggtttataaatacaccaatcagcactcagtgtctagctcagggattgtaaatgcaccaatcagcaccctgtcaaaaaagaccaatcagctctctgtaaaacagaccaatcagctctctgtaaaatagaccaatcagcaggatgtgggtggggccagataaggggaaaaaagcaggctgcccgagccagcagtggcaacccacttgggtcccctttcacattgtggaagctttgttcttctgctctttgcagtaaatcttgctgctgctcactctttgggtctgcactgcctttatgagctgtaacactcaccatgaaggtctgcagcttcactcctgaggccagcgagaccacgaacccaccagaaagaagaaaatctgaatacatccaaacattagaaggaacaaactcgggacacaccgcctttaagaactgtaacactcactgcaagggtccgtggctttattcttgaagtcagtgagaccaagaacccacccattctggacacagcaggtcagggaatggggtgccctacagagtttccagaaggcaaccacgacaaaacctaataccaattagctaatgaccattctacacacttacacacatatgtatgtgctcagaaagtgagacacactcagtgagagacacacactacatacaatcactcacacacacagtgagacacgggctcatacagcaagacaacacacatgctcagtgagataccacaattccaccagcagggaccatctcagcagaatgtggccatgcaggggcctgtgcctgctgctagaggcgacgaggtctcagcctctaagtacaaaccttcccacatacgaggacagagaaacctggggtgaattccacatagttcatctaacaaacaggcatcccgagcaagttggggtttaaccgcattgactctggcaacctgaacatgtgctgggtgtccaagtccagggctcagaagcagctggagagcccgggacatgcacagcattctcctggggacgtctctcaggacctgttacccagacgaccaagacgagatgcccaggacagccacagcccccgggagagcatgggaggtgcatgagggagctgtggggccagagactggggtcacagccatgggggagccgggggagcctggggagcccagcgctgtgaggttgcttggacacactggtcacgccggacactgccccatggtttcctgtccagctgtttcctggaatctggctgctaaaaagagagccatctacacactgtgtctgagggacgccaaggactccttcctccccagatgctcctttttcttctcctcagggcctctgtcatctcccactcaccaaagccccccctgtgccagtgatttccagaagctgactggtgggggggacattttctacttgcaggggagggaagagaaagggtcaccctccccgcaacagaactgactcctggctcaaccccattctcctccaagtcacagcgtggctctgtgatgactgctgggctgtcgggtgtccctggggaaaggagtgccagggcctcctggggatggggcacagagtggccaattttatggatgatggatgcttcacctgcttccaaaggggctgcaggcagcgcaggcataaacactcagcttaataaagaccaaggctgagaaacaagtaatccaggggaagaaaggcagaaagatggtgctgcgcatctggtaattgactgtaatctggcatacttctgggtgagagaagctaagcaggtgagcacaaaatctgggagtgagattgccgactcgggacgagagaaacgcctgacatggcagtggctctgactgtctggtggcaggaaccatgcagttcaccaggaacaccaacgtctctcctggtcatgggccccaagatgcactcaggcgtgtcctggctgagagacttggcggagcctcctcagcagcttcaggtgagttttctcaatgagtttcttacctcgcacccttcatgaaaaccaaggacataagatcatgggggagtcctgtaaggtctaccgaagacttactccaaaatgcaacgtgcagaatcctgcagtgagcaggggcatggtttgcggaatatgggcctccagaagcagctgtgttcacatggtcatctgaccaagtcagagccaagtctcaggtcagtgctgaaagggccctgggctaacgggctgcggccagaaagacagtggctggcggggcagatggagccatcagacccggggggagggcaggggctgccaccaccacacggcccccacgggtcagaccaaggttttgtatttcacaaccagcggataatgagttgagttgttcactaaactgacgctcagaactcttattcattttcagaacagtaaagtcaaaactccacgaggaccttaaaaaaaaccatattctggatttaattacagataaaagaaatctgacttctattaaaagaggagaaattgcgtatttaaaatggaaattaccccagagcatgggaatggcactgtctttctgtcttattttagaataagaaattatgtggccattcaattcttgaagaaaatgtttttaaaagggaagaggtggatgggcaggaatgcatgcaaagagtttcgttcagggaaagatcctgccctggctctctaacctcacacagggacgggctttctttccatgcctcagtttacctatgtgtcccacgtccctctgacatgacgttgtatgtttccatttatttcctctgaaaatcacataatatgctgctttgtttctctagcaaggaatggctgtgagcttgggggtcttgaggctcggaggcatcacaaaaaataagactccgtcagcaagatggtgtgccccctctgcctccctctccgttcccaaccaccagcctgggatggcaccttccatgaggtggatgagtcccctccattcaaggccttctctgcaaacagccacccttctggctccaggatgaaatgaggctctaaatatgggctgccaggctcagggccagggccgacaggcacactgacctgcagcatggctaccccaggctctctctggcagttttgccacagaatgtgctctaagctgtgctgcttcctttccttcaaccacctcccaactcctcagtatggaagggctctgagtgctcaaaggaacacagccttttcagctggtgtcacaagacatttacaaaacaccgtggagaaattccaaaaccaggcactgtagagagacagaaagtagttttccctacaggagaacgttaacgctaagatcggctttagaaaacacacacctgacacctgagttgtggtgactctcacctggtgaagtcccttacgaatacatccttacccagattgtatactttatgggaaaattaataatgccaagcagacggcaaggctggcaggtgactctggacctcaggatgtgacacaaaggactggtcctcgtgacttgagcacatccctgggacatatggggtggctgagggctctgcagagagaaacacttcctcagtggggccctaggcctgtcaagcgggaaataaagacgaaatcttaagcagattttcaatcatcttccttcaatatcagcaaatcccacaaaaattacagtagggagtagttataggttgaaaggttagagctggggagaaaagcaggctatattttcctgttttcatgaaatttctcttcttacacctggcacctaagcagcctgctgctgtagttactgttcaggttactatggccacaggagggctgaggcatgttagatgggtggagggcaagggaagggttgagatgcaattcttatttccacgtatgtgataatgctgttgcaatgcttttcagcgaagcctcctcctgcacccagggtgtctcctgatgcagaggggccgtttccaatgccttgcagtcgtctaccttccctgccgctgctccggccagcaggcatttgctgagtgtctactgtggaggagctcccagctggcagggggcaggggtttgtcttcaggagctcttggactgcagctgtgagtggtactcggctccagtgccattgaggtccctgggggctgctcccaatggcttgctggccttgcctccaggacatgttctgaacctctggggtggggcccaagagtctgcgtttttaacgacctccagctggtgctcaggggccccgtttgcagaactgctgttctacaatcttgagaaaaggtttctgtaacgggctggagagtgagtgtcggaggctttgtgggtcgggcagtccaccgtgaccacgcagctctgcctgtggcgaaagctgccagagacaaggcgtgaaggagtgagcgagtgacagagtgagtgagtgagcactgttcccaccaggcttccttcccagagcagcacaccgggtcaggccgggccgcgggcagcacaccgggtcgggtcaggctgggccgtgggcagcacactgggtcacgctgggccatgggcagcacactgggtcacgccgggccatgggcagcacaccagggcaggccgggtcatggtgtgcttagaatttggtgaggcggcagggtcggggcagacagggtggggtctgaggacagccgctgaggctcttcctgtggggtggcatggaccttgcagctgggagatggcaggaccgggtatggggaaaggagggaggaaggcaggcatgctgggctggaggagagctgagccagggtgggcaacaggacttggtgggggtccaggctgtgcagtcccaggggaagaacggcccatgccagcggccctgactgagcagagcaggccagagcgtggggacttcatccctcagtgtccctgtcactccttcaacatgaaggagaaagccatgaaacgacgcaggtggctgtctgatcaggcccactgggtgctgagcttgctgtccccgtggggtgcccgtgctcatggcagccgagggtacggtgcagtgcacaggaggcccaggccacagctcccacgccaggaccattagggacccagtgcagtggctggactgcagctggggcaggagctgctgaggaggtgggtgcccagcaccacctttgcactcggcaccacctttgcactcagcagaacggaggccgcgtcctcagggaagcatgggcctgcattggtacggcttcactttaaaaatgcatcatcaaaccccgcaaaccactggaaccgggtgcctattgaatgtgagcactcagcccaaatcatcactgtgaactaaggtatctacacctgcttcattctaaacagaaatgcagatctctctaagcaggaagcaccttaagctcctgccaccagcattcattgggggatgtcattttggtcggtcaagggctgtgaagctgatgggattttcaatttgtaccattttataccacatgaggaaattgtgtaattacttttgcccatgacttctcattcttaacttgctttctcatggattacaactgtaataagacaaggtgttgatagagtgcaaactgtctttaaatttaaaaggtctaattgtacatccacctttaatcagtgctaaaatatcaacacagattgaaacttcccttcccaagctgcctgccagaggatgtgataaccctgctgccgacaccatcttcacgtgctctctgtaagccgtgggctttgcatcatacgaatcatcgcatctcgttagtgaagcggcctcatcttgacactgaagacagtccagggaggagtgagcagcactgcaagaagatgtcttagtgcctgacacggtgggtcttatcagctcaagatcctctcccattctttttaaacaaaatttttagagatagggtcacgctctatcacccaagctcaggggcagtggcatggttgtgaccatggttgtgacagatcactgcagcctggaactcctgggctcaagagatcctcccacctcaacctcctgtgtgggacttacaggtacatcaccacgcttggctaaatttttaaatatttttgtggagatggggtctcactatgttgcccagcctggtctcaaactcctggtaagtgatgctcctgccttggcctcccaaagtgctgggatgacaggcatggccaccacacccccaccttctccattctttaccccccaaagtgctgagatgacaggctcggccgccacgccccacctcctccattcttaacccccaaagtgctgggatgacaggcatggccaccacgccccacctcctccattctttacccacaattgttgctattcttctaaccccatgacatcttactgtctgcttgtagccaagtaaagaacactactgaaaagagagtacttcatgaggatttgccatggcatctttcccactccaggcattcgtgggatgcccaggcacgcaaggccaatggacatcttgagtgagcaatggcaaccaacaacttataaactgctcagactttacattttgctctcacatcaaattattcccacttcatttgatctgaatgcagcctcgcggagtgtaactattggccctagctgacagagaaggcaccctgaggtttgaaaacagtcaatgagtcgtccaaagtcacaaaacaagcaaatagctgggagggtgctgtgaactcaagttctaaactccaagctcttgtttttccttcttccattttgccaacctcaggtgccatgaagtggcacagaacatccaggcagggctggagaggctgatacctgacctagattggtgcctaatccatggggcactgcactatggccaacacagcagacatccaaaagcagggactgacctagagtaaggaggctccattgccctcagcttcagtaggtaagcagccaactgctgtagaggtgctcatggtgatggaggtgctcatggtggaggtgctcgtggtggtggaggtgctcctggtggtggaggtgctcgtggtgtggaggtgcccgtggtggtggaggtgcccctggtggtggaggtgcccgtggtggtggaggtgctcgtggtggtggacgtgctcgtggtggtggtgctcgtggtggtggaggtgcccgtggtggtggaggtgcccgtggtggtggaggtgctcctggtggtggaggtgcccgtggtggtggaggtgctcctggtggtggaggtgctcctggtggtggaggtgcccatggtggtggtggaggtgcccgtggtggtggaggtgcctgtggtggaggtgctcctggtggtggaggtgcccctggtggtggaggtgcccatggtggtggaggtgctcctggtggtggaggtgcccgtggtggcggaggtgcccctggtggcggaggtgcctgtggtgtggaggtgcccgtggtggtggaggtgcccgtggtggtggaggtgctcatggtggaggtgcccgtggtggtggaggtgcccgtggtggtgaaggtgcccgtggtggtggaggtgcccatggtggtatggaggtgcccgtggtggtggtggtgcccatggtggtggaggtgcccatggtagtggaggtgcccatggtgctggaggtgctcctggtggtggaggtgcccgtggtggtggaggtgctcacggtggaggtgcccgtggtggtggaggtgctcatggtggtggaggtgctcgtggtggaggtgctcttagtatggaggtgctcatggtggtggaggtgctcgtggtggtggaggtgcccgtggtggtggaggtgctcgtggtggtggaggtgcccgtggtggtggaggtgctcgtggtggtggaggtgctcgtggtggaggtgctcttagtatggaggtgctcatggtggtggaggtgctcgtggtggtggaggtgcccgtggtggtggaggtgctcgtagtatggaggtgcccgtggtggtggaggtgcccgtggtggtggaggtgctcgtggtggaggtgcccatggtagtggaggtgcccatggtggtggaggtgctcgtggtggtggaggtgctcatggtggtggaggtgctcgtggtggaggtgctcgtggtggagttgctcctggtggtggaggtgctcgtggtggtggaggtgctcgtggttgaggtgctcgtggtggtggaggttctcatggtgcaggtgctcctggtggagatgctcgtggtggtggagatgctcgtgatgatggaggtgctcctggtggtggaggtgctcctggtggaggtgctcctggtggaggtgctcctggtggaggtgctcgtggtggaggtgctcgtggtggtggagatgctcgtggtgatggaggtgctcgtggtggtggaggtgctcctggtggaggtgcttgtggtggaggtgctcctggtggtggaggtgctcgtggtggtggaggtgctcatggtggaggtgctcgtggtgatggaggtgcttgtggtggtggaggtgctcctggtggaggtgctcgtcgtatggaggtgcccgtggtggaggtgctcgtggtggtggaggtgctcgtcatatggaggtgctcatggtggaggtgctcctggtggaggtgcttgtggtggaggtgctcctggtggtggaggtgctcctggtggaggtgctcgtcgtatggaggtgcccgtggtggaggtgctcgtggtggtggaggtgctcgtcgtatggaggtgctcatggtggaggtgctcgtggtggtggaggttcccgtggtggtggaggtgctcgtggtggtggaggtgctcgtagtatggaggtgctcatggtggtggaggtgctcatgtaggatctaaatgccattcagttgaaccttttggttctgctgaccagcgtgcatttaacccactcatcctcacccaaggactcttgtccaataatgcaaatacgtagaatgctgtcctggccgataagtccgaggcctgatggtgtgcagtgccctccttattaagaacgattacagggccaggggactcagatgccagccttgccgtgtgaatcatcatgtaaattttcaagaatgggccttcagagctttggcattcccgtgctgggaggaaaagtgcaaagaatcagatgcaaggcctgagagcccaggggccttgggcaggtgttgaccaggtaagacctgcctgtgacaagcgtccccagcagacaagcttctgagcaattgtttcccaagtgctgaatagcctcatgctggtcccaagtgctcagggacccctccctacccatcccaggcagctctcggacttcactgaacctcccctgccttccaaccaagagctgcttctccggagtcctggtgtcaggaggaactttcctgggctcaccaaggtgactctgtgttagtctgatcaactgtgcactcacaggggacaccaactgccaaggggtttgtgccacacactccagctgctgtgtagccctgtagggtccccaaagcacaaggagacaacaagggagagtttcagatgccaacgggctggcggaacataattttttaaataattgagcccttcagagtctctcaaaagtcataatatttggacaattcatgtctcaagacctgagcttgtcccaaggggcccataggtatggcagagcaggagaaaccctctgccctgcccaagatggcccaggcttgtgacctggtgcagctacagggcaggactcctgggccgaccaccagggacagagggcagtggctcggctgtagctgaggcaggatctgctggggaggtaggtgcccagcaccatctttgcactctccatcacctttgcactcagcaccacctttgcactcagcaccatctttgcactcagaaccatctcggctcctctgcccctactgcttctgtcgagttgccatgggaactgatattggtagaagaactcccaagaagtggcttctggcagacatcggcctcccctcagctcagagacagcctgtgagccgcggctgcaggaggaaggagcatggtgggcacctgtgtgctggctggaagttgtgtctccaggtgcccgggggagggtgtgggcccatgcgttggcttcagggccgcactggcctctccctgcaggctccaagtgcaccttcctcgggcaccccttgctttcctccttcaggtctcaaagctatgccctgcccagctgccctgcagaacacagccctgatttaaaatgagccactttctgctccggtataaagacactaccctttctatgcggagatgaagccgcttcctactaaggtatgaagacactgccctttctatgcggagatgaggccgcttcctactaaggtataaagacactaccctttctatgcggagatgaggccgcttcctactaaggtatgaagacactgccctttctattcagaggtgagggaaagagtggaaacagcattcgcttatggacaaagaggaaaagaaaaggctgtgaaaacaggcatggcagcctcgcatcatggaaggaccagggcttcaacacagcaaaacagagagccaagtggacagcaggctcctccagcaaaacctgaggcctcgtcccccaggcccacagcccagcggcatcttcaccagcagacgcggctcccctgggactcccctccagcacagctcatctccagtgggctaggacggctaccacaggaggacatacgtgtcctggccacagccgccagccatcctgccgtcctcccgtcagtctctaaccccacggggcctggggcagtgaagacagaaacccatgtgcagggaagagtaatacttgggaaactcagcgacgcccacagtgtgctccatgaccgtcacaccgtcagcaaaaccccctcctgcacatccagggtacagggccttctgctggatttcacctgccccggcagccgactgcaccagcatcacagcctcctgccgacgatccctctgctgggaggctgggcgttccgtggagagaacagctgagaccccctcggcagcttcccaggcaacagaaggcgcagggaggtggtggtgattcactgtgtttctaacaggtcctctggccacggaagcctcctgcacatgtgaaagcctgcagagaatcccacgcacttcaaaactctcactcatgtttttcagaagcgggttttacaacttttggcatgaaaaggtcttagtggcatttctatgggtgtttatctaggctgctcccaaaccccagccaactaggggtgagctcccgtggccacctgtgacagtcagcccctcgcagtagacgtgccgacgtggctcccgaggtggaggggaagctggaggccctgggggctcttctccctgatcagggtatgaattctaaatgaacgtgaaagtgaggatgaaatggaacctgctctccccagcagtgagttggaggggggccaggtgctccccagcagtgagtcggaggggacaaggcagcaccctctgccagcaggatcagcattgctcgttcatttgcaggtgagaacgagctgctcccatgagtggtatgtccagtgcataaaccccctctgtgtaaaaataaacacagaaaagtggctgctgagcaacgcagtttcctagcccttggtttagcagtatccccgagtgtcccccacatgcggctcctggcgttccacgctggtagccctgtcgatggcgatgcaattattttctaccacagcgttgtgttgtctgcgctcagggtaaagccatgatgaaggcggctttcgggacttgtaattacagagccatgggtggcctctgtcctcgcagccgggaaggtcagcacaggtcctgggtgctgccagccctgagctccactcctgcaaacacttgtcaaaatgccagaagtaattacctggctgttcagaatggagtcatggggtgcagctcctaccatctccgattccctaaagcctccatccaaaccgaaacttgtttacaacctcctggggctgcagccacagggcacctgctctttggcagcagaacctcgccatagtccttaccaatgttcctgtctgctggtctctccggcagcccaggggaggcgctcccgtgcaggtgggagttcttgttccatgtccagcccacgtggccctggacacaagctggggctggttcacacactgcaggccccctccccgcccccaacgcagcaggtccagcaggagacgggcactgagcctgcggggcccactgtgcagaccccaccagcaccaccggcccacgcttcccacgccgcgccctccacttcttcatctttttctcttagaggctcctctttttagttactcctcatcgtctgtgtctgtgccgtgagtcagggatgttctaagagcaggaggagagcgtggtgcttccctctgagcatctccctcgcccactctgggtgacacctcagccaggcgagctgtgggatcgtcaacctcatggctgcggagcagcaggatgagcacgagccccacgccagccacagctggagcccaggagcccccagcctgcgttgatcctggcagcagctcagctccatggaggacgtgacacagcggcccacgtgcagcggaacctggagccgggctgcccaggccacacctccagtctcactgctctggcgctgtttctcagctgcaccctggaggtctggcgaaggggagcgctgggatccctgtgcctggaagacccttgaggagagtgcaggtccttggagagtcactttcatcagtctgacaggtgtctcattcacctgcacatggaggcaattttctcagcaagtggctgttttgaacatttccaaagcatcctccttcatttctaataagagtgcaacttcccttccacactcatggctcaggagttcctcttgtcttgctccaatctcttaatcatgagggtggtaccggagcacggatgggcttcgggccccaccagtgcacagctccacccggcctggcctccctggggagtgggtgtgtgggagcgtggatggctttaggccccactgctggtgaccagcatgcagctccacctggcgtggcctccctggggagctggtgcatgggagtcagatgaggaacgtctgccgcttgtggaccaatgctgcagcagcaaggcacccctccccctcccccggggccaacctgcctgtgtccacctcagcggagctgattccatcagctgcagtgaaactcaggcccaagtccttcttagtggctgctgaagatgaagttcccacactatgaagtccgattctgaattccaccttgccagcctcttactggcatgtccttggcacactggaccccacatccaggctgcaccattctcattcctctcaccttcagcccctgagacccacgctagtccctgtgctctgcccaaaggccagcttctctgtggagcctcatctaagccctgccctgccctccccgatgtgccatccactgcccctaagaactcccgtctgaacagccctggcaccggggttggggggagcttctggagggcagggccactgacatccagagtgatatcaccttaggaaggtgtgatgcattgccgaagacagaatccgcacggagcggaccagactgtgaagcaccgatgcctgcctggggtcgatagttaaggctggctggattgtaagtatgtgttataaaggaattcacttcactttgccattacgcttttcaaaataagcacgtttgtctgctttatgagaggccagaagcctgggcagcccttgctccagcagagaggcctgtgactaacgcagaacgctgcgggctatggggtccaggcatcggcacagagtccagttctgagccgggattcaagagaggctcacaagagaggaggggagcctcttcctccatgtggacccgctacatatgagacgtgaaacacagacagcagcacagcagacacgaccctgttctgacactcaccagcttcacaaagatgccgaacaggcagaagcaggaggacgtcacggaaagtcaccgtacctctgaatacagaggcgccgctactgaaatgacacggggcgcctctccaacaggctgaaagaaacaatggcagctgaatgccgtgtcttagaggctgtcaggtggaggatgctgaggtcaaagggggaaactgctcaggacaggagccccccatgagcctcaccccaccattcagggtcagcacaggagccccctatgagccacacccccaccacacagggctgagtgccagagacacaccctccgtggcgcccgagagggaatgtttgaagaaacagcctgaactcggcctgaaggaaacggccgagcatgggaggggattcctggcaataagctcataaaccacaggcagccccacaggccaccgggtgagggtctctgcagactgggagccagcaaaagcaaacagtttctaaaggatgatgaatttccttttctttgaaaggagcaatacaaaaattgatcagaaatatactatttaagaagaaactaccaaggaaatgaagaataaaaaggatttttctcttctgccagttcaactatgtgactgagccacggagattaaacgtagctaccagtcatttctatgtactttgtggtagagtaagtgcctccttgagcaaaacccacttatttttaatattcactaataccctgtgctcatacccaaggtcataaattagcagaattcccgggaaagcattgcctacgataaagaggagacgctgagtaatggaaagcagctgcccttctcattcggcatcaataccacgtgacgtttgatggggactaatgtgggattaactacacgcctattcattaggttttgtatcattttgtataaaattagcaaaatgaatgccctttgaattctaccgccagggtgatctccccgcattaataacagcagcctcaggtcctcaggcccttgagggaaccagacgccagcagccattgggcttccaggcagctggcaggtggcaggtgcaggcagcacccagcactcccagtaatttcaacagcaggctcttgagttctgtatgttggtaacacaggcaccaccacacgtccttccataggtgtccgcccatcaccacagggcgtttgtgatgacactattaggattccacatcatcttttaaaacacaaaccataagaaactccttttgaatttgaaattcttccctgctatcatgtcagcctgtctacgtctcacctgaaactcagtaagaggctcctcttcaccgtgctaagcactctcccaaggccaatgggccagtcaccgtgctaagcgctctcccgaggctgatgggccagtcactgtgctaagcactctcccaaggccaatgggcgagtcaccagtcaccaaccgtgctaagcgctctcctgaggccgatgggccagtcaccacacatgggcatgtccactgcctacctgcaagatcttcacagtcacaaaattcttttttataatctcttgggttttttttgtttctttgtttgtttgtgagacagggtctccctctgtggcccaggctggagtccagtgatgcaatcttggctcactgcaacctctgcctcttgggtttaagtgattctcccacctcagcctcccgagtagctgaggtttgagccaccacacccagctaatttttttgtatttttagtagagatggggtttcaccatattggtcagtctggtcttgaactcccaacctcaagtgacccgcccaccttggcctcctaaaatgctgggtttacaggtgtgagccactgcacccggccaatctgtttcttatatagcatcaggcacgttcatgacaccatagaattattcaaaataattctttaaaaatcatgcatgaatgtaaacaattttgcacacgttcaagaagcaagaaacattctgactcacacagccacaggagttaacatggaggcactggtgcaagttagcaaattcaggtgtttagaaagttgtcaatatgagactcaaatgtacatttcctatgtggctcccccttggtgcagcacttcgataaataacatgaacacatttgaaatgactgagaaactagctttcaaataatcaacctcattttctctagagagccataaaataaatcaaaggtccttgtctgtgagtatattgttatgatttttaaaaatataacaagattgccattcctagcatccttgaggtcctgcaaacctaattccagtggcattgctccccagtactggagaaactgccaatcatgggataattatcaatgcatttctgcataatacctgatcacggatttggtcttaaatatctccaataatcacttctgacagggaactagagcaagcgaaacagatgccatggagggagggagctctggcagccacgaggcactgaagccgttgttgggaccccccattcctcttgcgtgggagtgtttggtatggatcccactgacttttcatgctgggaccgcactggaccgcccagctggagtgaggatgctgggctgcttttccgagttgtaccccagctccacaagcctcacagcaaagtatggcaacaaagtgagactggggactcaagtctccacaaaccttaaatcagactgcagaagtttagtacaactttgcaaagcactgtatttcaaccacaaattctcagccccctaaatcaccaccttgagcaaaggagttactgagggcacgaggatatcccataagcaaaacccgcagcagccaaaacagataggaccagcaattcgctccatcccttagaacatggtggctacttcacaccttgattactctcactggaaaaagaaacttcaagtttacagggtgccagtacagtgacgcctcaatcaacgagaactaagtattgaaatcccgaaataaaccagagtattttgctgcattttacactgggaaaaaaagacacaaatttaagcaaaaaaaaaaaaaaaaaaaaaaaaaaacaagttcatagatttagcaatataaaggactggctaaaaccaagtgtcatttcccgctgtggctgggtcagtgtgttccgtcctgtcttatcaatgatacggaacgggagcaccctgcctgcggaatggccctaatgcactgaaaaccatcaggctaaggttctgttatgcttcctgtatttttcttactaggcaggaagattaaacaatacactctacaagagttttcaacaagtttaaaaaaaaaaaaaaaggcaggttgaggaaaatgcaacattgtgtccaccatcccattctgttcttcaagactctggagagtaaagctttgtgtttttcactcaatgacaattattaatcatataacaaagattactcaagctctatctgtaagtacatctcaaaaatgtgtgattcgcaatgcccagaaccctgggctctaaacagtgaaaccgtctggaagtcggccggtttttactgaaacctcccagatactttgtggtgtctctgcccaccgcagtcgggagcagggccggtgtgtgctcctggtctggtacaaaatgaaaaacctcaaagcaaaattgcacgtgctctgcacacactgggattactacaaacaccaaatcttgcttttccaaaagccggatttgttctcggtcacttgcagccctgtgtctcctgccttctatctgagccagttccacacatcagggcagcccagtccctctccacacagtgaaatcccagatggtgcccacggacagccacattgccctgtgactgcccctcgtcccctcactgcacaccagatttccacggaaaccgagaccttcctctgggttgccccatgtgggtagtgtgagtctctctctgccctggctgtgcatgtgcgtgtttgcgtgcgtgtgtgtgtgcacacacgtgtgtgtgcgtgtacgtgtgtgtggaaacagcctcacctgtggccttctccacatcctcagtggtcacgttttggacattggcgctcactttgaaggtcactgctggtccgagaaccctggaagggataatttaaaataagttcataacgaagtctacgcgccacaccgcttttctgaaaacgacatggaaaacactggtgtgtttttaaaaacgcaaacatccaaggccgctgtggctccaggcgtcgactccactggacgtcggttttccttcacaccatgacctttgtttccatttgccaggaattccgtttttgggctttgcttttccaaaacacacatcacagtgtaatatgctatcctaaaaaattcacatcaacctctgaacccagcaacagcaagcagatattcttgctagagaaaaagaaaagttgttattgaaatagattttagtctttggtccccaagggagatgtatgaatctagagcagagaggaaagagactagtattttttaaactcttttgacaggaaccatttaaaaaactaccaaagtcattaagaactactctgtataaaaacaactggcagggaattgctagacaggaattatcaaaattgttcaaagctttttaaatgctatgtcaaccacaattttgaaaaaataccttactttttaaaccatttaattcatctgaagaccccatatgcagtagaaactgattattgtgcctacagccatctcaaaatgaattaggaatccagggtccattcccaaagacagacagactgaccccatgtccacagatgacagccatagatagctcttcctggaacagaccccttaaatgtcttctaagaagtaaatccctggaacagacaggaaatgcgaagaggacccaatttaggtgggagagggcagctaagactgttgcttcctggtccctgggaggtgcctgcactgacatctaagctgtgaaactgggtaccatgtagcccagggtcccttgctgtccccactgcagccacacaccctccaccacaggctcatcccaaggcagcatatgacacccaggctgtggattttgcacccaaaatcctttcaacctcacatgtatttttgattcagacatctctgctcatgatacctcagtcccaacctctggtcttcctccttgggatttttgctcattctcccagccagggccagctcctccatgtgcaagcccttggtgaaggggactgtcgtgccattacgaggcagcacaattaccatcctaacaccatggctgaatattccatgtggacgtcttagcatcactttgaactcaacaaggtctcccttgaatcagcgcctgctctgaggagcaaacagcattctaaccttacggatattccctttggcttccttatgccaggaatatccagctagtcaccaaattctgcggaaacccttggaaaatgcaccatgtccaccactgcctcttggttcccactgtgatcttctagtccaagcctgtgccctgtcacagcagagctgagtgacttcctgcgtccagctctactgcatgcaaaatgtccttggaagccgcctccagggatgaccatggagcaggagctggtgtcttctcgagcccaggccccaggcctgtctacggtgcctcggctgggccctctgctggtccccactatgggccctcagaaaggaggaggccactccctccctggactgcagctctcctgccaacgatgttccactcgctcatgagtgctgagttctaccccctctcaaagccctactcccgagtgagcactgtgagagtggctgattctccctgtctccacagtcttccagaagggccctgagtgcctgatatttagtgctcaaatggcacaccagacgttttatagatgttttccttcttcccgagcacaggatgggctctttgaagcatgcatgatgatttctgccacggcctcacccacgcaggaggtgatcaattcatatttgtgaccggttcaacattttggttgaatggttttctaaaattaagagaaagtcctcattaacacaagcagcactcatgtacccccgaaacaacgctgaggacagagagctcagccacagggcttcaagcttacacacggcatctgtgaaactgtaatctcgaccacatctgaagattccctgacagatgggactggaatatcctaaacctaatttttccctcacgtgctgaaagttttctctaaaggctgtgaggaggttcttggttcctcagagtccaaagacccagacccctatgctatgaagaagcatgtgacccatacatggccccgtatttcacgtgggggccgcaggagaggcccacacagcccgtgtcctttcttgcacgcatgccgagcgtcaccattgcgtggggctgtggtcatcaccagggagtgctcctgacaccctcggggtacatctcgcaggcggtgagcacccagtgaccatcgccgtcaggcccagcgagacccaggtgcctgcggtcacggtgcactgagccctggctctggcccttgtgctctcaggaaccctgtgggaggacggggcatgaggagctgtctccggaggagactcagagggtcggtaacgtgaccccaactgcataaccttccctaacttgaatatgtgcaggctctgacgtgggaagaagtctctatcccgaggccccactacaggtctaactccatgagtcactgttctgtggccctcctgggcccttccgctgggcctcagtttactcagctgtcgagtgtggcaaggcccacaggtcctcttggacttgctttggcctaggagaccctggttttcaataaactctggtggccaggcccagcgggtctgcagtaaacaggggcaacactgggggctccagagctgagctgctggctctgcccccagcaccatcagcagcagagatccctccccacaagaagaacttgccctggcatttgttaccaaccccacccaccaccccccaccccgcccgccacgtctgctgtgcaggtggcagatggctgagtgctgtgtggtccaggtgagaggcttctgggtagggagtgaggtcagccttcccaccaacttctttctaaccagggagccttggttgtctctgccatcttgttcagctttctgtctctttagacatttggggaaaattgaataaatcccatgtgcatattgccagcatcaaaaggggaatttctgtactaatcaggaaataaaaagtaaaacaaagatgcctagagccctgcagagtctcttaggagcaagtactgcacctaatattacagctctcggggagaaaacacccaggacgcccatccacacccacgacactcatccacatcctcgacgcccatccacacccacgacgcccatccacacccaccacgcccatccacacccacgacactcatccacacccacgatgcccatccacacagatgcccatacactccgacactcatccacacccacgatgcccatccacacggatgcccatacactcctacaatgcccatccacacccacgatgcccatccacatccttgatgcccatccacacccatgatgcccatccacatcctcgatgcccatccacacccaccacgcccatccacaccctcgacgcccatccacacccacgacgcccatccacacccacgacgcccatccacacggatgcccatacactccgacacccatccacacccacgacgcccatccacacccacgacacccatccacacccatgacgcccatccacacagatgcccatccacacccaccacacccatccacacccatgacgcccatccacacccaccacacccatccacaccctcgacgcccatccagatacccatccacacccacgacgcccatccacacccttgacgcccatccacacagatacccatccacacccacgacacccatccacacccatgacacccatccacacagatacccatccacacccacgacgcccatccacacccacgacgcccattcacacatgcccatccacacccatgacgcccatccacacccacgacgcccatccacacatgcccatccacacccacgacgcccatccacacccatgacgcccatccacacccacgacgcccatccacacggatgcccatacactccgacacccatccacacccacgacgcccatccacacccatgacgcccatccacacagatgcccatccacacccatgacgcccatccacacccaccacgcccatccacaccctcgacgcccatccagatacccatccacacccacgacgcccatccacaccctcgacgcccatccacacagatacccatccacacccacgacgcccatccacacccatgacacccatccacacagatacccatccacacccacgacgcccatccacacccacgacacccatccacacatgcccatccacacccatgacgcccatccacacccacgacgcccatccacacatgcccatccacacccacgatgcccatccacacccatgacgcccatccacacccacgacgcccatccacacctacgacgcccatccacacccacgacgcccatccacacatgcccatccacacccatgacgcccatccacatacacgacgcccatccacacacacgacgcccatccacatgggtgttttctccgtcaggcacattgtaaccacgtgtcccggcctcacacacagagcacttccttcccattcctgctttggctttgaagcatactgtgaaattcttcgtggctcccttctccaccaggcgctccttacacagtgctcacctatctaattacagacctgcttagaaattccaggggccaattttcaaacagaacaggcagagagactgagctgcagaatcctctgctgagggggagttaggaacaggtagcccaccgctcccaggctgaagccacaatgatagaaaccaggcctctgcacgatgagataaccatcagaacagacacacagcctggcgtccgcctgcaccactccacacagctccatgccttttcctccttaaacccctcactcagccacaaagggggaatggtctgttaaaggcatgagcctggccattccccagctgccagcgtttgattaataactgctttcctctgcccacacctcactctcatgttttcggcctctgagtggcaaacagctggacttgagccagttacaacactaggaacaccagtcagcactcagcactgtgctggggccatttaaacaacaaaaccaccaacgaaaagcacaaaaaatgtggaaaatgtggcactcaatagaccataaagaggagccttgttttacagtatgagctgaaacgagaaggcggagctgtcctctcccacctgagcacaggcatgtcaggcaacctgaactttatggctctgtgtgtgtgcaggaatgactttggcataagcattgatttgggggttacaaattaatttgcaaatacagaatctgcgaatgaacaggatcatcgactgcctagcatctgtgttgaagcgctttcacacacatcaataaccttattatcttcttcacatttttcaattttatactgtagagaggatgggagcactggagcttacaaggcttgagatccaattgtttgtttaaccgccacttcctcgcggggcgattttgcacattacattatttaccctgcaaaatcgggggaacaagacaaacattgcagggcattggaggatcgggcaggatagctgacatgcgacagggttccctctgaaccaaagctgtcagtctgtgccctgctcagtcaggaggggtctgctcctcctccaaattcttccataaaatccactctctaaattgactatggcttgtgtgggttcacacagtccccgcacgctgtactgctttctcagggagcctggttgctttccttcgggaatgacgtggttgatacaagggaggggactgtctctttcccgaccctggaccgtgcagtgaagatctcatgaggaatctgtaaatggccacgtcagggtagatcttgaaagtgtcgtcccgatggtcgtgccaggcacatctatggtaagaagcgtctgatgcaagagcaggaagagtttctgagtcactgttcctgggagaaccatccaccttttgacagtcaaattcacttaccgtgaaaggtgactcctatttagggtggaagaaatgccaaaaaggaatgctgcccactcagatgcaaacgcttcctcccctgacgaaggagggagtcttcacacaaaccttcctcccctgatgaaggagggagtcttcacacaaaccttcctcccctgatgaaggagggagtcttcacacaaaccttcttcccctgatgaaggagggagtcttcacacaaaccttcttcccttgatgaaagagggagtcttcacacacatccttcttcccctgatgaaagggggagtcttcacacaaacccttcctcccctgatgaaagagggagtcttcacacaaaccttcttcccctgatgaaggagggagtcttcacacaaaccttcttcccctgatgaaagagggagtcttcacacacatccttcttcccctgatgaaagagggagtcttcacacaaaccttcttcccctgatgaaagagggagtcttcacacaaaccttcttcccctgaggaaagggggagtcttcacacaaaccttcttcccctgatgaaggagggagtcttcacacaaaccttcttcccctgatgaaagagggagtcttcacacaaaccttcttcccctgaggaaagggggagtcttcacacaaaccttcttcccctgaggaaagagggagtcttcacacaaaccttcctcccctgaggaaagagggagtcttcacacaaaccttcttcccctgatgaaggagggagtcttcacacaaaccttcttcccctgatgaaagagggagtcttcacacaaaccttcttcccctgatgaaagagggagtcttcacacaaaccttcctcccctgatgaaagagggagtcttcacacaaacccttcttcccctgatgaaagagggagtcttcacacaaaccttcttcccctgatgaaagagggagtcttcacacaaaccttcctcccctgatgaaagagggagtcttcacacaaaccttcttcccctgatgaaagagggagtcttcacacaaaccttcttcccctgatgaaagggggagtcttcacacacatccttcttcccctgacgaaagagggagtcttcacacacatccttcttcccctgaggaaagagggagtcttcacataaaccttcttcccctgatgaaagagggagtcttcacacaaaccttcttcccctgatgaaagagggagtcttcacacaaaccttcctcccctgatgaaagagggagtcttcacacaaaccttcttcccctgatgaaggagggagtcttcacacaaaccttcttcccctgatgaaagagggagtcttcacacaaaccttcttcccctgatgaaagggggagtcttcacacacatccttcttcccctgacgaaagagggagtcttcacacacatccttcttcccctgaggaaagagggagtcttcacataaaccttcttcccctgatgaaagagggagtcttcacacaaaccttcttcccctgatgaaagagggagtcttcacacaaaccttcctcccctgatgaaagagggagtcttcacacaaaccttcttcccctgatgaaagagggagtcttcacacaaaccttcttcccctgatgaaagggggagtcttcacacacatccttcttcccctgacgaaagagggagtcttcacacacatccttcttcccctgaggaaagggggagtcttcacacaaaccttcttcccctgaggaaagagggagtcttcacacaaaccttcctcccctgaggaaagagggagtcttcacacaaaccttcttcccctgatgaaggaaggagtcttcacacaaaccttcttcccctgatgaaagagggagtcttcacacaaaccttcttcccctgaggaaagggggagtcttcacacaaaccttcctcccctgaggaaagagggagtcttcacacaaaccttcttcccctgatgaaggagggagtcttcacacaaaccttcttcccctgaggaaagggggagtcttcacacaaaccttcttcccctgatgaaagagggagtcttcacacaaaccttcttcccctgatgaaagagggagtcttcacacaaaccttcttcccctgatgaaagagggagtcttcacacaaaccttcttcccctgatgaaagggggagtcttcacacaaaccttcttcccctgatgaaagagggggtcttcacacacatccttcctcccctgacaaaagagggggtcttcacacaaaccttcttcccctgatgaaaaggggaatgttcacacaaatccttcttcccctgacgaaagagggagtcttcacacacatccttcctcccctgatgaaagagggagtcttcacacaaacccttcctcccctgacgaaagagggagtcttcacacaaacctgtcttcccctgacgaaagagggagtcttcacacaaacccttcctcccctgacgaaagagggagtcttcacacaaacccttcctcccctgacgaaagagggagtcttcacacaaacccttcctcccctgacgaaagagggagtcttcacacaaacccttcctcccctgatgaaagagggggtcttcacacacatccttcttcccctgacaaaagagggagtcttcacacacatccttcttccactgatgaaagagggagtcttcacacaaacccttcctcccctgatgaaagagggagtcttcacacacacctgctgcctagagccctcagaggtgtgatactcgaacaatgtgttcacatgggtcctatgaagaatatattaggagaaacaaaagctatttattgccgctaggagtcatctcccaattgggctggaaataacatgaaaaaatatatcactgagattctacagaattcactgacttaaaactacctttaaccaaaataaggaaaccatatatgttgtacatagataagagatcatttcatcactgtaattttagctatagttacctctattttaaatatcattccatttattcctgagttctttatcactcagtggttccacttgatagtttactatatattgataattgctcatttcttttgatggtcataaaacatgccaacaaagaagagaagtgacatctagcattttaacactgattttattgcttgtgttctaggatactcctatcactcaagacttatgagacaaacataccagccctccatcaaccagactgttgagtgtaagagttctgcgtaaaaggccttttcttaactgaggactatttggaaatctctttttcccctacttttatgagtgaaataatttaaaaatacatataattatctgcctttagaacatcaatatactgatgtactaatatttgttgtcttagcaatcatatatctcaaagtgattttctgaatattagttttcagggcatgacactttaaccacaggaaagaaaacactgagctccatctgttcttagaccaaccgtccggttgagaatgaagaagatgaacaaatctctgacaaaagcttccatgtttcggaaatggttttaaataagaaccgaggcttctatttggttgggttagtctgggggttgttatttctgtatagtaacgactatacagtcgatacataacacaggcttatttgtatcaagtcaacctttaagggctacaataaatgtaacacatttgactacagttttctgaatagacactgcctaagcagtagttaacaagtttgtagtccgtttaaataaagacaggcctcaggtactagattcccttgactttttgtggataaaaagaagatagccaaggcatatatggcaacaaatatagttttaaagttaatcatttaatgttgatgctttacaaccaacataaaagtaaatgcttctcttttcaactggtgaattttcttgaaagttatttagaaatgaaaaaaacaaaacttctgtagactgttttttgtttgtttattttactagcatgctctctgctggcttgacagactgacctgtgctttatctatttgacacctggatttggagtgaagcccataacatgaatagatgggtgcgtgagggataggtgatagatggatgggtagagagatggttgggtgagtgggtgggtgggtgagagataggtgatggatgggtagagagatggttggttgggtgggtggatgggtgagggacaggtgatagatagatgagcagagagatggttgggtgggtgggtgaaagataggtgatggatgggtagagagatggttgggtgggtgaaggataggtgatagatggatgggtagagagatggttgggtgagtggatgggtgagggataggtgatggatgggtagagagatgggtgggtgggtgagtgagggataggtgatagatggatgggtagagagatggttgggtgggtgggtggatgggtgagggatcggtgatagatggatgggtagagagatggttggttgggtgggtgggtgggtgagggataggtgatagatggttgggtagagagatgggtgggtgagggataggtgatggataggtagagagatggttgggtgggtggatgggtgagggataggtgatagatgggtagagagatggttgggtgagtgggtacatggatgagtagatgggtgaatgggagggcagagatatatatacacatatacatgtatatgtgtgcatatatatatatacacacatatatgtatatatatgcatacatatatacatgtgcatatatatacatatatgtgtgtgtgtatatatatgtaggtgagtgggtgggagggaggatgggtggatggatggatagatgggtgggtgggtgggtagaaggatggatggatgggtagagaggtggataagtggatagatatatgggtggatggctggctggatggatggggaggtagacggatggatggatgaaaaattgataggtgggtggtttggtggatagagatatgtatatatttattgcttatattaattcaaacataattagacactttctcaaaatactgtttatagcttaagaatcattttgcattaaacctttcccatcttgtgggctatacatttagtgaattgctcattctgtttcttagtcagtattatgttcagagaaacacagtgctaataaaggtctcaaaattatcaaacaaaatcataatgatttaagagacttactatatctggctgaacataatttgaggccaggtaaaacctggaagagctcactacacacagtacatgttttaggggctccctaaagccagcccctcagcctcgaggtagaggcacaggggaacttccaagaaaccagccctgtgtctggccttgagtaggtgggcgcaaaccaagagagcacgctgctgtggtgctcggtaacaaccacaaaatttgacctaaggcaactcatttggcaatcgctattttatagatgaataagttgaaacccttgtagttttaggtgctagctccaaatagtccaattctaatatcaatgccaccactagaatcacaacttcggcgttcttggctgagagccttctgcgaggcacgagtataagtgtgagacccacacgcaggcctgcacctctgtcctttcctgactctgccgctggaccgacccccacaccatagacccacacgcaggcctgcacctctgtcctttcctgactctgccgctggaccgaccccccacactgtagacccacacgcaggcctgcaccgtcctttcctgactctgccgctggaccgacccccacactgtagacccacacgcaggcctgcaccgtcctttcctgactctgccgctggaccgacccccacactgtggacccacaggtaggcctgcaccactgtcctttcctgactctgtcgctggaccgacccccacactgtttgtgcttttactccctgaattgttcctgatgataacttgcctcctccagtcttgttccttgttcactggcgtccctcactctaggcaagcccacagcttggtgctgggctaatccaagctaccgacagaaaaccaataaaaaaatgagctcacgtctggctgctacagaattctctttgcatgcctcattccagctatgtcttcttacagaggagacatcgggaacataaaactccggaattccacgtggatagcataatgcatacctactttccttacacacacttttaattttaccacatttcctgcacaattgtgtattcctgcctctcgtacatgaggcaataacttcccaaaatatctagcctaagagcttacaaaggaggaagaagagagaaccaattcttatttgaatgtatgaggaaacaaagacacacacagttattgcaagataatttaacatcatgcaagccttaatgaaaacataattattaatgatgctttattttcttaaagcattgagcaactgcatcactgtgcagattgtatcttctttgcaattactttgccattacatgggatttgggaaatcctttctgtgccagggaatgtcttgccgcttacttttctcatggagtatttggaagaaaacagattgttcagtatgtatgctttgcctttgaactttagaagcatttgcctcctttgaagttctactgcaggctgctttcctgttacacctgctgggtggcatgaccagtcccaagagaagacccttgttcccccagcacaggggtgggccggatctcaccaggagcagcagaacgctcgccattcccgaaggaccagggccaccccatctgtgttttttctgttttgtttttgtttttgttttcagacggagtctcgcactgtcacccaggctgcagtgcaatggcgtgatctcggctcactgcaacctctgactcccgggttcaagtgattctcctgcctcagcctccccagtagctgggattacaggcacctgccaccatgctcagctaattttttttttaaaatagagatggcgtttcactatgttggccaggctggtctcgaactccagaccttgtgatccgcccacctcggcctcccaaactgctgggattacaggcatgagccactgctcccggcccccatctgtgctttctattgcagcttcgctctcatgatgcttaaggattaatgagctacacaaacacatgactgaattattagtgactaacatttagaagtagaagcattcacccaagaattaggacccaggctttttcccgaagcctcagcagcttggccacagccttcggtgctgtaggacaggcaggaaaggtgagaactcctccccctgagtgttcctgagggctccactgcgcagtccccaccatccctcagggtctcctgggcactgtggctcactctggttttgtttcttgttttacttttgtttctctggacacgcaggctgctaactcccgaaggcaactgccagccttcaaacaactccagtttgcaatcccaaatgaagtgtaacgcacactcatgggccagcatccgtggtgggaggagccgctgggtcctgtaactggggcaggtttatattcctccctgccctgggttgcaggtctcagcctttcctgcaggaggtgagtcctgaataacctgccccgcccatctgccccaaagcctcctgcaatcagctcatgcgcaacgtctctgactggagagacacattcggaagagtgaagtgatttttatttggtcctggtgagaaaaataagaataacgccaagcagggtatctagtattgacggtgtaggtcataagtaaaatgcatattttaccacagtgtttggtgtcatttctatataaatctaacttgttcatgtgtttacatatttcttggcttagacattttattactttaataatgtatctggaaagctaccctttatttggtgttaagtatctgcatacgcagggcatttaattctacaactctgatgtagacattatcgtctctactccatggaggagcacactgaggccaggtggcttcagtaatctgcccagggcctcacagcaagttgagaaaaacagagtcaaacccatgtgcctttgaattcagtctgcccattctttcgtggaatcattcattcactcattcaacaaataagcccctgttatgggccagaaacactctagtcactgatgacgcatgattgagcaatacagactgaggccctgccttcaaggagcgtaggagtgtatactttctggttctggttttgcagagacgaggtcttgctatgttgccctggctggtctcaaaactcctggtctccagtgatcctcccagttcagcccccaaagtactgggattacaggcgtgagccgccgcaccaggccaggagataaaagattcaagtcctatggatgaaagtgcctttacaagaaaactcagaactgcctgggaaactcttcactacctggtgtccagtacccaaatccagcatttacccaatgcttcacacttgaagtgcattgaaaagtctagagaaaagaatgggttcttcttgccaatctgaatccattaacagtagaaattagagtgttttttttcctaacagcaatgaaatagcgcaattgtccagctaacatgtattgcaaacctccacagcagacgttattctagtttttcctagagtctctccaaccctgtcatggcctcacagccgtatacataatttgtggggccctttgttgaagaattgtaagagtctcaagatggtaccagcaaagcatgaaccatgtgtggggcctctaagagccgggtctcagccacatgcccaggccacctccatccttgtggggaaactgaggctcaggaaaataaggaaactgctctcctcctaaatggtcatatcatttcatactaggaaacaaggctccaccaatattttaaacacaaatatctttaatcaaatcatgggattcacttaacctgagaaatgccacctttcactcaaacagaattattatttgcaaatccacagtggccttcccttgttgtctcatcttaaagacgggacggggagttttgacgtactgtgacatttccttgacattccttatttccaggaaaacctcatgtcactgtctcgagacactagcttgcacctttgcaactgcttgtaatattcagacagggcactgaagacgaagcctgggctccgtttgggaaggagagttacataacatgaggccccattccccaccttcctcacttggcaaatccagaacacaggtgaaacaggtagcaacattgcccgtgagggccggagtctgcaggtggtggatacaccacatccagatgcaaatgccatttacccagaccctcccctggggctcctgggagtttctcactgcgggggctcttggctttgagtgatattactaacgcacagcactgtcgctgcagtggttaatctgcactgccctgatgtgtagacaaaattatccagggctttatagtcatcgaggccacagggaaaaccagagagccaacccagggaatgaaggaccattctcacccctcacaggattcctgctgcctacaacatctttgtaaatcccctatgcatggggacaagactaggggcaaaacaatcacaactctgcccccggaaactgaaacatactttccagaagtttcccggcaaaccccagggacttctcccactggcagggtgggagaggggcaggcactggggaaggaggtggaggggcccgggcagcactggggttgtcacaggatcgagcaggcacaggcacctcccgcgccccgtgcacagagaagaccccaacaagaagcatcagggttgagaattcccactgctgcctcttcggtaataacaccgtattcatcaatccagtaaatcacacagatgagaaagtaaacgcttctcccaccaggagagcacatgaagattgatcacagaattaggctgcgtgccccgaatgccccggcggtcctcgtggctgatgtgggagctccaccgaagccatctggaagagaactgtcacagagcccgtctcactgtggactcaggggctcgtgggaatgtgtctttggcatcctttttcccaggagcactgcccacctccccgagattccgcggaaggcggcctggcatcgatcaccgccgccgcagacagccacaatcacgtcgtaaaaacccggctgcggtcactgccggtctgctggcataattacatcacatgctaatgcagttttaatggtctctaatgatgtcataagaaataatgggatttatgtgacagctacataaccactaacaaaacatattcagcataactagcacttccacaaaaccgcaggagagtctgagagtgacagcttgcgcatcctgtccgcctcttttcctttcccggaacaatgagcagctcccagaacatgctctgacaggcagcaccgcgtggccgtgtctcccgcctgtcagagctgctcccctcgagacaccaacgaggcacagcccacacccccgtccgtccctcgagccggtgcatttgccaagtgtgtgcccgtggctgctgggcccgggtgaggcacaggacgtggaagtaaggcttgcgtggtcccctgcacatgagcacacacgcacgcaggcaccagaactcaagacccagcgtggggcagcctctgcctggccaggactggggacctcggagaagcgctggacgcagcaagaatcaggcttcagctccgcaatgtgggcaggggacccgcaaaggatcctgcgggtgaggccaccgggggggctccctggggaggaggtggagaggtccagattcccgaaggctccgagggacgggcggcgggactcaggtttgactctgtaggaaagagggggccgccagtgtcctaaggcgggagatgcccgagggtgacgcttacccaggactgagcctggcaaagcccagccctgctcccggaatgcggagaagccgtccgtgctcagaatccgtcttccgacagcgaaggcggtggccaggagggccaggggcagggagcaggcacgggcgaggcccagctgctctgtgaaaccagaggctccccgaggcacacgcctccctcgcccgccccggcctggcatctgccagtcccaccattttgctgagactctgtgaaggtgaatggggttgcttgggctcggggactggaagaagaaggacgtttatctcgtgaacgcgggacgctccttatgggagaggagtgggagacatgaagcaaagcgtgaccaccgaggagctggggagaaagcgagaaagcaaggaagcagtgggggacggggaacggggccgcggggagggccggagaagatggtagaaggtgacagtgcggggtgcagcgttcctgggtccttgaggggagccgggcttctcagccttgaagacccacttcttctctggcctcattcctgggttccgcatcccggctgcctccccttcctcccccaacacatcccggctgcctccccttcctccccccaacacatcccggctgcctccccttcctcccccaacatcccggctgcctccccttcctccccccacatcccggaggcctctccttcctccccccacaacccggctgcctccccttcctccccccaacacatcccgggtgcctccccttcctccccccacatcccggatgcctccccttcctccccccacatcccggctgcctccccttcctcccaccacatcccggctgcctccccttcctccccccacatcccggctgcctccccttcctccccccacatcccggctgcctccccttcctcccccaacatcccggctgcctccccttcctccccccaacacatcccggctgcctccccttcctccccccacatcccggctgcctccccttcctcccccaacatcccggctgcctccccttcctccccccaacacatcccggctgcctccccttcctccccccacatcccggctgcctccccttcctcccccaacatcccggctgcctccccttcctccccccaacacatcccggctgcctccccttcctccccccaacacatcccggctgcctccccttcctcccccaacatcccggctgcctccccttcctccccccatccccggctgcctccccttcctccccccaacacatcccggctgcctccccttcctccccccacatcaccggctgcctccccttcctcccaccacatcccggctgcctccccttcctccccccaacacatcccggctgcctccccttcctccccccaacacatcccggctgcctcctcttcctccccccatcccatcagtggtcatgcttcacttcctctccccactcctccctcataaggatcattgtgttcatgaaataaacttattccttctttatttatttttattttccataggttttgggaacaggcagtgttgagttacatgagtaagttctctaatggtgatgtgtgagattttggtgcaccctcctgccacccttttccctgagtctccaaagtccttatgtcattcttaagccttcacatcctcatagctcagctcccacttatgagtgagaacatatgatgtttggttttccattcctgagttacttcatttagaataatagtctccagttccatccagcttgctgtgaatgccattatttcattcctttttatggctgaatagtattccatggggtgtgtgtgtgtgtgtgtgtgtgtgtgtgtgtgtgccacgatttctttatctactcattgattgatgggcatttgggttggttccatatttttgcaattgcaaattgtgctgctataaacgtgtgtgcaaatatctttctcgtataatgacttcttgtcctccaggtagatacccagcagtgggattgctgaatcaaatggtagttcttttagttctttaaggaatctccacactgttttccatagtggctgtgctagtttgcactcccaccagcagtgtagaagtgttccctgttcaccacatccacaccagcatctactgttttttgattttttgattatatccaatcttgcaggagtaaggtggtataacattgtggtttcgatttgcatttccctgatcattagtgatgttgggcattttttcatatgtttgttggccatttgtatatcttctttcaagaattgtctattcatgtctttagcccattgtttgatgggactgtttgtttcttgctaatgtgagttctttgtagagtctggatattagtcttttgtcggatatatagatcatgaagattttttctcactctttgggttgtctgtatactgctgaaagaaatcacagatgacgcaaacaaatggaaacacatcccatgctcatggatgggtagaatcaatattgtgaaaatgaccgtactgccaaaagcaatctacaaattcaatccaatccccatcaaaataccaccatcattcttcacagaaccagaaaagacaatcctaaaattcatatggaaccaaaaaagagcctgcatagccaaagcaagactaagcaaaaagaacaacctggaggcatcacattacctgacttcaaactattctataaggctatagtcaccaaaacagcatggtactggtataaaaataggcacacagaccaatggaacagaatagagaacccagaaataaactcaactacttaacagccaactgatcttcgataaagcaaacaaaaacaaagtggggaaaggacactctagtcaaaaatggtgctgggataattggcaagccacatgtagaagaataaaactggatcctcatctctccccttatccaaaaatcaactcaagatggatcaaggacttaaatctaagacctgaaaccataaaatttctaggaaatagcattggaaaaactcttccagacattggcttaggcaaagacttcatgacaaagaacccaatagcaaatgcaacaaaaacaatgataaatagctgggacttaaactaaaaagtttctgcacagcaaaagaaacaatcagcagaataaactcattccttcttccagtcatctagcccaaacaatcccactgtatacaaagaaagacctcacaccttccattgcaccaaaagagtttaaaacccagctcaccatgaaagccatggagactttaaaagaaatcccacctggtatttaagaaaatctcacccagcacagtagtgcacccgtcagcctcaggtctgctccaatcagtgtggacagcaaagcccctggccaccctgaccgtccagctgttggccatgtggccaaccactcctcccttcttcattctggcccaccctctcccaggggatgttactgggggagggcagagatggccaaagcagtgagcagcggcaggcccatctctgcccgtcactacgccacggtgggccctgaggtcccaggatctgctcacagtgagcagccatggagcttgcagctgaccctggggcccctctcctgtcctgaggatgaagtggttcctctcccaagccccagatcgcaaactggacccatgtggcaggcactgagcccaggtgccaggcagccctcagcccacgccttcaccctggagccatgatgctaacagtgcatggcagccatcagcagcagggcggccaggagggaaccttcagaaaacactgagcccctgtgcgcctgagccacggccttccacgtgctggacagccaccacagaagggctttgccagaggaaaatatggtaaactcaatgcacgcatcccgagctggcccgaggatgctttattccaaagccacctcttgtgactgcctgccctctgcccaattatctcagttatgtgtctgggtgcaacagcttcctccctcccatggctccaggccgccctgctgctcatggaggcacctctcatggtacccaggctgcttcttttccatggccctcaaatgtccctgaggacaatctcacttttaactaaggaggcatccacacctccacacgttcatcagtaattgtgggccttggcagcaacaggtgagtttcccagggctgcagaatcacagagcatgccccatgtatttgatatatggagagaggcagaagggggtgtgggatgggcctgcagctttgcgggtgttggagggatgaggcctttgttgttcaaggactcattgcatcacgcttgaatcacacttgcacttaagatgcaagtgtgcacttgcacacttctctgcagtcactgagccgggttcaggacatagataggcactgaggagctgatggtctggggagaaagacagcacacggctaatgttctgggggccacggtgcagggaaggcactgcagacccgggaggacacacccccaggacagtacctcatgctcctcagcggcatcagagctgagtcctagacagggagcctgacgggacaggagctggggcatcagtccatggggaacccctccttctgaaataagccatcagcaggacccagtaaggcctgggtgtccagacatgcacccgtccctgtctgacagcagaagcaggcgtgagcacctagaacaaagggcctgcggtcattggctgcagtcagtgtgaggctcccacttaccacctgtggcctcatcctccctgtgcgcatggcctgggcccacgatgagttcctgagtcctaaaactaggcgccttcctgggggccatagggagggatagtgccaaagatacaggcctgggatggaatccttcgtggaaaggaatgcagtttgaaccattcaggacacttgatggcaggtggctccttccagttcaaagtaagaggtaaaaagccttaaaataacagcagtaggaaaaagaacgcgaagagccctgcacacaggtgagactcaaagaccatcaggaaaactgcactttctggactaacgtggctgtgcccatggagcagcgatgtccgaggcagggcccactctctgggccccaggagattcccttcctctccagcctcacttccctagcatgagttgtactcagaatgtctgaggtcactggcagttccagaaccttctctagcactgtccgatttgtttgtctcatgagccaggtttcaaacagctcaggggcagggatgagtgttccccttcttacatgtcctgctctgtgccaggtcagtgcaggcccccacttgatgtgatggacaccaatggtgtcgggggccacagcacactgctctttgtaatgcccatgaagtcagatcatcccactcagcccatgatggttagcagcctggacacatttccttctggttcttagagacagattattattattttttttttttgagatggagtcttgctctgttgcccaggctggagtgcagtggcgcgatctcagctcactgcaacaactgcctcccgggttcaagcaattctctgcctcagcctcccaagtagctgggattacaggcacctgccaccatgcccgactaatttttgtatttttaagtagagatggggtttcaccattttggccaggctggtcctgaactcctgagctcatgatccacccgcctcagcctcccaaagttctgggattacaggcatgagccaccgtgcctggcctagagacagatttaaggcaatggagcatcagggcatcctgcctgagatttcttttctgtgcttcctcactatgccctccccagagcagtctgaggcatcagaaggcctgaggaaggccaggatgaagacaatggaggtcaggtgaatctcaggctcaaagactcctgagaaaggccctggaagacacataagaatcaagacaacttaagagcaaagataccgctgtgaaaatcagggatttgtggatggataaaaaagtcatagatgaggaaatagtaagacaccaagatcagcagcagggcccctcacaagatgaaaaaggagatgaagactatagggctcacctaggcagggacagagaggagaacagaagggagaaaagagagagaacaggactgatggaggccttgtcagtagtggaggagagcttgaggaagagccaacaaccacccatgatcacaaccatcccagctccatcccaaaatccatcccagctccaaccagcaccaaccgcagctccatcctcagcactatcccaactccactcagctccatcaaactccatcccagctccatcctcagctccttcccaactccactcagctccatcaaactccatcccagctccaccctcagctccatcccaactccacacagctccatcaaactccatcccagctccaccctcagctccttcccaactctactcagctccatcaaactccatcccagctccaccctcagctccatcccaagtccacacagctccatcaaactccatcccagctccacccttatccaaactccatcagaactccactcagctccatcaaactccatcccagctccatcaaactccatcccagctccactctcagctccttcccaactccactcagctctatcaaactccatcccagctccatcctcagctccttcccaaccctactaagtgtcatcatactccatcccagctccatcctcagctttatctcaactccagtcagctccatcaaattccaccctagcttcaccctcagctccatcccaactccactcagctccatcaaactccatcccaactccaccctcagctccatcccaactccactcagctccatcaaactccatcccaactccaccctcagctccatcccaactctatcccaattccactcagtttcactgaactgcatccgagctccatcctcatcctagctccatcccaactgtgctcagctccgtcaaactccatcccagctccatcccaactccactgagctccatcaaactccaccctagcttcaccctcatcccagctccatcccatctccactcagctacagcagattccatcccagctctaccccaggtacatccaaggcttcaataatccccagctccatgaacttccatccagctccattcctatccatccctactccatcccaagctgaaccaagctccatagacttccatccagattcatcaactctatcccagaccatggagctccatccacctccatcccagctccacctcatctccatccacaaatccatcccagctctatccatctccattgtatctccatccagttccatccagatgcatgccctgctttatccttatctccatcaatttccatcctagctccatcttacgccatgcagccccatccagctccattgcagctccacccagcttcatcccatctccatactactctatacccggctccatcactactccatctcatctccatactactgtatacccagctctatcactgctccatcccagctccatccagttccatcccctccttcatccagctccactgaattccatccccatctctcttctgttttattcccagctccttccatctccattccaactccattcagctctatcctagatcatcactgctccattctagctccatcctgctctgtcctcagattcatctcagctttttttctgagcttcatcccatctccatttccagttccttccctgatctatcttagctctatcccagtccatcccagccccatccacctagcttccccgcagctccctctagcttccccccagctccatttctgctctatctcatttttatccttattccttacaagtggcatctccagctcctttctgagcttcatctcagctcatctccctctctcttgagttccatcccaacctccacctctgctccctcccagctccagcgcagtttcctccaaagctccaccatcacctccatccttggctccagcttctttcttagctccctccctgcctccacacacacacctccgtgtatcatctggaagaagctatttccaccttttctgactcactgtttatcactgctcagaagtgtgccactttgggaatatccaaaacactgataaagaggatgtctccaggggctgatgaaatgagcctctccacacaaacgcctacctgtggagtctgcccttggggatataaccctgtcacactatctgtgccctgctccccgaaggtgatagagtgcctgttacatgattttcactagtgtcccaggtcacaggttcacagaagattaatccttgagtaatcactaaagatgaagtaggcaaacccctctaattttcaaaatataaaactatggcccagagaggaaaagtcacttccccaggatcccataaaaccagattatctaattctccttcagcataaagaggaagattttaagatcctggaagcatctcagctctttcaggtcttgggagcttcttctattttcaacctctgtgaaatctgtcctgtgtggtttccctagagttaatatttcttccctaggaacccaaaacactgactgggagctacctcacaagaaaccaaggtggtgccaacatgcacacttgtctctgttctcacatacacctaagggtccacgtgccccacatcgctgctgccccccttctcttcccttacctccatctcctgatcccatcagaaactgggatcttgctgtccactgtacattaaggttatgtcatatacacctacccagatctgtcccctaagtcacctggacagcaccccttagaagtcatccaggtacctgaaacaaacctatcaatcaaacctgttaggaagctccctcaaaccctcccccctcctaagtccctggtgtgctgaaagccactccatacatttccagtaccctcagtcacatcagaagttaaaacactgaagtatttcctaccaggtgggaaacagctgcagcccctgcccacccgccacctccagaaccccagatgcccaaacatcccaggccactctgggaacaacaggccctccccattgtgagccacagggaaaacacttgactgcccaggggccaccaggacttctgcctgaggccctacttgcctgtttccatgggcaggcatcacactgtgtagatcaacacacactttgcactcagatctaccctcatccttgaagctgcctttctacaattcttcaaatcctgcttcccaggcagaagtcacccagtggccacccactgcagtcacgctgtacctgctctcttccctcacctgcatcttctcgtgtcccctgcccacagcagcccatgaacatgccccctctttcatgtggatatctgcatctgccctgcacctgccccctctcacacatggatccctgcacaccgtctgcccacagcaggcccatgtacctgccccctctctcacatggatctgggaaagtcccctgcccactgcaacttgatgcacctgccccctccctcacctggatctctgcacctctgctgcctactgcaggcccacacacctgccccccaaaaaacatctgcatctcagcatagccccttcctactgcattcaccctgtgcctggtcccactcttacctggatctctgcaaaccacctgcccactgcagccctgagtacgtgaccctttgctcacctggatgtctgcatgagcctgccaattaaagccccatgcacctgccacctctcacctggatctctacagcccactcacccactatagccccacaaatagccccccctcacctggatctctgtgctcccattgccaccacacccgccttgcacctgctccctcctttaccttccccaggtggcctcagggctgctctctctcagctctagtcagaccatctcactgtgttcaccctgtagggtcctctcactctacatactgggtccctaaatggcctctctgtccctgctgagcagtcctacctggcctgcccaccggaccaccccatttcagggaaaccccagcagccctggcatgtatggagccccctgtccctccacatctttcctgtccatggacatttccttgaacctgctcattgcatatgtctgtaccctaggaacggtgtgggccacagtgagcagtgtggagttgcatgtcacatctctctctgggacgcctccatgtgtccttcagatttctacttctagaaacttctgatcccaggctggctggggtgcttctcatgcatgtcccctagtgccctccatgctaatgacccatacactcttctgtcttttcctaataaatggcagaattgaggcagggcccatgtatctcaaaggggatgcccagctcctggtgcgaggccaggttgccacaggtgcccagtgagcatctgctgtgaggagccactgagtgaacgaggtcaacctgtgtgaaggggccagtgagtgaatgacatcaaccctgtgtgaaggagccagtgagtgaatgacatcagccctgtgtgaagagtcagtgagtgaatgacatcaccactgtgtgaaggagacagtgaatgaatgacatcacccctgtgtgaaggagaccgtgagtgaatgacatcacccctgtgtgaaggagccagtgagtgaatgacatcactcctgagtgaaggagacagtgagtgaatgacatcaccccatgtgtgaaagagacagtgagtgaatgacatcacccctgtgtgaagactcagtgagtgaatgatgtcacccctgtgtgaaggagccagtgagtgaatgacataactcctgagtgaaggagacagtgagtgaatgacatcacccctgtgtgaaggagacagtgagtgaatgacatcacccctgtgtgaaggagacagtgagtgaatgacatcacccctgtgtgaaggagacagtgagtgaatgacatcacccctgtgtgaagactctgtgagtgaatgatgtcaccccatatgtgaaagagacagtgagtgaatgacatcacccctgtgtgaaggggccagtgagtgaatgacgtcaaccctgtgtgaaggagccagtgagtgaatgacatcacccctatgtgaagactcagtgaatgaatgacatcaccctgcgtgtaggagccagtgagtgaatgacgtcacccatgtgaagagtgtctgaatgatgtcacccctgtgtgaaaggctcagtgagtgatgtcacccctgtgtgagggagacagtgagtgaatgacgtcacccctgtgtgatgagtcactgagtgaatgatatcacccctgtgtgaagcgtcagtgagtgaatgacgttaccccggtgtgagggagccagtgagtgaatgatgtcacccgtgtaaagagtcagtgagtgaatgacgtcacccctatgtgaaggggacagtgagtgaatgatgtcacccctgtgtgaagagtcagtgagtgaatgacgtcactctgtgggagccagtgagtgaatgacgtcacctgtgtgaagagtcactgagtgaatgaagtcaccctgtgtgaagggaccagtgagtgaatgatgtcacccgtgtgaaggggccagtgagtgaacaacacgtgtaggcaggcacccctcggtccacaggcaggtgggcacacagcccgggccggcctcttgtctcacgtcctctgtggatgtcactctaccctccctcttctctctgacctctccacacccagctgtgcgctgtgggagctcctgcagcttctgcactcagccatctctgctccaagcttcacatatgcacgcatggttcctcaagcacttgtcgtgagacaggtaagaggctgcccctgtgtgtactcacccaccagccctgcatgcctcatgcccacaactctctaaaccaggtcacgctgagaccatggccatgcctgccatggaagctgcagagactcgggatccaaagccaggtctccgaagggcagcgcattttcctgacagccagggacagggccgtgtccacagcaggtgctcatgaacgctgcacagtgttctctggggtgggccctccagaggctcccacacattggcataggacatgtgcagaatgttctagagccttcggtggttacagcaccaaaggtttgacacttggctgcagcgacactgtccttcaggagattttcatccttccccttaaacactggtttccactgcctctaaataacttaccaaagctgctgaaatcacctttcacttctctaaacaggttccctcatgtaattaacaagagccatgggctcgcagctccttccctcccacccagtctctgcgaccaagcaacaggagccaaacagaaaccccagggccccgtacttactccacgtcagcgaacgcactgctgggcacctgcaggaggcgggcgacgtcctccaccagccgccttccttcctcggggcgcagggggctgcggatgacagcagggatggggagcagtcaccacagagccagcagtcctggagaactaaagccctgtggccccacagccccgctccctggtccccacacacaccctgctctcctggcctggggtcagctgccccctcaggcacaaggagtcacctgagtttccagcaacaagacaaacagtgcagtgcggacggggctgtgggaatcgcaagtggcccaccgtgtggagactggctcctctcagccttcagtgaaaatacaataaaggggagaagggagaagggacaggcaggtgcggcggatgctgggactctgactgaggatggggcggatccatggagaaagcatctgtttttaatgggctcatttctgatgtgaaccaggccccagtgaggggcaatttaactacccaatggaagtgtgagcatggaaaccaggcagccagcccactggcagcaactcagggcagggggcgggggcactcccggaaggcactgtggccgcagactccccacaaggccacctggctggggacctgtccgtcaagaggcaagagccgtcaccagggtggtttgcagcttgatgactcatcctgaaggccagcattcaggttgaaagtcacaagttgcctgtgaaatcctgttagtaccactttaatggagtattaagttacaatattatgtaaaagcatgttgtaccgcaaaggctttcaccccagcagaccaaaacgcctgcattcctcatccagtgagcgtgcaggatgcctgcagggcaccaggagctgcttccaaatacagcaatgaacagcaagaccagccctgccctcgaggggttcacattctagagatgctggtgaatagaaatcaatcatgctatgatgggttgaattatgtcacctaaaaattcatatgttgaaatcctaaaacccaaataatgtgaactgatttggaaatagggctatcatagatttagttaagctgaggtcaatagggtgaaccctaagccaatatcactggtgtccgtataaaaggagggtttggactcagagacaaacgcacagggtgtcgcaaagacatggggagaaaccacccacaagctgaagtcatctcaggccagtagcagcaggggcgaggctgggagcagaccctcctcagcctcaggggaaccagccctgcccacacctgggtcttggacttccagcctccaggacagggagaagatggatttcccactttggaagtgtgcgccagcagcccaggcagactagctcctgtcggctgacaagttctctggaggagacagctgggtagagaagtggcatgcagggctgtggagggaagggcagagaggagagactgtcttgtaaagtgggctataggaggcctctccagtggggccccgtttgaacagaggtgaaggagctggaaacagggtatcagacagtgagcagagaaggcaagggggccgcggtgccacatggtgaggaggtgaagtcacagagcagctgggtggacatggcctggagacgagtgcaggaggccgtcagctggggcaggggcctgagctggccaccacggctgtccggtggggagcctggggatctggagggacatctgaggccatgccggtggagtccgctggcactgggaaaacacaagatgggcagaagccccaggaaggcccagctgggagtggtgctgacagagtcaggagtttacatcctgcacacgtggacatggggaccccagcagggcgtccaggctaggtgctgaggggcgacgtgtctgtcagtgcagaggtcaaaggccccagcggggcatccaggctgggtgctgagggcagtgcatccatgtgtgcagaggtcagaggccccagcagggtgcccaggctgggtactgaggggcgatgtgcctgtgagtgcagaggtcagaggccacagcagggcgtccaggctgggtgctgggggcagtgcatcatgaatgccgagaccggggagctgtacgaccagaggtgttcactggcctcaggagggtgactgaagctggagcacctaagacggagccttgccccccagcatttaggatcccccagcattgagggccccccggcatttagggccccccagcattgagggccccccaacatttagggcaatgaggggaactggcaaaagagaatgaaaaggactgtgacagaggcaagcagcgagctggcaagaattccaagaaggagaagggccgggcctcagattggtccagagagatgaggatggggagctgaggccgagcttagcgggtcatgatggctgtgggctgacctcacaggagctcttctgcaaggctgtagggacctgcagcctgttcagcattggagggatggagagtaggaaaggagagatggggccaacactgtaagagctgcccagggttctgggggcaagaggggcagtttctgttaagctggaagacgtctaggatgctagcatagggataggagtgatgagacaaggtgctggatgtagggcatggctgtgtgtgcccagagcaggcagaggccttaggcaggagtaggacaatggtaacagaactggcaccagggctggagaccccaggcattctctatccatgacttacactcagggaccccttggggagaggacctcagcagggcctgcagattcagactcatgagcaggcgcatgccgtgactagtctagcctcagagcgcagctgcactagctggagagagagggtagttcttgggggttatgaatccttcctggggacagagagacgcattgaggtggattctcatgggcctcgcacctgcaacaagaaagccatctgatggcgtcgacgctacaagctgttgttgtggccaccagggacacagcctaccatccttggccaggacttcgaggcacgtagcaatccgggaccagctggggcacaggccgccttccactcagggaggagccacatctgagctcaggggctgagcctgtcccaaaagcccggtacctccagggagaccggtggcccctacatctgggtacccctcagagccacctggggagggtgtccaggcccatgcctgtcctgcccagccagtgtggctgcaactggagcccaggacagtgtatttaaaataaaaaaaccaaaccaaacaaaaaaaccctttgtaggtgaaggtgacagctggtccagtttgggagtggttacagcaatggaaaggtgaggctgcatccacgtaccacaggccttccctgcccagtccagggctctgggacctgagtgggccaaggactcaccaggatgggccaaggactcaccaggaatgcagatgccccagccaccctccagcgtttcggagtcaggaggccacaggtcaggcctgggaatctgtgtttctcgtgggttcccactggtgctgacacttgttcaggcatctgctttgggaaccccttggccaaactcccacaccataaaatcagcaacaaagccacatgacttccaaccctagactaacgtaggtcgctcagcttcaggcaatctacacatcagttgggagggatgtggaagacgtgccgcgggaatgctctactcttcatctaagaaatacttcctgagcacttgtggtaccaggctgagccaggagctatggaagcagagatgagagaggaggaggagccagcggcccccggcagcctctaatctggcaggaacaacggtaaagaatatgcattaaaaaacccatggcaaaccccagggaaaagagaagccaccggccacggccctggggcctacatgggagcctggtccaggctggggtaagggagccccagaagggtccccaagaactaccacagggctgagagaatggatcgtgttactagtctaaggcacagagcgcgagaggcagacgcagggatggaaacagcaagcaaatgccctcgggtagcacagtcactcagagaacttgagagaaggggcaggggaggcacggatggctagaaggaagggagccaactacatgggtgctcctcacccattaagggattggagtttatcccaaatacaatggcgagctatcaacagggcctaggcaagggcactgtcccactctcctggtcccagcttctcagaaggctgaggagccaagatcactggagtccaggagctcaaggctgcaatgagctatgattgcacctgtgaataaccactgcatcccagcctgggtgaaagagcaagaccccatatccaaaataacaacaacaacaacaacaaaagttccctcccctggataaagaacaggttggagaccagaggagacagaagggaaacagctggtggcctccagattgtctcaatgagacatgagctcaagcagcatggaccgtggtaatggtgactgaagtggacatggtcatagactgcgatgtgtcagcgggtaaggtgttcagaactgtgagtgagaaaggtgggctctgcagggttgaagggacagcagagcagatgctgttttctgaagcaggctgctatgaactaattgtgacccctaaaatctgtatgttccaatctttagccccaaggtgaaggtgtgaggaggaggggcctatgggaggtggtcaggtcatgagggtggagtctcctaatgagatcagtgccctctacaagaggctctgtagatctttttccttcatgtgagaaaatgccatctgcaacccagaagtgtgcctccaccaagaacccaaaaatctactggcatctggattccaacccctggaattgtgaggaagaaattcctattgcttctaagctgccccatccatggtgctttgttatagcactgcgagtggactcaggacagccccaggacagaggaaagatcctgaggtcagcatcaaacacacggagtctgtgttgccttcaaggcatcaggtgaagatatgacaagactgggtgggccctcaactgtctgcactgagcccatccctcacactccaccctgtgccaccctcagatggaacagggaaggagcctggttcgctcaggtgagtaactgggaacttgagttttataagacaggcccgctctgcacaccctgcatggagcggtgaagtaaggacctcacccacgtggggtaggctttggctactgcaccatgcacctctccctgcacatggacacaagtactcattccacaagtagattctacattggcattaactgcatgaatgaatgaacacgagaatgtcaaaaacagcaaaaaatccaacattttaaaaatcattaaaatgtaaactattaaatgaaccccactcaatttataaagtttctgtaaaactaaagtaaagcatgaattagttttgggaagatggtgagtaggaaacaccaggaatctgtctcccacctgacaacactgtgctagtaggatctgtctgatgtaactgatccttgaactctgaagcctaatgaaggcctccgacttctagtggaaggtctggatacaccttgcagtcaatgtcagctttcatcacagtaggagctaccgctactcaccttcagccctgtggcaagcagctgtgcacatgttcctggagcagcctgcacacactggcaggagccagaacaggcaatacagatgttgtcctccaaatattgggaatctgcaatctcactgctgattgctgcttctcatcacagaggtgcaggaaaggaggagggcaccattgtttggccacctcctcattgttgttgctcctccccctctggccaaaatgacttacaggggatttaaaatgctaacacccatttttcccaccttcatttttctctttttccgcttttgggagccagaaattaaagaccagaatattcaaaagtaactgaatatacagggaaaattagaaagtcaccacacatgctcagggaaaggctcagataataccacaagtttacacctcaggctgatccttggcacaaagacagcctacaaaaaatttaaaagaaagataaacaaaaaatagcaaacctatggagagacaatctgatttccagagttagattaaaatttctagttttcaacaaaaaattgcaagaaacaagaaacaaagaaacaagaaactacagcccattcaaaggaaaaaggtaagtcaacaataattgtctctaaaaaaagacctgatggcagatgtactaggcaaagactttaaaacaattgtcataaaaatgcttgaagaacaaaagaaagatgtaaagaaagtcagaaaaattatgtatgaaaaatgaaaatgtcaaagagaaaacctaaaatataaaagaaattctgaagctcaaaatacaatagctgaaattaaaaagttcactagagagattcaaaggcagatttgagcaagaaaaataaagaatcagtgaacttgaagataggacaatggaaattattcagtctaagaaatagaaaaaaagattgaagaaaagtgacaaaaccctaagggacatgtgggataccactaagagaaccagtatatgaattgtgagaggaaattgtgcccaaaagaaaaaaaagagataaaggggcagagaaaatacttgaagaacaatacctgaaaacttcccaagtttgatgaaagacatggatataagcatccaagaagctcagtgaactccaagtaaaattaactcagagacacattttaactaaattgttaaaagacaaggacaaacagagaattctcctcttacatttgaaagcagcaagaaagaagcagttcatcacacaccaggctttccaaataatattatcagcagaaactttgcagaacagaaagcagtgaaccaatatattccaagtgctacaggaaaagaaaaaaaaaacctgtcaaccaagaatcctatatccaacaaaattgcacttcaaaagtgaagaagaaattaagacattcttagataaaccaaagctgagagagtttgttatcactagacctgccttgcaagaaatattccaaggagccctgcaggatgaaatgaaaggacactggacaataactcaaagccatataaaaaattaaaatctcaataaaggcaaatatatggtgaattataaaatatagtattattgtaacagtggtttgtaactccttttagttctctatatgatttaagagactagtacatatcttaaaaacaattactagttaaaactagtattataactttggtttgtaactccacattttgttttctacataatttaagaaacgaataaattttaaacaattattagtttatatcctgggacatacaatgtataaggatgcaattttgtgatatcaatagccaaaaagggtgggtaaatagcataaaggagcataatttttgtatgttattgaagtcaagctagtataaatttaagttagtgttgtaattttcagatgttaaatctaatcctctatgataaatacaaagaaaatagctacataatacgtacaaaaagaagaaaggaatttaggcatttaatttttaaaaatctactaaacacaaaagaagatagtaatgcagaaaatgagtggcaaaaaatccataatgcacatagaaaacaaatattaaaatgacagaagtccctcctcatcattaattactttaaatgtaaatagattaaactctccaatcaaaagacagagattagcaaaatatgatattccacagatcttttaaggactatttctatagtacacaacaagggatatctatttgcattaactataagcataaacatgacagtctttgttttcaagcatgtcaataatgtcttctttttttgtcgcccaggctggagtgcagtggcatgatcgttgctcactgcagcctcaacctttccaggctcaggtgatcctcccacctcagccttcccatttgctgacattacaagttcatgccagcatgccttgctaacttttctattttttgtagagatggggttttgccatgttgcccaggctggtctcaagctcctgggctcaagaaatccaccactttggtctcccaaagtactgaaattataggcatcagccaccacacctggccaatatcttcttttaatataagagatagcactgtgagtgtattattgctacatttttagtttaacgtaaaatttctcattttgactattaaaggaaagtaaaatatttacatcactatttaagaaacctcataatgtacctagcgtgtatagagtactcttaaaactcaacaacaaaaatacaaacaataccatttaaaaatgggcaaaggacttgaatagacattttcctccaaagaaaatatacaaatggccaaaagcacatgaaaagatgctcaacatcactaatcattaggaaaacacaaatcaaaactacaatgtgataccacctcatacctatcaggatggccactgtaagaagaaaaaaacccagaaaatagtaaacgttggcaaagatgtggctaaattggaactcctgtgccttgttggtgagaatgtaacacggtatatcaagtgtggaagagtatggagactcctcaaaaaaatgaaaaatagaattgcactttgatcgagtaactccactccttggtatctacagtagtcccccattagctgcagtttgttttctgtgttttaggtacctgaggtacagtacaagaagatatttgaaagagggagagagagagagagagagacaccatatttacacaacttctattacagtaaattgttataattgttctattttatcactactgttgttaatctcatactctaatttataaattaaactttatcataggtatgtatgtataggaaaagccatagtttatatagggttctgcactatctgaagtttcaagcatccactggggttcctggaatgtctcccccttagataagggggagactactttgcccaaaagaattgaaaacagggtctcaaagagatgttagtgcctcacattcacagccgcattattctcaatcactaaagcatgggggcaactgaagggcctagtgatggacaaatggaggagcaaagcgtggcctgcaccaaaagtagaatattatttagccctgaacaggaagaaattcagacacatgcgacaacagggatgaaccctgaaacatgatggtaactgaaataacctgggcataaaaggacaaattctgtgtgtctacccatgtgaggttcctagaatcctcaaattcagagagacacagagtagagtgaaggctgccaggggctggggtagggtagtgtttaatggggatgaaacttcagttttacaggatgaaaagagctctggggatggacagcggtgatggttgcacaatagcacaaatgttaacgctactgaattctatgcttaaacatgggtaagacagtaaactttatgttatctatatgttaataaaatacaagaaattgggaagatgaaacaaggtgattagtataaaagcaccatgacgtgtggctgctccccacatccaaggcagtgtaccagccttcgtccaatctctatttcagcagaacactccttgtggctcacggagaaagctgagccaagttcctgctggatccctggcaaagctcctttctgctccctgtctccaaggaaagcctgtggcgtgttctttaaagtggatttttcaaggctgcattctgtgtaattttacaattgagaaacaagccattttcctttaaagagtggctgctggaaggggaggggtcccagatgtcctctcttttcctgtacattttggatgtctgctctaacccaggtcagctcctgtcccaaaacatcctccagggccatctgaacagcttgtgaagggcactggtgccagaaaaagtgtcagaatggccagatgttgggccagaagggaggcaacagggaagggagccaggcggggctacaaagacaaactcaggctgcagctggacagagcaatgacccaccacagccggctcagctccaccccggctgagaccagcccaggctgctgggaactccagacttgcatccaaccagcctccctgctccaagccaaaccctcctggcaggcaagtgcgatgcttccagatgagcccttcctttttttcgtgtggctgcaggttccttcctcccggctcctgtgctccccagcagcctgggcttttctctctgcctgggcctggtggtgactgctccaaagggccagcctacctgctcccatcgctgacctgccttgcctcagccccctgcaccccagcctccctgggcctccccatccttggagccattaggaagagggcaggtgcagaagggcaggtggagaaggctaggaccgaccacaccactccaatcagcaaagacagaaactgctgctcttcaggctttccctaaaactccctgtgtgctttgatcagcaccactcagctcatgacttattttaaaaggtctccagtactttcatattttaatcctgcctccccctacaaactgcaaactcattgagggcaggagccacgtgtcatctgagtttgtttcttccaagcctactgccccctgcggagcataagccaacttcccaatcaatgtttgctaccaaattccatgagtctccttttctagcatgtttcaaaccaaggggatggtatgaggacatgggaggggctccaccacgaatcctgggcccagccctctgccctccatgctccaatatggaaaccaacagaagcatccacaagactcctacaacaccctgaacacaacaaggaagtccacaagcccagaatgtgtttgtgaacccgctgcctccacaagccaaggtgtccccagttatacaaagtgtacgggacgtgcagtccactcccttccttcctcagcctggcaagggtgacagtgccggccaggtgggcaggggcatcacggctcctctgtaaagcagaagagtgctggctccattctgtaaagcagacaaacaagacagggctgactgtgctcacaatgatcacgcagccattcctatttcatctctaaagccacagccatcatctgtcattccgaggcctgaacttccttagaaagcagttggacgtcatcctgaaaatgagtgggaggatccagcaggtgcgacgtgctgtgtctgcatgtggcggcttccaccctcaatacctggacactaatattgccgtagaagagaaacaggcatgagaacttttatggggtcagggtcagagctaggagtgcctgtgagggcagtggaaaggactttcaaagctgaagatggcgtctcctctctctagagtctttcagttctgaaggacagtggcaagtttgtgacgtctctaagctcaaccacgttggacaagcctgttcctatggatctactgaatcagccacatgggaggccctaaggcctcggcaagcactcactggagggaggctcagagtaagaagtgacagtgtccctcttccacggtgtcctctcagccccggcacagtgctgggtcttccgtgtggcatccacatcaccccgaaatgagtgcacgggtggacgcatgagcagaaaatgactacgggagtgtcacccctaaaaatcagactagtgaaaagtacgtaggggtcggaaatataaagagtagtaaaaactctgggaagctcctgtgctggacgccacactgaggccccacacagcggtgggatctggcattcagcagacccctgaggaacacactattattggcctcatttaaaagagaaaccgaggctagagaaactaaagtcattgcccaaaattacactactaggaaactcccaggagaaaagctcaaacggaacactttatcattcaggctatgttccaacgtaggtgcccagaaaggtggggtgagcccggggacctgttgcgacctacacttgttcttaacaaaaccgaaggaagcctgcataaaacttctccacgtctcattttggcagccttgttactgcctcttccttgtgggccagatgaaatcaagccaagaacaggacccgccatgaccgaccctcctgctgaccatgctctgtgcttctgcagcttcaccagcccgatctgggacattttactatttactgcaaaacccaccaggagctagggagccaaatgtgaagggaaaatgagtcaactttgatataaactcttttgataagacaatactcaaaaccaatagataaacgaggtttcttgggatcaaccaattattctagttatccctgttcatcattaaaacaaaccatgaaatttattctatttaaatcatcttataaagtagttaaaatgtttccagcccacgggaacctcccccatgcagagaagcaacgcttcgagggtggcaaacagtgggctggggaggtgccctgaccaacgcgtggtgactgacaggcgccacagtatcctacagacaccacggtgaccgacgccatggtgaccgacgccgcagtgaccgacaccatgtctgtctccaccctggatcccctgcacgcccactctcttcctgcaggagtctaatgtcagggtctgggagaaggaggttttgatgctttgtgcacccaaactgaaccttcctcctgcggaccgccatgcagccccggagctcgtgtgccgcacccaggccaacgaccctggaccactgctagtggggctgtccacaccatcgactcttccaggcagaaaatcaatagaggaaaaccactgtattctgacaacttattttttggcataaggatgagactgtactgctcactataaacactttttaaatgccagcagctaactaaagatctaggtacggaaggtctatatagcgtcacctttaaaaagtgtgccaaataggatcgggaagtgcctccagcaggagccgtgaacccgtgctgacccaggcagagctggttctctaatctgattggatctcagatcccgtgccgacccaggcggaacaggctctctaacctgatttgacctcagatcccgtgccgacccaggcggagctggttctctaatctgattcagcctcagatcccgtgccgacccaggcggagctggttctctaatctgattcgacctcagatcccgtgccgacatggaccaccaagttaccatgggacctgagttgcccatcatgaactgaatgttttccgacccaccaagccagaaagttgggtgtacacagcagcattccatcatcaaatggaagtggtatgtgtctgggcctaagtaggccctaaaggcacaagttacataaagaagtgccgccaatgccaacggtccccactcccgctatgctgccttctctctcccagcctgcacctacagtctcctggagagttccctaaaatcagctgacggaggaagacctgggcctggtttacagatggttctgcatgatatgcaggcccccacgttagtggacaactgcagcactactgcccctttctggaacatccttaaaaggacagcggtgaagggaaattctccaatgggcagaactataggctgtacatctggtttactttgcttggaaagagaaatagccaaatgtgtgattattacaaattaataggccatggccaatggtttggccagatgctcagagtcttgaagaaacataatggaaaattggtgacaaagagacttgggaaagaggggtgtggacagacctctctgaatggggagaagacgtgaacaggaagctgcctcccagacgggacaggtgcagagctgggaccttctgcaggagcccagctgccggggcggagggagggcctggtggagtgtccccaagatgcacctgcagagctgctggtcagcctgggccacgctggggctggggtctgtatctcaggaccagtggagtcacagccagattccaacaggagagggtgacggggccagatttggttttgtcgagtcctctttgggttcaacgtgcacggcgggtgagaaagaaagagccgtgatgctggtgcgcaagagagaaggccccgcagtgcggaggcaagaggctcagatggcctggaccagggtgggagaagggaagaggggagaaggggagacagcatggatggagccataggaggggagacagctggccatggagggagccgggtggggcacagagcccactgagctgccgggctggcgagacatggctcaggcccaaccatggccacccccctgcctcaagtgcctcccacggccgcctccctgtctcgagtccctcccagggccacctccctgcctgaagtccctcccagggctgcccccctgtctcgagtccctcccagggccacctccctgcctcaagtccctcccacggccgaccccctgcctcaagtccctcccagggccacctccctgcctcaagtccctcccacagccgccccctgcctcgcgtccctcccacggccacccccctgcctcgcgtacttcccacggccgctcccagcaggatgggctggactgtcggggatgctgaggtttgggagagtttttgtttacttcttcttcctctttttcctgccccacccccatgccactccttctcgccttcttctcttctaatgtacaagcaaccgtgaacatgtttacccatcggggctataaccccacaccacctgaaatcttcttaaatgataataaatccatcatgctacagatattcttttaagaccacaaagcaaagaggagcaagtgacaaggcagggcatgtccgccctcaggaggggcctctacagaggtgaggactgcgctttctgaacaggaagtcacaacacagcgtggaggctgaagaacaaaacagaacccctgaaatctgccctggcgccagaaacacagaatccatcttcagcatcctcagggtttcctttactctaacaaggaaggacgagcaggaagcatcagtccggacctcggctgcaccccgtcctggcaccctgctggttctcgtgatgcgctcttctcgctgaacccctgaggggctcctgagcggtgaggcctcctgggcagccactaggattggaacttcctctccaccacaccagccccggagagcgggcggcggaacttcctctccgccacaccagcccccaggacagcgggcggcggaacttcctctccgccacaccagcccccaggacagcgggcggcggaacttcctctccgccacaccagcccccaggacagcgggcggcggaacttcctctccgccacaccagcccccaggacagcggcggcggaacttcctctccgccacaccatccccggagagcgggcggcggaacttcctctccgccacaccagcccccaggacagcgggcggcggaacttcctctccgccacaccagcccccaggacagcgggcggcggaacttcctctccgccacaccatccccggagagcgggcggcggaacttcctctccgccacaccagcccccaggacagcgggcggcggaacttcctctccgccacaccagcccccaggacagcgggcggcggaacttcctctccgccacaccagcccccaggacagcgggcggcggaacttcctctccgccacaccagcccccggagagcgggcggcggaacttcctctccgccacaccagcccccaggacagcgggcggcggaacttcctctccgccacaccagcccccggagagcgggcggcggaacttcctctccaccacaccagcccccaggacagcgggcggcggaacttcctctccgccacaccagcccccggagagcgggcagtggttcctgagcactcggtgggtttcacatttcacatctcacagtgagccgaggaaggggctgggggaacctgcagggccagggcactcactgagggtggcagatggagagaccgaagcccccacctccttccagacttctggttccaaagttcctctccctggccggcggatccctgccttcactggcctctctgaattccacattccaactgaacccccacagaggtgagcacgcagcagcccctaacggtggcccggtaccatctgccattttgctgcttgccttctccgaggtgcaagaaagttttgtcataagaaacacttgaaggaagaaacatttcagctgcagctgtctcccttgttagcattgagaggcatcggagaggtcaacgccgccccatgccactttttgcacattcttccctcagccggcctccccgcaagactcagggctccaacctctccagcttcccctcgtggaaatccattggctcctcctctttcaagcaacactgtgttcttcccactgctgacagaggctgctcatccgtgcacctgtgccctgcgtcctcctctgcgtgcaccctgcgtcctcctctgcttgcgccctgcatcctctgcacgtggcccgggctctgctccacctgagccccgttcatctctccacagtccaggagccacacactgcggctgccactccagagaccaggaaacccaagcacaggggcgtttgccacattctaggtctcggggctgccgtgggaccctgaccctggatgccggacttccgtgggtcaagggcccaggccaccttctccaacagcactgtggccgccaccccagactcaagcctctgcctcagctcccatgttttcctgactacaggtttcacttccccaaaatccacctcactggctcagcgtggtcgttccgcagaatacatcccaatccagtggggtctggggtaggcagagagaggcatgtgtgtgtgagccgtggtctctgaagctcttgcctctggatttagaaggcaggttcctctttgctgagaggtaaggggctccctcctccctatacctggtgtccgtcctgtgattccttctggaaacctaacatgaaatcattttaaagttgtccttggaggactggggcggctgtcctgcccttcgtccagtcttcaagaatccctctagtttgtaaaaaggataaaaatgtaaatggcaaaggattactgtgtccatcagaaaatgtgagagagaaaatcatgcctggaaaagccgagccctaccatcctcccatctgaacctcagcaccaagagcatgtggatgctgaggtgacaccgagttctaaaccacattcctctcctttctgtgggacaaccaaatgtacaaaagtcccccttttttaaagaatgccatctgtgtcttggaaattaatagctgatctgttaaggtttaagctgaaatctggtgaaaacttgcccaagagaatcacaaattattagtctgataatagggcaaaaacctcaatctccttgcaagaagagaggagacctcacctagtgcatcacaccttgctcaagcagtacaaattgctgacaaaaagctgtgctgtcttcaccagatagcttccaaccagttgaagtcgcaaaggaaaagaaaagaagtcagccaagataacatgatgattttttttttctttaacccactgctcataggaggtaaatattccagtccaaaaggcatggccggcaaacccactacaagaaaataaactcgaatgcaaagaaaagccctagcttttttctactggaaagtcacaagcacagacaggaaatgacccaatgtgataggtctccttccccagaaagtgcgaggctgctgcagacaggggccctcctgtccttccctccagggtgagcccattagcagcaatggcacaggattgtcggctctgaaggttccctagcaaaccacaccggcctcctgctctccgggtgaacacctcggcatccatttggaaagcccttaaaatgaccagatcactggttctctggggcactctcctaccccggggcagggatgggcggccgtccccctgcaagggtggctcaagtccccaggacacctgcagggaaacacacagtgtccacgaacacaacatgggggccttcaggagaaaagagggctccagcacagagtgaggagacacaggcaaccaaacacacacacacacacacaacataccccacaccacacctacaacacacaccacaccatgcaacacactatgtgccacacacaccacatatacaacacactgtgcaccatgcacacacaccacaaatacaatacacaccatgccacacactacacaccacacacaacacataaaccacacagcacaccacacactacacacatacactacacaccacacacatacaacacataccacgccacacactacacaccacaaacagataagccacacagcacaccacacacgacacacaacagacaccccacactacacaccacacactacacaccacacacaacacataaaccacacaggacaccacacactacacacatactgtacaccacgcactacacataacacacaccacacagcacaccacacacaaacaacacacaccacacactacacacaacagacatgcaacacataccacaccatgcagcatactacataccacacaccacatatacaacacactgtgcaccacaacacacagcacacacacacaccatgcaacatactacacaccacacatacaacacacactacacacaacacacatgcaacacataccacatgcaacacacaccacacatcactacattaccacacacacatcacataacacccacaccacacacaaagcagtgtttcctagggagggagacgtccacagcacagggcgtttgaccacccataggaatcggtcatgataatggtctgcgtcacccagtgctgaggcaggcgcctccccttggctctgctggtgcagacacgcagcctcagaacacatcacttagggcctgcctgtgattctccactgggcttgagagcaaagaaatgaacagccatgagaagttcctgactctacaaacaggagagcaagggcacagacagacacgtgggacgcctcctccaagcaaagagcctggaaacgggaaagctcatcctgacttatgtaaagcagtcttgagaaaatggagtccatattttagtgtaagcttcaagtttctgctgcttacaacttacctaaagatacaactaagataatcacctacagctgaaaatcatcttaaattttaatttggctttgatacacactctgcggtttgagctcaagataaaatatttctgcccaattatgatatgcagctaattctccctgatgaaatgtagcatctgcagcacagcgacagcaccagcccgagcactgcgaggctcgcagagcccgcaggacagatgggttctagctgtcatgcagctcccacctccagtgcgaatgatcctcaaaataagaggtacttcttcaccaaggaagaaatacccgaacagacgcacatcatactgatacacatctacccgacacacacactcatatacacacatgcacatatgcacacacttctacccaacacacacactcatacacactcacacacacacgtacatacagatacacatctacccaacacactcatatacacacatgcacatatgcacaaacttctacccaacacacacactcatacacacacacgtacatacagatacacacatctaccccacatacactcatatacacacatgcacatatgcacaaaccaatacacatctaccctacatacacactcatatgcacatatgcacaaaccaatacacatctacctgactcatacacacacacgtacatacagacacacacatctacccaacacacactcatatacacacatgcacatacgcacaaaccaatacacatctacctgacatactcatatacatacatgcacatatgcacaaaccaatactcatctacccaacacacacacatacacacacgtacatacacacacatctacccaacacacacactcatatacacgcatgcatatacgcacaaaccgatacacatctaccgacacacacactcatacacacacatgcatatgcacaaactgacacatctacccaacacacacatatacacaaacacacatatgcagaaatcgacacactacctgacatactcatatacacacacttatacacacacgtacatacagacacctgcccaacacacacacttatacacacacgcacatacacagatacacatctaccaaacacacactcatacgcacatacacacatacacacacaaatacccgaagatgcacatcataccaatacacatctacctgacatacacactcatatacacacacgtacatacacacacacccaacaaacacacatacatacacacgcaaatatgcatagacacaaatacctgaacagatgcacatcataaaaatacacatctaccccacatacacactcatacacatgcacatttgcacaaaccaatacacatctacccgacacacacactcatacacacacgtatatacaaaccaatacacatctacccaacacacacacgaacatacaaactgaaacacatctacctgacacacgcactcatacacacacacttatacacacaaaccaatacacatctacccgacacacacactcatacacacacacgggtacatacaaactgatacacagctacccgacatacacactcatacacacacacgaacatacaaaccaatacacatctacccgacatacacactcatacacacatgcacatacacacaaaccgatacacatctacccgacacacactcatacacacatgcaaatatgcacagatacacacacatctacccaacacactcatacacacacatgcacatacgcacaaaccgatacacatctacccgacatacacactcatacacacacacacaaatacgcaaatacacacatctacccaacacacacacacacaaatacctacaaactgatacacatctacctgacatacacacacatgggcatatacacaaaccaatacacatctacccgacacacatacacacacatgcaaatacgcacagatacacatctacccaacacacacactcacacacatgtaaatatgcatagatacacatctatgacatatacactcatacacacacaaatatgcacaaaccgatacacatctacctgacacacacacacacgcacatatgcacagatacacacacctatccaacacacatacacacacacgtacatacacagatacacatctaccaaacacacacacatatacacacacacgcacagatacacacaacgaaatacccgaacagatgcacatcatacggataacacatctacccgacatacacactcatacacacacacacgcacaaactgatacacatctacccgacatacacactcatacacacacatgcaaataagcacaaaccaatacacatctacccgacatacactcatacacacacatgcaaataagcacaaaccaatacacatctacccgacacacactcatacacacatacatatgcacaaacatatcgacacaacacacactcgtatacacacacgcacgcacatgcacatacagatgcacacacatttacccaacgtacactcatatacacacacatgcatacacagacatctatccaacactcatatagacacatgcatatgcacagatacatgtctacccaacatacacactcatatacacagatgcagatacacatctaccctacacactcatatacacacagatacacacacatctacccaacacacattcatatacatacgcacagatacacatttacccaacatacactatacacacacgcacatacacatctacccaacacacactcatatacacacacatgcgtatgcagatacacacacatctacccaacatacacactcatacacacacacacctacccaacatacactcatatacacacacatacaaacgtgtgggtgtgtgtacatccaggcagacacgtccttctctttgaaacaccaattctatcacttgaagaaaacacaacacttgtacaaagcaaagcatcaaatgtcagattcattaacggggtgacctgagaacgggccagccacttgtgccttgctgggcccgtgatgtctgaattctgagactcgttaagttcagatcgacatgagggcggggaaagaggctcgctgctgtgaagccccttcttccttctgaagggcgcccacgccaggatatttgggccactttggtgcaaaacagataaagcacctggagtccttcctaacaggcaggaggagtccggggtgcagcagtttccagggccgcgtcccatcccgcattcccgcgcgggccgtgctcaggctttgctgtacacttacctgccccgagaccccaccctgcctggccgccgctgaaggtgattctgacccgcagagaggcgcggcctgcaggtgaccagtcaggaccaaaaacccaggaagggatttgcttggtttggttttgtttgatgcccttcagagaacggctctccagctctggagcccagctcagaagcatcaggaggagccactgtccaggcacctggctgccctccgcgcctgagactccagggatgcctgcaccccattattcagttgaagacacttaaaagcgtatgcatccgccacagcaaggaggcgccccacctccagcctgctgggacaagccctccctcggcacacaggagcttagccagggctgctactcactctctgtctgtcacgatgtagccccgcgcctcttcctcggaaggctggacctccaattgcaggccgtcgctgagggcctcctgagcacccgctggaaggctctgctcctccttcgagggcccaggcatctggttttggagctccccaaacgcagcggccccgggctccgaatgcggctgctgccccagcagatctttggaatacgtctggctcttgacgttctccactccggcagtctcctcttctgaagacagggaagactcagggtgctcggacttcttcctctccatgtcgaggggccttgcaaaggggagggctccaggtaagagtcgagacccgtggtcctgcaggaggcccccgagtgtggcactcagacgatggacctgacagagaggacattccgtgagggacgtctgcgaaaggaatgctgatgtgacacatgcaatcaagggctgcccgggacagagtcactgtggggatgacatgggcagcctggaaggagagtgtgggaggaaggcgaagtgtgtgcagtctatatttagaatgatgtctagccgagcatgaggtgtgagggcgctgagtatccgaatcacttacgtgctgttttctcctccctcccgctccctctcacacacatgctcacacacacacctctctgaagaatcagattttgtagagtttgtgtaggtctttggcattgatatttttaaaaataaactgtgtgatatcaagatcccaccccagccctctagaagcaatgaacactaaataataataataataataacaaatttgcaacgactgagctcttccagcacacaaaggcactgtactaaatgcgttatctgcatgaacacactgagtcctcacgtaagcctgtgggtggggcaccctcagtaaccccagttcacagaaggggagacggaggcacaaagcgattaacccacaagtgggcacatcacagggatgtgtaattgattctaacgatacctgagggatctgtggtcctcacacgggctacagtctcccagccggatccccttttcctggacaagccatccctcggaaccccctggcacctctgctgactatgcaccgggtacagatttgctttgtgtgggttctcatgtaattactactccaaccccataaataaagggtgagtttcacctttaatttgtagactctggagtttacagaggttaaatatcaaattattggtaccagatcacaaaagtcgtgattatcagatccagaattggaactcaggtctaagggccatcaaagacatgatctccacccctgggccgcactgccctcccaggcaccctacactgcttcctaggaaagaccgggtctgctcctgccactggcacataccaggcaacccacggacacctcctggtgcatgtgatgccaaaagtcttatgtctacttggcagggtttttttccaaccatgaaattatatcttcaatattatattagatgtaaacaggaaaatctgattcactttacaactcactttgccaaaacacacttttaagaaaattaaggaaggactatagaggcaattattcccattttggctacaaattacaacttttccttttgtattttttaaaatttaaacaaaatagtagtgtgataaaaacactgctcaaatttggatcctcaatgacaataggatgtagccgttgacgttactaaacagagctaggaaaaagcataatattgtcacttaaattgtgtttcatgtgagaagaaaaagaaagatgtttttaaataaataagaagtcagaaaatacaacactcacataccctttttgagaaacagaattgcttgaaaatacaccccaaacaacagagaactgagtcagaattccacgcatggaggatgaaaagcctgtggtctaaaagtcagggagtcttaggctaacggcagccccccagagcgctccctgcccctcaggtgggagggctgggtctccccgactccctaaattaggaaatgtgtttctcagccccacttctccctccacagctcagacagcaggtcccatcatttctgatggatattcaaaaccagaactgctgatgttttcttcctgcacttgccaacaggcatggaaccactaaccagtaagagaatctgaggagagaatgactaaccaaagactcttctttctccacccccaaaactgggtttcccagaaccatgcaatgtcactgctgttgcttagaacggttcttcatccttcggccttgtattcacgaccaaaggttcttaaagggagagaaactaagaggctaaaagacttaacagggaaggccagtgtctagctcgtggacatcgcctgcgactgggcccttcttctgactgcctccggagcagcagtgcccacgggggctctgggatggtggaccgtcctcttcctgtggcatccagcgccttggccctgagccacatgcgactaacgtgccgccgacctgaacccagtgcggccaaggcactgcatctttcatttatttaattttattcaatttaaatataggtttagatggccacatgtggccagaggtgccacacgggacagccaggtgtgagtgagctgaacccctcaggaatccgcacatgcaggaggcatcaaatgtgcaaagtgggcacaggctgccgtgtgataatcctggctgggaaattccaggaaaaattaattttcttctttgcatttaccacgactttcatatttctaccatggataaattaggttataatttgaaaagagatatttcgtatccaaatatacacacttttgtatgttctctttatactgtttttcaatttggagattatgaggggtttctccataattttctgggaaaaaaacttttgtatttcataaatgttcccacaccatgaacaaaaagatcaccaacttccacatttaacatgaaacaaacaccagagacgtcatcttacctcttggtaaagtctatcatcgtcgtcctgcactccgtcatctgtaaaagacaccagtgttaccaagaccctcatcaagaatgtcatcacagggtgccacagacataaaaagggtgaccctgcagacccctccatacgaaaggtgaggtgtgatgacgctggcctaagtcctgccatagagtaaaccttttctgtttatagcacaaaatggcattctgtaaacttcgcgagagcggaggggactgaggagctaaatggtagacgtgaaggcagccacaatgacctcacccagctctgggggtctcacgtgatcgacaaagttaactcacggcaaaaaaaaaccccatcgtaccgagcagttcacgtcatgaaaaagcaaagtgaagccttcgccaaaaccacctcacaattaagatggcttcagaatccactgacttaggttatttcactgtggtcagcgtttctctctaaataggtaccccggctgggcgcggtggctcacgcctgtaatcccagcactttgggaggccaaggtgggcggatcatgaggtcaggagttggagatcagcctggccaacaggcgaaaccccgtctctactaaaaatacaaaaaattagctgggcgtggtagtgcacacctgtaatcccagctacttgggaggctgaggcatgagaatcacttgaacccggcaggcaaagtttgcagtgagccgagatcacgtcaccgcactccagcctgggtgacagagagagactccatctcaaaaaataaaataaaataataaataaattaattaatatcctactttcagtgcccaaaggtgcgtgactcatggcacctgaacagtgcccctggagacagcacgcacaccagggcctcctgcatccctcctagccatggtgcgggtcccgattccttcaaccactgggcgaccacctaacacaggccctcccggggtgcagttccactactcccctgcaccctgcctgtcagccaagtcaggcttccagcttccagcaaggccccctctgcacccgtgcagagagaggggcacgtctgtcatttggttttcagcacgtacttgtggggctgccatgtgtggggagctgagctaggtgctttcttgcagctccacgctgtgagaagccatcaggctgcagaagtcctggctgacccatggggcctccacagggctccggatgcctgccggggtagtggtgctgaggggctgccttctgcttccccagcagcctcagaggaccaatgcacgccccaagcagacatttgaatgatcccctctcactctgctattcaaatatttgacaatattcaccggtacacagtccaaacacaacacttcccatcacgcctgttttcctgactcagcctcagcatggaggagtgaaacctcctcgcagagagcaatttgccattcaacataattgctctggtaggcttagtctgttaagaaagcttttagaggcaaaagttcaaacagataaaaatcattaatacagatccccatctccccagcagaaagcccacattgcacttggtgagccagcagtctctgcacagccctgaggcctcccctccccgcagcacccctgggtgtgggcacccatggcgctgcagtcacctggaaagctgtctccacggagggtggccttggggccatccgcctgttctccagactctcccagggccgctctcccagggctgcctcgagctactccatggtccacgccttgcatcaggccagccatcagctcagccatgccgtccagctccaggccactcaggcccctcacctcagccggctgcctctgcaggtccttcaggagggtatgaatccgtgctcctaggggcacacacacaaacacaaggacgttgtgggtggacgaatgcaaaggtgagggcctccagaccataggggtgtggtgggcgtctgcggcgtcccaaggcagtggccacctagggccaggcgcaggccagtgctcagagaagattgggatattggacttgaatctcaaatccacctgaccctgtaaccatcactagttcagttccccagaggtggaaaacccacagaatggaaggacagactcatccacgcgctcaggaggatggaaagcacagcttccagaaaacactggaatgaccaagccaggaagagagatgggctaggcaacttcaccatgtcctccagaggataaaagaatgggatgagctgtgtccccctcacttggcagaaggagaaacaatgcctggcaaggacagcgccctgcccaggacaccctgcccagcacaccctgcccagcacaccctgcccagcacaccctgcccagcatggaccaactctaattacatctaaacacagccacacagggtcaaagcctcgtccaagaaagtaactgctgccggaaaagccccttaaaggaaggtggcagggtctaggcccccacttcacacaagcagcaacagatgcaggaggaggcagaaaaacagaacccgaaattgagaatagggcagtcgatgattagagcgaggagacaaggccatttgtggagctgccataaccgcggagagatgtgtgcacccgctgctcagcagagtggggaaattaaaacagaatccaacacacattctgtaagtgaagagcacggcgtctgaaatttaaaatttatgtccattacgggtggacataacggaagaaacggtttgtgaatctgaagacagatcatagaagcgatcatcgttggaagaacagaatgggagacgttctgcagaacctcagtcacccctggggcatccaagccgtcggagtcaggagggcacgggggggtgggaaaggaaccagaaacacctgaaagaaagcccacaagtctctcaaatctgggaaggattgtcactcagggactcaagacagtcactaagttccacgataataaaatgcaaggagaaccacgccatgacttcagctgagctactgcaagtcagagatggagaagattcctggaaagcagcgggggcggggcggggggaagacacgctccacacatgagaatggaaagggtcccaggagcgcagaggccgccagacaccctgcatgtcctgtaagaacaacgtatttcatacaatgtgcagagtcaggcatttgacgttacagataatgaatgccacatttgaagggttgaaagaaaaatcattcaatccaggagtttatatccaatgacaatatccttcaaacgagagggtaaaggagagacattttcatatcacgtatgtgaacaaagctgagccagtgggtccctgtgggcctgcacacaggctgaagagaaacaccaccacacagaagcccagagctgcgggaggagccaaaaagctcctgaaagggtaaatatgtggttacataaacaagaaagaccgtcttcttttctcctcttactttatctaaaaaacaactgattgttagcaaggaaaaattattaccactttaaggtagggttcataaaacagctgcaggcatgaactggatggcacaagaggctagagggagctgaagcctcctcaccgcgtccaggaagtggcacagtgacaactccgaggagactgtttcaaaggcgccagggcgtttcaacagagaaaggaaagtcttttccaaaaggacatcttccgtattacccagaaattggactcgtaagtatttacccgagagaagtgaaacccgtaaccatgagagttaaatgagactgtgggtagcagcctgactcctcatagttccacagacagagtctaaagtccatgtgcccggcagcaggagagcggataaggaggccacatccacaccagcactgagccagaaggaaccacagagacgagaagggggacagacctagaaccagtcaggctgagtgagagaagccggtcaccagagaatccacagaatcctgttaacagaagatgaagttcaaggatgggcgaggtctgcccagggcaaccagagccgcatcacctgcaggtggggctggggcaggaggaagcgtcgggtgtgagggtgtgccgtgcagcgtggccgctggttccaggcccacatgcgtccaacgcgtcatcgtgtccacctgcggtctgcgcatctcgccgtgtgtatactccccctcaacagcagcaataaagactctgccctaaagaaggttcatgggcccatttccgagctttgaaggaaaacctgactttcttttgtattcagtgttgaaatctctgtcctcataaaggtttatgtaaaatagctcatggccacgtctctaccttcccgaacgacaccggcagagtgacgcagaggggacacagaatgtcctgacctcagtggggtctcaccacgaccctccactgtaggggggtcccgctgccaccctccacgctagaggggtctcaccacgaccctccaccctagacaggtcccgccgcaaccttctgccctagagggatcccactgcgaccctctgccctagagggatctcggcacaatcctctacaatagaagcggaggaattatttctgctttttacaaattaagaaatgtaggcattttaggttttttgtctgcgtcaaatgcatcaccaggcctgggctgcagcctgcagtgtctgcacagggctcgacagtggcactgcctgtggcacccccgttcactcagccgcacgtcccgtcctctctccacagcgcaggctgtgtctagtccatgccgaggcagcggggccggcacccggtccccacgtgccccgttcactgcatacgcaggacaggagtcagtgtctggggccgcctagactcgcatgactttccaaacacaagtgccgatggcctgtggtgggttctttgagtgaaaattttttaagtgcagtctctcttgcccattaattgaagctggttcttcagggggcgtcttgctacacggctgtaaggacacattttttgaagtgttttgcttcatttctgaacactctctgctgcaccccatcccccaccagggtctcgcatggaaagggtcacagccatgaccctctgattttcccctttgaaaacctgagtcctgtcagcgccactccagacttgctgttgatgactaagaccctctgatgtaaaggcctgaacgtccatgacaggcatttctgagacagcattatgtgtagtttagcatgggatgaagcggacagagtcctttaaagtcaatctgtacacgaaatgtgtgacggacacgggcgttctgatcggagcgtgctgggcgttcactgccaccgatgtcccctgctggggtggccgagtgccccgctctggccgacgttgaggcctctgaattgttcggcagacagtggcggcttctttaccttcgggttgaagtgtccgtattaaccccacatttctgatgctctgacatctggggccctgctgaccctgggggctgcccctcccacgaacagccaattcccagatagtgaacagtcacccactccacgcaggctttccacatgcaaaccctgcgatccggagcccacgcccgcctccgcctctgtgggctcagactccaggccgctgccctagtcaccctggggcaaggaccagacacgggcagcccctggccccggagcggctggaactattcaagctgggcagtcctgtccctgacgaccctgccttgccctcgcccagcctccggactgacgctggcgcatccctgtatcgacccatggcgtggcctgccccctcctctcaaaatctgtaagtaacaaactgttgtttcaacagcagctgtacccagatctctcgggcttgccgtcctaaatcataatgaaacctgccgtttaaaacagaagaagggaaacgcagggattggcatggaggccgcgtactcttctgttttttcattagccttgagccttggaggggagggccagcctcccttcgccacacccccagggcccaccaacccccacacatcagccctcaccatgcattcactgatggaatgctaccttcaaagaaagcttccagcaacaaactcaggaaaatacatctcactttctcacaaacaaaaacatgcctaaaaccgcagcaaagcctgccttcaccgctactcctgtctgcaggtgacaaagggctgaagggctggacagtcccaggtcaacggcacccatgccccagctccttccacgctgacaggctcacgttgtttcacagagaagataaaagatgtgctccggaattaaaggtgcgtgtataccacagccctcggtgctgttttgaaaatgtgctgctcattgcagctttcagaatcagaagagccatctcagcctcgcaaccgagccaccgagccacgagcccagagcaaccttttcattctcattcactgcagtctcctcccaccacagatctttttctttcccagcgattatcatcgcgacagtcttatctcgctcgtccacgtccacaggtccaatgctggcaacaaagggctcactcatcccaaagaaaatggaaataaggaagtgcagggatcgggaggaagagctgtgtctggaaaagtaggcggccacaggcaagagcctgagttctgaagggtcccgggctccaccaggcggagcccagaaaactaacagccccagagaactggcaggaggcaccggagcctgcggcaggaaccggcacagctgcagggagacctgaagggccctcggcattgggcatggctgtccccagcagtcggcgtcctccgtgcttaggaggcgagggatgtctccacacatgcctgcactagccaagatgtgtgtcagagtcggcccggccatagctcacggtggacaccagtccccgtgatggaatttcatcggagggaaagaaacagggaggtgaggaatgagtggtggttgctaaggaaaggtccttcctgtggacacgaaccaatgaacacaggctcggctgcccagcggcctcctcatcaggtgagtggggcaggagggccccagagtaacgacctgaccagaggcctcgtctggggcaaagtccattatttctgatgtcacgattcgcaggaagtggcagggcctccaagtgtggtagaacaattcacttccaagtccaaagatcccttctgccctcccaaaaggacaaaaggactctccacacactagcttggcacagcaggcaccacaaggcctgggagcctccacctgcatctgtagacaccgccttcctgagctcccaggcagcagagtggccaccgtcccccccgcagccggagctccccaggactgcagccccgggccaccacctgcccagacgaccccactgcagctccagagaaggtgacgtggtccgtgcggggacaagtttgggacagagttccattaaccgttcttctgcaaggccctgtgtttcctaagggggctgaaaagctggttgtgatattttgacaaatggtgagagaataaaaatcatgtgacttctcaataaagaaggttaaatgttctcgaattcggcatttccagtgaaaatgaatcatgttttgccatactgatccacaaataaacttttctgagccccccaaggtttataaaaatgatgtgcacaggccagggtattcaattcagagtggctacagtgttgccagcaggaaaatgccaaaagaaagagaaagcagacatcagccggacgcggtggctcacacccgtaatcccagcactttgggaggccaaggtgggcggatttcttgagcctaggagttggagaccagcctgagcaatatagtgaaactccatctctactaaaaataccaaaaattagctgggcatggtgtcaggcgcctgtaatcccagctatgcaggagactaaaccaggagaattgcttgaaccttgggggtggaggttgcagtgagctaagattgtgccactgcactccagcctgggcgatagagcgagagaaggggaaggggaaggggaaggagaagggggacatcagcaggcatcccggggtggagcgctcaccctctccctccagggcaggctggcgcttctcccaccaccccgagggaagaggctgcggtctgtgtttctaacagcaaacaccgtcactgtcaacactgatgagtcctgcttaacacaaagacaggtgtgtcgacccaccctgaactttgcaaaatgatgcttattcccctctcaaacccacacagaggccaagtgcctgctctgaaggaggaactgaacagcaagccacgtctccagaatgccacggctcggcaagacttccctcacatcatcgcaagaaggttccagaataccacggctcggcaagacttccctcacatcatcgcgagaaggttccagaataccacggctcggcaaggtttccctcacatcatcgcgagaaggttccagaataccacggctcggcaaggtttccctcacatcatcgcgagaaggttccagaataccacggctcggcaagacttccctcacatcatcgtgagaaggttccagaataccacagctcggcaaggtttccctcacatcacggtgagaaggttccagaataccacggcttggcaagacttccctcacatcatcgcgagaaggttccagaataccacagcttggcaaggtttccctcacatcacggtgagaaggttccagaataccacggcttggcaagacttccctcacatcatcgtgagaaggggcggcagtgcccggtacagcgtggtacagtgagcgccacactcaaccatatgaacagcctacttgtatcgacagagagcagctgggaatgtagagtttggggaactggcaggcatccacccttgagaaactgaggctccatggtggaccaggaagggaggaagaaatggcaacgtgagcagaaaggccatcaggcacggcgggaaagccagagcaccctggccagacgcggccaggcttggcgtggagctgccagtactgaaccaacaggggctcccctgccgtggctgcagctgcctgcacactttctcaggcctgattattctagaatctgtagggtgttagctcacatttctttttccatcattgcagctaggaccttagacacatttaaagttcccatcaatccgatcatccatccttgtgctgccctgccctgggggatgccaggctggactcccatgaagaaaggctgaccatgctcccggagtcttggccccagcgctcatggtctgtggtttggggcaagctcgctcatttcttcatgcctcagtttccatatctgtaaaatggtgacaagtgaggcatgggcccagcatactgtaagtgcttaataaattataactattatcatgaaacaaggagaggatgagaaatcattttagttttccactcttttccccctttcccatccattctgaaaacaaatacttggttctccatgagaagctctcgccacagctcattgtgatcctcaggtgagaagtgaggaacacagtcagagagccccttagatgctcagtcacacaagctgacaggcaccttccaacttgctcaagatctaattcaagattatgcattttgaaactattttctgccaaaatattaaccaaaatgttaacctatatttaaaaaaatatgaacctctcattaaagtcaaagcccagtctccgtccatccctccacccactaacctacccattgattgcaccaacctgtattgggcatctattgtgatcaaagcctgggaacaaacattattctaagaaataataggctgggcttggtggctcacacctgtaatcccagcactttgggacgctgaggcatgcggatcacgaggtcaggagatcaagaccatcctgactaacatggtgaaaccccatctctactaaaaatacaaaaaattagccaggcgtggtggcgggcgcctgtagtcccagctactcaggagcctgaggcagaagaatggtgtgaacccaggaggcggagctagtagtgagctgagatcgcgccactgcactccagcctgggcgacagagcgagactctgcctcaaaaaaaaaaaaaaagaaagaaaaaagaaacaatagaaaattaaaagcttcattttcttgagggctacaacattgttctcacaccagcacagacacactaaaatgttttggaggccagagagacttgaccaatggatagaacaagcaaacagtttacagggaaaatacaccattaagatcctgtgaagagactgaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccttcaatgacaccccatctcacgccacgtgtctttccccttcaatgacaccccatctcatgccacgtgtctttccccctcaccgacaccccatctcacgccacgtatctttccccctcaatgacaccccatctcacgccacgtgtctttccccttcaatgacaccccatctcatgccacacgtctttccccctcaatgacaccccatctcacaccacgtgtctttccccctcactgacaccccatctcacgccacaggtctttccccctcactgacaccccatctcacgccacgtgtcattccccctcactgacaccccatctcacgccacgtgtctttccccctcaatgacaccccatctcacgccacgtgtctttccccctcaatgacaccccatctcatgccacgtgtctttccccctcactgacaccccatctcacgccacacgtctttccccctcactgacaccccatctcacgccacgtgtctttccccctcaatgacaccccacctcacgccacgtgttattccccctcactgacaccccatttcacgccacacgtctttccccctcaatgacaccccatctcacgccacgtgtctttccccttcaatgacaccccatctcacgccacgtgtctttccccctcactgacaccccatctcacgccacgtgtctttccccctcaatgacaccccatctcacgccaggtgtctttccccctcaatgacacaccatctcacgccacgtgtctttccccctcaatgacaccccatctcacgccacgtgtctttccccctcaatgacaccccatctcacgccacgtgtctttccccctcaatgacaccccatgtcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcactgacaccccatctcacgccacgtgtctttccccctcaatgacaccccatctcacgccacgtgtctttccccttcaatgacaccccatctcatgccacacgtctttccccctcaatgacaccccatctcacgccacgtgtctttccccctcactgacaccccatctcacgccacaggtctttccccctcactgacaccccatctcacgccacatgtctttccccctcactgacaccccatctcacgccacgtgtctttccccctcactgacaccccatctcacgccacgtgtctttccccctcaatgacaccccatctcacgccacatgcctttccccctcaatgacaccccatctcacgccacgtgtctttccccttcaatgacaccccatctcacgccacgtgtctttccccctcaatgacaccccatctcacgccacgtgtctttccccctcaatgacaccccatctcacgccacgtgtctttccccctcaaggacaccccatctcacgccacgtgtctttccccctcaatgacaccccatctcacgccacgtgtctttccccctcaatgacaccccatctcacgccacgtgtctttccccttcaatgacaccccatctcacgccacacatctttccccctcaatgacatcccatctcacgccacgtgtctttccctctcactgacaccccatctcatgccacgtgtcattccccctcactgacaccccatctcacgccacacgtctttccccctcaatgacaccccatctcacgccacgtgtctttccccctcagtgacaccccatctcacgccacacgtctttcctcctcaagtgcacgagtgtctgggctgacctgctctccaagctggcaccaattatagtacagggaacccaatttccaaccaaaagacctccaaacttttataaagcaatgtcatcaatgtgtaaatcactgcctatatttaacccctggaaattaacaactacattgacataaacttaaatctaaccagtgtcttttcagtataaactcttaaaacataaaatgtataagatgttaccttttctcaagaggtaaaaaaaaaaaaaaatccttatttttaatctctaacaaaggcaatccaattaactcactgatttttaaaaagataagcccggctgggcgcagtggctcatgcctgtaatcccagcactttggggtccgaggtgggtggatcacctgaggtcaggagttcgagaccagcctggccaacatggtggaaaccccatctctactaaaaatacaaaaatgacccaggcgtggtggcgcatgcctgtagtcccagctactcaggaggctaaggcaggagaattgcttgaacatgggagacggaggttgcggtgagctgagattgtgccattgcactccagcctgagtgacagagcaagagtccatctcaaaaaaaaaaaaaagataaacccaagtgatgtctcttgaaaaaacaaaaaaattactgtggaatttttgggatctaagttatgctgaacaaaaagtggcaagaatatattttaaatttaatataaaataaataaaacatatgaaaaataaaaatagaaagtaagcaacacaattctttgctgtttgttaagcctcattacagacacatcagatttaggtggcgtagtgtggcatcaagggcatgaatgataagaaaacagagtcatctgagggaagaggccgtggggcagaaggctgccgtgggtgttctgctgagctctgaagcttggccggcaacaatgctgttccctgcaggctcctgttgcctcaagcggggcagtgtgtgtgagacccaccttcatgcttcaggaacactggccaaggcagaaaaatagatggatgtattcatgagagatttttaaacaagttgaatccaggctgtttctgctaaaggctaacgtaaccagaacattcagctgacaagcatgttccatttctgagtacctgggctcaccaagggtgtaccccagtctccgccctccacatgcagggctgagatgtccaccctcagcagctcgaaaagtggcagctctgccgccctgacctggcactgacgcagcaggcggatgttcctgtgtcccctgcactgaccttcactgcaaagctaacccaggtgagtcccagtattcaccagctcctggagcccagaaacaagtgggcatttctagaaggtcaaggagcatctatatggaaagaccttttctccttaagatctcggtgtcatctcctgcccctctaattccacccttgtgaacataacccaggggggtcactgaggtgagatctgtcatgcagagggaagaatgtgggtgatcatggtgatctgcaaagctctcttctttcctggtctgtgagacgctgcgtatctgcagcaccgcgacccagcactcctctccctccgtgtcctgtgaactctcccatgatggttgcaccccagccactctggcctcctttctgttcttccaacccaacgtgctggtggaattatcctactggtttgcagcaaatgggccccacacaacaccgagaagctgggaaatattattctgtgcatcccaccctgcttacagcaatgtctgttcctctcagcacctcatgctgcctcctatgcgggaagccaggccctgtcactgtcctgcccctgcctgcccacactgcccgcctttccactcttgcccctgcctgcccaaaccgcccgcctttctgctcctacccctgcccacaccgcccgcctttctattcctgcctctccctgcccacaccgcccgcctttctgctcctgcctctccctgcccacaccacccaccttctattcctgcctctccctgcccacactgctcacctttctattcctgcctctccctgcccacaccgcccgcctttctgctcctgcctctccctgcccacaccgcccaccttctattcctgcctctccctgcccacaccgcccgcctttctgctcctgcctctccctgcccacaccgcccgcctttctattcctgcctctccctgcccacaccgcccgcctttctattcctgcctctccctgcccacaccacccgcctttctattcctgcctctccctgcccacaccgcccgcctttctgctcctcaccgcacgtcctactccaggcgatctgcaggcagcctcttactctgcctgtggtggggtggtggtggtgggtggtatgagccacgccctccccttcagggacagatgagagcttcaggaggtgaaatactcccccgccccctccttcttccctcttgtttcctttcccttctttcttccttctccccaatcttcctccctccctcccttgctagctgcattctttccttccttcctgccacaaatatttactgcacatctcctttgcaccagctacctttgaaggcgcagagataaatccatgagcaaagtccttgcttttgtgtgacttccatctatgttagaaggaacaggaaacaaataaaaaccatgaatgcggccgggcgcggtggctcacgcctgtaatcccagcactttgggaggccgaggcgggtggatcacaaggtcaggagatcaagaccatcctggctaacatggtgaaaccccgtctctactaaaaatacaaaaaaattagccgggcgtggtggcagacgcctgtagtcccagctactcaggaggctgaggcaggagaatggtgtgaacccgggaggcggagcttgcagtgagccgagatcacgccactgcactccagcctgggtgaaagagtgagactctgtctcaaaaaaaaaaaaaaaaaaccatgaatgcacagaatatgtggtggtgattgatgctgcgaagaaataacccagagtatgaaggatcgggggctggagcactgctctttcataccgcactgccagagaaagcctcattgagaaggtgaagtttcagcagaggcctgagggaggtgagcatgggcctagtggggcctgggaagctgtcttcaggcaggagtagcagtgagcactaaggccgtgggcagaagctgcctggcgtgttgggttggaagaacagacaggaggccaaagtgtccagaatgcagccccacgtggagagttcacagtgatatgggagtgctgggaaggggagagctggtccctttaaatgatatagaagtgtgaagggaagtgctgggttgaggaaggcaggtccctggctggggctccatctccacagacctaggtgaggacaggcactcctgccttcaccaccaaatgctgcatttcccaagaccaccctggcccctaccacactcccatcctgtgcctataaaaacccccaagaccctggcaggcacacacacaagtggctggatgtcaagaggagcacgttggcaaaagagcagaccaacagacaccagcatgccagcaggccaccgactggtgggacaagagcagaccgacagacaccagcacgccagcaggccaccaaccagtgggacaagagcagaccaacagacaccagcacgccagcaggccaccgactgatgggataagagcagactgacagacaccagcacgccagcaggccaccaaccagtgggacaagagcagaccgacagacaccagcatgccagcaggccaccgactggggggacaagagcagaccgacagacaccagcacgccagcaggccaccgactggggggacaagagcagaccgacagacaccagcataccatcgaccagcggaacgatgccgagtgtggccggggcagtctgaggagagcccaggccatcaagcattcggactccaggggaaaatcatctcccttctggctcccccatctgctgagagctacttctactcaaaacaaccttgcacttactctccaagcccacatatgatctgattcttccagtacactaaggcaagaacccagcattcagaaagccctctgtccttgtgataaggaaggggtctgattgagctgactaacacaagccacctatagacggcaaaattaaaggagcgaaaccaaaagagcaccctgtaacacatgcccactggggctttaggagctgtaaacattcacccctagacactgccatggggtctgagcccacagcccacccgtctgtcagctcccctagaggtttgagcagcggggcactgaagaagcgagccactcccccatcgcacgccctgtgaggggaataagggaacttttcccgtttcaacaggacacggagggagaggagtggtgggtgggggtgccacagatatgcagggtcttgcagaccaggcaaacagctttgatttttactgagtgtgatgagaagcccgtggtgtgctctgagcagtgggatatcatctgattgacaaatttacaagaaccactctgcaggcctgagacaaggtcagaggcaggaggccaggtctggtcagatctggttaggggtggtggtcggggggacagagagcagccggctggtggggaggagggggcaccctgggtgtgctcgctcggaaggcaggtacagcagggtctgccaacagactggacatggggggacagaaagaaaaggacctaaatggatagtggccccacagccatgctgtaggaaccatgggagggttcgttcaaggtgtggggtccgggctgggctgggaggccctcaggagcccggcaggcacccacactgccatgtttggtcttgtgccagtgcaggtgggatgagagtcctgctggtcacaggcagggaatgtcagggcagaaaccctaaaagattcactgccttccagaaaaggcagcgtaacgcagagacaggtgttctccggagtcagccaaaccgggctcaaactccaccccaccattcaccacagttgggactcggggaaacccatccagcctcttccagcctcatgagccctctgtgtgaaactgaatcaataactcccactcgaatgggttgctgagaaaatgaaatatagtaagtgtgttgtctactacctgctaatgctcagtatttgttgacaggaagttgtgtcccctcttctaacaccgctgtaacatttaacaactcagaaaaactctctcttatggctgctacgcatcccttttcctttgactccctttggttcgagtcttgttaaatggatgggagagcagaaatacaactgccctgaaataaaacttcatgttctttatggtaaagatcagagaacaggaggcattttcagtgggcctcttagaatcactataataggaaacatccaccttcaaaatggaataataaagtacaattccaaaaactacttcccctcatctgaaaaagaaactttttaggttatcattaatgaaaaataactttaaaaaaaatcataagtatataagagaaaattctaagttgctgggcagcttatgggagaacagttaatgcatactagggatcccctcccatgtaacctctacaaaccacacacacagcattttatgaacatgctgagttatctcagaagcatccactacctgccatttgaagatgaagagaaatgaggaagtatgttttgcagcatccagtgagccctggtgggttgaagaagggcggcagcacagagcacagataacaagaatatcaaagtaaaacgttgtgttccatcaactgcaccacgtaattctgcaatctggccagttcataatgacattttaagtagctttcagtgctccaactgggctctcataaggcaattacacaaaatgtcaggatattaaatgtgtaaagcctggagtaagagatcagctcacatgactctgcattctcaactgccacagccaggcctattgaaattatatgtcattgtagggccttccaaacaaaatggtacaagctttaaacaatcagcaacagcctgcagataacctcgccacaacattgttttcacaaagacaatgggaatcatgcacaacagcttttgctcctaagtgcctttacaaccatgtatatatgaaggtacacagttagccacatctgaacacccatcatcaccatcagtagcaccaccatcaccaacaccatcatcaccatcatcatcaccatcaccatcatcatcaccatcaccatcatcaccaatgccatcatcaccatcaccatcagcactatcatcaccatcaacaccatcatcatcattgccatcatcaccatcaccatcatcaccatcatcatcaccatcaccatcaacactatcatcaccatcatcaccaccgtcatcattgccatcatcaccatcaccagtgccatcatcaccatcaccatcagcactatcatcaccgtcaacaccatcatcaccatcaccatcatcaccatcatcaccatcaccatcatcatcaccatcaacactatcattaccatcatcaacaccatcatcatcaccaccatcatcaccatcacccaccatcatggggaatggactgtgctcctttggtttagaggacatacagcccatttaattgctggggtccaaaacttgggtatttgcagaggattcaggtaaattcagtaggagctcattatcgcattctctcctcatttgggcttccacagggagaaactgacataatcatatgccagcatgttgtctattttcactggaaacaacacaagtgtagtaaaatatattctgcttccaatatgagggggtaaggaatcacagctgagtagtgtgcatctctccctgactaatgaaaagtgcccatgctgcagcctgggatgaagcttctcctgcactgtcatgccgcaatattttgcactcacagggctcagcattcacccagtctgacactttctctattgaatgcaatactgaggcaaagaagaaaaaaatatatccaattagctctggcattaatgacatgacttcagtggggtgtggggattggcagtcaaatggctttctaaagactgcttcctttaggttcatgttagtgtgagtttgcacactcagaacgtgaactgacggacgacaggtaacgcagctcaccgtggactgggtggcaggtaagaccagaagagaaaatgttttacagatgtcagagggttgggacttcggagctgcccacattcgctaaatgagctaagccgacatctgcagaaacgccctcgtaatgggaacagttacctcgaaaagttctagaaatgccggtggagagggcaggtgaacacacagctgcagtcagacgctcggcatgatcagacccaaagcaaaccaactgctgcatagaacgccctggggcttcgagcccccagttccagcctgtgacgcactcacccgtgggaaggggaaaggctcccccagtgccttccctacacctgccctgtgccctcagagcggaagcatcaccatgtaatcagcggtctccattaaccaccagcgttcaggttggaactggggagatttggaaaagtgacaggaaggatgacatcatatgcagaggatgcttatacagcggagagcacccctgttccatgtggctctggaaggcctccccattgtgctaacacagcggacagcacccctgtaccatgtggctctggaaggcctccccattgtgctaacacagtggagagcacccctgttccatgtggctctgaaaggcctacccattgtgcttacacagcggacagcacccccgttccatgtagctctggaaggcctccccattgtgcttacacagcggacagcacgcctgttccatgtggctctggaaggcctccccattgtgctaacacagcagagagcacccctgttccatgtggctctggaaggcctcccccttggagccatggcagaaggtggtgggaggaaaacctcaggggttgggcagtgacagtgaggtgcctttaggtgccctgccaattcctagtcagacagaggcaaatttcaacccaattctcaaagtaaaaatctttccagcaaatgcagctggcttacagcagcatggacctggcaggaaagcagtgacctcagaggtgtttaagcagagtctgtaaggacatcagccaaacaccggggaagagatttctcacatgggggcagtttatgactcttacttctcccaaatctgaaagcagtgactctgcactagtgcagaagtcggggagcctcctccccctgggagaagacatgagctgggtggagccgagcagtgcaggtccgggactgccagccacacgcaggtccgaggctgccagccacacacggccgctgccaccccgcactgggcgcatccacgtcagggttgctgagcaggtgggtgtgtcctcaaggtgcagtgagacgaaccctgttcccgctatataagccacagagtgacccccccagcaccccgggtgccctctcctgcgcctgctcccctgggagagagtgcgctgctgctgactccacggtgtgctgacacacaggaagaaaggcctcaggcagtgcacactgagcccgggactgtttcgctaggatgaaaggcactttgataacataggtgccttctcctcctgctttagagggtgctcgtgaactccagccaggggcatggatccgagattaacaatttatcagtggcttcctcctggagcagcctgtgagaggcggcctctgtgtgccagtgattaggtggccaattctcttctaattttttttttttaagccaagaggcgtgcttgggtttagagcactgagcagcactgggatgcattcaaatatgaatgaatttcttcaaaaacgaaaaggcagcaggtgcttcctttcaagtgaaaatgaccccaaaagtgtgggcatattttctccaaagtgacagaagcattggtatcagttatttctgtgttataatctactgctgtcaccgtgaaaagtcaaagctttggttcagtgccctcctgagactgggctgcggggaacacgcccttctctgtgagggttttcaggctgggattcccaccaccaacacgacaaggaagtgggcaccccaccagccaacgcaggacctcagggtcacggaaggctcgaaggagaagaggaccagaacacgcttattttggatgaggggagagaactgggagcggagcccatgtgattggccaggacttcgcaagtgctttctgagtgaatgagtgaactcaggagaatcaggagcccgtgtgattggccgggacttcgcaagtgctttctgaatgaatgagtgaactcgggagaatcaggagcccgtgtgattggccgggacttcgcaagtgctttctgaatgaatgagtgaactcgggagaatcaggagcccgtgtgattggccgggacttcgcaagggctttctgaatgaatgagtgaactcggaagaatcaggagcccgtgtgattggccgggacttcgcaagtgcttcctgaatgaatgagtgaacgcgggagaatcaggagcccgtgtgattggccgggacttcgcaagggctttctgaatgaatgagtgaactcgggagaatcaggagcccgtgtgattggccgggacttcgcaagggcttcctgaatgaatgagtgaactcgggagaatcaggagcccgtgtgattggccgggacttcgcaagggcttcctgaatgaatgagtgaactcgggagaatcaggagcccgtgtgattggccgggacttcgcaagggcttcctgaatgaatgagtgaacgcgggagaatcaggagcccgtgtgattggccaggactttgcaagtgctttctgaatgaatgagtgaacttgggagaatcaggagcccgtgtgattggccgggactttgcaagtgctttctgaatgaatgagtgaacttgggaataaccacgcgaagcgttgcatggctggagagttgcacggccggcagcagaaacaagttcttccagcttccacatgagtttccgagtgcacttcccacatgaacaccacgggccccatcttaggacagaggctggctgggtggagacccgtgattaccttggccatacaagcgatagtataataagacacctgaatagaagaaatatcaggtatgttgggatgaggttgcaatgtgaaattcagaaccaaaagtcagtcgtcatgatgtgaattagggacttgtaattcccatccaggctctggagggcgcagaaccaagatgatgaaagaaagggttctaacaggttggttaccggttttgtttcccgttcagtgtggctggtgtttgatcaatgagcaaggattacaacagtggacaccccacacattatttgtcattggttcatttagaaaacggtgtctgatgcatctcctaaagtgatttccaaaacgctttcgctgtcatcagagtcttgagctgaaagtatggcattacacaagtaccgtatctatatgaaaaaaaactacagcactgatgaaagaaagcaaaagtaaagaaatggagaagcagcgtataaatattacatgctcatggctagcaggacatgggtttggatcataatctcaaaagatacagtcccaattgccataatcccaaatagtgaaatccccaaatatctgaatatcaaaatctctaaatagagtctaaatcccaaaagtctagtgttgctaatgtttaaaatcccctaaatcataaccacaggagagttgcatcctgctgggtggagctattagcttgttattgtctttatttggaaattaagcataacttaaggagttgtgtgtgagtgccaagttgacaaggggtgaaactgtagacttcgttttaagtgtcaacttgactgggttaaggaatacctagaaatccagtaaagcttcattttgggtgtttctgggaggtgtctccagggagattggggtggagtctgagagggctgggggaaggtctgcctcagtgttggtgggcgggcactgtccaaacagctggggcccagagagaacaaacacagagggtgaattaggctccctctgagtgctggggcagactttccttctgctgccctggacatcagagctccaggtttggcggcctttggactccaggactcacaccagccgtccctgggtcttcagactgagagttacatcatcagcttccctggttctcaatgcaaaaacactgcaacttcctcaataaatgaagaatgtcctttttgtacatctgcatttgcgaaagatacaatttcttgagatctcagctcttcgactgtttatgcagcagtgacccatcagggtttttgactcatcttgtcaaaagccttaggttgttcatcagggtatttcagatgcctgcagttatacagctgggtgcacacaattaccaagcagagggacatgcttttatacatctcccttcctgacctatgtcttcataaacacagttcatctgctcataagtgtgatgcccatgcaactgtcgtcaagatatctgagggcttatgtctgcaaaaatacgaatgttattattgcttattttattgtgtaaaatggcctatgaagtgttttgtcacgattttatatattttgcaaataaattcccttttaaaaatgtaaataaatgtcttttaaataattttttccagaattacatttttgggattttgatattttgagactgtgattttcaggattttagggaccttagggattttgatatttcaggatcttaacattcagaactatggcattcaggattgtgtctttcaggattatgactggctcccaaagactcaatattgtcagcatgtcagttctccaacttgatctatggatttaatgaaatcccagtcaaaatcccagcaagtcattttttggatacaagcaagtttattctaaagtttatatgtagaggcgagtgacccataacagccaacacaatactgaagaagaacaaaggcggaggacaacagcacccatcattaggatgcactacacccattgttacgactcactccaactccacaggaatccaggcagggtggggttgatgacacagacaaacagatcaatgaaacagaacagagagcccagacatgggtccacatacatgaggtcagccgagctttgaaaaggagcaaaggtgatgctatggagaaaggatcgcctcttaacaaatggtgctggacaactggatgtccacatgtacagaaacaattccagatgcagaccttacacctttcacaactaactcagaatgggtcacagacctcattataaaatgaaaaaccataaaactccttaaaggtaagagaggagaaactctggatgaccttgggtttggtgatgactttttaaaatccaacaccaaaggcaaaatccatgaataaaataattggtaagctggacttcattaaaataaaaactaatgctctgcaaaagacgctgtcaagagaatgaaaatacaagccacagactggagaaaatgtttacaaaagacatatctgatatctgataaaggaccaatatctaaaatattcaagaactttacaaactcaacaataagaaaacaaacagcctaattaaaacatggcccagagaccaccacagacacctcaccacagaagatacacagatgaaaacaagcatgtgaagatgctctgcttcctccatcatcagggaaatgtgaatgaaaatgacaacgagacaccaccacacacctctcagaagggccggaacccagaacattgacaacacccaatgcaggcgaggatgtggagcaacagcagctcattcaccactggtggcacgcagaatgcagaatgccacagccactggggaagacagtttggtggctgcttccaaaaccaaacattctcttactatgtgatccagtgattacactccttggtacttaaccagtagaagttaaagacttatatccacacaaaaacctgcatgagggtgcttatggcagctttatgaataattgccaatacatggaagcaaccaagatgttcctcagtaggcgaataaactgtggcccatctatacaatggagtgttatggattataatgtaataatacaatactattcagcactaaagagaaatgagccatcgagccatgaaaagatgggggaatcttcaaggcatgtgacccatctgaaaaggccacatattgtaaggttccaactccaggacattcaggaaaaggcaaactatggagacagcaacaaggtccatggttgccaggtctcgagtggggaaactggagacgctgaactagatgagccccaaattccttcaccggccactgcacgtcacctgttgtcctccccgtcaccccaccttagataggccttccactgaacctgctttaaagctctttgaaaggagaccagatgtgaattatgaataagtgaaggaagagagtctctttttaaagcttttaccaggtaaacttttgtcatatgcgttcagcccgcagcctcgttgactgactgcttctttgggagcaggtacgcgtgggtcttctctcccactctctgaagactaaacagcaagggtctcatgttggacccgaccgtgcgacaggagggtggccctgttctctgacctgtaaagaagttttctgttccctggcattatcacagggtcctcccttcctgctcgggtgcagttgctctttgtgtgttgagaatgtctgtctagctagggcctcacatcttcagaaatcattcgatgtctggatttgctttagaatcatcccagggcagagcagggggctgtagtgggcgcagaggagcatcaggaaagcctgagagtcaccacttgtgggagacaggtgatgcctgtacggggttctcaatattctctgtatatttcataggtgatgcctataccaggttctcaattctctctatttcttaggtgacgcctgtacggggttctcaatattctctgtgtgtttcataggtgatacctgcacggggttctcaattctctctatttcataggtgacgcctgtacggggttctcaatattctctgcgtgtttcataggtgatgcctgcacggggttctcaatattctctgcgtgtttcataggtgacgcctgtaccgggttctcaatattctctgcgtgttttgtaggtgatacctgtacggggttctcaattctctcttcttatttcataggtgatcaatattctctgtgtatttcataggtgacgcctgtacggggttctcaatattctctgtatatttcataggtggcgcctgtacggggttctcaatattctctgtatatttcttaggtgacgcccgtatgaagttctcaattctctctgcttatttcataggtgatcaatattctctgtgtatttcataggtgatgcctgtaccgggttctcaattctatttcataggtgacgcctgtacggggttctcaattctatttcataggtgacgcctgtacggggttctcaatattctctgtatatttcgtaggtgacgcctgtacggggttctcaattctctctgcatatttcataggtgatcagtattctctgtgtatttcataggtgatacctgcatggggttctcaattctctctgcgtatttcctatttgccgttttacatgaggcttttctaaagcgcacagtgcagtttggaagtcagtttttatcagaatatcaccagcatcgcagggtagctcaggaagaatgccaagcacattgtgtaactcgtagggatcacgggagagtggagagagcacggtcaggacgcttgttccgaagatccacaccctggggtgtgggaggaacgagaaggcgccaaggcagggaggtgaagctccccggtgcataagaaaggcacacagaacaggagcgcgcaggaagggctcgcagagcaggagcgcacgcgtaggaagagcacgcagagcaagagcgcgtgcgtaggaagggcacgcagagcaggagcgcgtgcgtaagaagggcacgcagagcaggagtggcgcgtaagaagggcacgcagagcaggagggtgcgtaggaaggacacgcagagcaggagcgcgcgcgtaggaagggctcgcagagcaggagggtgcgtaggaaggacacgcagagcaggagcgcgcgcgtaggaagggctcgcagagcgggagcgcgcgcgtagggagggctcagagcgggagcgcgcacgtagggaaggcgcgcacgtagggaaggcacgcagagcaggaatgcgtcctattctctctgtgagctcaccctcacccggctctccagctgggtttccctccctctgatgggggcgacgatgtttattgctttctgttcccaataatgaggacagaggtgaatggggctttttaagctgtgggagatgggataggagagagaaaagggaggttagagaaggaagaggacgacccaaagtgaccccactagaaggagtatagaggtgggagaatgcaggtagaggggcagccggtgccggggaggggcaaggaaggctgagatgagaagctgaaggtcacctcagccatgtattcaccgcctgtggccaagggctgaggccacactgagctggaggagaacaggaagctcggcagctacacggacccaaggtcgcaagtgaagaccccctgatagcgtccaggacctacgagagtgcaggaggcagtgaagacccccgatggtgtctagtacccacaagaggcagtgaagacccctgatagcattcagtacccacgaaagcgcaggaggcagtgaagacccctgatggtgtctagtacacaaagagtgcaggaggcagtgaagacccccgatggtgtctagtacccacgaaagtgcaggaggcagtgaagaccctgatggtgtctagtacccacgcaagtgcaggaggcaggaccatcaaggaaaggggtttctcggagtagagcatggcttagaacagaggagacgtcgtcccagagggagaggtgctggagggaaagtggccactccaggcgggcagctcccgtagcaaacagcaccatcaatgctccagcagcactcactcaagtgcagcatcggcctcctccgccgtccttctcctccaagagaggaacaaggagaaagcatcggtaatggtcacacgtccttccctctaattgcaatttcacattccttctatttaaaaactgccataacggctgcatgaacaaagaaagagcgagggcaggagagctcccggctgcagacagcagagaagctgatgctcgctctcagcggctcccattcagccttcacttaaggagcagagagtgctcacataacgcgatgctcaggcaatgtttgtgaaattttagtatttgttatctccaaaagggaagtcatgttttatcagaacccactgcaggatggtcttgggaaaaggctgttgggaaataaatgggtcggaaccttctccatatcacaaagagtcgcaggaacccgcaaacgcctttctcccctgggcccgccctgacgtggcttaactcaggtagcgacaccggaagccacggtcttggcagagcagtcacctcgaggccgacactgttcagctagtgcatggtgagcagcatgaaatccagacagggggcttcggaggatgtggcaaaccgccataaatatgggctacggtcacatgctgggccacagggagaggtgagttcagcgacaaaggacactggacttaacgtgttcagagtcaattttccaaaacagatatggatgacacaagctgtgggccagacccgtcctgcaagccatgttgcccgccccatccatcagcttcagcagtagaattgtgaaatcataaaatctggggaagggatgaacaagaagtgagaagggaacacacactgtcctcacaccctcaggatcatctcctcctccccctggctgccgcgttccctgtcctcacaccctcaggatcatctcctcctcccccccggccgccgcgttccctgtcctcacaccctcaggatcatctcctcctcccactggccgccgcgttccctgtcctcacaccctcaggatcatctcctcctccccccgggtgccgcgttccctgtcctcacaccctcaggatcacctcccctcccactggccactgtgttcactgtcctcacaccctcaggatcatctcctcctccccccggccgccgcgttccctgtcctcacaccctcaggatcatctcctcctccccctggccgccgcgttccctgtcctcacaccctcaggatcacctcccctcccactggccgctgtgttcactgtcctcacaccctcagcagcgccttctccatcccactgtcaggatcacctcccgcctctcactggccactgcgttcccaggacgtgaaatgaccacatactccttcccagcacagagagggtatgagggccgaagggacccttccctacatggtgccccattcctgccacgcgtcctcgggggagtgcggtgtgcagaccccacgtgtgggaagagcatggtgcgtctgtcactgggaggggctggacagaggacagtcagcaaacaagaaacaccaagcggggctggctcaccatcgcctgtgctggaggggtcttcggaatctcccagaggtgaaggccacttctggggggcggctggtgccagcaaaggcctgggcattcttgagggtgcacgcagaaggtactgtggctccaggctgccctccccggggggagctgggggcctctgggcagcataggcactgagggccgccatcagatggtgtctgtccacaccactgtccaccttagggctgagctcatctggctggagctggccgagggtccgcggcaggaggtcctcgcggagctgggtccgggacccgggagggtaggtcagcgcagacgtgtgggccacataggtcaggatgctctcggagaagcggtcatcaccctgaaggaaaggagagcaaaacagagcaagagtcacatttccatcgtcagctgggggcaccaagatgcccttcagtctcagttttcaaggtcctaaacagccctgggggtacaaagatgcccttcggtctcaggttcaaggtcctaaacagccctggacatctctgaaatgtaaagccaaaacaggactctcattttcacactgaccaacccaggtccctatttcatatttgttcctgcattatttttaatatcagctttatggagataattcacccacatcagcagtttttagtgtattcagagttgtgagacatcactactaagtccagaacatccgcatcacccaaaaagagactttgcagtgttcccattcctccctcccaccctgacactgctcattcgctttcagtctctatggaggagtctcttctggacgtttggtgtaaatggaatcacaccatgtgtggcatctgtgcctggctcatttccctaagcataatgtcctcaggtgcacccatgctgatgctggggcatgggccaggacatccttcctctttcagccaagtactatcccactgcatgtatatcccacattttaaaaattcacctatcagttgatggacatttgcttttttctaccttttggctattttgaataatgctgctatgagtattcatttatgagtctgtgtatcaatgtgttttcaattctcttgggtttattcgaggatattacatggtaactcgacatttaactgactgaggaactcccaagctgttttccagcacagcagcaccacaaacaatctcaccagtaatggatgcagatgccagttcctctgcatctttgccaacacttgctactttccttctgtttttactatggttgtcctagcagttggaaagcaataccgtgctgtgtcacttgcataatgcactgagcctagtatgtcctgcacctggagcctccaactcagctttaactaaaggtcctttgcacggcagctcggagttactgcattcacagcaatgagaggagctgctcccagacacattcatgaggctcggcggtgcctccctggtggctaatgatgctgcatctttgtgtgcccttattgaccactcctacatcttctctgaagaaatgtctgtttgtattttttgcctgcactggtttttattttaaccctgaaaagctgctccccaatagctgaatctctctttcagcaaccctcagcagaggcctcaagtgccttgtctggaggtcttcactccaacttctttactgaagacctgaaacatgtttgctgcctgctcttttaactgcagtgtgctgcagcagggaagatgccagggtctcttgttcgataattacctatcacatcatttactagtcaatgccctggctaacagtctttcatgggatttctgtctatattttctcctcactcatttagtaaaattccgttaagaggacatgtcctcatcacactttgtgtcactagataaaccaaggcccagctgtcctcacctctagggcagctgtaaaaatgtgaaaagtccccacattgtacctctgacttgggcttcatcaaaatgtcatggacaggctgagtatgaataatttccagcttagagactttcgaatcctggacacacaagctgagctccctggaggcgtgcatgggtgtgtggacaccccagtttaaatcccatccgttcatattttctacttgcacctccttggggcacatgatcaatgtcatgtcagtggaggtggacacctcggcactagctaagggtgtgcagccatcactgacagtaaggtaagggggtccagctcctgagtctggctatttccgaaaatatttgggttcatcctctgagttagatttttgagtagcaacctgggagttgggaagtgggttgatagaggttggggttgtttggtttttctgggtttttttgagacagagtctccctctttcatccaggctggagtgaagtggcacaatctcagctcactacaacctctgcctccttggttcatgcagttcttatgtctctgcctcccaagtagctgggaccacaggaacacaccaccatacctggctgcttttgtgagtgtgtgtgtgtgtgtgtgtgtgtgtgtgtgtgtgtgtgttttagtagaaatggggttttactatgttggccaggctggtctcaaactcctggcctcaagtgatccgcctgcctcagcctcccaaagtgctgggattacaggcgtgagccaccgcgcctggccaggttgaattaggttctgatttcagttctcatatatgaacttgggtaaattacttgacccctaaagactcaattttcttctgtcaaaaaaggaaatcggacattatctctaagatttttttttttcttttgagacggagtctctcactgtcgcccaggctggagtgcagtggcacatctcggctcactgcaacctccacctctggggttcaagcgactctcctgcttcagcctcctgagtaactgggattacaggtgcccttcaccacgccctgctaatttttgtgtttttagtagagatggggtttcgccatgttggccaggctggtctcgaactcctgacctcaagtgatgggcctgccttagcctcccaaagtgctgggattacagtcatgagccactgtgcccagccattatctctaagatattttaattattatttctaaagtgatgtgactatagctatcatccaaattgcttaaatttgtccaaggactagctgaaatcaactattcttcccttaagaaagagaatatgtgagagagcaagagcgtgagaaagagcgagagcgagcgagcgagagacagtgaatgccaccacaacaaacagcccctctagcaatttcccacaaattgggtgtaagtgtcaatctccagctcagcctgcactccctcttgcaaaggctgtctctgaacacctggtcagccaccgtgctggggggtggggatctgcgtccaaatccctcgttatgtgcctgcaagtggctttcccctcattgctatgaatgcagtaacctggagcttccacgcaaagggcctttaattaaagttgagttggaagctccaggtgcaggactgactaggttcagtgcattacacaatcacagcagagtgtgatctgtgcagtagacttggataaacaatctatttttggtttatgttctgaatcaaattaaggtgaagaggaaaaagaatatttcagtagttagcacaaacaacagagcctgtagaaataatagcaaacatcggtttttgcaagccactccggctactcaatagatgattgcagacactggggtgtttctcaccaaggtgaggtgaccatcccataaccaagagggcctgagagttgggaacatgggcagtaaagaaaagtattctcacgctgactggctctttcacggtttgaggtccccaaggaaaaggaactggctctggagctgcctgggtttaaactaccaccaatgctacgagcttaatgacctttgcttcagcacactatttaagtaatctgtaaaacaaggataataataatagtatctggcacggaagtgttaatggctatgactactactattattacaattatttactttaccttatccttcatatatatacatacatatatatatacacatacatatatatatacacatacatatatatacacatatatatacacatacatatatatacacatatatacacattatatacacatatatatacacacatatatatatacacatatatatacacacatatatacacatatatacacacatatatatacacatatatatacacacatatatacacatatatacacacatacatatatatacactatatatacacacatatatacacacatatatatacacatatatacacacatatatatacacacatatatacacacatatatatacacacatatatatacacacatatatatatatatatatatatatatatatatatatatatacacacacacatttttttaagacatagtctcgctctgtaacccatgctggagtgcaatggcgtgatcttggctcactgcaacctccacctcctgggttcaagtgattctcctgcctcagcctcctgagcagctgggattacaggcacgcgccaccaggcccagctaacttttctgcatttttagtagagatggggtttcaccatgttggtcaggctggtctcaaactcctgacctcaagtgatctgcccgccttggcctcccaaagtgctgggattacaagcgtgagccaccatgcccagcctataccttcatattctttaaagcagtcaggaaatccacatctcaactgaggagaaactatccaattagactttttcttctactctcagctctgagtttaaaattctgtgactcattttcaaaccccctgttgtgaagatgttttcagtctcagttcaacataccaatgaagggaggtttcctaagacaatgtggaataatttttaagaccgtagctgcccaaacctggaaattagcagcctaacggcatagacacagactaatttccagtacaggcgatggacattcctgtgcatgaagtcttcaaactatgtgtaagagaaatccggctgagcatctctggggtagcccagctgtggatatgaagcattcgagagcttctgccaaagtctgatgatgtttaagctgacatgatattctactgggaatattcttcaacccactgcatttccatatgacgagaagcagaacccactcgcccacacactgaaaaagccagcaggaaagaaggctcactgaaagactggcccaatcctgtcagttctgtgtaacttgtgtaagtttggaccagttatctaacctcttgaagtctcattttcaccacctgcaaaactagaaaaataattctgttttctttaaaagccactgtgaggattagggagagtataggtaaaagtgccttgctcagcacacaactcagaggaggaacttgataaatggcagtcatcagcagtatcattatcaccattagtgtcactgccaccatccacaacagcatccccaccatcatcttcaccatccacagcaccatccctaccatcatcaccctcaccatcagcatcatcccaccatcaatagcagcatccccaccatcatcacttccaccatcaacaacagcatctccactatctccaccatccacaacagcatctccactatctccaccatcaacaacagcatctccactatctccaacagcatccccaccatcaccatcccaccatccacagcagcatcccaccatcatcatcttcaccatcatcatcttcaccatccacagcaggatccccaccatcatcttcaccatccacagcaggatccccaccatcatcttcaccattcacagcagcatcccaccatcatcatcttcaccatcagcatcatcccaccatccacagcagcatccccaccatcatcaacttcaccatccacagcaccatccataccatcatcaccttcaccatcagcatcatcccaccatcaatagcagcatccccaccatcatcacttccaccatcaacagcagcatccccaccatcatcatcaccccatcatcgacagcagcatcccaccaatatcatcttcaccatccatagcaggatccccaccatcatcaccccaatcatcaacaacagcatctccactatctccaccatcaataatagcatcccatcaccaccaacaccaccagcgtccccaccatcatcatcaccccatcatcaacagcagcatccacaccatcatcaccctcaccatcagcatcatcccaccatcaatagcagcatccccaccatcatcacttcctattgggggaaccagcccccaatatttcaacacaggttcttttctattttccctaagtgttggccagtctgagaaataaagagaaagagtacaaagaggtaaattttacagctgggccttcaggggtaacatcacatattggcaggttctgtgatgcccacctgagccacaaaaccagcaagtttttattagggatttcaaaaggggaggggtgtacaaatagggagtaggtcacagggatcacatgcttcagagggcaataaaagatcacaaggcagggggtgaaattagaattactgatgagtgtcccactgggcatgcattgtcttgataaacatcttaacaggaaacagggttcgagagcagacaactggtctgactagaattcaccaggctggaatttcccaatcctggtaagcctgagggcactgcaggagaccagggagaatttcatctcttatcttcaactgcataagacagacactcccagaacggccattcatagacctacccctgggaatgcattccttccccaggattattccttgctgggaaaagaattcagcaatatttctcctacttgctttctgcaagaagaaaaataaggctctattctgcccgaccccgcaggcagtcagaccttaatgttatcttcccttgttccctgaagatcgctgttgttctgttccttttcagggtgccctgatttcatattgttcaaacacatgttttacagtttgtaccattaatgcaatcatcacaggatcccgaggtgacatacatcctcagcttatgaagatgatgggattaagagattaaagacaggcataggaaattataagagtattgagtggggaaatgataaatgtccatgaaatcttcacaatttatgttcagagactgcagtaaaaacaggcataagaaattatgaaagtactaattttgggaactgataaatgtccatgaagtcttcacaatttatgttttgccgcagcttcagccggtccctccatttggggtccctgacttcccgcaacaacttccaccatcaacaatatcatctccactatctccaccatcaacagcagcatccccaccaccatcatcttcaccatcatcatcccaccatccacagcagcatccccaccatcatcatcttcaccatccacagcagcatccccaccattatcacttccaccatcaacatgatccctgccatcatcacctcaaccatcagcttcccaccatcatcatcatcagcagcagcagcaccatcatcatccacaccatccacagcagcatccacaccatcagtgtcacccccgccatcagcatcatcaaacccctactgctgctgtgtgccaagccctggacttctatgaaggaagaataactcagatgtggccctgtcctcaaacatcttgcagactgaactaggagttgagtcatagacattaacaaccgtaattgaaagaatgctattagaaagggtcagaaaagcaatcctggttttggaagaatgtgattctcttcagctggaggaaatcagagctgcttcctggagccagctgatgcagttcacagagccacgccctgcaccatacccctcacctgtcaaacagtgacactgctgaggaagtgactctcctcgctcccaactttactggggccgggagtaccagagctaaaaatcaggcctcttcctttgacaaacatgcctctcctggagatccacccagcccagtcccaaaggcacaattatgagttcaggctgacaggaaggcctggaggtccggggagtcccacatgccgggagactctgggtggaggagactcctgtgtgtgcactggtctctgcccatgctcatcagctattctcctgcaccgaggatccaaaacaaattaggaagcccaagttgggacatcttttgaccacataacacacgttttctccctgtctcactgcccgccggcagcactgacaggcaccttgatcacggcgtgcttgctgccagcctgacaaagcacacagcctcagtgctattcacaggcttcctaatgagccggcaccggatgcggccaggtttgggagctgaggtgggaacgctgcagctccggctccggctcgtgaatgtggggttgggatgacttcactgtgcctttctgtctcgggccttagagaggtgattctggcagctcatttattttctctgtctctctctgtgtctctgtctctctgtgtatctctgcctctgtctctgtcttaacacagtagaaagtgtcagtgtttaacagtgctcaggctctaagtggcccactcgtgtggaggggaaataattgtggtgtcattcttaccaacagtgctgtcgccaagacaaaataacttttttgcattcagggaagcaggggggtctcacacgagcgtatacggtgctatctctgcagccaaggtatagagctctcagactgaaaaataagaccccaaacagttttcagagttcacaaaatctatgaggttgaagaggttaagtcctaaactacttgggatcaacaaatttgtagcgagttgacagtatcacggggtgccaatgtgaactcctggatatctgctaatgatgatgcattctgagagtctggaattatctgaagactcgtgacaccatgaggccagtgctgctctcagtctgccctgctcaagactcgcgacaccgtgaggccagtgctgatctcaccccgccctgctgagactcacgacatcgtgaggccagtgctgctctcagcccgccctgctccgagactcgcaatgccgtgaggccagcactgctctcagcccaccctactttgcccgccactcttccttctgtcactcttctggctcctgtttgcgttttggcctttccagaagctgcacccaaaagcctcctacctggcaagtgaaaagcacagggcatgattaaagcagcgagttccaatccatgtcccgtccaccttggcctggggttagaggtcagttggctcataaccacccagaagatggagggacagtcatcgccacggggctcttattcactgagtgctacaccaggctgttttcggctttacatgccttaattttctctaaccctttcaatgactcgatggtacagacatgattacccacattttgcaaatgaggaaagaagatcctgcagtgaggaaagggcagagctaagatgcagcccttctccctaggctgtgtatgtctgtcgagtgacagacaccaaacacgccgagtgaacagaggaaccgtaagcaggtcggcttccatggagcacaggtctgggtgtggagggactgctagtgcagggtgggtggtagctgtcactgtgagtgttcagtggagggcagggacaggactgtctgggaggaaaccaggggagacagtcaggatgacggtggccagcatgcatcaacctgctctgcctcagatgctactgtgtatgctgggagcagaacaccatgccctggggccaattttccaccagagctccgcttcccaccaaaggtcataagaacaatcacatgagggggcaaacttttaaaaaactcaaatggacatcgtgaatgtggcatccaacatgtggaggccacggtcctcatcgctgtgtgcctccacacctgctcctccaggtggcatggctaagcagagggctgtgagggaagctgtgctatctctgcacaatctctctaggtggccctcctccagaaacagggataggggaaggtgggcttgttgaccacatctgggtggtgacagtttggggctgttctggatagagccactgtgggcagtcatgggccagctttcctgtgaatgcaggcgtccctcctcttggatagacatccagaggggaactgctgagtccaaggacagacgtatctttagcctttaagcagcttccaaatacaggttataacagcttgcattgcattccccctaatttgagaatttctatgtcctcatcaagagttggttttatggatttttttttaattttagccaatctagtgacatgaagtggttgttctttatggttttgtgaataaggatgctaagcacctttgatgccttcattggccatttgtatatctttttatgaagtatccgttcaaagtttttatacatttttgcatgggattgcttgcctcttttccctttggagcactactgagatataattgacatacaataaacagtacaggaggcatgacaatgaacacgtccgtcaccctgaatacattccggtgcccctggagacactgccctctcccatccctgtccacagctccaggcaatcccgaccagctttctgtcccttataacccagtttgcattttctacagctttccaaactggaattataacaatagctcctcttttgtcttttggtcaacagaaatgagactcactgtgctgtttcatgcatcaacagctcactccagtttattactgagtagcattccattttgtggatcaaacaaaatttctttgtccatttctgatagacatttgggttttttcagttgtgggcatttactatgaaagctaccatgaagatacgtgtgtaaatctttgaatgcacacatgctttcgtttgtcttgagtagaagtgggatggagggatcacaggcaagtaaacatttcacttttgaagaaactgtcaagacgttttccaaatcgttgttaatgttttacatttccactggtggcatatgagaggtccagctcctccacctccttgccaatacataggatggtcagtttgtattttgtttttttaaattttagccattcttataggtttgtagtggtatttcactgtgatttcaattttcatttccataatgaggaatgatactgaatatttcacattaaattgtcactcatttatcctctttggtgaagtgtttattcaaatcttttgcccattttttaaatttcaaaagcttttggggtacgcatggtttgggtcacatgtatgaatttaatagtggtgaagtctcagatattaatgcacccatcatccaagtaatgcacattgtacccaatatgtaggtttttttatccctctcccctctcaccctcccgcttctgagtctccaaagtccattagatcactctgtctgcctttgcatacccatagcttggctcccacttataagtcagaacataaggtaatcgattttcctttcctgagttacttcacttagaataatggcttccagctccatctaagtggctgcaagagacattattacattctttttcgtggctgagtagtattccatggtgtatatatatactacattttctttctttttttttttttttttttttttttttaagatggagtcttgctctgttgccaggctggagtgcagtggcacaatctcagctcactgcaacctccaactcccaagttcaagtgattctcctccttcagcctcccaagtagctgggactacaggcacccgccaccacgcctggctaattttttgtatttttagtagagacgaggtttcatcatgttggccaggatggtctcaatctcttgaggtcatgatccacctgcctcggccgcccaaagtgctatgattataggcgtgagccactgcacctttagccactcatcagtcaatgggcacttagactggttccatatctttgcaattgtgaattgtgctgcaataaacatatatctacaggtgcctttttgatatattgatttcttttcctttggatactcagtagtgagattgctggatcaaaagggtagatcaacttttagttctttatgaaatctccattctgttttccatagatgttgtactaatttacattcccacctgcagtggataagtgttcccttttcaccacagtcataccaacatctattgttttgtgactttttaataatagtcattcttgcaggagtatggtggtatctcattgtggttttaatttgcatttccttgatgattagtgatgttgagcatttttttcatatgttgttgcccatttgaatatcttcttttaagaaatgtctgttcacgtcatttgtccactttttaatgggatttttttttcttgctaaattgtttgagttccttgtagattctggatgttggtcctttgtcagatgcatagtttgcaaatattttctcccattctgtgggttttctgataatttcttttgctatatgaagcttttcagtttaattaggtccaatttatttttgttttagttgcatttgcttttggggtcttacccatgaactctttgccaaggccaatgtccagaagattttttcctacttaatcttctagaagttttatggtttcaggtcttagatttaagttgttgatccatcttgagttgatttttgtataaggtaagagataatgaggtaggaggcaggactcaacttcagaggccgggctgggttactgaaccaaattgaggactagttaaaacagggccaaggtggaagcaggtttccataagtctcacccaccaatatgccatgtcagtttacacttgccatgacaacaccaaggagtaactgcccctttccatggcaatgacctgatgacccaaaagttactaccccttccctagatatttctgcataaaccactcttaaccctcatgtaattaaaagtagctataaatatgactgcaaagcttccctgagctgctactctctgcctatggggtagcctggctctgcaggagcagtcacagagctaaaacactgccagagttgtaacactgccttttcaataaggttgctttcttttatctccagcttgcccttgaattctttcctgggcaaagccaagaaccctggtgggctaagccccactttggggctccttaccctgcatcaatagagatccagtttcattcttctacatgtggctatccagttttaccaaaaccatttatcaaacaggtgtcctttccccagtttatggttttctatgctttttcaaagatcagttggttgtaagtgtttgggtttatttctgggttctttattctgttccattggtctatgtgcctactcttctaccagtaccatgctgttttggtaactctagccttgtagtatagtttggagtcaggtaatgtgatgcctccagatctgttctttttgtttaggattgcttttgctatttgggctattttttggtgctatatgaaaataatgttggtattttgataggaatttcattaaatctgtagattgctttgggcagtgtgggcattttcatgaaattcttccaatccataagcatgggatgtgtttccatttgtttgtgtcatctacagtgtatttcagcagtgtcttgtagttctctgtatagagatctttcacctccttggttaagtatattgataggtattttatttattttctgaagccctcgtacaggggattgagttcttgatttgattctcagcttggtcattgttggtatatagcactgctactgatttgtgtacattgattttgtaacctgagactttcctgaattcgtttatgaaatctaggagtcttttggaggagtctttagggttttgtaggtatatcatatcattggcaaacagcaatagtttgacttcctcttttccattttggatgccctttatttccttctgttttctgactgctctggctaggacttccagtactatgttgaatagaagtggtgagagtgggcatccttgtcttctttcagttcgcaggggggatgctttcaacttttccccattccatataatgttggttgtgggtttatcatatatggcttttattattttgaggtaagtcccttctgtgccgagtttgttgagagtttttatcatgaagtgatgctgggttttattgaatgcttttcctgcatctattgagataatcgtatggtgtttgtttttaactgtttatgtgacgtatcacatttactgacttgcatgtgttaaaccatccctgcatccctgggatgaaacccacttgatcatggtttattatctttttgatgtgctgttgggttcagtcagctagtatttcgtagagggtttttgcctctatgttcatcagggatattggtctatagtttgcttttgttcattattttatccctgattttagtgtcagagtgatactggcttcatagaattagttagggaggattctctctgccctgatcctttggaatagtttcagtagaattggtaccaattctttgagtgtctggtataattcagctgtgaatccatctggtcctgggctttttttgttatgggcaatttttaagttactgattcaatctcactgcttgttattagtctgttcagggtttttattccttcctaatttaatctaggagggttgtatgcttgcaggaatatattcgtgtattcatttcttctagattttctagtttgtatgcatagaagtgttcataatagtcgtgaataatcttttgtatttctgtggtatagttgagcttattttaatcttcactcttcatttcttgattaatctagctaatggtccatcaattttgtttatattttcaaaaaaccaattttttgtttcatcttttgtatttgtttctttccttcaaattgatttagctctgttctgatctttgttattttcttcttccagctttgggtttagtttgttcatatttctctagttacttgatgtgtgacattaggttgtcactttgggctctttcagactttctgatataggcatttagcacagtgaactttcctcttagcattgcttttgccatatcccagaggttttgataacttgtgtcactattatcattcatttcaaagaatttgtaaacttccatcttgattttactgttaacccaaaaatcattgaggagcatatttttttatttccatgtatttgtgtagtttaaaaaattccttttggagtggatttctagttttattccactgtggtctgagaagatacttgatataattttaattttaaaaaatttattgagacttgttttgtagcctagtatacagtctttttttgtttcattactttttcttctaaaaagacgggatacacgtgcagaacatgcaggtttgttacctatgtatatgtgtgccatggtggtttgctgcacctattgacttgtcctctaatttccctccactctccccccaaccctcagcaggccctggtgtgtgttgttcccctccttgtgtccatgtgttctcactgttcaactaccacttatatgtgagaacatgcagtgtttgattttctgttcctgtgttagtttgttgaggatgatggcttctagcttcatccatgtccctccaagggacatgatctcattcctttttatggctgcatagtattccatggtgtatatgtaccacattttcttcatctactctattttggagaatgttccatgtgctcatgaggagaatgtatattctgcagttcttgattagaatgttatgtaaatatctgttagatccatttgttctagagtgtagactaagtccattgtttccttgttgactttctgtctcaatgatctgtcctgtactgtcagtgaagtattgaggtcccccagtgttggcatgttgctgcctatctcacttctcacatctagcagtaattattttatgaatctgagagctccagcatttggtgcatataaatttagaattgtaatatcttcttgttggattggcccttttatcatcatttaatgaccttctttgtctctttttactgttgttgctttaaagtctgttttatctgatattagaatgctcctgctcacttttggtttccatttgcatggaatatattttactacccctttaccttaactttatatgcatctttatgtgttaggtgactatgttgagatagcagatatttggtttgtgtctttttatccattctaccaatctgttatcttttaaatggaggatttaggccatttacattcaacactaatattgagatgtgagatattgtcccaatcatcatggagacaggaagtgtggctttcagaccacatctatcccagtccagcagcaaagccaggctcccagatcctgtgtttgtggctgcagcgtgcttcccactcccccctgggttatggccaagggagtttgtccccactcaagattagattgcaaatttcagttgggagcttctctcaacccgtggccactgactgagttggttggcagacttccgcaaggtcccctgtgaggcagaatggcttccccaatccatgctggagactgggaatgcacacagggctctttctactgcttctcctactttatattctccactgctccctaaatcagttccaggacttggtagggttaaggtcccgcccccatgggctgaattctccagtgggggtgcatatcttggaggcagtgtctccccctcacactgtggggcttacagttctttgcttggctcacagtgtaggctgcagcctgccacttctttcaaaggttctgtggtttcttttagttttcctgtcaagttctggtgtcgcttcttggaaaaaagttcacagtgtgaatctttacacactattttgtctttccaagtgggagaggcatgctaacaccgcttctaatccactgtcttgaaaaaaaatgcccatttttaatgtgctgcttttttagtttttagagatttttatacattctgaaattttttatcttaaaaagtgctatttgcaagtatttttctaagtatgtggcttgtcttttcaatcttttgtgtgtctttcgaagaagtgtcttcttttgaagaagaaaatttttaaattttgacaaagttctagttatcaattttttttaaggattgtgtttttgtatcatattgataccaatttggaggtaatttctaccttaacactattgagtctttagacacatgaccatgtatatatcaccattaatttgtcttattgttctcatcaatgtattgtagttttcattgtacattgtcttacacatattttagattcaacctcaattatttcataatttttgatgctactatattttttaaaattcatatttaattgttgctagtatacagaaataaattaatttttgtgtgctgactttgcactctacagcattgctatatttactagttttagtagcttttctgtaggttccaccaaatttttgacaaaggttatgtaatctgaatgcctctcatttcttcttgttttattgcactggctaagatcttcaatgtgacaggcagtggatcacctgaggtcaggagttcaagaccagcctggccaacatggtgaaacctagtctctactgaaaatgcaaaaattagccgggcatggtggtgggtgcctataatcccagctactcgggaggctgaggtaggagcatcacttgaacccaggaggcagagggttgcagtgagccaagattgtgccactgcactccagcctgggcaagaagaatgaacttccgtctcaaaagaaaaaaaaaagatcttcaatgcagtgttgaattgaagaggtaagagcagacatcctcgtctaatgccagattttaagtggaaagcattcagcccttcaccagttgatgtaatcttagatgtaggtttccgtcatggatggatggatgctgggttttgccaaatgctttttccagtatctactgagaccatcacatggtctatgtaactatggtgagttatgttggttgatgtttaaatgttcgatataccctgcatatctgggataaatctgccttgattatgatgcagtattcttttttatatattgttgaatttaatttgataaaaattgtttagaatttttgtttctatatttctgaagaataataatctgcagttttcttttaaaatctttctctgtatgattttgatctgttgacatttattgagacttattttatggcccagcatttgatctagtttgggaaatattctatataacatactcaaaaagaatgtgtgtttagcagtttttaggtgtatcattctataaacatcacttagcttagactggttaatgctgtggttcaaatcttctctatccttactgatactttatctatttgtttaatcagttactgacagaggagagtttcaatcattaatgatcatgatcgacctgtatgttcctctctttagtactctcatatatttcctttatgtatttgaagctctgaaattggttcataacatttttctatagcatcttaatgaattgaccatttagtcatcataaagtgtctctgtcatgaataacacttttagtcttgaagtccactctgtctaatattaacatgaccacaccagctttcctgcctttcgagtttccatcgtacacattttccatcctttaggtctaagttgccttcttcgcccaggcttggatctgggctccagtgagactcgagatccctttatgctctgcactcagccgccaggtttctgaaccatgggggagctctctgctttatggtccaagtgtcagtttgtgagtttctgaagcttctcttccccgtcggtcccaccctggctttctgcacccttagaaagattcaacagatctttttccaccatgctcccttgtccccagtcttcagaaggccacatggggcactccatagaggcctggtgctccttggcaggatttctcccagccctctccctcctccatccctagtgccgcatctcacatactcagcgaaagcccacaggaaagaggcgggggtgcagacactcgctttgcacagcctgtctctcaaatctgttccatgcacctcaagagtttcttaaaatttaggccgaattctccccacttcctgtgactggcttctgcttcttccattccaatgcgcatgaaagaagctgtggtctcctctccttggaatgggttcatccatccctttctggaatgcagttcatcctcttttcctgtgtcctcagctctggcagatttctcctggggctcactcgtgttgttggggtgggagggggatagtctcctggcagatttctcccgggggctcactcatgtggtcggggtgggaggagaatgggctcctgacactctgcaccctacgtccatcgtacacctgcaggaggtgtctcctggtcgtcccccaaggccgtcctcttggaagcccacctgggccacctaccccctctggcatgagtacgcctgggctcacctgccccctccgtcagaagcccgcctgggccacctgccccctctggcatgaacgcacctgggcccacctgccccctctgtcagaagcccgcctgggccacctgccccctctggcatgagcgcgcctgggcctacctgccccctctgtcagaagcccgcctgggccacctgccccctctggcatgagtgcacctttactttctgtgttccctccatcacagcacttgctttaattttttaattatattttttgcttgcttgttttctccctcctacccagcaaaactgtaaaatcctaaaggacagaaactaactttccttaatcatttccttaatctagcaccatttcttgtatgttaaatatgttttttaaacatttccaagataaatcagctagttaatggtattggtaagtaatgaatttctgactaaacctcctcagtaacagagtggacagggaatttatggtgttctgcatgatgagttcaaggactgtgaactggtgctaccacagtcaataaaacaggaagcgttaccaccctcacaatgcagaagtcgtaacgacaccttgatttagtgatcaataagtgctcaattagtgtttaaacgaggagaaagctctgagtcatctcgctaatgaacaaagagaaagagcatgattatattcccagtggaataaaataaaataattctgttatgacgtcaccagcatgaaggccctgaaaggcaatatgtttaggatatttctccatctacgctagagtttcatttttgatgatgggtacatagaaaacaatgatttataaaataattcacaggaagttgattgtaccttcaaagatcgtcagtatataaagcttaaatttccaattaaaatatttcatcagctgagaggggaggggagaagccggggcccagatctctaagtccctatatttacggggcagcaaaatctgcacggcagcgctgcagcctctggtcacgcacttcctgtgcttattcagtctttgttcattagcaagatgactaagagctttctcctcatttaaacactggacagaaaagaaaatgagttctgggttttcatgcatttttttaaatactgagaagcatctatcttaacaaagaagaaaaatacctaagccaaaatgccaccaagtgctcattttctgaataaccgtttgacagctgtgctaaatgtctgtgtgctggaatgaccacggagctcattaattcaaactgggacacctccgagtgggaaagaatgacttcctgataattatgctgagtaacagtagagaccaggactgtgaggccgaccatcgtgtgtaggagattccaaggtgacacagccaaacttatcagaaggtggaccctggctgctggtggaatatttgacatgaccggtgcccacgcccctctcccattcctctttcttgaaatggagagcaggcaagatgggggcagtggtggaagatgctcctcctccatgcacccagcagccctggggagcggcagggtcgcaacccaagagatgaacccccagtggccccgtcacgagctcccaacggaagggatgtcctagtgcagaggcagccaccacgctcgccccctgtactgggaaggccgccacgctcgccccgcgatggggaaggccgccacgctcgccgcctgatggggaaggccgccacgcttgccccgcgatggggaaggccgccacgctcgccccctgtatggggaaggccgccacgctcgccccctgtatggggaaggccgccacgctcgccccctgatggggaaggccgccacgctcgccgcctgatggggaaggccgccacgctcgccccgcgatggggaaggccgccacgctcgccccctgatggggaaggccgccacgctcgcccccgatggggaaggccgccacgctcgccgcctgatggggaaggccgccacgctcgccccctgatggggaaggccgccacgctcgccgcctgatggggaaggccgccacgctcgccccctgtatggggaaggccgccacgctcgccccctgatggggaagcccgccacgctcgccccctgatggggaaggccgccacgctcgccccctgatggggaaggccgccacgctcgccccctgtactggaaaggccgccacgcccgccccctgtagggggaaggccgccacgctcgccgccttgtatggggaaggccgccacgctcacccgctgtatggggaaggctgcttccagagcactccggggcgtgtgttgagaatgctggtgctggaatcctagtgcagtaagccaggaatggaaagacttcagtaaatacaactggttagtgtgacgaggccacgggccctttggcctaatgagcactgagctgctgagtccagcagaaccactgagcacctggaaagcatcccaggacatgcagtacactgtgctcggcctaggaaggcatcctgtctctggcaggaacttgctttccccaggggctgctatgagccatctcatggggcatcactaggatacctcccaatggctcatagcacgaattgctcaatatctaccaaagaccttcactctcaacgagttcctgcaatttgctacggtttgtttctaatgtgtggatgttgcggctgcttggccgacctcacgtctggctgctgagggcagggaagcactgcagccattccatttaccctcgaggcgaatccatgctgcgccttgtcccacaggcaaattccattctaactctgactcttttattttagtgccagggctatttaataaaataactgaaaccgaaggaggagcatgatgatgggttcaaaatggaacaactgaggctcccattgaatgaaaccaaatgctgtttgcaggtgacgactcgctcactggcccatccaaggcacattggacgagcctccaaggctacgctcctgcctttctctattcagtagcccgtgaagagggcccttggacgtcagtctaggtgagcacgccactgtcaagtcaggggggaaagacaggaaactgcttcacagaaaagtgtcaactgatttcccttctctcaaacttcttccgagtctctgaaacttttaatgacgcctcccccttccctcgtatgttactaaaaccatctctggactgcacgtgggttactttactgatcattcacttccagcgtctggggacgtgacgtcacggcgccgttacagaagcctgaaatctcccagcagcagtggaggcagagcacagggccccacagcccttctgataaagacacagcggggcagaggaggaggacaaagcaatgatttcagagctggaggtgctaaattaccaacgttcaagagggtgggagaaatgccagtttccaccgtgctgtgctgagacctgctctgtggtgccgaggcacaggtgtgcggagggaatatgtttgccagtgtcctggcgccctctgattcctctcatcagagtcggagacctccactgagcctggttcagactctcaacctaatttctatttcattttttaaagattattttatcaacgatagttacggttacagctattgctgactgggcactccatgaggagcttcacacgtggctctcatgacacctccagggccactacccctggtttacagctgaggactcgaggcacagaagctgagcggctccccctggccccagagcagtgggtggaggagcctctgacccaaggacagagctgcatgaaatccaccttctgcatccacaaaatccagcaggatgtctggcgcaccagacgtgcttagttgctctcagttaatgaataaaaactttaaatttagcctgtttaaaatagtgttaagtggaccagaccctctagggttaggcccacacagagagactcccacaggctcctggaaggctttggggcatgtttttcaggccagccagtggtcctgatgggaggtgggcctggcacagagcagggctgggactggcctttcattgtgagcctaaccttagagggagacctggggcccacagagccctgtgaccctgtacttccacgagggctgaagacccccaccctccaccatgaggggtgatttcaaccaaccaggaaacacagtccatgatcaggaaaaacacaaatatggcccaggtgccactgggccctcctgagcagcctctcaactgtggcctgtgggtctggcaccccgtggcccctgcatggctctgggccagcatcagggctctgtttggcggccgtggacagactggcttctgcattcaaacgtcattgtgacatcctcctgaagaggcaaggccacagcaaagatggctgcccaggagctgccctcggaaaggctccagagaaccatggggccaaggccgggccttccccaggcaccacctgctaagacacagaagtgcctcagcttcctcacctgcctgcacagaacgtgccaccttgtggggccaacttctgtggaaactcaccctgtggttcccacgcttggtgcaaggttccaggaagcccctaagctggcctgggattgagcttagtggccacgcgtcctctgggaggactctacctttcgaggtctgtgggggttgcccagagttaacttaagtcatttcaatggctcgatggcaggaacataatagaaactgggcccacattgcttcccacacatatcccagggccacagctcctggtgagaccccagtggagtccaagaggatgcagagggtcctcaggctttcctgtctcacaccagcatggcttccatcttagaaaggaaagtgtgtcaaattagagctgatgtaactaacgtttggcagaaaaggagtgtgtgagcgtcgccatcaaacccccaatgtccccagggccatcctgggcctcaacacctggtccaaaatcctatcccaggaagctggcagggctgggctccaaaggtgatttctgcagctcttgtccctccctctttccaggcaatgtgggacctgtgaactctggcctaacaagtcgtcataaaaatcatgcctgcttttccatttacaaaatttactgagattcctaattccgtgtccttaagatgttgagtgggcttcgcatagtgaagggtcttgggtggctctgtgatgcgggtccttgcagctcccactcgccctgcataaacactcctggggttcgcctccgagcctgtctggggtctgtgtgcccagggcatcaccttgtgttttggtgcccagaccctcatgcccacaggcagatggagcccttacgctgccctgggctgcccccggggcaggcttgccggggagcaggagctttccttggatgcagtagttgcacctggtgccccctaattccagccatgttcatggcccctcagtctacctcagtcaggtttcagtgtccactgctgtcccggatcctttctcaaagggtgaagagcagccacctatctcctctacctccctggtgtgcatctgtggtttaaatggtgggctttctggagtcacgacaccttgtcccaagaaagatcctacagagcctcacccagaggactaagcatttgtgggggtggctggactgggagcaggtgtcgctctaaggggccccaggaacaccgaagccctgttcacaggatgcccgctggcccgggaaacaggcgcaaagccaagaggagccagcgactaaggaaacatgcccaggtacctgcaccctgaaggaaaagccaaccccggcccggggaggaagtggaagggtcacctcagcggggggtctgtcctgcgccgtatgggtcctggcgagcacgtctgaggctggggcctgggacagggcctccaggaagggcaggtggcgtcggagggcgttggccagggcagcaccgccctcccgactgtacctcctctcgctgccaacgctgtgttttgagggcctgaaaaagcaaaagaaaccagacatcaaccgcatgtttgctggtgcctggagctgctctgtcccctgtggtgcctgggtgcatgcaaggggctgggagccgggctctcggtggccggcctggccttgctgctccatgaccatgggtttgaacttctcccgggcccccgagcctgtgtcctgcacgaggatggctaacagcacctgcctcgtggttgtggggatggacgattgacccctgctgagagcagaagacaggaagcaaaagcaatacatgggaaacaaggggaggggagaaagggaggaagctgcaggtgttggctgcaggctcagcaggaattctccaggaggctgaggcagccagaggccgggtgggcatggggggcccaaggcttggcatggcttctgctgggtttgtgggtagaccaaggaaggtggcggcccagaagctggaaaaggcaggaaccaggttctcgcctgataaatgtgcattgttttaggccttaggttgatgtacttcgccacagcctcgggacgtccatgcagtgctctcagcccctccgctgcagtccctgctgttaaacagtgattcacgcaccgccatcgcgtgcaccatgcagggcagggacgccggaggctagaaggacaaacacatgggacgcttcccgtgggcagacacatgtggtgcccaccctgctgagggcggcaggggtagggccagcgaggacaaggccaagaaccaggcacggctggccaggggccccatgggacagctgcgtgctgaaggcataaatccaggaggcagctggacgtgtcagccacatgtggcccccactaatgatgctcagagtccctgagaaagcagccacttgccagtggggcccccatcaccagcttgtgcagccacacggaaaggaagagcagaaccagggagattcactggaaaagtcgcggtaacgcccaacaggccccggagagacagagtcaggactccccatgtttatggggagccctggtggaggcctgggcatgcacagaggatgtccgtggccccctgagcctgcgccctgtccccctttaccctcagctgtggcggagagcttgcctgagccacggggcagcgtctcagcctgggacacgatgggcatggcctccctagggatgggcatggccctccctgcccagctcacccgcagactctgccgctggtctctgcacccaggactcagccgcccagagcttcacagcccccacggaggcctttgcttttttgcacatgaccaaaagggcccagagcatgctcctaaataaggaagataattcccataggagacgcctctaccagccaggtttaagaacacctgcgtgagtgactgcaccccacctccacattccagcaaggctctgtctcaaaaaaaaaaaaaaaaaaaaggaatataatgtgaggccggcatgggggctcgcagctataatcctggcactttgggaagtggaggcaggagggtcactagagcccaggaacttgaggctgcagtaagctacgatagcgccgctgtgctccagcctcaggcaacagaggaagaccctgtttcaacaacaacaaaaaaagtgtgtgcacgcgcgcgcatgtgcgtgtgtgagtttgtgtaagtgtgtgtgtgagtgtgtgaggggtgtgagtgcgtgtgtgcgtttgtctgtgtatgtgtgcgcctgcacgcacacaccatgcttctaataaaatgcaaagatttcgtagacatggagtttagacacagaccaaagagcttttaattctggttatttttagtttgtataattaattgagtgcgtcatttatgtccataaaagaacgggcatcaccattaaaaagatgggccagtctgggggcccttgctgtccggctctgctgcccacagacaagggcagggccctctgtgaacctgccgccctcagcaatgctcccaaatccccttcccgctgagagccatgctcagcgatgaccaatcacttcaggtccgacttgtgctgcagtggacggtccagacgccacaggccccggcgtcatgccccactgccagcacaagactcaggcctccctcataacaggctttacaggtgcggtcagctgccatctgcttctctcaggccagggagaggctaggtccgaggtggaggcaggtactttcctgagcgcccaggcactggctgcctcagagccctggggcatggctccaccttcaccttctcaacatctaagtctagatcctcgttagggcaagaagcccaaattacagatagtgtataactgtcacgtttaactgaccacaggttgcctccaagggacatcacaccacttaacatatgaaatacgagccttaaatagatccttgcaattctccctccagctctgatgcggtgttgacatgaattctgttgacagctatgttatcaacctcacaatacactttcatcatttttgtttaatcaacttctttaaatgtgatttaagtgacaggaaaacaccatctatcggtggatgcagttgccttcgcgtgttctctcattggtttccatctggcacctttcccttctgccagaacggcggctttaccagccctggtcatggagctctgtgggtgatgatgtccttcagcgtctgtatttctgagaaagccaataattttacctttgtatctgaaggatacttccatgggatatggaattctgggttgatgtttgtttgtttgtttttcctttcagtactttaaaaatgctttccatcgtcttctggcctggagcattctcaaggagaaacctgcagtggccttcatcatctcatctctctatgaaatgcacctttttttcctctggctgcttttaaggttggctttttatcactggttttgagaaattttattatgatatttcttagtcttcatgtttcttttttagggggcttattgagctttctggctctgtgagtttatcatttttatcatattgaaacaattttcctcattatttcttcaaatgatttttctgttcctgtctctcccgccttgggactccagttatacagatatttggcctttagatgtgtcccatagctcactggtgttttttatttttttttaattatccttccttgtttccttatggatagttcctattgctgtgtcttcaagttcactaatattttctaccacagtgtctaatctgctattcattccacccatgaaattttcctgtctcctacttattgtgtctgtgtcagttctgtgtctacactgatgaattttatgagttgcattttcctgctccttttcatgccagataatccatgtctatatattcacattgtgaattttaccttattgggtgatggacatttgcaatcccataaatattatttacctttgctctggcattcagttaagttccttgggaccagttcaaccctctcggttcttacttttaagtcttgtttggcagtatcagagcagcaattatctatgacaaattactccccactactaagacaggactctgtgggcattctacccaattatctggaaattatgaggtttgcaagtcttgataggtttgaagaagcactatgtcgcaccctgtgtgaatgtcagatactgtttgctctcatttttttggatggttcttttccctcatagacacaaggtcatcagtcatctaccaaatcctcagcagtggctgaaaatctccagggctctctgtgcactcttctcttttatactctgacctgtgaactcaagctgccttggtttccccagaccttcagctctgtctcatcaactctggcaggccactgagcaccactgtccctgaggcagctgggggcaagtgtcatcgccacacagctgcgtcccctcccaaaatggccctccaccatgggggtctgcctcacccacgtttataccccatctagggaggtctgcatcccacactggtccccagcccctgaggaggggtgagggctcctgaggcctctgtcatgaccacactgagtccaacctctcctcggccaaacccgtctcttcacttccccatgaggggtcttcccaagaccctgcatttggacttcaggactacagagtctgctgtccagacacccaaccgagatgtagctccccgggcacccctggggccctgcccacggctagtgaggatcttgggggacttcaatccagtgcccccgatgccagtggaaaggcgactatagatttctccttgagaagtgctccaggccagaagacgatggaaaacatttttaaagtagtgaaagaaaaaaaagtaacccagaattctatatcccatgaaaatatccttcaaatacaaaggtagacttatggctctcttagaaatacgacactgaaggacatcatccccagcagagctccacaatgagggatatgaacagcccaggctccctaggcaggcacaggaggtagatatgagtcaaggagcacctgtatacgtatatatgtatatacatgtatgtgtgtgtgtgtgcgtgtgcatgtgtatctcctttcacagaatttgatgctacattctgaacaaaatcgtattcagaaaaagtctgggtatgtctccaaacacagcactgtggcatcacccaacagcctgagggaggtgcagctcagactttgcaggtgctgagtgaggcagtattacttcaaatagaacatacactttgctaagaacaatttccacttctgggtatcagcaagaagtgtcttctatccaaacatgaccatctggtacttgtatatgggtctttagtgtgatttagaaacactttaggaaatacactggggcttgagtggatgtggaactcattacaaatttcccacatacagtaatggaataggtttccaggtactgtttccatgtaggatgttgattttcaagaacagatcactaacattaggtgtgtgatacctgcatggggcttataaaaaaaatcccatttttgcttgattatctcaattgataaacccaccatgtttttatttctagtgcctttttgtattactttgttcccacactgctcataaagatatacctgagactgggtaatttataaaggagaggtttaattgactcagttcagcatggctggggaggtctcaggaaacgtaacaatcatggcagaaggggaagcaaacacacccttcttcacaaggtggcaggagagagaagtgcaaggagcaaaggggaaagagtcccttataaaaccatcagatctcgtgaaaactcactcactatcatgagaacagcatggagacagccacctccatgattcaattacctcccactgggtccctcccatgacacgtgcagattatgagaactacaattcaagatgagatttgggtggggacacagccaaacaatatcacttttcaagttacactgatacagatgtaacaggcatataaattaccaaggcttttgcagttctttgcatctcaaatcatggctataatttccttggccattttttaattaatgaaatttcatgttctatgttgtcagagtgtaatttaactgcagttaatttacttttctggtattttgtctacttttctcactaattgctaatcaatgcaaatggaaccacctcataaatgtatctttaaattgtcgtattcatctttgcttcgcctctgtccatgcctggggacttgtttgtgatgctgcagtatgttacggcaatgagagggtttatcattatgccgcgtggtgttgtagcaattaacttgcacattgacttttgctctgtcatccagcttgaagtaggtcaaaacttcatacgtatgaattttgtactttaaaaagatgaaaaatgttttacacttagtagctattcccttctccattggcacacactggccttaggctcacgataatatgagatagtctagattgtcacccagtttgttaaaggaaaaaattccacattacaggcccatcttatgttttatatccaaccttcatggccacctgaagttctctgtgaagtcatcggtgctcatatacacagctggtatttgttgtccctgttcctgcctcaggagcatttagcatgatccctggttctctttagccattagcatgatccctggttctcaggtcctccttagcccttagcatgttcttctcaggttctggcttctcaggtcctccttagcccttagcatgttcttctcaggttctggcttctcaggtcctccttagcccttagcatgttcttctcaggttctggcttctcaggtcctccttagcccttagcatgttcttctcaggttctggcttctcaggtcctccttagcccttagcatgttcttctcaggttctggcttctcaggtcctccttagcccttagcatgttcttctcaggttctggcttctcaggtcctccttagcccttagcatgttcttctcaggttctggcttctcagatcctccttagcccttagcatgttcccaggttcttggttatcttagcccttagcatgttctcaagttctcagttctcaggttccccttccttgactctcttagcccttagcatgttctcagctcctccttagactttagcatgttctcaggttcctggttctcaggtcctccttagtccttagcatgttcttaggctctcagttctcaaggtctcttagcccttagcgtgttctcaggttcctggttctcaggttctcttagcctttagcatgttctcaggttcctggtgaccccttaggtgcgagctctgttcctcacactgggcactcatacctactgctttgctgattttccacactgcgtctctttctggctttctctcatggggcttactctgcttaagggacctcatgtgtgggaagagaagaaccagcaggagaaatgagcttgtggttgccactctggtaagcccaaaaacagggctggggattctgaagacttcattctaatgtcgcctttatttcatgaatggatgattggttttcagcaagttactcaatctctggagattaactgccttatgtaaagaacaccagctactatgtcactggcccatggtggattcttgttcagctgtgaagctcagaatgctctgaatacacatggagtggagaaagccaggtgacattcttcgttagtgtagctacccatgcaagaattcaaaggcttgggcagatcacgcattctgtccttcaccaccatttatccaacaaatgctggcccagggtccatctggtgaagggcacaggcaggcactaggggagcctggttagaagcagctcctgggagtggggagtgaggatgctgaaagccaacacggttccttatcatgcagcaggaatcagaacatgatccctttaatgaggaatgaaacaaatccattactataaaatcgcttgaaaatctagaggtgatggccacaaattaaatccaaaataagacaaaattacgaatactaaagaagaggcaaacgagccacaatccacgtatgagaaggcaaacaagccacaatccacatatgagaagaaaaagccccacagaggaatcagtccccttgctgctataactcgccctccgacctgacccaaggggctttggaaacaccacttgatcttataaaagctgagtttcaaacagaaccagtctcaaaggtcaaattctgaagatagccatggattaatcaggcaacaaaaacaaagaggaagcaggaaaggccctactcatttaggaaaatggaatccaagacaacaagcattaagggagatgcaggcaccatttaaacaacaatccactaatgatggacgccgaggacgagctgacgcagcccccgtgtgctaagcagcagagcctcagagcctatgaagctaaacacatcaacccccaaagaaaactcacagattactgtttttgtctgagaaatttcagaaagtcacaatataaataaggacatgttgaagtaatacaattgacacatttttacctaattacacatcatatatatataattataaactatttataaaagtctgtatcctgcaaatagttatacaaatatatttttgaagcgccaattgaagattaagtatggtatcaattaggccaaagaaaacctcaaaattaccaaagagtaaaagttgaacaaagtcacattctgactaaaatgcagtagaattagacactaatttgaagtttaaaaacaacacataaatatgaaaaagtagaaaagcctaccaaacatttattgtttcaaaaggatataaaatgacaattacagataatttagaacaaaagcaagtgagaattcatcagttatagaatgatgttaaaattatgctcaaaagcaaattatttatgtgatttcattatttttttaaaaatgaataaatagcgtaaataagttttactgaagaagttttatttaaaagagaacagcaaaaagaagaaaatctaagagataattctttttaaaaatcatgttacaagggtgaaaaaaaagtggttttttttttttgagacagggtctcactctctctcccaggctagagtgctgtgtgtgatcatgactcactgcagcctcaatcccccgggctcaggtgatcctctctctcagcctcctgagtagccaggcgccaccacacctggctaaagaaaacgtacgtttacaatgcaaaggaatataactacacaagtgctgagtaattttaaaaaccataatagtgagaactaagctctgattttttctcttgtccaaattcctatctaagaggtctgggaagtcataccccacaaaccataaattctcatcagatgggttttatttgaccctatatatcgtgactgacttttcagtctgactctggcagaacattatgagacaaagggaaaaaatcaaaatatttaactctaaaatatatttccttgcaatacctggaaattgccctgcaaagtctcttgtgggaaaaatccacattctatagggatctactttcccctttgttttccttccttcctttccagatccaggagataatcaaccaagagccaggcacccttttaggtccaataagaagcatcttacaacctgctttctctgaagtctgctaactgagagcttcctctgcacaataaaacttggtctccacaatcctttatcttaactggaacattttctattgatcccaggtcttcagataaactcaacgagttgtcaaccagaaaatgtttgaattcacctatagcctggaagcccctgctttgagttgtcccaccttctgaaccaaaccaatgtatttgattgatgtctcacgcctccctaaaatctataaaaccaagctgcaccctgagcaccctgggcccatgttctcagggcctcctgagggctgcatcacgggctatggccactcatatttggctcagaatacatctctaaaaatattttacagagtttgactcttttcatcaacaagagaatagcatccactacactgcatttacaaatgtggaaatcgctattaaaggatagcttataaatatcccaaatcacacaacagtgtaagcatattttaccaataatcgtggaagacaatgaaaatactctataaatgaagaacattcctaaaaaatatactagaaagtagatcaatggtaaaagaagttttccagaaatgttaggaaaaaaagaaaaacgatcacatttccatgaggaaatactgtgggcaactgttgaggaagacgatgggccacactgtttcttattctctcctgggcagggcctcatgggaacctccctcagtaggtgtcagagtcgggcatgaggaaggcaccggcaggactggggaggcctttgggtcagcaggagggacagcatgagagggagtgattgtccccaggcagtcatgtctgggcctggggaagagctggggaacatgcccagactcctctgccctccatgctgggtgcagcttgttccaaaccccaccaaagccagaggcccagaggacccgatggagcttacaggcatgaagcccatagcagggcaggggaagggagtgtggaggaaaggagtctggagaatatccagccaatgcctccctaaatgggcctctgttttgtgggcagggataattgctcttgcctgggttcaacactcacaaagaaagaatttagaaatccaacctacagaatggtaagagctgtttttatttgtaaccatagctagtgccatctacgttccaggctgataaaaatatttttacaaaatataatatgtgaaaagttactagcctgaaatataaagaacctataataaaagaaacaaacagaaaaatacaaaaagtcctttttatacagacaaagaccatatacagaaaattcacaaagaaaattccaatctcggccagatgtggtggctcatgcctgtaatcctagcactctgggaggccaaggtgggcggatcatgaggtcaggagttcaagaccagcctggccaacacggcaaaaccccatctctactaaaaatacaaaaattagctgggtatggtggcgcgcacctgtagtcccagctactcaggaggctgaggcaagagaattgcttgaacccaagaggtggaggctgtagtgagccaagatcgtgccactgcactccggcctaggtgatgaagcaagagccaaaaaaaaaaaaaaaaaaaaaaaaaagaagaggaaagaaagaggaaagaaaaaggaaggaaggaagggaggaaggaaggagaaaattccaatctcaaagcatatgtattttaaacttttaatctcacttataactcataaaacaaagataacataccatttttcataataaaactggcactgttttaaataataaaaactggcaatttttccaaatgaccacatttaacgttgtttagaaggcacaatccaggcgcctctccatggttgttgctgagtttgatttctcagaggcaggtcctccctggattgttctctatgtggcgcccctttcctcccacgtttggcagcttctgtttgccctgttctgcacccccccagagtgaggaggagccatcccttgcttggttttcccaattcttccagccctctattttttgcccttcttggccgtccaacccatccctatacttgatggagttcaaggtcattggggcagtgcacaacgcccccagtggaatttagagaggagtataaggagtttgaacacatccaaaatagaaattcaacacagctcaagttgaaaacattttggtgggtttttgtttggtttcctacagaaaagtcttacagactataacagcacattctctttgataaaggaggtattaaaggtagatacaccaggcacagaagcacaaagaggcagcccctgccctcagtgtgcgccgcgtgctgaagtcgcagcccctaacctcagtgtgcgccatgttctggggaaagacgcagcccctgccctcagcgtgagccgcgttctggggaaagacacggcccctgccctcagcgagcgccgtgtggtgaagacgaagcccccgccctcggtgtgcgccgcttgctggggaaagacgcagcccccgccctcagtgtgtgcggcgttctggggaaagaagcagccgccgccctcagcgtgcgccgtgtggtgaagacgaagcccccgccctcggtgtgcgccgcttgctggggaaagacgcagcccccgccctcagtgtgcgccgcgttctgaggaaagaggcaacccgcgccctcagtgtgtgcggcgtgctgggggacggttaccagttctccacacgttctcactcttgatcctgccaggacacttaactgctttccctatcagatggccatgagcatgaaagcagatatctaaattttgtgttactggaatctttctaaagactatgactctagaattgtctgtcagggaaaaatgaacttttcaaactaaacctttaggaaaggtcattttcatgtttttttttaaaaaacatgaaaaatagcacaatggctcaggaatccgacagtgccagctttcttactgtggtttgtctttagactaattttttaacctccctatgactcaatttcctcactttcaagaatcggtatgacattagtccatggtatgtatgacattaccacatcgtttgtatgacattagtaattaccacatagttttgagtacaaaataagataatatggaacaatatatttagctcagtatacgttgctatgctctgggaaaggatgataaagactttcacaattctgttttttgtctaaagcaaaaataatttcttactgagaaatgagaattctcgacttatctgctttcgaccaaggccttgaagatgcaggatttttctaagagtctcatggaaaaacgaagaacccctgggcatgtctcttactggagggtcaccccaatatcgctttctctcatgggaaccaaacttttccttacagacatcctaactttctgaaacgtctgcaccagaaagatggtgggtgctttgctacattaaaacaaacaaacaaacaaataataagtgtaatggctatggactgtgtcctgggagcaaggagcaacaagccacgtccacacttacctggctgggctggatgcttcaggacgcctcaggtaggttttcgggaggtctgcaagttcctggtccatcacatactgagtatagtcatcctgccacgtgaaacctgtggacaaaaattgcaaaaattatgtcatcattttggaaatttagccaaagctcttgcttcagtctcacaattagttgcatttcagcattaagttgatggtcccatcagcaaagtaagcctccctctcactgcagtttatcaagatctccttacagaaattccagctttctgaaacttctaggccaaaaagaaaactgatgctctgctgcattaatagtaataaaaaggcttgggtgagagtggagaaagctggccaaatagaagcctctaccaatcatcctccctgtaggaacaccaaattgaacaactgtccgcacagcaaagcaccttcatacgaaccaaatttcaggtgagtggtcacagtacctggttttaactccatatcattgaaagaggcactgaagagggtggaaaagatcatttggaattgctgatgtcacccctcacccatccccctgcagtggctgtgtgccccagagagagaacgcatgcacttgggagagagagcacagtgatagtgggacttggtattggaactcggtgctgccctgtcacagtaaaaacaacaggcaaaactcaaccagagcccatggagggaatatttagaccagccctagacagagcagtaccacccatcccagtggtcagaatctgagttctgacaagcctcaccaccatgggctaaagtgctctggggtcctaaataaacttgaaggctgcctatgatggaaggactacaattcctgggcaagtcctggtgctgtgcttggcttgtagccactggacttggggtgcagacaacctagtaaggtactagctggcacaactaagggtgctagtgtcacccttccctcaaccctaggcagcacagctcacagctccaaaagagactccttccttctccttgaggagaggagagggaagagtaaagaggactttatcttacaacttagataactgctcagccaagtaggatagggcactgggcagagtcatgaggcccccattccaggccctagctcccaggtgacatttctagacacaccttgggccaaaggaaaacccactgccttgaagggaaggtcccagtactgaaaggattcatcatctcctgactacagagcctttgggccctgaataatcaacagtggtacccaggcagtaccccatgggccttgggtaagactcagagatgtcctggcttcaggtctgatctggtacagtcctagtggtggggtggccacagaggtgcttgtgtcacccgtcacccagctccaggaagctcggggagggggggagagagagagaccgtccgttcgtttgtctcggagaatgtaagagaaaaaaagtctgcctggtaatccacaaaattcttctagattgtatccaagactgccaaggtgatacatctgtgagtctgaaacagccatgaaattactgggctttgagtggcccctaatgcagatatggctgcagggattaaaaacgtagatcacagaaccaaagtcttttcttttttttttttaatttatttattttttattattatactttaagttttagggtacatgtgcacattgtacaggttagttacatacgtatacatgtgccatgctggtgtgctgcacccactaactcgtcatctagcattaggtatatctcccaatgctatccctcccccctccccccaccccacaacagtccccagagtgtgatgttccccttcctgtgtccatgtgatctcattgttcaattcccgcctatgagtgagaatatgcggtgtttggttttttgttcttgcgatagtttactgagaatgatggtttccaatttcatccatgtccctacaaaggacatgcactcatcattttttatggctgcatagtattccatggtgtatatgtgccacattttcttaatccggtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaaacaaatttacaagaaaaaaacaaccccatcaaaaagtgggcaaagtcttttcaaatacctggaaagccttcccaagaaggatgaatacaaacaagccgagattttagcgactacaataaatacctaactcagacaccaacaaacatccaagagcatcaagactatccaggaaaacatgacctcaccaaacgaactaaataaggcaccagggaccaatcctggagagacagggatagatatgttacctttcagacaaagaattcaaaatagttgttttaaaaaaattcagtgaaattcaagataacatagaaaagacaatcagaatcctatccgataaacttaacaatgaaattagaataattaaaaacaatcatgcaaaatctctggagttgaaaaacataactgacccattgcagaatgcctcagactctcttgacagcagagttgaccaagcaagacaaagaattagtgagcttgaagactggctagttgaaaatatgccgtcagaggagaccaaagaaaaaaggattttaaaaaatgaagcacacctgcatgatctagaaaatagcctcaaaaagacaaatctaagatttatcacccttaaagaggagggagagagagaaagaggtagaaagtttagttgaaaggataataatgagaacttctcgaacctagagaaagatgtcagtgttcaagtataggaaggctataagaacactaaacagattcaacccaaataagactacctcaagacatttaattatcaaactcccaaaggtcaggaatgaagaaagaatcctaaaatctgcaaaagaaaataaacaaacaaacaaaaatacaatggagctgcagtacatctggcagcagacttttcagtggaaactttacaggccaggaaacgggattgttatttaaagtgttaaaggaaagaaacccttttattctgaaattgtatatccaacaaaaatgcatttcaaatatgaaggaaaaatactttcccagacaaacaaaagctgaaggattccatcaacagcagacctgtcctataagaaatgctaaagggatttcttccgtctgaaataaaagaatgttagtgagcagtaagaaatcatctaaaggtacaaaactcactggtaatagtaagtacacagaaaaacacagaatatcataacactgtaattgtggtgtgtaaactgctcatatctggagttaaaagactaaaagatgaacttatcaaataactccaacaacttttcagatataaagatataaatagaaacaacaaaaagttaaaaagtagggggatgaagctaaagtgtagagtttttattagttttctctgtgctggtttgttagtttgcttatgtaatcaatgttaagttgtcatccgtttaaaataatgggttataagatgttatttgcaagccttattgtaacctcaaatcaaaaaacataaacagatacaacaaaaagtaaaaagctagaaattaaaacataccaccaaagaaaatcactttcacttaaaaaaaaaagtaaggaaagaaataagaaagagaagaccacaaaacaatcagaaaacaaataacaaaatggcaagagtaagttcttacctatcaataataacaaatacacatggactaaactctccaatcaaaacacacagagtggttgaatggattaaaaaaaagacccaatcatctgttgcctataaaagacacacttcacctataaagacaaatatagactaaaaagaaagggatggaaaaagataatccgtgcaaatggaaaccaaaaaagagcaagagtagcagtacttgtatcagacaaaatagatttcaagacaaaactagcaaaagagacaaagaaggtcataatgataaaggggtaaattgagcaagaggacataacaattgtaaatatatatgtacccaacactggagcatccagatatataaaacaaattttattagagttaaagcaagagacagaccccaatacagtaacagctgaagacttccacatgccactttcagcactggacagatcattgagacagaaattcaacgaagatatattgaccaagctgcactgttaaccaaatggactgaattgacatttacagaacatttcattcaatggctatgaaatccacattcttctcctcaacacatgaataattctcaagaatagcccatacattatggcaaaaaaatgcatctttaaaaattcaaaaacaaactgaaattatatcaagtatcttctctgaccacaatggaataacactagaaatcaataacagggaaaattttggaaactatacaaacacatggaaattaaacaatatgcttctgaatgaccagtgggtcaatgaggaaattaaggagaaaatttagagatttcttgaaacaaataataatacaaacacaacataccaaaaacctgtgggatgcagcaaaagcagtactaagaggaaagtttatagctataagcaactacatcgagaaaaaagagaataccctcaaacaatctaatgatgcatcttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcctggctaattttttgtatttttagtagagacggggtttcaccgtgttagccaggatggtctcgatctcctgacctcgtgatccgcccgcctcggcctcccaaagtgatgcatcttaaagaactagaaaagcaagagcaaaccaaacccaaaattagtaaaagaaaagaaataataaagatcagagcagaaataaatcaagttggaatgaagaaaacaatacaaaagatcaatgaaacaaaaagttggtttttgaaaagataaaattgacaaaccattttctagtctaagaaaaaaagagaaaagacccaaataaataaaatcagagatgaaaaaggagacattacaactaatactgcagtaattcaaaggatcattagaggctactatgagcaactacatgccagtaaattagaaaacccagaagaaatggataaattcctagacacatagaatctaccaggactgaaccatgaagaaatcaaaaacctgaacagatcaataacaaataatgagattgaagctgtaataaagtctccaagcaaagaaaagcctgggacttgatcacttcactgctgaattttaccaaatatttaaagaagaatcttgctcaaactattccaaaagatagaggaggaggaaacacttccaaattcattccattaagccagtattaccctgataccaaaaccaaagacacatcaaaaaataaaacttcacgccaatatccctgatgaatattgatgcaaaaatcgtcaacaatcgtcaactgtcctggggataggacagtctcttctataaatggtgctgggaagactggataaccacatgcagaagaatgaaactagactcctatctcttcctatacaaaaatcacataaaaatggattaaagacataaatctaagacctcaaactatgaaacgactaaaagaaaacactgggaaaactccctagtacactggatagtgtaaagatttatttagtaataccccatgagcacaggcagccaaagcaacttgagtaatgctccacaagcacaggcaaccaaagcaaaactggacagatgggatcacatcaagtgaaaaaacctctgcacagcaaaggaaacaatcaacaaagtgaagagatacccacagaataggagaaaatatttgcaaagtattcatctgacaagggattaataaccagaatgtataaaaagctcaaacaactctgtagaaaaaaatttcaataatctaactttaaatgggcaaatagatataactctgaatagacatttctcaaaaaagacattcagacggcaaacaggcgtatgaaaaggtgctcaacatcactgatcatcagagaaatgcaaatcaaacctacaatgagatatcatctcacccagttcaaatggcttttgtccaaaagacaggcaataacaaatgctggcgaggatataggaaaaagggaaccctcatacacactgttggtagaattgtaaattagtacaactattatggagagtagtttggaggttccttaaaaagctgaaaatagagctataatataatccagcaatcccactgctaggtttatacccaaaaggtaatcagtgtatcaaattgatatccacactcccatgtttattgcagcactgttaacaacagtgaacatttggaagcaacctaaatgtccatcaacagatgaatggatttttaaaaatgtggtacctctacacagtggagtactattcagccataaaaaggtgagattctttcatttgcaacaacatggatggaactgaaaatcattatgttaagtgaaataagccagacatagaaagacaaactttgcatgttctcaccgatttgtgggaactaaaacttaaaacaactgaacttatagagagtagaacaacagctaccagaaggaagtaaccattgttactgggaaggaaattggcagggggcggggggcaagtgggaatggttaatgagtacaaaaatacagttaagtagaatgaataagatctggtacttgatagcacaacagggtaactacagtcaacaataatttattgtacatttacaaataactaagagtataactggattatttgtaacacaatgaaaggataaatacttcaggtgatgaacatcccatttaccctgacgtgattattatgcattgtatgcctgtatcaaaatatcccatgtaccccataaatatatacacctgtgtacccacaaaaattaaaaattaaaaaaatagacttaatgggtgctgactatggctagacagcaaggagccttacaccaaatacaagtttagttagaagacagatttttatctactatgaaagatggaaacatcttccatctacatggaaatattgtggtcacagcaaagatactcctcatccacaataagcacatagtacccgccactcacccactcctctacctgcccgccaccatatcttaggtattttgttcttcctaacaaaatcttaaaagacagcaattggaatggaataaggggtattgttactgtgaaagcaattatcatggggcttaatgtactgtatccgggagccaattacattatatttatactcaaatgttatgacaaagagctttataacaagggtgaagtagttatgaaggcaaaatccatgtgattatgcattaattacatgcactgtggatcacatgataattatgctcaaaattaccaaataactctcaagaataattattatgcaatttgtacatgttagatcttatggtaacactttagcacttagaactaccccatgcaattatccataattatctaatcactaaatatcatgtaattacagagatatatttttatgccctgtacaaaaacacattaccaaaatcttcaaatcaggatggctctgtgcttgtgtgtgtgtgtgtgtgtgtgtgtgtgtgtgtgtgtgtgtgtgtggcgtaggaagtccagaacatgatgagaaccacatattctggatggaattaaaagagctcagtaaatataagctatcttcatgaacacacaaatatttttttcacatgcaaatctagattttttaaatgttatagacggcaaattaaagcaattgtcatatttctaaatctcaaaagcctaaatggcattacctgaagtgaagaatgataggaaaattcaccattaggatggcctccaacttactctaagctgctctagttggaatatatcacttagagtataggtcgctgcagaaaacaggccccacactcactactatccaatttaagattaaatgtacttaataataatcaagtctatcccatttgccaaagcaacttaaaaacacccactatgaaatgtacttttgtttatatagctatttctgatccattcttgggagtatactcaactgaaagcacatttgcaatgttagtataatatctattattgtggatttagaaataaggatattttaaccacgccattcctaaaagggattctcttaatattaatatttatcaggaaacagaaaatcaatggcacaaaaagaacttttcatgaaaaatatcatttataaaatttaaataactaaaatttaaaaatttttatctaaaaatcatataagtctgagttatgtcaactttgggatctatgataaaggctcagttcttccagaacaacagttggtcaactactcagaatcatctgtactgggcagtctgagaggaccctgtataccttagcccagccatctcagccttcccggaagtcagaagaaactgtgctcttagatataaaaaacaaacaaaacaatgcagaggtatgggagtttaagcatctcctatgaacttctgtccgtggcatatcttggagaaaatataaccctgggaagaaggaatccactcccagagatgacatacgtcttcccactaagtacaactaaaatctctgagcatacgtaaaacaagcataagactctgaaggatggcaatacgaaggcagagcagagaaggacatggtggtggattccctgggttttctttttgcctcaggtacctcagacttggagtcaaagaggccgcaatccggaaacaccagcgtgtacacacacacacacacacacacacacacacacacaactaaagcagcctctctctaatcaaggagtcaggaaagaatcaactcagcaagacagaaaaatattagatattaacagctctaccccagcaaaacaccacagaaaaaagtacagcctctccctacccatgccaacaaaggccaaatggggatctagacttcctctttcatgaggctgtaataaggcctcccctcaggcctaccaggtagtgtcagagaaggccaagtagggatccagaactttcatctccattgggttgtaattaccacaacccctgcagtgccagcagagaccatctgggaagttgaaactcccacccctctccctaaccaatcagtaaaaagaccccaccttcaggtatcaacagaggcctcctggggaatctagacttccatctccctgtcagttacaaggaatcaccaccaccaccccttacccccagaagaggagtgtccaaaaagagacagttaaaatgcaaggtttaaatgagatccagaatcatgacataatacaaaaatgtccagatttcaaaagaaaataactggttatacaaagaacaaagaagatcacaaaataaatagaaaagagacaatccacagaaaccaacactgagatgaccgagatgttaaaattgcctgagaaagattttaaaccagttacgataaaaatgcttcaatgagcaattatgaacacacttgaaacaaatgaaaaagtaggatgtctcagaaaatagatgatgtaaataaaagccaaattgaaatattattactgaaagatacaataaccaaaataaacaacgcagtggatgcacataacagaaggatggagagacagaggaaagaatcagtgaagtgaggataaaacagtaggaattactcaatgtcaacaacacagagaaaatagtagaaaaacatgataaagcttcagcaactgcggggctataaccaaagatataatattcatgctatcagagtttcaaaaagaggagtgaaagaagacaagatgacaggtctgaaaaggtactcagaaaaataatggctgaaaacttctcaattttggaagaaacatgaacctaaaactttaagaagctaagcataccccaaacagggtaaacccaaatctcctccaagacacataataattaagtttctgaaaacttacaaagaaaaatcttaacagcagccagagaaaaatgacaacttacctacaaggaaaacacaattcaaatgacaggggatttcttatcagaaacaatggaggccacaaggaaacagcacatttttcaagtgctgaaagaaaaatatgtcaacccagaatcccacaagtctatcaatccagatacccagtgaagttatccttcaggaatcagggggaaataaagatatccccagaaaaaggaaaattgtgtttttcaccagaccaactctgaaagaattactaaatttatgtctccatatagaagagaaatataaaaaaaggaattttggagcatcaggaagaatgcaagaacatggcaagcaacaacctgagtaagtacaataagcattccttgagttttatgcttgacagttcaattaaacaccatactactgtcttatgtcattttaaatgcacatagaggaaatatttaaacaattataatataaatgaggggcataagtaaaatgtcataaaggaaggtaaagtttctatatttcacccaaactggtaaaattatgacaccagtaaactttaatgttatgaatatgtatatgaatattatatctagaacaataaataaaagaaagctatcaaagacatacactcaaaaacatagataaagtggatttccaaaatcattaaagtaactcaaaggaagggaggaagaaacaaagaaacaaaaaatacaagaacaagtagaaaatacaaaattaaatgagttttaaatcctaacatgttaataattacattaaatgtaaatgggctaaatatgacaatgaaaacactggctgagtgggttttttttaaaaaaagactcaactatacactatatgaagctcactttgaataaaatgatataggatggttgaaagtaaaaatatttttaaaaatatatcatgtaagtattaatcaaaggatggaagcaatagctatattaatatcagataagttaacatttagagtaaagaaaatggctacagagaagggaattacagagttataaataggtcaacccactaagaagatacagcaatcctatatatgaattatatagatagagcaactaaacaaaaaatcaacaaagatagaaaagaactcaacaataccattaatcaacaggatctaatgaacatttatggaacactgtacccaacaagagcagagtatatgttcttttcaattgctcatagaacacaaaccatgatagacttaatgctgggccataaaacaaacttcagcaaaattataatcattcagagtgtgttctctgaccacaatatagtcaaggtagaaatcaataacagaaagataatggggaaatataacaacatgttataaaataatccatgggtcaaagagaagataatacattacatgtaattaaaataaaagcacaacatatcaaaattcatggcacatacagttaaaactgtgctaagtgaaatttttagcactaaatgcttacattaaaaaagagggccctactggagcacttttgccagtggcccccacccaccctgccagggcacttttgccagcaaccaccaatggggcagtttagctggtggcccctgatagagtgctttcaccagcagcctagctgcaccttgacctcccagtgaagctggtactaaagctcaaggggccagaggacaaagccacaggcctggtcccaggtcaccagggttagagcatacagcccaggagttccaagctgaacctcggccctatgaaaaaattcagaaacaaagccaatcaactatatccaacttacacaacagcaaaactcttatgagaaataacgaacataaaaacaaaaagccctatccccaggacagcaacttcaaaaggataaaagaacatcagcactcacagatgagaaaacagcacaagaactctggcagttctaaaagccagagtgtctttttacctacaaatgaacacactagctacccagcaatggttcttaatcaaactgaaatgactgaaatgacagacataggattcagagtctagatggcaaggaagctcaatgagatacaggagaaagttgaaactcaatccaaggaaatgatttgagagttgaaagacaacatagccattttaagaataaccaaactgaacttctgaaatttaaaattcaatataagaatttcataataaaattggaagcattaacatcagaagagaccaagctgagagaagaattttagagcttaaaggcagttctttcaaatcaacacaggcagacaaaaataaagaaaaaagagtgttaaaaaatgaataaaacctctgaaaagtatgggattatgtaaagtgaccaaaactatgactcactggcatttctgaaagagaaggagagagagtaagcaacttggaaaacatagttgaggatacagtccatgaaaattttcccaatctcactagaggttgacatgatattcaaggaattcagaaaacccctgtgagatactatataagatgaccatccccaaggcatatggtcatcagattctccaaggttgttgtgaaagaaaaactcttaaaagcagctatagagaaagggcaggtcagttacaaagagaacccaccaggctgatagcagacatgtcagaaaaaagcttacaagccagaagagactgggggccctattttcagcatccttaaagaaaaaaaattccaatcaaggatttcatatcccacaaaactaagcatcataagcaaagaagaaataaaatcatttttagacaagtgaacactaaagaaattcactatcattagacccgctttacaaaggtccttaagggagtgctaaacatggaaacaagaaagatacctgcctccacaaaaacacaaatacgtagctcacttgcactataaagcaactatacaatcaagtttacatgaaaaccagctaacaacacaaatgacaggattaaatccttacatatcaatattaaccttgaatgtaaacaggctaaacacccacttaaaaggcatagattgacaagttggataaagaggcaagacccaactgtctgctgtcttcaagaacccatctcacatgtaatgacacactttggctcaaagtaaagggatggagaaagatctatcttgtaagtggaaaacaacaaagagcagaggttgctattcttatatcagatgaagcagattttaaaccagcaatgatcaaaaagaacaaagaggggctttacataatgaaaaagggttcaattcaacaagaagacttaactaccctaaatatttatgcacccaacattggggcacccagattcataaaacaagttcttagagacctataaagagacataaacacaataatagggggagatttcaatatcccatttgacagcattagacagatcatagaggcagaaaacaaagatattctggactcaaactcaacccttgatcaactgggtcttctagatgtctacagactacccaacaacaacagaatatatattcttcttatctgcacatgacacatactctaagatcagccacatgccataaagcaagtctcaaaaaaatccaaagaaaattgaaatcataccaaccactctcttggcccacatgtaatataaatacaaataaaaaacaagaagatctctcaaaactatccagttacatcaaaattaaacattttgctcctagatgacttttgggtaaagaatgaaattaatgcagaaatcaaaaaattatttgaaactaatgaaaactgtgacacaacataccagaatatttgggacacaactaaagcagtgttaaaaggaaagtttataacactaaacaactacatcataaagttagaaagatctcaaattaacaacataacattacacctggaagaactagaaaaaaaaagaacaaaccaatcccaaagctagcagaagaaaagaaaaaatcaaaatcagagcagaactgaatgaaattgggacacaaaaacacaaacaaaagaaagttcattttttgaaataataaataagattggtagaccactagctagattaacaaaaatagaagacctaaataagcacaataagaaatgacaacggtgatattacaagaaaaccttttaggttttctgggttttttccatttcttctagaacaccttgaagaaataaataaattcccagaaacatacaaccttgcaatattgaaccaggaagaaattcaaatcctgaacagatgaataatgactttcaaaattgaattgctaataaaaaaaaaacctaccaaccaaaaaagcccggaaccagacaaattcacagctgaattctaccagacatagaaagcagagctagtaacaatcctactaaaattacttcaaaaaaccaaaaagtaggaactcctccctaaatcattctatgacactaaacagaattgaaaacagaaaccatatgatcatcttaatagatacaggaagggctttcaataaaattcaacatcccttcatgttaaaaaccttcaacaaattaggcatcaaaggacaaagataaaaggaatatgcctcaaaataataagatccatcaattacaaacccaaaggcaacatcatattgaacaggcaaaagttggaagcatttcctgtgagaactggaatgaaacaaaatgcccactctcatcactcctattcaacatagtattggaattcctagccagagcagtcaggcaagggaaagaaataaaaggtatccaaataggaaaagaggaagtcaaattatctctcttcatagatgatatactatacatagaaacccctaaaaactctgccaaaagacttctagaactaataaatgacttcagtaaagtttcaggaaaaaaatatcaatgtataaaaaccagtagcatacaattcacttacccttagcaaaccaaaacaaaaactaaaaaactaatatcatttctacacatcaataatttccaagctgaaatccaaatcaagaatgcaatcccatttacaacatgtacaaaaagaataaaatacctaaggttatagctaaccaagaaagtgaaagatctctacaagaattaaaaaacactgcagagataatacaaacaaatggaacaacattccacgctcatggataggaagaatcaatattgttaaaatggtgacattacccaaagcaatttacagactcaatgctattcctatcaaaccaccagcatcatttttcacagaattagaaaaaaaaaagaattataaaattcatatggatccaaaaaaaaaaaaaggctgaatagccaaagcaaccctaagcaaaaagaacaaagctggaggaatcacactacctgacttcaaaatatactataaggccatagtaaccaaaacagcatggtactggtacaaaaacagacacatagaccaatggaacaggttagagaaaccagaaataaagccacacacctacaaacatctgatcttcaacaaagtcaacaaaaacaagaaatggagaaaggactccctattcaataaatggtgctaggatagctggttagccgtatgcagaagattgaaacttgactccttccttttaccatatacaaaaatcaatttaagatggcttaaagatttaaatgtaagacctaaaaccataaaaaccctagaagaaaatgtaggacacaccactctggacacaggccttagcaaagatttaatgatgacatctccaaaagcaactgcaagaaaaaaaaaaagacaagagggacctaattaaaccaaagcgcttctgaacaacaaaagcaactattaacaggtaaatagacaacctatagggtaggaaaaaatatttgcaaactatgcatctgcattagtccattttcacactgctgataaagacacacttgagactgggtaaactaaaagagcaagaggtttaatggacccacagttccatgtggctggggaggcctcacaatcatgatggaaggtgaaaagcacgtcttacatggcagcaggcaaaagagagaatgaatgccaagcggaaagggtttccttcggatccatcagatctcatgagacttattcactaacatgagaataatatgggggaaactgccccatgagtcaattatctcctaccaggtcccctcccacaagacgtggaaattatggaagctacaattcaagatgagatgtgggtggggacacagccaaaccatatcagcatccaaaagaaatttaatatccagaatctgtaaggaacttaaattattcaacaagaaaaaagcagccccattaaaaaatgggtaggagacatgaacagacacttcttaaaagaagacatagaagcggccaagaaacgtaggaaaaatgttcatcattagtaatcatcagagaaatgcaaaccaaaaccaaaatgagatactatttcacatgagccagaatgaatatttttaaaaagtcaaaaaataacagatgttgacaaggttgcagagaacagggaatgcttatacactgctggtgggaatgtaaagtagttcagctggtgtagaaagcagtttggaaatttctcagagaacttaacacagaactaccattcgacccagcaatcccagtatgggcatatagccaaaggaaaataaatcatcctaccaaaaagacacaagcacctgtacattcatcacggtattattcacaatagcaaagacatggaatcaacctagatacccactgatgatggactggaaaaagaaaatacggtacacatacaccatggaatactacacagccataaaaataatgaaatcatgtcctttgcagcaacatagatgcagctgtaggccatcatcctaatcaaattaatataggaacagaaaaccaaatactgcgtgttctcacttataagtggaaactaaacacggagtacacacagacacaaaaatgaggatgacagacgccgaggactatgaaaggcagagggtgggaggaagacgtgggttgaaaagctataagggactaggttcactacctgggtggcaggattgttatcacaccaaactgtaacaacacacaattcacccatgcatatgtaccctcaaaccgaaaacaaaagtcaaaagaaaaataaaagagaaagtctcaaatcaataatctgaattctttaagaatctgtaataaaggagaacacaataaacccaaataaagtagaagaaaataaataataaggataagaaaagaaatcaatgtaatttaagtgagaaaaaaatagagaagataaatgacaatgaaagctggttccttgaaaaaaatcagtaaaattgacaaatctctatcaagactaacaaaaaacaagagagaagacacaaattatcaatataagcaaagaaacaggggaagtcactacagactctgcaaacatcaaaaggataatcagggaataaacaactctacacacataaacctgacaacatagatgaaatggatcgactccttgaaatccacaagttacctcaattcatccaatgtgaaatcaataatttgaatacttctacactattaaggaacttgaattaataattaaatatctacccagaaagaaataatcaggcccagatggtttcaccaaagaattataccaaacatttaaagaggaattaaaacaaattccataaatatcttccagaaaatagaaggcgaggaaacagttcccaatttattttatgtagctaatattaacccgataccaaaagcaaacaaagacagtaaaaagaaacctacagaccaaaatccctcacaaatgtagacacaaaaatcctttacaaaatattagcaaataaaatccagcaatatatgaaaataatgatacatcatgaggtttattccaggaatgaaaggctggttcactatttcaaaacaaatcaatgtaatccaccatattaataggctaaagaagaaaaaaatcacatgattacagcaatcgatgcagaaaagacatttaaaaaattcaacactcattcatgaagaaaactttcagaaaaatagaaatcaaggggcactttatcaagctaacaataaacatctacaaaaccccacatttcactgtacttaatggtgagtaaccatcaaaagctttcactgaagactaggaacaaagcaaggatgtttgctctcaccaatcttattcaacataaagctggaagttccagccagtgcaatagggcaagataaaaaaaaaataaaagatatgcagacacaaaggaagaaattaaactgtacctatgtcctatttcctgattatctacacagaaagccccaaggactctacaaaaaatataaaaacctctcaaacctaataagttcttgtactatatactaacaatgaaggcatgaaaactgaaattaaaatactatttaaaaccactcaaagaatacctaggtgtaaatttaacaaaccacgtacaggacctatgtgctgaaacacaaacaatggtgatgaaagaaaccaaagatcaaaataaatgacagacataccatgttggtagatcagaagattcaacataataatgatgtcaactctccccagattgatacagaggtttcacataattcctataaaaaatcccagggaaatactttgtagatacagaaaagcaagttatatggaagagcaaaggaactagagtagctaaaacaatttgggaaaataaaaataaagtggaaggagtgatcatatataatttcaagtcttatataggtacaataatcaagactgtgtagtactgatgaacagatacaaataatacaatagaatagaaaacccagaaatagatccataaaaatatgtccaagttatttttgacaaagatgcataaacaatttaatggtaggaaaatttgccttttcaacaaatggtcctggagtgattggacatccacaggcaaaaacaggaacctctatgtaagcttcacagtctacacaaaagcaactcatggacataaatgtaaaaatgcaaaactataaaacttttagaaaaaaacaacagaaaatctttggaagctagagctaggcaaaaagttcttagacttgacatcaaacatcttccataaaaagaaaaattgacaaattggccttcatcaaaattaaaaacttttgctctgtggaaaggccctcttaagagctgaaacaatgagcgcagagttggagaaatattggcaaaccacgtatctgacaaaggactagtatcaggaatatacacagaactctcaaaactaaacattaaaaacattcaattagaaaaagggtgagagatgaaaagacatttcgacaaagaggatctactgatggcaaataaccacacgaagagatgctgaccatcatctcatcagggaaatgtcaattacacccacaatgagatgccaccacacacctatcagaaaggctaaaataaaaaatagggacaacatcaaatgctggaaaggatttggattcagaaaaactgtatcactgttacttttttttttcttttttactgtgaatgtcaaattttgttctggaaaatggtttgagagttcctttaaaaactaaacatatacttatcataagacacaaaaattgaacccctgaccattcatcccaaagaaatgaagacttatgttcaaacaaaatcttgtgtatgaatgttcaccagttttatttagaatagccccaaactgggaaccaccgagtccctcagcaggtggatggttaccatgcagcacctctgcaccacggagcaccacttggttatgaaggaaagaacgattagtacacaccacagcctcgctgaatctccccggaactgtgctgaggcaaaaagccaattcaagaaggatagatgctatataatttcatctagacaacacctgcataaccaactcttgtgtcctatgggaggcacatacggtttgagggcagccacagcacccatcttcctcaagtttgcagtctagtgtggaatgcaggtacgtaattagctaagatccaagttggagtgcaatcattatataataaagttatgagcaaactgctaagggaatagagaaatgaagaggtgaatttgtgttggaaagttaagaaagtttcatagaaacaagtggtatttgaactaagactggaaagataaatagaattctaacaggtggggatggattaggggaggaactctaagataacggagtagcatgggaagggacttggggctgtggcactgagtggtgcactcaggggatggtgtatgacatggggagggaggtgggggcagtgcaggaacagagggaggggagttgcatagtcacaggaggacgtcaaagctacatcaggaagcaccggtgcatctgtgcacagtggggagcagtaaaagctctgcatcggacagaaatatcatccaactgtgtcccagaaggaggataaaagtaacaatattaaaattaaaaatttaaagatacatagcagtttctatttgctgagccttaactatgagccagcactattctaagtccttcctattttaatcctcaggatttgtgaataatgaattaaagataatagggagaagggaaggcattcaataagagttacaaaaacggttcattagagagatgataaggttgtaaactcagagaacactagtgtggatagtttgagaagcagaattggtaaaaataatcagtatatgcaggattaaaggagaacaaggtgtcaaggttaactgcaagagaggttggctaggtcactggggaagaggaaatcacaaagaaggaaggctgggaacacaccaggtttgtgggtggggacgacgtttgtttcttctgcaggctgaactgtgtggcagaggagatccccgtgggaggggcaggtggagaatgccagggacagactgctgagagggaaacggaggcggcagagcaagtggtggcagcgtgcatggtggtcccggcttgcatgcaacacgtcaacacttaagcaggcaagggcatagcaaggacagaaaccaaggtgcacgctgcatatgaggaacgaagacagcgcttcccttttttttttttttttttccggtggtatccaagagtaagatatgcatcttgaagtgagacctggggaagtcccacaacacagcacttaccctaatcgcgtgggagcctctcacgtatcactgtgtcctattatatcatatttattctcttctgtctcactttttaaaatttctggctgcaacaccctaaaactctctcagggtcattaatgggctgtggcttgcagtttcaaacacactggatccaggcgacaggctgtttggagggaggagggagccaggctgaggaacagagatgcaaaggtttgggggtgaagctgaagatgactgactgccaagctaggctccagtggcaccagctccaggagaggaccctgggtcacaggacgaatggaggcctcagagctactcatcagagagtgcactgtgcgtggataaatgggaggagggaggtcagttgggagaaggtgtgagaaaatggaacagtagaaaatctgtcaaagtaaagaggatgggatagatcctccatctgttttaggagaaaaacaataaaaaagaggtgctgagcagaggagcaaaatcgacaataaagacagacagcccaaggtcatgtgctcaggagccaggagaagagagagcttcaagggtgagagagaggcggtattcatttcaaacgcggtaatactgagagataaatcagagtgataagaatcagaaatgaaatctattagcattttattttgcctacaggaaagctgtaaatgagaggctgatttcaaaatatgaacgtggtcagggttgaaatggggctgaggaggagcccctgacgtgtgacgggaagaccccaggtggcgaggaagaagtgtcggggaaaggcggtggtcagcacattgcaggatctagattttatgagtagaattcacgactatataaaaaaatacagtggcactctaatcagcagtaaactcatgctcaaaatgctctttacggaagatgaatgtgcagcttgccctcgcatcagcaaggaaagggctggtgagcagagtgtgaaggatgatcccatgcaggaagcctgtaggctttgtgaactgagaggaaacactccttaagaagatgacgtgaagtcaattaaagggatcaggtgggctctccttcccaatcagagaagacagggtcatagttccattcctgggctgctcaactgtgcacagtgggggtgcctgtcccaggcctggtcagggccagcacagactccttgacatggttttaactcacattttcacaatccctggaaaaatgcaaagcatttctataaagtagttaaggctttacatgtatatcaaatagaaatggaacctatacattcaagacattaaaaagctctatgcgtattcaaaggtggtagcattgttggtgatattttatgtctctttggaacacatttacaaagacagtttagaaaccagacaataaatcagtcttgttgttatatgttcacacttcacttttacattgaaaacagtgtgacaatcaacttagtcaatgactgggatgcaaataacttatttatcccacctggtatcaactaactttatgccacatcctcatgcatctgccttcaaaaagaagagtcaccattactgagaatgttcagagatcgccctctaccaggttactgaaggaagatcccaaagaagaattttaaacttttctgagcaacatcagaagctttccaaggtgaaatttttgaaaagaaaatattttctccagatacatttcatattccactacacctgttggaaatttctactaggagggacttctggtcccaaaatggtggtgcagtagaagcaaggtgacttcactctgctccacagagaagcaaaaacacacacagcactgacacaatcccagcaatggccacacactcaaatacaaaaggagacagttcccaggaacacagaaaattgaaaacaccccaagcagacagcaaaagcatcagaccaccatgtctgcaccatccctcctcataatctgtttggcatcaagagtatgggaaatttcccctcaactcatagcttctatgctggaaaaagtgagggtgaggtggacaatcagcttctccaacctcttgggggccctggctggagacctgttcctgcttcaacccatgggaagcgctgcaaatgtgtgaagggaaacatccctgaggacagccagagataaaagggggaggtgggactatagtccccagccccacaaactctactctgcaactcggtcaaagaggcactccatcagagtggctgctcacagcaccaccctgtagcaggaatgctccacaggtcccctcagcacgaggccccagccagccttctcacactgctggcatatcccctttgagacctctcccattcagtacaggcagcactcagatctttaaccttcagtacaggcagcactcagatctttaaccagagccaaggtaaacctgggcttaaggtgccatctagtgccgaaaaggagacagggacctagaagggggagaaaaagaaattccacaggtaaattatgtgactctctaagcaaatgtatccaataaaaactaaaacaagccaggagacaagactggagtaaataaataatccttcagtgcaaggacacagacacacatcaacaagaaacagcagcaaatgggaaaccatggccttctcaaatggacaaagtaaggaactagcaattggccctaataagatggcaatatgtgagttctcggaccaagaattcaaaatagcagttttaaggaaactcagtgatttccaagataacacagaaaagcaattcagaaatttaacaaagagattgaaacaatttttaaaaattcaaacagaaatcttggaactgagaaatacatttgctgaactgaaaaattcattatagcctctcaaaagcagaatggatcaagcagaggaaggaatcagtgagctcaaagacaggctatttgaaaatacacaatcagggatggaaaaagaacaaagaatgaagagggatgaagaccacttgcaagacagaaaattacctcaaaacatcaaatataagaatgattgatgttcaaggggaagctgagcaagaacaaggggtagaaagcttactcaaagaaacaataacagaaaacttctcaaaacttgagaaagacataaacatctaggtacaggaaggtcagagaacaccaaacagatttgacccaaataagactactgtaaggcatataataatcaaactctcaaaagtcaaggacaaagagagatcctaaaagcagcaagagaaaagaagcaaggaatatttaaagcagctctcatttgtctggcaaccaactactcaacagaaaccatacaggccaggagagagtaggatgacatttgcaaagtgctggaaggagaaaaaaatgaaaaacctgtcacccaagaatactatatccagcaaagcattccttcaactataaaggagagataaagtcttacccatacaaacaaaagctgagataattcaccactactagtcctgtgttacaaatcatgctaaagagagttcttcagtctgaaagaaaaaaaagtaacatgcaaaaagaaaatatttgaaggtataaaacacaccggtaaaagtaagcactcaaactaacccagaatactccaatactgtaattgtggggtgcaatccactcataaccgtagaatgaagcccaaaagacaaatctgtcaaaaacaataatagctgcagcaacctattaagagataggcagcatacaaatatgtagattgagacaataggaagtcaaagtgtggggggatggacttaaaatacagaggggttttttttcatttttttctttgtttctattcttttgtgatctcagttatctctttaagataacttgttatatgtttaagttgttttttataagtctcatggcaactacaataaaaaaaaactgtaacacatgcactaaaaataaaaagcaatgaattaaaacatactagcagagaaaatcactttaccacaaagtaagacagaaagcaagcaaggcaacaagaatgaggagttacaaaacaatgaaaaaacaaacaaaatagcagtagtcagtccttactcatcaataataacattgaatttaaatgtactcaattctccaattaaaagatatagaatggctgtatggataaagaattaagacccaactataagctgcccacaataaaccagccatatctataaagatggacattgactgaaaggaatagaaaaatatatttcaggctgggcacagaggctcacacctgtaatctcagcactttgacaggccaagttgagagaattgcttgtgtctgggagttcaaggccagcctgggcaatacagtgagactccatctctataaaaaaatcaaaaattagccgggcatggtggcatgtgcctgtggtctcagctacttgggatgctgaggtgggaggatcacttgagcatggaaggtcaagcctgcagtgagccatgatcacaccactgcactcagctgagataagagaatgtgaccctgtctcagaaacaacaaaaaagatattccatgcaagtggaaaccaaaaatgggcagaagcggctgtgcttatatcagataaaatagactgcaagtcaaagactgcaaaaagcaacaaagaacatcactatatagtgataaaagggtcaatcagcaagaggatataaaattataaatatatatgcacccaacaatggaacactgaagtatataaaacagacattaatagatccaaaggaagagatagcccgcaatacaataatggcagggcacttcaacaccccattctcagtaatggacagatcattcaggcaagaaatcaacaaagaaactttagagttaaactatacactacaccaaataggcttgactgacatttatatcatttcacccgactgctacagaatacccattcttttcatcagagcatgaagcactctccagaatacaccacatcttaggccacaaaacaagtctcaacaaattcaaagcagcagaaatcatatcaagtatcttttctgaccaccatagactaaaactagaaatcaataacaagaagaaccccagaaactacataaacacatgggaattaaacctccttctaaatggccaatgagtcaatgaagaagttaagaaggaaatttaaaaatgtcttgaaacaaatgaaaattgaaatatactacaatctatgggatacaataaaagcaatactaagaggcaagtgtataataataaatgcctacatcaaaaacatagaaagacttcaaataaacaacctaaccatgcacctcaaggaccaaggaaagcaagaacaagccaaacctaaaatgagtagaaggaaagaaataatacaaatcagagcagaaataaatgaaattaagataaaatatacagaaaaatcaataaaacaaaaagttttttgaaaaggtaaacaaaattgacaaacctttagctagactaagaaaaaaggaaagaagatccaaataaataaagtcagaaatgaaaaaggagatgtaacaactcagatcacaggaataaaaaggatcattagagacaattataaacaactgcatgctaagaaatgggaaaacctagaagaaataggtacattcctggacactaccaagattgaaccatgaagaaatagaaaacttcaacaaaccaataacaagtaattagatcaaagccataataaaaaaatttaccatcaaagaaaagcccaggacctgatgccttcactgatgaattctaccaaacatttgaagaaataataccaattctactcaaactcttcaaaaaattgaagaggagggaatacctccaaactcattctatgaggtcagtgttaccctgaaaccaaaagctgaaaagacaagacaaaaaaaaaggaggactataggcatagacacaaaaatcttcaacaaaatattagcaaactgaattcaagaacacattaaaaagatcattcaacatgatcgagtgggattcatcccagggatacaatgacgattcaaaatatgcatatcaataaacataatacatcacattaacagaattaagaacaaaactacatgatcatttcaatagatgctaaaaaagcatttgataaaattcaacatccctttatgataaaacactcatcaaaatgggtatagaaagaacatacctcaaaataataaacgctatatatgacaaatccacagctaacaccataatgaatggggaaacactgaaagccttttctctaacatttggagcaagacaaggatgttcactttcaccatttttatacaacatagcactgaagtcctgaccacagcaattaggcaagagaaagaaatacaggcacccaaattggaaaggaaaaagtcaaattagccttatttgcagacatcatgatcttatcatatttataaaacaccaaagacttcaaaacactgtcagaactgacaaattcagtaaagttgcaggatacaaaatcaacatacaaaaatcagcagcatttatatatgccaacagcaaacaatctaaaaaacaataaagtaaccctatttccaatagctaaacataatataagatacctagaaattaatttaaccaaagaagtaaaagatctatacaaggaaaacgatacaacactgaagaaaacaattgaagacgacacaaaaaactggaaagatattccatgctcatgtatccaaataactaatactgttaaaatgtcgatactacccaaagcaattgacagattcaatgcagtccctattagatgagatggggcttgttcagggtgggcatggctgtagacatcagtgtagtccctatcaaaatgccaatgacactcttcacagaaagaaaaatctctaaaatttacataagctcacaaaagaccccaaatacccaaagcaatcctgagcaaaaataacaaacatggaggtctcatatgacctgacttcgaaatatgcttcaaagctatagtatccaaataagcatagtactggcataaaaacagacacacagaccaatggaacagaatagagaatccaggtataaattcacacgtttataaccaactcatttttcacaaaggcaccaagagcagatattggggaaaggacaatctcttcaataaatgttgctgagaaaactggatttccatacacagaagaatgaaacaagactcctatgtctcaccatatacaaaaatcgaatcaaaatggattaaaggcttaaatataagacccgaaactatgaaaccgctaaaagaaaacactaaggaaacactccaggacattgatcagggcaaagatttttttggtaaggcctcaaaagcacagataaccaaagcaaataaagataaaatgagatcacatcaagctaaaaggcttctgcacagcaaaggaaacaaaaaagtgaagaaacaacccacagaatggagaaaatatatgtaaacgatccatctgacaagggattaataaccagaatatataaagagctcaaaacactcaacagcaaaaaaaaaacaaacctctaatttaaaaatgggcaaaagatctgaatagacatttttcaaataaaaacatataaatggccaacaggtacagtcatcaaataaaaacatacaaatggcaaacagatatagtcatcaaataaaaacacacaaatggccaacagatatagtcatcaaataaaaacacacaaatggtaaacagatatagtcatcaaataaaaacatacaaatggccaacagatatagtcatcaaataaaaacatacaaatggtaaaacagatatagtcatcaaataaaaacatacaaatggccaacaggtatagtcatcaaataaaaacatacaaatggccaacaggtatagtcatcaaataaaaacatataggtggtaaacagatatagtcatcaaataaaaacttacaaatggccaacagatatagtcatcagagaaatacaaatcaaaatcacaatgagatatcatcccactcccgttaaaatggctttttttttcttttgagacggagtcttgctctgtctcccaggctggagtgcaatggcacaatctccgctcactgcaacctccacctcctggattcaagcgattctcctgcctcagcctcccgagtagctgggattacaggcacctgccaccacacccggctaattttttgtatttttagtagagacggggtttcaccatgttggccaggctggtctcgatctcctgacctcatgatctgcctgcctcagcctcccaaagtgatgggattacaggcatgagccaccgggcctggcccaaaatggctcttattgaaaagacagaaaataacaaatggctggcacggatgtggagaggagccctcggacactgtgggtgggaatgtaaattagcgcagccactatagagaatagtatggaggttgctcagaaaaaagtgaaactagaactaacatatgatccagaaattccactaccgggtttgtatccaaaagaaaggaaatcaatatatcaaagagatatctgcatgcctgtgtttattgcaggactagtcacaatagcaaaaatatggagtcgacctaagtgtccatcaatggatgaatggatatagaaaatgcagaatatatacacaatggaatagtattctgccataaaaaagggtgcaagcctgtcataggcaccaacatgggaaactggaagtcattatgtgaagtgaaataagccaaacatagaaagacaaatactgcatgttctcactcatatgtgggagctaacaaatggatctcatgagggtgcctccgttgagattggtggttaccagaggatgggaaggggagctgggaggaaggaaggagagacattgactaatggctacaaatagacagaagaaataaaacctagtgtttgatagatcaacagggtgactagagttaacaataatgtatgtatgtttcaaattagccaaaagagaacagcttgactgttcctggcacaaagaaaagatgaatattttaggtgaagatcccaatcaccctgatttgatctttacaaattatacaatggtattaaattatcacatgtaccctgaaaatatgtacatcgattctgtatcaatatagaaaagctttctagagagcccatttttctacactcggcacctccacaacaagcaggaagcagccggtgtgaccacacctcccaaaaccaccattacgggctgcttagcattctaggacacggagacgtcgtgggggaaactgcagggtgactgaagaaggagaatcccagaactcccccaaggacgacagtgcagagcccacagcgttgttgaaggggctgggtgagctgtgagtagatcccaggcaccatcaccatcgtccttgccattgctggccgtcatctctggtcatcgcaaacagagccccttacggtacgttaggggatggtgtggaaacgcttggctaaatgaagatgctgctgacattgctacgtggtgcctgccacacaggcaggcaatgtcttcagaggagccccagcttctcctctcccttctcctcctcagatctaggtagggccgcttgtgctcccttggggcatgaaggaaaaacttcacgcaggccacccctctagccaccgtgctcattcagaagccacaccagacaaacgttgaggggtgggtaaggctgcctgggccctgggccctcagaacctcaagcaaagctgcccgaaggtggggtctgccctggcgtctgtggggtgggggcacacagtctgatcccagtctgacatgcaccagctgtgagcctcgagatgcctcaagtatgtcttcatggagccgccgtgaagacgtgatggcactcagtgggactccccacagggccagtggaacctgtccctgcctggccccccagttacccagttacccggtgcaacctgtccccgcctggtcacccagttacctggtggaacccgtccccacccagccactctgttaccaggtagaacctgtccctgcccgaccactctgctgtggggaaaagcaagagagatcagattgttactgtgtctgtgtagaaagaagtagacataggagactccattttgttatgtactaagaaaaattcttctgccttgagattctgttaatctatgaccttacccccaaccccgtgctctgtgaaacatgtgctgtgtcaactcagagttgaatggattaagggcggtgcaggatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggagggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcactgagatgtttatgtgtatgcatatctaaaagcacagcacttaatcctttacattgtctatgatgcaaagacctttgttcacatgtttgtctgctgaccctctccccacaattgtcttgtgaccctgacacatccccctcttcgagaaacacccacagatgatcaataaatactaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctacactctgccacttcgccgccacccatgctgccattgcactgatgctggcttctcgtttcctgctccccctctttctgaacaccccccggcagacacagcgcttacatgggagtgcacgaaggacacccttccctcacgctgagctcagcacagagcctgcaggagttgcccgcagcccggcggctgccatggagatacacacaggacacaagtgtctgtgatttctgtggccacacctgtgctggctgctcccgacgtccctggaggccagctgttccggcagggctggggcacacacacaatctccacagtgcagccgcggcctcctgctgggaacgtccgccccgtcctgcctctcggggcggctaagtcgctaagtcacgcccgtgtccggctctgattggaaaaggacgccctgggcttggctgggaggaaaggccagagggtccacaggggaaaagctcagctctggggggcatccctccctacagctgggcctggagaggagcccagcacacctgatggccatcgcagatcaggaaaccgtcctcccctccctcctgccctgggccaagcaggtcctgccagttactataaaataaagcggggggtgtgggtggcaccaaaagcacagcaggcgagacgcggggcacaggaaggaaggaagccacagcaaggcttctggtctctgccgctcatcagaaacctttcttccgccctcagccactgtccctcttaatccagccacattcacggtttctgtatcacccaaaacatcatgtttgttggaacttattttattttagattcaggtcttgttaaccattgctccaggatgctttactttccttgtcttaaacgggaacttcccaggtcatgttattaagaagtgggtgcccaggaagcacgggtcgcagctccacacggacagaggctcctgggacctgggactggctctaggtcatgacagctcagcaggattccagggaccgacggattcagtcctgaggggcagaccaggtcctggtaggtacagcaaggaggactcccctgcaagtctggagcaacaaggccccatgaagggagacaaaaccagggaccctgacacggtggctacaagggcagaggtgagagcagaggtgtgaaggccacgcagcccccaggacgcccccaggacaggctggcctatgctaagccacgcggctccccagactcctgaatggagaagagggtgctggcctcagaggctctcgtgagggccgtggaggggagcggaaagccaggcaggcagctgccacccgagcctggtgtttgctcggtcaaggtgccacagcccccatcaccccggggtgggggccaccaccatgccctgaggaccgagggccttctctgaggccagccagagggtcgatgttcctctgcgccttttccaaacagcaggatggtgcagaaacctcaggagggtaaaacccgtcagctattccccttggggcactgtctctctgtgcagggaagagtcagcagttctctctgttggagcagacgcgacctccagctctaaccaagactctcagaccacgttcaagttgcagccagcaaggagcccggagctggtatcccggagcttgttctttcctggggcgctttgtttcagtccacaagccaacgctccgtagcgcggcccccaccctcctgccgtgtggggcaaactattcaaagtcccctggccgtcagaaggttccagagggtgtgcagtcactttcctccccattctcacagcagcaggaccaatggggacgtggctttgtctgcatccctgcggcccctgccactgcactcgccaccatcaaaagcttctcctctcggagctcaaggacacatcaaatgatgtcacaccacttcacgcccttctcccagcagccccgcttcagtgcctgggaagctgcacaaaataagattctgttatcaagcaacgctgcacttcccacatctggatgcacgccaagacaagacgtcagtcatttcctggtgaaatgaaagaaagccacgcttcctccacgcccattgggtcacgaaatccttgctaatcctggccggggcactggaggatgctataaacaatcacggatctgagcaggtggatgaagggaacgtagatgacacgttgagggtgtggtgcgggcaatacacagactaagagtgggaactggcgaagtgagctataatcccaagcataaaggaaaggaggggaggtggcctccagcgcctctcctactagttaaaggagagagagggagaaaaataccactggaacctccaggcaggtcagacgggcacttggggcttatgtgcattatttgatggaacaagcagtgtctttgtttcttaggatggccatttttatctttttgataagtgtggaggaagttggcttagtataatttaatttctctctcctattaacaggtctcagtaaaacaatggggaatataccaaaaaagagagagagagagagaaagccaaaagaacataaaactagcacattagtcttttaaataaaaatgcagaggaagatagggaaggaaaagaatactacccaatattagtccagacctcgaatacgaccaggacagcctgccacagcagaaagaccaggtgtgtgggcttttgttttgtttttgttttctttcgagatggactctcactctgtcgcccaggctggagtgcagtagcgtgatctcagctcagtgcaaccactgcctcctggggtcaagtgattctcctgcctcggcctcccaagtagatgggattataggtgtgtgccaccacacccggctaatttttgtatttttagtagagacagggtttcaccatgttggccaggttggtcttgaactcctgacctcaggtgattcacctgcctgggactcccaaagtgctgggattacaggtgtggccactgtgcctgggcaggtgtttggtctttctaatggcaaaaggcttccttcgaactttacccttgctagatcttaatattgattcaatggggaggcatattttgctaacagcaaagaagaaaaacatcattgaataattgagatacaattctcagtctaaggccatcaaactgtttgtggacaggaagtggaagcagaagctgagcctggctttccaggcagaggcctctgctgtggtgcccaggaaccatgtcaggagcccacttctgaataaagatgccccaaggcagccccgtgggcaggtgccctcaggcccagggccccctgtgaacgtggatcatggtcttgggccagccagcatccagttccagcttcatggtggaagcatcaaagtgttcttggttaacccattttagaaattccttcagttaccaggtgactcttccctttctccagttcggctatagtttcctttcataacatatttgctgacggactttaattagaatccttcactttcggccgggcgtggtggcttacacctgtaatcctagcattttgggaggccaagggggaggatcacctgaggttaggagttcaagaccagcctggccaacatggcaaaaccctatctctacaaaaaatacaaaattagccgggcatgatggcaggtgcctgtaatcccagctacccaggaggttgaggcaggagaatggcttgaacccaggaggcaaaggttgcagtgagccaagatcacaccactgcattccagcctgggtgacagagtaagactctatctcaaaaaaagaattaataaataaataaaatttaaatttaaattttaaaaaaatccttcacttcccctgacacagactttaaagtacgaatcatcacacccaaattcagctctgaagacattgttttctgaagtgttcacgccctgttttgggcataccaggaaaggaggcagtgttctgttctgttttctcatatcctacctgaatcttatgattgattttacagctaacgttctacagctccccgttctcctaatcacagctctgaggtcctccccaaatgatcactgagtaagaaaacatcttgggaccttttttaagtcaaggaaatgatacagatggctcgaatgttcccacaaagtgcatatggtcctggagaagggagaccacagctctaccaaagctgccatctgaaaccccctcaggcccatatttctagacagcacagtcgcaaaccgaggggtccttatcttcactaaactagctttgcttttgctgtggagccttgtttgcttgcttctgttattgtccaaatcttaactgactctgacttggcctataaggcaggttcacccacccggtagagccatgctagtggctcctagcagcccaagagcccagcctgtaaccattcatccctggagggaaaggagctgaacctaaagtttccagtacaacctcctccccgccccgtcctctgcaccttcctctcccatcgtttattttcatttccatctccagtcttctatctcaagctccactttccacctgcctaggcatggacttctccaacctcttagttccgcttcttttcaattagagagaattctaaatcaaaagcgtgtctgcaaagtggagagattcaaaagatgagaatctcctctaaagattgcaatcagtggccaagagtgagggagggaattcacaaagttcaactcctttcagaaaacatctgtgttcgtcgggaatactggcctgtagtcttctttccctggagtgtttgtctggctttggcatcagggtaatgatggcctcgtaaaatctgtttggaagtgtttcctcctcttcagtgttttggaagagtttgagaagatgggtattagttcttctggaagtgtctggtaggattcagcaatgaaaacatccgttcgtgggcattattttggctgagacattttattactgattcaatctccttactcgttacagtctgtttttctgtttcttcatgattcagtcttggtaggttgtatgtgtctaggaagggctccatttcttccagattgtccaatgtcttggcgtataaatgtccacagtggtctcatgacccttggtgtttctgtggtatccattgtaacgcctcttctttcatttctgattctatttatttgagtcttctctcatttctcagtctagctgaagatctgtccattttgtgtcttttcaacaaaacaactcccaattttgatgatctttcctattgtttttctaggctatttgacttgtttcttctctaatcattgttatttccttccttccactaactttgggcttagtttgttcttcatttcctagtgccttggggtgtaatgttaggttgattagaaaacaaaataagctaacccaggaagctggagtgagaagattccagctagaaagcacagacgccttcacttcagcctcaacctgtgatcagagcagacacagcaggaaagcaggaaagctttcatttccatataccagactcagagctgaaaagaggcaaagaaagtcttctctcccaaaattaatcaatgcaagaggagcagaccatttcactgcttcacactggcacttctcaccttgtttctcttgcccaaccctagtaaaaatgattcccatgtgagcacaacagcctggacattgtggtttaaaagtctggtcactgtagtgagaggaaaaaaagatctgtctggtttcatgagaagaaatgctcagtggagagatggttactcgtgttttccagatggttctgtggaccccagaacgctgtcccagccaaactccaccacagataccaccttcagagttggccaggagctgcaggaagcccacaaaggttgatttggaagaagcaacatcctacaaaccagatccatccacacagagagcaggctctgctccttggcagtagtctctacttagtgctaagtactaagtacctcctaagttgtagtctctgcttagtactaggtacctcctgagtcatagtctctgctaagtactaagcactagtcactactatatatctcctaagtatcagtgtctacttagtactaactactgctaagcactaagtacctcctaaatagcagtctgtttagtacaaagtactattaatgataattacaaactacctcctaagtagcagtctttgcttagttctaagtactgctaaatactaagtacttcctaagtcacagtccctacttcgtatctaatacctcctaagcaacagtctctacttagtgctgatccctcccaccccgagtcactgacatcacttcctgtcctccctccttcctcacaatgtggcccattttccccactgaccaccaatgcagcacccagtccctgggaagagaacaagctgcctccttcccccaggacttccatggtggttcctgctcagccagaagggaaaggccaggctctgaagtccttccagctagctcctgcttcttcactcagaagtgcaggaaactgaccttcccattaatgcttcagagggggtagtagcacagaagttggaaacgcaaattaaaaggtgaaaggtcaaggcagtgtcctgaagaaaaaggctgaacaagcctcaaaaacacacctttcaggtattcatgaaaaaggaacagatacacagagtgtctgtagacagtgagctgtgtgttttgcgtgagtgtgaatgagcgtgttttgtgtgtgagctgtgcataagctatgagtgtttatgagtttttgtgtgagctgtgtgtgagggtgtgtgtgaatgagcatgttttttgtgtgtgttttgtgtgaaaatgagtgtgtgagcgtgagttttgtctgagttgtgtgtacaagctatgtatgtgttttgtgtgagctgacttgtgattgttttgtgtgtcagttgtgtgagttctgtaagctgtgtaagttgtgagtgtgtgtggttgtgagttgtgttagagtgaaagtgtgtgtgtgtgtgagttgtgtggttagcgtcagagtatgtgtgggtgtgtgtgagttgtgtgagtgtgagttgtgtgtgagagtgtgtatgagtgtgagttgtgcacatgtgagtgtatggggggcgtgtgttatataaaatattaaactttttctctgagctcagtgtctcccagtgtgacagagccccagtgccccggggtgggggccgtgggagaagcgacaggcctgagcgaggccagcagttcgaagcccctgctccctggctgtgtcatgtggacaagtgacgtcgtcttgaggatggcctcgtgaggcggcggtgggcatgaaatgagatgaggcgtccagccctgcatctgcagcgtggtcagcacagaggctgacatccatggtcatgccggaatccgtggtcatgccagaatccgtggccatgccggaatccatggccatgccggaatccgtggtcatgctggaatccacggtcatgccggaacccatggccatgccggaatccgtggtcatgctggaatccacggtcatgccggaacccatggccatgccagaatccgtggtcatgccagaatccgtggtcatgccggaatccactgatggtgcacgtgacccacgatgggaaaagtcacaagacagcttcagagctggtcaaacgggactgagaggggctgcaccaggaatgcgcggcctgttgagtttcagtgatgaggccatcagaagccatctccacgcacttctcatagagcgcatgggccgccctggcctgagtcaaaccaggggcctttcatccgagccgacctcttgacgtagagtcaggtctccttgccgagagtgggacctgcaccctgatccattactaggtggagggagttttccagactgggtttgtttgggttgatacaaaggcaactctgcacatccaaattcgcatggatgggagctgccttctaggcccctctggcagtttccccaggagtcaggcacagcgtctcatgacgtggctgtgtgaacaggtgagtggggatgtggaagcagccggctcagggccggcacacagtaggtcgcttgtgcgtggccaccatgctatccgccaaccccggtgccatggttatccctatgctgactcacaggcatggggctgctgactcacaggcatggagctggacatcagtctggctcgcaggcacactggaaagctgctcttaccctactaactttcagtcactgagacacaaatcagggcctggttggcagcagcgagaccgtcagggtgccctccccacctgcgacaataaacaccgcatgatgttaccctccagggatgacccaggattgtgtgaaaccaaaattcattaaaaatgaatattctgggccaggctgcattcactaattgattgattgattgattgataatttgatttatttaaaatacacctttctcgtaagcttctcggcacatacggcaaaatataaataccccacatgaataaaattatcacttgaaaaaactcatcacttgaaggaagagggggaaaaatccatgttatggaaatggcagcgtaatgggtgggtctcctggtgaccaaagacatcctgggaggtgagagatggagagagaaacagaggcttaaagatttggagtcgagacgcgtctctctaccaagaaggaagaagacggctctcactgcccccagctctaactccgtgtggtccacaggacaggaagtcccacacgggagaaggaggatgctggggctgctgacgataagaaaatgtgagcgtttcacaagtcaccgtgggtggtcattgtccttgtccacgggatttttcaaagtaggacaatctgtattttaaagaagttgcgttttcttcctttttgacctttttaaagacttatgcagaaagtgactgcaaccaaaagcatatggttttattgctaattcaaccttacagagctgacaggcaaggccgaccaatgtgtgggagggctctgatgacagcaacgacgacagtgaatccaggggtgacgtcccccaggcgtgtgcttcccatggccatgccggaatccgtggtcatgccggaatccactgatggtgcacgtgacccacgatgggaaaagtcacaagacagcttcagagctggtcaaacaggactgagaggggctacaccaggaatgcgcggcctgttgagtttctgtgatgaggccatcagaagccatctccacgcacttctcatagagcgcatggagcttcccagagcaagcgtgcagccatgccaggcctgggctgggagacatgtgtgaggacgcacgatggggttaggcagcctgagaaaccatccctggcacgggctgcctcaaggaatgaggaggtgtgggcttcccggctgcccatccccatatctgcacatagcccctgcatctcactacacagagcgtggcccgtgggtggcaccccccagcatggccaggagcaccgaggcgcacgctgggctctgagacgccccctggccaagaggggtggaggaagggggcaggcgccaggatctggaaggagatttccaacccacgtggggtctcacaggagaaggccgtgatgggaggtggggaagtggggaggagggcgctcttgaccgtgtctgcgtgtctaagcaaaggatacaggggcgcaaagggaaggagtggccaggggtgcccgtcccaggtgtgctcttcttcacggcgcccctgcttccccaccacgcccatgtccacggctcgtgggcagctgggcactgggccactcagacaccgtcctaaacactccacacaggtaacttgctccctctccagccacacagcaaacacagcaaaggggacttgggtgtctgcggtttttttgtttgtttgtttttaagatggagtttcattcttgtggcccaggctggagtgctatggtgcgatcttggctcactgcaatctccgcctcccgggttcaagcgattctcctgcctcagcctcctgagtaggtgggattacaggcatgcaccaccatgcctgggtaactttgtaattttagtagagatgggttttccccatgttggccaggctggtctcgaactcctcacctcaggtgatccacccaccttggcctcccaaagtgctgggattacaggcatgatccaccgcgcccagcctaccatctgtgttcttaaccatacctcgcacaagaccccagcctggagagaggagcgggagggggaggcctttatccccccattattagggagatcccaaaggcttgtctcataaaatcacagcacatcgtttctgagggtaaagaattagagactccttgaaaatgggagagaatgagtgatgctttaacaagcttctaagatgaaatcctaaagctggggctttgctcagagcccactaaggccaggcgggtcatgctgtccttccaggagcggccccaccccttccgtcttgacactcaaaccatcgggctggaggcaaatgtcagaggagaaaagcctttgcttttctcccagctctcctgtaagaagccgctgagctgccagctatgcagcaagcacctgcgtaccccaagatgcagccaggaaggagtggggtaccccgaccacgtggggacacagccctcccaaggggcagccagtgtttccctgaaggaactgaggccaggaagcttgtttctcatttacttgaattcaaatcttaaaatgtttgcaataaattcaaaattttcaaaatactgtgtaggactgaacaaaacaaaacactcccacacacaccccatgcacacatatcacatatgtgcatatatacaccacacagtgcacacatgccacacacggacccacatcacatacatgcacatacacacgcacacacaccacacatatgcacacatcacacccacacagcacatatgtgcatatatacaccacacacgtgcacacacgccacacacatgcacccacatcacatgcatgcccctacacacgcacacacatcacacatatgtgcacatcgcacacatcacatatgtgcatatagatgacacacgtgcacacatgccacacgcatgcacccacgtcacatacatgcacatacacatgcacacaccacacatatgcacgcatcacacgcagcacatatgtgcatatatacaccacacagtgcacacatgccacacacatgcacccacatcacatacatgcacatacacgtgcacaccacacatatgcacacatcacacatgcagcacatatgtgcatacataaacacacgtgcacacatgccacacacgtgcacccacatcacacacatacaccacacacaccacacatatgcacacatcacacacacacatgaacatgccacacacaccacacgtgaatcacatattcatatcaccacacacgtgcacacagcacacacacgaacacacatcacacacatgcacaccatacataaatgcatacatacacgtatctaccacacatcctgcatgcacacgcatcacacacatgcacaccatacacacatgcatacatatgcatatctaccacacctgcatgcacacaccctgcatgcacacacatcacacacatgcacaccatacatacatgcatacatacacatatctaccacacctgcacgcacacaccctgcatgcacacgcatcacacacatgcacaccatacatacatgcatacatacacatatctaccacacctgcacacacacaccctgcatgcacatgcatcacacacatgcacaccatacatgcatacatacacatatctaccacacctgcacacacacaccctgcatgcacacgcatcacacacatgcaccatacctgtgagttggattggctgatgagtctcccagttgtgacgtctatgcagccaataaaatgtggaagaggggtttcctatggtcagtgaggctttaggaccagaaaagccccatcccctggggactgcagagggctttatctcagcggtcagatgccctctgtgacatcattgccaagcatcattcactcataactttgacagacatgcactgaatgcattcccatttaaactgcttctcctgtgctccagcaagacgccacgtccctcccccagtgtgtgtgcacaacgacccgtgcagtgtcattgtgtcataaatgcatctgagtgtaatgcaagtgagagaacacgtgttggatgcacgacacacacacgagtttcccacactggacactcagtggatgcacaacacacacacgagtttcctacacttgacactcagatgcatttatggtctactcttaccaaagtaaaaagcaacagatgaattgttgaagtatggtacatcagctctaaatgcttcacatatttatggaaatattataataaagaaaatacttatactatcaaggaaagccgaacaacaggacccacaatcggatctatggggtggtccctgcctctaacctgagctcagataaagtaggacacttaagccctcatttttaggatgtatgaatgtggatattctctcattcctactgttgcataattttcagattctttctaatgcatataggttatttattgttatacatttatagcataatgcatgcctatttaagaaaattgaaatggtatcaaaacaaggcagaaattgcacagaacagcaaaagggaaccggcctccccatcctcatcccctctccatctgctcttaacccagactcaggttttgcttttctgcatacatgtacacacccatgtacacacacattccatacatatgcacacacacacgtacacacacatcccccccacatccacacagaaacagaagtgatagaaaacaacgatttttataagacaggtatattttctttgcaaaatctcaaacccccgaattgttgtggtttctctctcgtctgttttttgacgtgatgcaaaacatgtttgaatgttgcgccgtagtcctgattccttcaaatcaacatcagctgactcttagcagcactgtgctatcactatttcatatcattttcaaccagtcataaatgtgtcctcctaaccatgttgccacaaaagacaattccagatgctttgctatctggtagagaaaaaattaacaattcgcttattcttaaagtgtttgtggggaaattttccaaaagaaaaaaggtgaaattacgcacagtgagatgagcacatttttacttgattgtaacaagtacggaagttaaagccccctggaaatctcggtggaaatcacataaagtagactctaggagacaattccctatctaggctggcatgaaatcctaatgcatagaaagggtaatgggacacgcacaaagcgtactgttacttagcaggctctcaagaaccacacagcatgacggtaataatgtgctcatcttcaggagaatgggaacaagtgctcagggtcaaagaactgggctcccgtcctgcctgctgaggtccctggggtgctttggaaccctcattggtgagccgaggagaacctcgcctttctcccagcagagatcagatgtcctccttactgcacggatatgatacatgtgcatgcggtatgtgtgcatgtggggcgtgtgcaggtgtgcaatggatgtatacagtgcatgtggggcgtgtgcaggtgtgcaatggatgtatatggtgcatgtggggtgtgtgcaggtgtgcaatggatgtatatggtgcacgtgtggtgtgtgcaggtgtgcaatggatgtatatggtgcatgtggggggtgtgcaatggatgtctatggtgcctgtggggtgtgtgcaggtgtgcaatggatgtctatggtgcatgtggggcgtgtgcaggtgtgcaatggatgtctatggtgcacatgtggtgtgcacaggtgtgcaatggatgtctatggtgcacgtgtggtgtgtgcaggtgtgcaatggatgtctatggtgcacgtgtggtgtgcacaggtgtgcaatggatgtatatggtgcacgtatgcatgtgtgtgtccccctcattacctcacatgcgtatagagcacagacacacaccttaataaagcccagagtatgctcagcacagtaagtgtgcaaatcctgaaacgctgtaaaactggacctgtgacttgaagcctccattccattgttggggacacacaagcagggctccctaaggggaggtcagggaaacgagagccaccacatacctgccccaggctcagggcaggtcccagcaaagccccttcttggctctggcctcctcatcgtctgtgggacacgcccattttaccagaaacacaaagttggtccctccatccatccttcgcctaagcagcctgcctctccagttgccatggcaactctgctctggttgccgcacagcctcaagcctcagctgcttggagtgggtgggaacgcgagagcacttgagcaccagtggcctgacaactctgcctcgtccccatcacctctgcggcgagaatcagagcagtcgcagaagctcctgccacaccactcccataatctctcagtgccaattacttggaggaaaaatggaatcatccccgtgcccagggtggtgagtggtgtcaccgttcggatggctcagatgaaggcggccaactgggcagcgggaatggagcctttctaggcaggcagacccaagcatactgctcctgaattagtgtgtgggttggtgagcactccaggcggacctgatagcccggagccctatccctcactaccccccagccccagccctgcaccagttaccaaagacaaacaagagacacgtttctccaaaggatggcaggacaggacagggtaggaaggccccaccaccccatctccaggcacctggctttcagggaagccaccacgccagctgcacagacgcgtgacaggcaccccagtgctgaagcccaaggaggaggctgacagcccagttagatcgagtccaagcagcaaaatcacacagcacatcccgacaatcagccgcatcacatgcaaagccagagaacgaacctctcactccccaaatccaatcctccccaacatgagccacccccaccacccccgattgatggggagattaacatgccggaaaacgaccccatatcacaaagcagagcctggtttctcaaaggagaccttaatcttccctcacccttgggctggcggagtgagagtccctgtggcccgaggttcctcctgtcatgcccacggcactcagaactgaggctggcatgcggagggtgtggtttccccggaccagacctcgttgtccagaccaaacccaaccacagttccaatctgttttttagccaagtgctttaaatatgtgtcaagcactaatgctgggaggacttaaataaatacatgagccttttcttctaataaactggcagatccaccagatctacctgggccagtctcattttccaggcgactgagcctggatgtgcataactgaagctgcctgaggactggaggactgaccggggccagcacagcgggcgggggcctgaggactcgaggactgaccggggccagcacagcgggcggggctctgcccattaaatacactttcgcgtgtttcttttaacaacgtgctcctttcacagaagtgttttatgctgcatttcgtagaaaggaggaagcactcaacagaaccttccgtttccagtcaccgggtgattgccgcgcctgttgcttccacaaggaacccactgcaaaaccatctagggcaggggcagccccgggtctccagagcacacgccagactcccgaaacccaggccaggaccgcgccccacaggaatctgtcccctcccctcggcggtggtcaggttggccttgagtcttccatgagaatctgcagaatgcggcacacaggcgaggcaagactggggacttccttgaataacaaggtgtccagtgctttaaaaatactctaatggtgaggaaggaaattgagaaaatgattcattagaagagcggaataactctttttaagagcaggctcgcagaagtcgagctgggcaacagattctcgagccgctggcatccatatttatcgagcagaggaagcatccctgtaactgcacggcggcacagagccactgcccacggcacgacccgccctccatctctacgttcaggagcatccctgtaactggacagcagcacagagccactgcccacggcacgacccgccctccatctccacgttcaggagcatccctgtaactggacagcagcacagagccactgcccacggcacgacccgccctccatctccacgttcaggagcatccctgtaactggacagcagcacagagccactgcccacggcatgacccgccctccatctccacgttcaggagcatccctgtaactggacagtggcacagagccactgccgcccacagcacaacccgccccccatctccacgttcaggagcatccctgtaactggacagcggcacagagccactgcccacggcacgacccgccctccatctccacgttcaggagcatccctgtaactggacagtggcacagagccactgcccacggcacgacccgccctccatctccacgttcaggagcatccctgtaactggacagtggcacagagccactgcccacggcacgacccgccccccatctccacgttcaggagcatccctgtaactggacagtggcacagagccactgcccacggcacgacccgccctccatctccacgttcaggagcatccctgtaactggacagtggcacagagccactgcccacggcacgacctgccctccatctccacgttcaggagcatccctgtaactggacagtggcacagagccactgcccacggcacgacccgccctccatctccacgttcaggagcatccctgtaactggacagtggcacagagccaccgctgcacacagcagtaaaaatgtacagccctccctctctgcgttcaggagcagagggcatgagtttcacctccctacaggacaggaaactacgacagtcatctttgcacctgaagaaacaaattatttaaactttctcatcctgcagtttacttcttagacatgtctactttctatagcaaaatagatctggacacgaataataaatgcgaagcatggtgttacagggaaaatcccgaggcatggcccaggcccaggaagaagctgcagaaaaggagaaattcatgtccctcccctgctgtctttcctaggacatcccttccctgctcacccacgtccaggacctgttctttgtatagaggttcctgtcttctggtgttgagtgacacagagcaacccaaaagctccctcgcagaagcccctgcaggcttcacgacgtgtgagcaagggaggttctttggctaaagacccagacaaggcaatgatctacccaacaagatcaccaagggcaagacttcacgcgagcacagctgaggaagatgtttggggcttatctgaccgtttctacaagcatctctcaaatcacaccacagaggaaaccaaaaggcctggttcagcctccaggggccgggctctggaagaaagtaggcccagggcaggagtccacggccacagggaacagggaatgctgccttcctgtggggaacaagaggatcggccactccaccaccaaagatccgcggccgaaccaccttgctgaaatttaacctgaacttgcctcagcacgacagcttcaggattaaaagtggttcacggatttggggaactgcagaggacagtatgtgtgtacagagaattacacaatcatgtagctttttgtggagtgaggggtgttgagccctctgtccattcaggatgctttggaaatgtttttaccaaactatgagtctcacagtttcgaggactccattcccgctggggctgtgctgtccgccgcacccttgcactgggccctgacccaccctcccaccccatgcaccaagctcctggccactcttttctggctgccctgggctcgccagctgatgaggccaatgggccctcctgtccctggggcttggcactaagcctcagggcacccgtcctcactgcctgactacctttctctgcctgttccagctggacccactgagcaaaaccttctaaaccagacgatgctcagaactacccagcctcagaactacctctgtcctcagacttagatgccacaggaaaccccttgctgggagagccagtgctgactccagcttctcagcgggtttgattttggatgccgtgatcagaaccctgcaggtgctgtgtgttctgtctcatccagggatgtcccgtgtctactgcaggaccttcgggggaggcctgcctgcagaatctctgtgcaaaggtgatgtgggcagggagtgttgacgacgatgctttgatggtcctcttctgttgtctcccataggcacagctttggaccaagctctgtcccccacacaatggactgacctcttgggactcagagtctgatgccgactggctgaggaaagtggacgtggcagggaccccgcggctgcctctgctgagggggacaagagggcaccgaggcttctcctcactctgagaggagttgtcacgtgcacccttggagcaaggtcaccagccagtcacaagtgcagggccattattctggtccgcgccatgtggaattttaaaaagttttagatggtggaccattggcagttttagaaatacactaaggccccggaagacctacctattggttcaggtacctgaggaaaggtggtggaggagacagaagctggcgggggcgggggggaacctaggcagctcccgtgaggacaagtgatgacggcagagaagagggcaggactcaagcagctgggcgcccagcagaagctccatgttggacaaccatgcactaccctggtggcttgagagcaatagaatttgcccgagcttaaaattaaactcagccctaataggaagtttatggaatgattcaccatctgtaataaaatttatctttcttggagtagaaaagagtatttttcccaaaaaatatagtctctaagaaattgtggaataatcaaatctatctataacctaaacttatgcaaaaagaaacatggatgtgagtttattctgccaaaacgaggaataaggtccttcaagctaccagctttttgccgtctgggagcttgggtttcagaagatcccctgtaaattccggacccctagttccctggaacaggcatgagacaacctgctaaggcagactgagagcccagtcagatccctgctttccctgggatctgggttgaaatggagttgaatgagggacccggacaaccagaatcatgctcaaagaggtttcgagtatcctctgtctaccacccaggtcagcaggcggggtttgccctggaccagcgtgtggagagacccgggcacacggctgctcaggacgcagtcagacgcggaacccgacccctcaggtttgatcacagaaacctgtggcgtgtttctggggtaggatccttcctttaaataaaaacttacacaggaaccaaatgttcagagagtctacatcccagatttggctgattcttttctcctcagcgttacaatgagatggcgtgatttgaggacctgctgtacgtgcgctaaacgtctttttcttgttactctgacattcgaatccagtcaggcatcctgtattcaatctggaactctgctcttccttctggggggccctcaagctctgggaatcataggataagaggactgtggtgctggacgaccccgagcccccagttgggtgagcaagcgtgcagcagcgagaaatgtctgagcccccaggcttcaagcccacttcgctcagcctgggtctcacccactgtacaaaggatccaaccctgcagctccgctcctggaggactgaccaagacctgcggcggtgactgcccccgcccagccccacggcgctgacctggaactgccctgatgatgagaatcacagggatggcgtgcgtgccaggggtgagcccgcctgcagaggagctggtgagggccacagcccatgccctcccctgctgggctccttgctgtcagctgacagtaccctggcttcgcggtgacagcagctcttcctctgagcgctgcctcagctcatcacatgagctgagagtgggatgggtctcatcatagctaccttctatccattcttttttacctaaggctttcttgagaggcagttttcactttgcagcctgaatcctactctgcttcaggtaagataactgggcgggagcctgacagtttaagagacccaaatagaactaatctccaagcgggcacgtaagaacagctcacagcatggctgccccggctccttctcacctgggatttctcctggagcattcccgacgtccacacaccacatttcctccgctctgtctgctgcagagcctgctccagggtgaacacaggccgtcctgaatcagccgctgacgcctcccccggcatctccacgtgcagcccctgccctgcgcgactggcgtggaaagggctctggtgcgtctcacactctgctatcatcagcctccttcctgctccagttcttaagttcttgtcttttctgttgtctgcatttaatttaaatttctatgaatcgccgcgagacgaccctgtgagtacgcactccatgtgcatgtgcttctccacggagggagctgcctgggtggccgccctgctgatcctctgcatccagcctctggtaggatgggggcgaccacatcagataccacctctgtggaagggtctgtgtctcctcccctgccccccagtcacagctttgggggagatttcagaggtttcagggccttccctgaagcctttcctggaaggtggattctcttgctttttcagcaaccaccagccgttggctctgctggaatggcatccagggttttccttgttgcttctgtatctgtttgttttggcctatttgttgttcatattgttaagctttagggaggaacatttggggatctggtttcacaaggtcccaggaagccagaagtctcctgcagccacgcgaggtctgtccacgaggcctgcactgcgtggtcgtgctgggtagacacaccggctaggagacgaatgtggaagagttgatttcaactaaaggatccagagtggggtgagggaggtgcagcgtcggtacagggaggcaggaagcaggagcaggacgggttgaggcagcagcaccagcaacgcctgtgaaaccccttgtgcatgtccccgtgaggacccctgatgcctctgctgcctgatgctgcaaacgtctcttgagtgagagctcagtttccaaatggagtgacaaggagcagaacttctagacaccggaagtggaaggttgctcaaggcagatgcacaaataaatgacaaatggcagtttgataaccaacacaatgctaaagggccacaggcacaggccacagagaagggccatgggagcaggcaggccacgcaggacacggagaagagccagggaagcaggtggcccatgcagggcacagagccacccttccgggcagggcaagcggcctctcatcccacgtcacaacccgcagctgctgctgtgctgcagggaagagtgacatcacagacacccctcagagcccctgggaaaagcctaaaggaggctctggaggctccaccaaagaccgtcggcaccaacggctggcatgttccttgggaaattagaggagggcgtgtctgccaaaggtggatttataacaagagcccaagagtgggactcactcttcccggggatcccacctgctcccactcctcaccagggagcagcatggctgtgtccatgtgtccctgtgtgtacatgtatatatgcatgtgtttgtgtgtccttgtgtcccgggtgtacaggtatgtgtgtttgtgtgtccatgtgtccatgagtacacatatgtgcatgtgtttgtgtccatgtgtctctggtatacacgtatttgtccacgtgtccctttgtgtacacatatgtgaatgtgtttgtgtgtccatgtgtccctggtgtacatgtatgtgcgtttgtgtgtccatgtgtccatgagtacacatatgtgcatgtgtttctgtgtccatgtgtctctggtatacacatatgtatttgtccacgcgtccctttgtgtacacatatgtgaatgtgtttgtgtgtccatgtgtccctggtgtacatgtatgtgcgtttgtgtgtacatgtgtgtgcatgcacatatttgtgtgtatgtgcgtgcacgtctgtgtgcatattctgcacatgagaaccagaacgcctgcatgcctagcagacaagatgcctgctgtctctctgtggggtttggagaagcacatcagtacagtcaccaggctgcctaaaacacgacaaagcaaagccaattagcaatgctgaggactctcaggccaggatgccgccctaggctgccttcccaagtcagctagcttgacaaaagctttcatatcagtgcctgcaaaaacaccttctcagcacacagctcaaatgttattaaataattccatggggaaataagactttatacacaaaagtttgctttataaataatttgtcagtaatgtatagtaatgcatgcattcataaatcatggttaacagaagcagagacacaaccggatacgacttcttcagaaggcctagaaaaagagtctatttgaataaagcccagagggcctatagaatccaaagtatgcactcccacaataccccaaaacaaaagcaaaacaaccatgacatttatcctacggacattctaatgctgatagtaaggttaaaatccccgtccacataacacacccacacacaaacacaaactggctgttgccactagcgctccgtggggctgaagatggcaagaccccaagcctcaggctggcatttccagaaaacaccctcgctgccacgcctacacaaggggaagactggcagagacggctccttcctcctgacccagaagccaggagagaaagctgatcagtcgcacaggccgggacccagcatgccctgccactctggcaggtcctcaggcaggagtgtgagctcctaatgtctcaggagagacaggggaggagagaggaggcagacgggcaggagggggcctgtccctccagggtcagctcagccctcagagccacttgtaggaggtctgggcacaatagatacagtgactcctctgagaagctgcactgtgatgggacctggggtatccagcaaggggggcgtgaggctccgactggctgagtctgtgtcagcgtcagcaacagtgcccatcccgagctctttcccagcgcaccccaggacatggtggaaggtggaagaccctgcctacgggcagctcagagagcaggtggcagaggccagggtcggcctgcatgcagacaagcaggccgggcagcgggaagaagctcccggaaagatgggagcaccaggccacatggagcttggacagggcaaggagtcagggggagggaggtaacagcccctgggaaataataaagcacacgaacttgtgagacacaatcccttccccagattcccaactgtgtgatcctggcagggacccagcccaagcctcaggggctcacaggcagcgatgggccaaggaagggcttcagggcccagcgactccctgcaaactgagccctgtcctgcacaggtgagaagggaagggatggctcccctgccagttagagacagaggcttggtgcctgggggactccagccacccatcctgagccagaatgtggacgtccactccatagagcacacgaagaggataaaacagcagggtgcactccgggaccgcaggctccccccagcacacatgggtccctgtctgggcatgcacaccgccaggacacagcagctctgtggaagacgccatgcagaagcctcttcagggcaccgccatgagccaccctcagaacctgagctccaggcactacggacgattttaggaaacctgtgtctgttgcatttcgaatattctgacggggcttcccgttatttcaggagaagctaattccccacacagttagtgctcaggagggaggaatctaggagctcacttggccctaaagcccgtggtggctgcgccgtacttctgcccctcctcccgcggtgactgtgacaacaggaggggccacagccgccctgagcccctggttcccaggtgccagtggctgcagcacggaggccacctacggttcccagagcacgaagagctcctacgtccagcaggggatgttaagggtcacaccctcgaggccacagtgactgccccaaagtctgaggcctccccggttcactcctgcctccctcccctgctttcctgatgtaaacacagacacaagcatacacacttgcatggacacacaggcactcacactcacagatgcacactgcaacacatatacacacattcacacacaccgcacacacattcacacactgcacacacattcacacacactgcacacatattcacacacactgcaaacattcactgcacacacatacacacattcacacacactgcacacacacatacatacattcacacacatacacacattcacacacactgcacacgcagattcacacactgcaaacattcacgctgcacacacatacatgcacacacactgcacacacattcacacactgcacacatacacacattcacacactgcacacactacacacacattcacacacagcacacacattcacacacattcacacacactgcacacacacatacattcacactgcaaacattcactgcacacactgacacactgcacgcacattcacacatacacacattcacacacactgcacagattcacacacattgcgcacacatacattcacacactgcacatatacacacactgcacacacacattcacacacactacacacatacacattcacacactacacacattcacactgcacacattcacacactacacacacatacatacattcacacacattcacacactgcacacacatacattcacacacactgcaaacattcacactgcacacacattcacacactgcacacacacattcacacacatacacacattcacacactgcacacatacagattcacacacattgcacacacacattcacacacagtgcacacatacatattcacaaaatgcacatatacattcacattgcacacacacatcacacacaccacacacattcacacactgcacacacacactgcacacacatacacatatacacacattcacacactgcacacagtcacacattcacacacactgcacacacattcacacacactgcacatgcggtacctgtgtgcacccgcatgtgcctactgtatgcatgcatttacacacttgtgcatgcactgcacgtgttgcactcacagtcacatgtgcacaccgtgtgtgggtgtacacacagctgtacctactgcacatgtacatgtgtacacatatgagcacacacatgcacactgtacacacacgtgcacatccacattcatccacaatgcacaaacacatgcacacacacacaggcacacacacacagccatcttctcccgaccgcatcccacaggaggggcttcctcaccccatgctgcctgggtttggggcaggcccatcagcatctgctcagcttgctctggaggactttgccccaccgttgtttgtgtatttcccatcgctctgccacagagcctctgggtgctgggtgagggtctacttccaaattcctctcccgggcattccagctcctggcttctgtggcctgctggctaaggggaaggcacagccatgggtgggcgcccagcacctcaacggcccttttcccaccagggacccctccaaagcacccgtggcacctggggagaacctcctgccagttgtggacacctccctgcatgggacactgagtgagaggcacttgaaaatgtgaaagcaaggctgcaatgacggccgagccagagagcagcacctccctagcacaccctgcacccagcggaggtggctgaacacccgcgtcactcagcaaactccacggtgatgtgggccagctgaccaacttcatctagagccactgggctccctaaattcaagtccaactctacccctgccactctcacgcttcccaccttcatcttccagtgcaggactttggagcggcaaacggttattatttagaaggaggtcacatggtgaaagtccaagcctcctcaccttctagtcaaggcttgctgataacattgtccctaacgaacagccgcagcagcgcgtcaggcagaatgagcctctgtttagagttggtaacgaccgcctgaaaatgtcgtggtagaaataaaaccatgcaattcagtaggggaaataaaatacatatccagatggaactgcactgagacgctggcacactgacatctcaagttagacaatcatttaccactcaaagcaccgtggagtgaaggtagcttcccagggcagtttgctgagctcttcctgcgtgctggacacacacggtccaaagatcgtgctgagctcttcctacatgctggacacacacagcctgaagttcaccgcctaagccacactcctgtccatacgacagatcgccatgggccacacgtgacatgtgcatgggtacctgcagcagccggtggcagcaggtgacagtggggaccatcgagatggcccttgcaacagtctaggaagagactcactgccccagattcacctcgagactccaaatggtctcaggtcccttgcggggaccaaaggccgggagccaggagccgtgggctctctcctaatgctcttcctccatgcccaggctccaggactgcctcaagtgtgcactgaaaactgccccattccgaaaagccagcttgcaccttcttgttcctggtagggttccagaacagcgatgctgcttctcacgtggggtccctggtccttgctggcactttccttgatgcccgggaggagctgtcccatggagttttggggtcctcctcctcttccctcccttttctgcctttacacgaagagccccctgaccctcacctgctagagcagtcgaggtccgcctgttcacaacagccctcctggccatgggctctcctactccaggccccacagcccccaagcctggtgacattcccccaggtcactttctatctgctccaggtaggctacctcccagcccccaaggtagtgcatgcttcgtatgtgttccgcaggcccctggcccggtggagcagtgacttgctcagaaactagcaaggcctctcggtagtggcctcccactgacctggctccccacctgccatccactatgctcctggtgctggaaacacccccatgtggctcagagtggtccccagaggcccctgacacagacacgagcacatacctgcaggcacacacctgcaggggcacacttgtggatgcacacctgcaggcaggtacatacctatgggcacatacttgcaggcaggcacccacctgcgggcacacacctgtgggcacacacctgtgggcacacctgcaggcaggtacacaccgacgggacacacctggaggtaggcacccacctgcaggcacccacccacaggtgcatatatccccccatgtccaccctctgcacagcccccttgccaggctgccctctgcacatttctgtttggtcccagactctgggtgaagggatcacctggtgccatcatcagtctatcaccagccctcagagaagtgcctcagcaggaggcctggcagaactgtgtgaggctgcccagcagcacagccccgggtacacagcgtggcatttgatgagtacagctggaaatgaatgagcagaggcaccatgaggacatggtccaggcacacatcaaaggcggtggccagaggccgcctggctccccatcagcaggagcttcagccctgcctttgggtggaggcccacagagccccgccatggaacacagaatcagagtctgcgtgggggctgcgtccaccccatctgtttgcccagcttctctctctagcatgctcagaccccacagaggcgcagggctccttcgcctccccaggggttggggacccctggtctggaggaccagtggggacagtgtctgctgcggtgtgatgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggtgtctgctgcggggtattgtctggcagtgaggctggggatggtgtctgctgcggggtgttgtctggcagtgaagctggggacggtgtccgctgcagtgtgatgtctggcagtgaggctggggacggtgtctgctgcggtgtgatgtctggcagaaagagccggggccagtgtggctgtgagcatcaggcctgaattccgtgaactgaggaacagcctgacagagggacccagcagcagcggcctcaggacaggcacaacggccacttcccggcttaacctgggcagagagacgagagccacttcccggctttaacctgggcagagagatgagagttctgtaatttttgaagattgaattcagtctgataaataattcaaagtacattgcctgaccccattaaaaaatggagttcaaatatgccaaatttttaaaacttcatccattggctgcacaaacaggaaagtgggctccagtggccctggctggtggttcagatgccgctgtggggccggccttcaggggtggtggggtggcccagctgcctccaccccagctccctcccacgtctacatccaagatgtctggcttccactttccgtgtcactaaagggcggggaagctgcaggggaggtgcctcatctgcagcgtcgtctccagtgactggcacctcagacagccccacacccgcggcaggtcccgcctggcactcgggaagctcttgcatttaagagatctagaaatgttgacactttgcgtggaattttaaaagctgcttaatcaggaaggagccagtcaggaaaagggacctgccaacctgcttgttagccgagcagcgaggcactgtgagcacacgggatgatgggtgctgggtgctggagttgaccggctggcccggcagagctggttcccgcggggaaccccgggggcgtggtgctcacagcaaccttgttagaagggacactggggagggtgtgtgctctctccatctggagccgcctggaagccagggagcatgtttttgtgtgagtgttgattgtggacaacgcccagaccctgcctgcagcacagaggaattccaggtgtcaaagcgataggaattcagggagatgatggacgtgggctccacaccccaccttccacctcaaggaggtggcagtgggaacccttacacgggggtgactgagcatctgagcgggatcaccgtggcctgggggcctgcccctcgcccctgagagctcctggttagagccgttgtgggcacagcctaagcttctgcaggccttctctctcacctctctcatatccttccatcatttaagtagattaaactcagaaacatttttagtgctgtgtacaaaccaagggcagcaaaaaacccaacctctatgccaggctgagcttctgttcttcctgactctacagcaagagctctgggcatctctccacgtgaccagctgtgaccacggacttaggaacactgtttcctacctccttcacctcacctccctgccacctccagcccgtaatttagagagaagctgatgcagttgactcttcccagcttgccatttaaacgcacactgggttatgtgcacagagatgctgccccagtgactgtatttgggtaactgtttcaccctcgtggtgtgacagcccatttgagcgctcttcaaggcacgagatcctcagcaccgtcaacaagtctgtgtctcacctgcaatcacagctcattgagccgccagctaattagagagcccctaagtgaatcagtgacacaatgccgcctgcaaaagcatcagagccgcggccgcacgcacacagagcggggtgtgagatatcccagccgcacacacacagagcggggtgtgaaatatcccagcccagacgcgtgcacacggggcgggtgtgaaatatcccagccgcacgcacacagggcgggtgtgaaatatcccagctgcacgcacacagagtggggtgtgaaatatcccagccgcacgcacacagggcgagtgtgtaatatcccagccgcatgcacacagggcaggtgtgaaatatcccagctgcacacacacagggtgggtgtgaaatatcccagcccagccacaaacagggcgggtgtgaaatatcccagccacacgcacacagggcgggtgtgtaatatcccagccgcacgcacacagggcgggtgtgaaatatcccagccgcaggcacacagggcgggtgtgaaatatcccagccgcacacacacagggcgggtgtgaaatatcccagccgtgtgcacacagagagggtgtgaaatatcccagcccagccgcacacagagagggtgtgaaatatcccagcccagccgcacacagggcgggtgtgaaatatcccagccgcacacacacagggcgggtgtgaaatatcccagccgcacgcacacagggtgggtgtgaaatatcccagccgcacacacacagggcgggtgtgaaatatcccagccgcacgcacacagagtggggtgtgaaatatcccagccgcgtgcacacagggcgggtgtgaaatatcgcagccacattgttgttgaaagccgttgccgggcctgaaaatcgcagctttttgaacgcacacactgaacctccccggctttgttttctaggaaggacgtggcggctgctgcccaactttgaacggaggagcacaggaggagctccaaggcccctcaggagtcgccactgttgcctccggtcacccccaccttctgttggagtggccttcagggaaaatgccccaaaggggcctcctaggagcccctgcccgaccccgccccagatgctccctcccatcgccaaacctcgtctcctcatctatggaaggagaacaaggagacggccctcacctagcagtgtaaccctgaatgccaaggccatgcctggtgcagaaaggcccaaacaccagcctcaggaggcgcggccatccccgtcatcacacctggtttctgctttgacctttgctgccaataaatgtgagcagctgccatcctgtgcccagtccccggggcatacctgcagcccaggctggctgtctttgcttcccagacacctgggaagtctgggctctggggaagacattctgcagctctaattttaaaactatttggcattttcaaatccagttttcaagtccctggggtgggtaaaggatgcttcaagaagaaagtgctctgagccagagtaggaacaatggtgaagggtccaggatggcacaggacgggagcctgccaggtggttctgccagggcccaggaggacagcaaagtcagctgacggctgggaccaagagacagaaacagagagacagagacagagagagacagagacagaggaacagagacagagagagagacaaagggagcaggagagggacagagacagagatagaaagagacagagggatagggagtcggagacacagagacagagagagacagaaagagacagagagagacagagagacagagacatagagacagagaaacagagagacagagatagagagacacagggagacagagagaaagaatcagagacagagatagccagagaacagcagagacagagtcccagcagttgcccgtccactctctgcctgacctgcaatctgcctcttctgaccttggatgtgccccaaccagagcttttgcaggaggggctgctcactgtggaggggagcccagagctggaccatcaggagacccaggacagacgccccacagcaaaagccaggacacctgaactggtcaggccagcagtgactcagggcctggagagccccgtgggcagaggctgcctggaaggctccaccggccaagggcaggtcagcaaggcaagtcatggccagaaggcagaagggccagcacaaaggccagctttataggtgcagagcgggagccaggcgggggcactgggagcacaggcatggttctcggggtgaggacgcctccttggccccactccatgtcactggtgactggtcaacaaggtgcaagctgctaccttcacagagggtgatcctaccggagacagatgagcctcactcactggccataacgtgcccccgaccccctggctccctctgcctatgaccaggccaggccccctgcagtgggtgctgctatcacaattgagggctgaacaccccaggggaaactgagtcctttcagggcagtaataagggaaggtttcgaccactgttagctgcagaagggccaacccctttacctggctgtccctctccctgggagcttgctgggccacccctctactgggctgcccctctccctggggtgccttctctacctgagccgtcttctccacctggaccaccccgtccacctggaccacccctccacctggaccaccccctcacctggaccgccccctccacctggatgaccccctcacctggaccgcccccccacctggaccgccccctccacctggatgaccccctccacctggaccaccccccccacctggaccaccccccccacctggaccacccccccacctggaccacccctccacctggaccaccccctccacctgggcctccccatccacctggaccacccctccacctggacggccccctccacctgggcctccccccaacctgggccaccccctccacctggacgaccccctccacctgggctgccccctccacctggaccaccccctccacctggggtgtgccagagggagtaactgtgggatggaaacaaaattcgactctagtgggtggccaggagaggtcacgtgctgcttctcttgtgttgtgaatgcagcggtcagccgcaaaacaccaaatgacacccagtcactggaattcttggattaaatgcttttgatgcacatatatcctctccacacactgcataattaactgaatatccgacaatcggcagatccatactgttgaagctggactagccacaacttatcattaaagtattcaattacataatttataatgaaaagccacaatcaacgctaagcaataccaatggtcacaattcatcagggtccttcccaaaactgtgggactctcagcagagtccacatgcacgggacgggggcaacacagccaagccccatggggcaatccagcttctctgcagacactgctggcttttagtttgtgccaaattttaataaacgttaataactcacttgataggtgtctcagcccatgcaggctgctataagaaaataccatagcttgggtaattgataaacaacagaggtttctttctcacagttctggagatacccacagattcggtgtcggtgagcgcccactttttggttgggccttcccctgtcatctcacagcagaaggggtgaagaagcgtcctgaggcctctttcagaagcgcattagcccatccgtgaggctcttcctcagggcctcagcgccttgcaaaggcccctaacaccatggccttgggtgaggatttccatgtaggaactggaggcgtggggtaggcggacacaaaccttcagtcgctatggcaattgtgactaataagtaatttgtacttatatacaaaaatgaattcgtttgacattcttttagggttaaaagctgcaccatcaaaagacggtcaggttgttccctcctcatttaagccaattttaaaacgatttttcctcctacaacgtgaaaatgatcacagggtgccatcaggtgactatgcacacttcgtgctgagctggcagaggagggtctagagtgaagcccatctcaagccaagtggaactggtccaaatggaaaaacagccccccgggacgtcttgtcttcggagagccgcgtctccggggcccgggcaggccctgtggtctccctgcctgggctgtacttgctcagccttttgcaactgcccggtaccaacggtcaaggatgagaattgcagcagagctttaaagacttgggtcccaacgtcactgtctattgactgagtttttcaagtggtttgagtcagaagtagggatataccttcaattagagtcctgaattttaggcattacttaccaaaaacactgagcaggtttgcccagaaaatacagtctgcatggaacttccacatcccctcactctctaccagaacggcagcccacctcaaagacaccgcacgcggcccacctgccttgcaccccagacaccagggttgaaagcctgagtccaggcaggagccaacctcacagagtcaaatctcggagcaccaggtgaggggaggtctcagcgccactgccgggataagccctcaggatggagacagtcgcatctgccagatccctttcaccagactgcagagtgaggtgaaaccagggcctcataggtgtgagggccatcggggaggtgccgccggcagaaggagaggtgggaaggctgagtggatggaaggatcaggaatgaccaggaggaagctacagtcaatagctgatggggcttggctgtgttgccccccagcccggtgcatgcagactctgctgacagtcccacggtttgggactctcgtttcactcattcatcatttattgagcatcagggaatatgaaagtggccatgggcctccaaacagctcagaatgtaaaggggaagagctctgtgctgtagctgcaactccagccacaaggaagacaagacccagggctgtgggacgaaggggagagaggactcaggccccagctgcaggattcgagtgcccttcgggagtgagctcgcaggggaggaaccctcctaggacagggcacgtggagctccaggcagcctctccagggccctgcgtgtgctgtttctctgtcttgaaaatgacaccgaacgtttatggccagtgagcacccaccgcaagcccacactgtgagctccttgcctgctggggaggccaggagatgcagaaccaagggcagaagcactgcctgcagccctgtcccagcgtcgtggatgcagacacgggaggagccgcagacagacgcgggaggagccgcagacagacgcgggaggagccgcagacgcagggggagccgcaggcacagggggagccgcaggcacagggggagccgcagacagacatgggaggagccgcagacacggggagccgcagacacagggggagccgcaggcacagggggagccgcagacagacatgggaggagccgcagacacggggagccgcaggcatgggggagccgcagacagacatgggaggagccgcagacacgggaggagccgcagacacagggagccgcagacacagggggagctgcagacacaggaggagacacacaaggagccgcagacacagggggagccacagacagacatgggaggagccgcagacacggggagccgcagacacagggggagccgcaggcatgggggagccgcagacacagggggagccgcagacacaggaggagacacacgaggagccgcagacgcaggaggagccgcagacagacgcgggaggagccgcagacacagggggagccgcagacacagggggagctgcagacagacatgggaggagccgcagacacagggagccgcagacacagggagccgcagacacagggggagccgcagacacaggaggagacacacgaggagccgcaggcacagggggagccgcagacacagggggagctgcagacagacatgggaggagccgcagacacggggagccgcagacacagggagccgcagacacagggggagccgcagacacaggaggagacacacgaggagccgcagacacagggggagccgcagacagacatgggaggagccacagacacgggagccgcagacacggggagccgcagacacagggggagacgcagacacaggaggagacacacaaggagccgcagccacagggggagccgcagacgcgggagagccacagacacagggggagccgcagacacagggggagccgcaggcacagggggagccacaggcacagggggagccgcagacagacatgggaggagccgcagacacggggagccgcagacacaggaggagacacacgaggagccgcaggcacagggggagccacaggcacgggggagccgcaggcacagggggagccacagacaccctcacactccgggatctagcgtgtgtggacgagcccgaggcgctcggcccagcttgtcagcagccttcctgggaacgctgtggaaatgtgtggaggggccgcgtggcttcctgctgcctgggacgacattactgcatctgcatttgaggtgtggggcccagaggggctcaggtaccctacggggggagtcaccccatgaccaggaatcacgctgtggccacacacagggagcctgactgcagctttctggaggagaacgtggttgcatttcacatagaaacacaggtcattttgtttctgaagaattcattccgaatatttatttgctacttgacaaagaagagacttcatcagggataagatctcgacaaagaccatctcctggctgccttttatattcaaatccaccacagatcaactcctggggcgtagcagagtcctgtctccccccaaaatagggagcactttctgattgtggggttcaaaaagctgccttctgagggtaaagggtgttcttaccaggaaagaggagacagaacaatgaagtccccaggggccggcagcagtgccgaggagccccggggaagagctcaagccagtggccaagcctggaccagcctccagcagggacagcaccgtggctgtggggacagtggggacagcgcctcggggccacagagacgtgctccctggacgttggcccaggtgcctgcccacttcctcggagggcctctgaacaagctgcagggctgtctccatgggaaggcgcgcacctcctcacgcctctccagggaagccacagcttcactgtgctggcagacccactctgttttttctacattgcctagagttcggctatttttctcttcccaaagagcctacccagcaaattttactggacaaagtgcctggaacaaagcagccaacaataaaactggcgtgcaccccatgaataaaggcgtcgcccagaaaatgctctaaattaggatttaattgctagaaattactttcaattacaaaaattgcaataaattacttgttgaatagacacattctttcaccaccattaataatttaaaattgctaattgcacgtaatcgcaagtaatttttgttctttggtgagaatcgaggtactacgttatgtggggtgggtttgccagggctggcccccaccctgcgcacctccacgtgtggcaggcagagccgaactcccagaagaagagttgcagtgatggggcctccaccgccaaagccacggacctggtgcagttcataaggtggcctcctccctccatcagcccctcagggacaacaggtggccaagggggtgaccttcccaaggagctggtccctccgccatcctgagaacagtgaatttgtatttgcagtaaaacccagattctccagaaaacgtcttgctgtcagcatccccgccgccttacacgtgctatggctgccctctgactctgctgcctgacttttatctgcacaaatcctacagtctcctgggagcccaccggtcagccagctgcctccaggggtgcgtctcctctcagcttcctcttccatctgaaccttccctccctccccaagtgttcgtcccttgtccacctggaaagcctctctgcccttgaagcacagctcctgccctggccccggcaggctgtaaggtagcacccccacatcccggtcctggtagcacccccacactctggccccaacaggctgtaaggcagcacccccacaccccggccccgacaggctgtaatgtatcacccccgcaccccggccccgacaggctgtaaggcagcacccccacaccccggccccaacaggctgtatcaccccccacaccccggccccgacaggctgtaaggcagcacccccacaccccggccccaacaggctgtaatgtatcacccccacaccccggccccgacaggctgtaaggcagcacccccacaccccggccccgacaggctgtaaggcagcacccccacaccctggccctgggcagtcgtggtgaccgcatggccttgttggtagcttccttctttattaacttggccccatttattaaccaccagcttcctgagggatgaaaccatgcttccagcgtttccaggcccacacagcactgtgccaggggctccagggaagctgatggatgtgggtgctatgacaccagctgctgcggggccctgatgccatggctgggaaggacgtcggcctggggacgctcagctggcaggatatgcctccccaggtgtgcgggcggcctcctcgtagtggaggcaggggcggagggtgcgaggcatgccactgtgagctggggccgagggggccatatgctcaggtgctgtctatcagctctggagggagaagccaaactctcaggcagcccacagcggggtgaggaccgggctccgtcccctctaacagggtggggtggggggcactgactggtcggaccctgcaagatccccacgggcaagagtggctgatcagagctccatgaacagccccttcgtcagaagccatcctctcacacacgtgcacacacacacacacgtgcccgcacacgcacacacgcgcacatacacgtgcacataaacatgctcttctcacgtcgcagtggatttctcttgcactgttgctttaagaactgtcagagcggtgagatgacggcagcctgtgcgaatcggcctccagcctcctcggggtcctgcccactctgttcgccattcggtcccacacctcagccacaacgggcagtcagggcttcagccactccacgggcaccaatgctgaagaccacagaggaatgtgctccagacggaggaggccgggcccaggcctgatggagacacggacgtttgtacctgaagccctcaagtctgccctataaaggagatgaaccctgaaaacactgacccctgaaatcagcaagaggaggcggctacagtgccaggacctaacccgcgctctcccaagtctcctcctcatcacacagctcccgaggcctgccagaagcaccccttgaaggcactgtcagggccttgccacactgctgcacgaggtgcacacgcaggggctgggacatatagctctggccttgcctccaagtctgtctccaaaacaatgagctggggaagagaaactctgtacggtcctccctactcccttgcccggccggggttgtggtcaggccaccctgggaaagaggagcagcccagggcagctacagaggctcctcctcccacctggggagaggaatccgccttcagggagcagcccatgccctccctggcttctcctgtctggcatcacggctgcggcagagtctaagagaaaggctctcagccgggcaggaccaccaggcacacaagggggggatgggagttagaggtgccagccctgctcctgacctccctgacctccagcacataacagggaggccaggtccttgtctgacacacccagagaatcatcagatccaaggcccggggtggccggggaccaagtatggctcctatgagaaaacaggcgtctgcaggaggcctgagcctgccccaccagcctcagcacgtaacatgtctagaacattcctagagccagaaggatgtaggaacttccttccagaatacacttcccagtggacagggaaatgggaatcgaatgcagggaccacccaccacctgccaggggacctctgaccccagggaggaggaaacaaggtcaaatcccaagaccagcctgtgcaacatgatgaaaccccgtctctactaaaatacaaaaaaaaaaaaaaattcagctggacgtgaaggtgggcacctgtaatcccagctacgcgggaggctgcgggtgaaggtgggcgcctgtaatcccagctacgtgggaggctgcagcaggagaattgctcgaaccggtagcagtgagctgagatcgcaccatttgggcaacaaactgaaattctctctcgaaaccaacaatcaatacaaaccaataagcccagaacccacaacttcctgatgtagatggacatgttgtgtccggaattggtgggttcttggtctcgctgacttcaagaatgaagccgcggaccctcgcggtgagtgttacagtttttaaagatggtgtgtccagagtttgttccttcaggtgtgtccagagtttctttcttccggtgggttcatggtctccctgacttcaggagtgaagctgcagacctttgcagtgggtgtcacagctcataaacacagcgcatccagaattgttcattcctcccagtgggttcgtggtctctatggcttcaagagtgaagctgaagaccctcacagtgagtgttacagctcataaaggtagcatatccggagttgttcattcctcgtggtggatttgtggtctcactggcctcaggagtgaagctgcagaccttcgaggtgagtgttacagctcacagacgtagtgaggacccaaagagtgagcaccagcaaaacttactgtgaacagcaaaaaaacaaaccctccacactgtggaatgggacccaaccggtttgctgctgctggctctggcagcctgcttttatccccatatctggccgcacctacatcctgctgattggtccattttacagagagttgattggtccattttacagaggctaactggtccgttttgacagagtgctggttggtgcatttacaaacctttagctagacacagagtgctgatttgtgcatttacaatcctttagctagacacagagcactgatgggtgcatttacaatcctttagctagacagaaaacttctccaagtccccaccctcccagcagcccagccagcttcacctctcactggtactcgctgcaggactttgtggcccctagcccgggcactccaggcagcccaatgggagctcgtcccagacaaccaagagaaaaagaggggaagcgagaaagagacagagacccaccatcatggccaacgacccagggaagagggaatggcagtcctctcacgggatccagcctccaatcaagcccagcaggtgccggccagtcccacggagtgccaggcccgctaagcccgtgcccacccggaacctgcgccggcccacaagccccgtgtgcagccccggctcccatccgcgcttctccctccacacctccccgcaagcagagggagccggctccggcctcagcaagccccagagaggggcccccacagtgcagcagcgggctgaggggctcttcgagcccggccagagcagacaccgaggcagagaaggcgcccagagtgagcgagggctgctagcacgttatcacctctcaatgtggacttgaccccacggtgtgccaggtaaaataaaggtctccttagttccgtgaagacagtcgaggtctgtgcacttaatccagagccccggacggcccccacgccccaccgctgcccccgaacccacagagccccgcggcggcccccacgccccaccgctgcccccaaactgcaccaagacacagcagtttgctctcaagcagtttaaactcgtctaatgctttaactggcctgtcaaatcattgtttcacagaccgcataatatgaattgtgtcccttccatatctggaacaccaaatcctaaatccacagccttcaagcacatctggttttcccgggcccaatcggaaagcaggtcctctccggcctgaagctgcgaagagaggcagcagccatgagaaggtggctaaccccgtcgggggccatggctgcctaggggaggccggcagagcctgcctgggggtcggtaaggacgctggctttggtctgacaccggcagggagggacagcgacgagggcaggagccgcggctctacctgggaacgcaggatcatctctactctgacggctcagcctctgcacacaaaccatccttctgcgtttaattggtcctctccaggggatgttttttgaaactaggtctttgaagacctttcatagcagccctgagataccgggtggagagggcagatggagagagaaccaggagatgaaaggaggagccgagagagcctgggggagccggacgggtgcggcccgacactgcgtagagacgcggccgtggagtttctccaccgtcattaaaccccttttttgctgaggaacgtgttatcaattttaaaattttcccaaatgttgaacaatggaagtgttgtttgcagagagagctcaactgtctaaagtagagaaatagaaggtctcccgagactgaaatgacaaagatggaaagcgggaggggaggcctcacggcagctgtgcccagaaccagcacgctgtgaacaggcgccaggccctgcgccggcccacggctacacggtgctctggaaacataggctagcgagagtctaaagaggtggtgcaggctcaaagccatgtgctcgtcatcacagcttccatttaaatcttgagggctgggcgcagtggctcacgcctctaatcccaccactttgggaggccgagtcgggcagatctcttgagatcaggagttcaagaccagcctgatcaacatagtgaaccccacctctactaaaaatacaaaagttagccgcgcttataatcccagctgcttgggagagtgaggcaggagaatcacttgaaccggggaggcagaggttgcaatgagctgggatcatgccactgcactccagtctgggtgacagagcaagactccgtctcaaaaaataaaaatgaaaataagcaaatacattttgtgtatggtttaaaagcatataaaacagtagtagagtcatacacatactcctaaataacaaaggcaaataggaataccaggagtgcatgctttgtgtgttttcatcaagaacatagtcaccaaaatccaagcggatgggcacagccatttgcatgtaactttacagtataagagacattgtcatatgcccacagtctgctatgaagacacagatccagactggctaagagcacagaggtgcatggaaatgctcgggtgtgtggtgtgcgtggtgccctgcgcatttgtgctggctttgcacccccctcctgccacgtcccgtgcaaacgctcaggtgtgtggcatgcctggggccctttgcattggtgctggctttgcacccacctcctgccacgccccaaaccccaaggagtccaggagccaggagagcccaaaatccccatccatgctcctagaaaggaagtttcttgacaaaggtctgagtcaaccatgggtaaagccagaataaaccctgctagttcttttgaggtgtgaacagtctcagctactctgagccccgcataactcactttggtcaccagaggagcaggatttacagggtcaaaagccatttctccttccagaggctcccagctcaaagcccagccatcgtctcccagacattttgggtcgcatggaaatctgcctcttaagagacctggcctcctgtctagggttagagaacactgtgttcccagaagggacagtcaggcctcaggatcctctcctgagaagccctgaactcaagtcaaactgagcctgtgttaacagggtcctttgccgctaagaacccaactgtctcaggagtggctctgcctttttttttttttttcctttctattttcagacaaatcgtcactcagcatagtaaacccaagatataaaaaccaacaattgagtaactggtcttttccgtctgtcttgggaaagtagcttatcaaaagtaagatgaaaaaagagtattttattgttaaactctataatgaagcaactgtctttgactacacaatgtgggaacttgccagtgaatgtagaagtactgcggggccatgcgtcagaggtgtgtgggtctaggagacgcagatcaggagtctggcctggctcagatgtccacagccaggaagccgcgggcagagcagcggggtcgaggctgcggctgagtttgtgagctgtggcagccatacttactctgcagggcatgttgagttctgaaggagacagcactgctgaagtgagcacagcagcaggacagacggctgatccctccttgtgctcccacacacagcagcgagacacaaacggctcgtccctcctggtgctccacacacagcagccggacagacggctgatccctcctcgtgctcccacatgcagcagccagacacagacggctcatccctcctcgtgctcccacacacagcagccggacagacagctgatccctcctcgtgctcccacacacacagcagccggacacagatggcttgtccctccctgtgctcccacacacagcagcgggacacagagggctcatccctcctcatgctcccacacagcagcgggatatagacggtggtccctcctcgtgctcccacgcagcagcaggacatagacggctcgtccctcctcatgctcccacacgcacagcagccggacacagatggctgatccctcctcgtgctcccacatgcaggggcctcagctctcaggaggaaaacactcttgagagaagagaactgaggaaaggtagcgctgatgtcaggggaagacgcattcgacaacacgcatgaaaaaaaacacttcttgttacgttcatgccatgcttttgtattcgccacaataagaaaaccaagcaagtacttcagtcaggcggcagccgtcacaggtaaacaaactcctatgtgggaaatgaaccgaggctgtgagcctcaggcagctccccagacccccaagaggagagggagcagtgaccgagcaggccccgtctgcagttcacaccgtctgccatccgtcccagagcccagcctcttgtagccaagacggggcaggagacagagcaaaaccactgagaccaccactgagagggtaaccaggcttctcagtagaaccaggggcttgccgcagggacgggagctctgactggccacgtcgtggagtctgcagctgcccatggtggagggaatggcatgcaggtgacaaggacatagggaccttgctgtggccacccgccggggtcacagcatgtccacggcaccctgatggaagctttaatcatcaacggtgttggccgccaatggcataatgaccggacctcaccccacccgcagccctagtggacacgcccatgcaggtgatcagcagtgccgtggcagccacagagacaggccaccaccactcctcaggccactcaaagccaccagcccctccctaatggcctcctgagcaccagaaatgcagaggggtgacagcatgtctcagaacacactgtgagcacagacctagaatcaccacgtcgttcagaatcgccacctcacagagaagcaaacccaaaggcagccagcgtaggagccttttcctcaggagggctgtgtcctgctcctaaaacatttccagggttcgggcatcaagatcagatcacacgttaatcaatcacacgtttaagaacgcctgaaagacatgttcatagctatattcgatgtcgttggattttccaacatggactgatgctcttcaattctctcaagcgcgtttacacacacacttgtttgcctgtgtgtttttgtgtccaatgtgtgtcgtgcacaggtgcaatccaagtgtgcaccggactcacaagactcagtattggcagcgtcctacatttagagagaatccagacaaacagctggtgggcactgggcactgttgtgtgccaggaactctccgagtcagccaggcactgggcactgttgtgggctgggcactctccaagtcagccgggcactgggcactgtgtgtgtgccaggcactctccgagtcagtgtacatgaatgcacttggccctcttgatgctctatgagtaagtgctgctgggacacacccatttcacaggtactaaagctgagacagagatccactctgcaaacccttgcccagtgccactctggtaataggaagagtgagaatttgagctcaggcagagccactgtcggtggttttgacagaaattatggactctttctgaacttcctaatgagaatttaggaggctctcaggtgccccttcctgtcccactccatagtttggcgtacggactccgcttattcctgaccctccctgccatcccacctctgtcccctctacccacacctcccgcaggaaggcattcccacccagctcctctgcccgcatccaatggagtgagcaggtgcaggcgatgaatgtactatcaccaataattttggaacttctactacatatgtgtatctaccacatgctgcctgagctcgttgagctggacttttaaagcagcagtgcctcaatatgcctggcctggctggcacacgccgcctgcctagattgcatagggtgagcagtctgcctgtgcccccacgagcccggctgtgcccatatgctgacgttatcctccactgggtacaaaaaggatgacaggaaccctcctcatcacgctcgtcatctcagtaattccctgggagcttttgtttgttttttgttttgtttttctccctgcatctgtcttgctgttgctctcagtggaaaacatacaatatttctgacgtgcccaggctttgggccatgctgcaaatgtatcctgccattgtgaaatgaccttcactgcgctcctgcccagaatgtgtgggaagaaaagggcactcgcggtcccatgggccaaacaaaagagtggtctgggggatcctgtgctatgtagggacaggagaaggtgccaggactcctggtgaacaagacattccaaaggccaagcattgctaactaatgcaaggctgcaggagagaccagcaaatgacaatagccactctcctcagaaggacagggatgtgcccacgccggcttcaactctcccgcccaaccccagcacaagcagagctgagcgctcaggtcctcctccatccatgctgctcctgcaggcgggccccaggaggctggacctgctcttgcctgggtacagcaggcagctgagccccctcctctgacaccagcatcctgtgtcccagccctgcctccacagcttctcctcatcaggcctgccattcccacaccacagagcatgctgctgtaagaggccaggtgtgaagagcccttatgctctcaaccttgtctgatcagggtggaatgaggagtggaacagcgtagagcgcgggctgtctatgtcagctacaccggctaactccggcaaaacctcagtccttgggttagggagacaggtgacaaccccattcgcctctgagctagggaagtagagatgctctatacctgtgtccacacccctcagaggacaccaaaggtttcacagagagagctccacacacctctgaggttggatccagccacacagaggtgtctgctatgcagcaagctaaacacaaccaattcctggtgttgggattaacaagcagcagggcagaccacgagaatgaacatttatcaacagccatcgggaaacatgccctccagctctcacatgttctccaggctccctgggcaaatggagtcctaagtattttatattttttgagctactataaatgggattattatctgatttctttttcagacagttcattctcagtgtataaaaatgctctttatttttgtctgtggattttgtatcctgcaaatttactgaatttattagctctaacagtgtttttggtggcatctttaggattctatatgtaagatcatgtcatctgcaaacagggacaattttaacttcttttgttccaatttggatgccttttgtttcttccttttgcctaattgccctggctaggttttgcaatacagtgttgaaagaagtggcgagagttagcatccttatctggttcctgatcttagaggaaaagctttcagcttttcaccattgcgtatgatgttatctgtgagtttgtcatatatggtctttattatgttgaagcacatcccttctacagtatatctaatttattgagtgtttttattatgagaggatgttgtgttttgttgtatgttttttatacatctaatgagatgatatatggtttttatccttccctcaatgtggcatatcacattaatagagttgcatatattgaaccatccttgcataccagggataaatcccagttgatcgtggtgaatgatccttttcatgagctgttgaattcagtctgctggtattctttcgagggtttttgcatctatgttcatcagggattttggcctgtaattttcttttcttatagtgcctttgtcagctttggtatcacggtagtgctgacctcgtaaaatgagtgtggaagtattcctcttcttcagttttttggaagagtttgagaaggatgagtattagtccttctttaaatgttaggtaagatcagcagtaaagccatcaggtcctgaactctttttatgggagactttttattactaatcaaatctccatatttgttattggtctgttcagattttctgtttctccataatttttcttggtaggtatcatatgcttagggattttccatttcttctgggttatccaatttttggcatataattgttcatagtctcatggtcccttacatttctgtggtatttgttgtaatgtttcctccttcatttctcattccacttgacttttctcttttttcttagtctaaaggttttcaattttgtttatcatttcaacaaacaaactcttagttccattgatcttttctattgtttttctagtttcgatgtaatctctttctgttctgatctttattatttctttcctattagatttaggcttagttagttctttttatagtaccttgaggtgtaatattaggttgtttatttggattctttcttcttttctgatgtaggcatttatcactataaacatccctcttagacctgcttctgctgcatcccataggttttggtatgctttgtttttatttttatttatctcaagagatcttttaattctctttttaatttcttctttgacatattggtggttcagaagcatgttgttcaatttccatatatttgtcaattttctgaaattcctcctgttattaatttctagtctcataccaggatgttcagaaaagatgcttaatgtgatttgaatcttcttaaatttattaatgtgttttgtggcataatgtgatctatcctggagaatgttctctgtgtttcagaagaatgtgtatttgctaccattatatggtatattctgtatatatctgttatgtccatttggtctaaaagtatagtttaagactgatgtttccttattgattttctgtctgaatgatctgtccattgccgaaagtgggtattgaagtcccctactgctacattacagtccatctctctttcttcagacatattaatatttgctttacatacttaggttctccagtttttagcccatatttataattattatatcttcttgatgaattgacccctttatcactgtataatgactttattttacagtttatgacatgaagtctattttatttaagtatagcacttctactctcttttggtcttcatttgcatgaaatatctttttcatcccttcgctttcagtctatgtccttaaaagtgaagggaatctcttgtaggtagcatatagttgggtcctatttttcagccattcagccactctgtcttttgattagaaaatgtaatccatttacattcacagtaattattgacaggcagggtcttactaatgccattttgttcattgttttctggtattttctaagtcctttttcctttcatcctctgtgtctgtcttcccttatgattgggtgattttctctagtgatatgctttgattccttactttctatctttggcatatctactaaggtttttgctttgtagttaccatgaggcttacataaaaatatcttacagttatagcaagcttttctaagttggtaacagcttaactttgatcacatttttaaaatctctacacatttactccacccaccccacgcataaactttaatgtcacaattcatatctttttgttgtagctattatttaagaaatttcatagctatcactgtgatagttttctctttttaccttcatgctaaagacttaagtgatttgtacaccaccattacagtattattctgaatttgactgtatacttatttttatcagtgagttctatacttttgtatgttttcatgttgctagttagcattcttttctttcagcttgaagaactctctttagaatttcttgtaggacagctctggtggtgattaatccctcagcttttggttggctaggaaggtcttttcctctccttcatttctgaagaacagctttgccaagtacagtattcttggttggccatttttttccttcagcaccttgaatatatcattctactctctcttgcctatagggtttctgctgagaagtctgctataaaccttcctgtaactcctttatatgtgatttgcttcttttctctcactgcttttaagatcctctttgtctttgatttttgacagtttgattataatatatctcagtatagtcttatttggattcaatctaatcggagacttttgatcttcctgtacctagatatttatatatttccccagaattggaatgttttctcatattatttaaatatgctttcagtcccttggtctctcttctccttcttgaatacctgtaactcaaatatttgatcttttggtgttatctcacaaatcccataagctttcttcattcccgtttactctttttctcctctgactgtatgttttcaaataacctgtctttaagttcacggattctgtttcatcaattctgcagttgacactctctactgcatttttcatttcatttattgtgttttccacatccagagtttctagaatttttaaaaaataatttatacctctctgtggaatttctaattgcagtcatttactgttttcctgattttattgaattgtttttctatattttcttgaagttcatgaacttccttcaaacacttactttgaattatcgggccatttgtttatctccatttctttggagtctgctgctgggagattattgtggtttttggtggtgttgtgtctccttggtttttcatgtttgttgttgttgttgttgttgttgccttacgttgatgtctgcacattttgggaagtagggacttattctattctttgtagaatggcttcgcctgggtaagcccttcatcaataagcccatgcagattctgggcgtcatctggcatgctccataggtaggcttgctattggggtcctcacgcaggctggtccaatgcctgggttagcaggtgagtgagccttggcctggatccactggagtggacctgttgattgagtctgcaagggtgaacttagagcctggcatccgttaaggcaggactggtgctagggtaggccatatacctgagtctgaaggggctgtcctggggctaaggtgggcccagagcttgaatttgtgggggtgagcctgggtcctggatccacaagggttggcctggagcctaagtctgcagaagtggtcttggagcctctgtccaaaggggctggctggcaccaggggtctattggagtgggcctggactctgagttctggagcctggagcactggggaccagcctggatcctgagtccacagggacactcctggagcccaggtcagtgagggctggttcagtgctggggcctaccaggataggcctgggtcctgtctgctaaccatggagctgcagggccagcctggtgccagagatgatgtggagcctgaggccaatggggtcaacctgtatgcggagtgggcccagagactaagtccactgggcaggtgtggggcctgggcctgcatgatcctacctggtattggggcaggcctgaagcctccgtccttgggtaccagcctggagtaggaagctatgggggcatgtctggtgctgggtttaacttggttggtgggggatcaggaggcagttttagagttagaagcaaagtctggtactcacttctctttccttcccccacatagagggcatctctcaccacaacatgctgctaggcctgggtgagaggggacccagtcatgcaaaactgttttttctgccttttcagtgcatcttatttctgtgccatgcccaggtgctatcacctctcacctggtttccttagcacttgtgaaggtatttttgcacacagatagatgttcaaattgttgtttctgtgatggatgagcaatggagagtcctctcctgctgccttgctgatgtccatctctgacgaatgttgactatgtgactctctttaaaatattcagggaaaggagcatctgattctttaagaagtcagcagataaaatgtggatgctctttgacagaggaggaggaggtctgctgagccaagagcaggatgcagagatggggcatttctgctctggggtggggagttgagaacctcatggcaggaggagtttccaaggcttgccttcattccaccccacttggtgatgatgtaacagcttccatttgtgtttcacagttttcaaaatgtactcaccaggatcaacccacttggtcttcatgactcttttgatgtggatctagctgtgttgctttgtattattcaagatgtctaatcattttcacacttgagggttctagggatttttctgatactatccactcttcccttgatatacaaagtcatatgatacagaatcacacatatttgttgatctggagaaacaatagggatatgaggatatcatttattggaatttatattttgtttgggtttttttagtctaagctctaggagcttcccctcccccaattgttataaattaactagattttggttgatttctaatgttttccaaaaagtgtttattcattggtttttgtctttaaagttaagattcactgggtaaagtaaaatagagttctgtggcaagaaacaaccctgacagatgaaactgaccctggacagtgctgctgtctttggttgtctgacttattacttctgatttgtaataatttctgaggctgaatacagtgttaaatgaaattccctgtctgcaccaatgttcctgcactttgtaactcgattcttgacttcaaataaaagtgacttcttcatatagctttgccatttactcttagagccagctaacactaccagaaccctaacaaaatcacaagaaagtttaactcaagaagagagagatgaaagagggagagaaagaagaggggagtgtaaaagccatttccaaaacaagaggcccagacatcaatttgtaattatctgcccacatgagtctaaaggcttttatttgataaggccagtaatacacaagcctgtaatgtgaattatttcaaagaataaaagcctgattgtctccatgacctgtctagcttttagtgaggcttaagacaagattacattccatacagcccgcaaatggatccctcctctccccaccttcctgcttctttcagaaatgccagggttttctgtgctgccatctggtaagcttccagttccgataggtctcaatttcctcctctgttgagacatctaattctcctgagggtgacggttcttccttgtctgaaatgaagcttctattaaacaaagactgcccctattccaggatgttcaaaagcagatggagcccgcctcctggtgaggcttttccattaacactaaagaatgccctaaatcaagcttttcagttttaaatagggatgaagtctaactgacctcatactttaaaattaaaaggtaaaaactgtgggttgcatcagaaaagaaaatgcaagcttttaaagcattcacaggtaagccatgtagttttaatcctaagagtagtacagttgcattgcttaatggtaggggtacattctgagtaattcctcattaggtgatcctgtcactgtgcaaacatcacgggtgcacttacgcacccccagatgggacagcccgccacacacctgggctggatggtaaagcccattgtgcctaggctacaaatctgtcctacaagttactgtgctgaatgctacaggcaattgtaacacaaggttaagtatctgtgtatcatctatacattaaaaggtgcagtaaaaatatggtataaaagataaaaatgggccgggcatggtggctcacgcctgtaatcccagcactttgggaggtcaaggtgggtggatcagttgaggtcaggagtttgagttcagcctggccaacatggtgaaaccctgtctctactaaaaatacaaaaattagcctggcgaggcagcaggcacctgtaatcccagctactagggaggctgagtcaggagaatcacttgaaccacggaggcagaggttgcagtgagtcaagatcacgtcactgcactccagcctgggcaacagagtgacattcagtctaaaaaagaagattaaaatggtgcagctatatagagcactgaccatgaatggagcctgcaggactgaaatttgctctgagtgcatcagtgagggtggggtgggtgagtgtgaaggccgaggacattactgtacaccactctagactatcaacactgtatacttaggctacactaaatttataaaaatgttttttcttcaataataaattacctttaaatagtaactttgggctgggcacggtgactcacgcctataatcccagcagtttgggaagctgagacaggtgatcacctgaagtcaggaattcaagaccagcctggccaacatggttaaaccccgtctctactaaaaatacaaaaattagccaggtgtggtagtgtgcacatgtaatcccaggtactcgggaggctgaggcaggagaatcgttcaaacctaggaggcagaggttgcagtgagctgagatcgcaccactgttctccagcctaggtgacagagcaagactctgtctcgaaaaaaaaaaatagtaacttgtgtactttataaatgttttaactacttttaactttttcttataacacttagcttaaaacaaacacatagtacagcagtataaaaatagtctctttatatccttattctataagctttttcctatttacacttttcttccacttttaaaacttttttgttaaaaaaaaaaaaactaagacacaaacacacaccctagcctaggcctacacagggcaggctcatcaatatcactgtcttccacctccacatcttgtcccacaggaaggtcttcaggggcaatagcacatgtggggccatcatctcctatgagaagaatgccttctgccggcatatctcctgaaggacctgcctgagtctgtgtgagtgttagttttgctttttaataagtaaaaagagtgcattctaaaataatgataaaagtacagcaaatacacatgtaccgtgcacagctagactagactttcatacaagtgggagtgcagttggctcgtctacaccagcatcaccacaaacatgtaattcactgcactgtgacatcatgagggccacaaggtcagtcggtgacaggggttttcagctccactacaaccatatgggaccaccatcatgtacgcgatctgctgctggtggaaacattgttatgttgtgcttgctgtttacagtttctcaacatcacttgaacctacaagaatatctaaggaccttctgagacacaaaagcttgattctcaaatacataaaaataagaaggatttttgttttcccccaaagtgatgaaattacatgagagtttgttgttttcatgtctggctcccatattttttgtaagtttttcatgtaaattaaaggtttactctggcgtcaactattccctcctggcctggaatcacagacgttccatttcttccatctactcatttgggaataagtcacgtaattcccggccctcagctcctcaactgatatccctgagcaacagcatcagacatgcgtgtgcctctgacacaggaggatgcgagaggcagggctgagccaggccaggcaggagcaagcggggagggaggagtgttcccgggggagagtgagaggcaggaaagacatccagccacaaggagacctgggagcacgggtcgcccagaattcagtgtgcttctatttccacgctcatggttcacccacctttctgagggtccaagcccacggcacccgctgaccctgcctgtctgcccagacactgcaccacatcgtggttcacctgcctttctgagggtctaagcccatggggcccgctgaccctgcctgtctgcccagacactgcgccactttccacgcgcgtggttcacccacctttctgagggtccaagcccacggcgcccgctgaccctgcctgtctgcccagacactgcaccaccttccacgcgcatggttcacccacctttctgagggtccaagcccatggcgcccgctgaccctgcctgtctgcccagacattgcaccacatcatggttcacccgcctttccgagggtcagagcccatggcacccgctgaccctgcctgtctgcccagacactgcaccacatcgtggttcacctgcctttctgagggtctaagcccatggggcccgctgaccctgcctgtctgcccagacactgcgccactttccacgcgcatggttcacccacctttctgagggtccaagcccacggcacccgctgaccctgcctgtctgcccagacactgaaccacattgtggttcacccgcctttctgagggtctaggcccatggggcccgctgaccctgcctgcctgcccagacactgcaccactctccatgcgcgtggttcacccacctttccgagggtctaagcccatggagcccgctgaccctgcctgtctgcccagacactgcaccactctccatgcgcgtggttcacccacctttccgagggtctaagcccatggagctcgctgaccctgcctgtctgcccagacactgcaccactctccatgtgcgtggttcacccatctttatgagggtctaagcccatggggcccgctgaccctgcctgtctgcccagacactgcaccacatcgtggttcacctgcctttctgagggtctaagcccacggtgcctgctgaccctgcctgtctgcccaaacactgcaccactctccatccgcacggttcacccgcctttctgagggtccaagcccacggcgcccgctgaccctgcctgtctgcccagatgctgccccacatctccatagcacccagttgtgcactagcagctgaggtgagctgtcgaatcctcattttctcacttttcattttcacatcatcaggcaccttgtctgagatggttgcttagttaaataaacagaaagatgagtttggattgcttctgatatgggagatgggcagggaagtgctgggtggagaagggcgggtctctggcaagggctctacccctggacctttcccatgggcctaggcgaggacaggcatttttgtttttgtgcccaaatgttgcatttcccaagaccaccctggtccaccatgcctctatcctgtgcctataaaaaccctgagaccctagcaggcagagacacaagcagctccccaagaccctagtgggcaaagacacaagggctggatgtcaagaggagcacaccggcagaagaactcactgacaggcaccagcagactaggtagttggaggagagcctggctgctgagcggcccgactccaggggaaaactgccttcccagtccatctccctctggctcctgctgagagttacttccactctataaaaccttgcgctcattctccaagcccatgtgcgatctgattcttccagtacaccaaggcaagaaactccaggacacagaaagccccctgtccttgcaataaggcagagggtctaattgagctggttaacacaagccgcccacagacggcgaaactaaaaaagcaccctgtaacacacgcccactggggctttaggagctgtaagcattcacccctagacacggccgtggggtctgagcccacagcctgcccgtctgtatgctcccctgcaggtgggagcagtggggcactgaagaagcaacccactcctccatcgcacgccctgtgaggggaataagggaacttttcctgtttcacttcatctcaaccctcctgacccactctcttctgggtggcagttggcctttctgaggcagcagatggagccaagcatgtaggctgtggtcacagaggcacatggccacctggcccacaggaagaccatgggaagaccacaggtggacacgcccggcactcagggaactctaagggaggtggagcttgggtggtggagcagttggggtggtggggcaggagagaccagcagatgtggccgggggcaacatttggaatgtccatggatagcattccatccaaacacaaacgtgcgccttactagttcctctgcttctgaagcggtaacggtgaaaatcctgggagctctcaggatccagtcccggagggaccagcacagcacatatacagcttctgccaatggctgggcataagcttttaaaaactgatcatgtttcctagctacagaatgactttctcttcatttcagattgatcatcattcagagagagctgctaactctctggctttcagccgttctgtcctggtgttaacaatctgggaacctattctgaaatgtaccagagaaactctctgttcaaagggatctgccagaaaccctttgggaagggaagacgcccctggagccacagtgatgacactgcaaagtccgttcatttgtgatacggtatctccttgtggttcagcaaccctcagcccatgacctggtgagcttgacttgaggcttcattcttcatcagacacagaagcatcttgtcttgggaagggtcttcacgtacagccctcatttctcctttgactacaaaacccagcagtaaggaggggtctttcagagtcattaaggacaggtcccaaagaaatatggacttagtaaaaaatataatcaggtttcttgtaaaacagagaatggccaatgtttagaggttaagagtgctacaggtgcacaccacacgtgcctatgtttaaaataactaacccccatcctacctaaccacataccccagttatgctgttccctcacctctccacatatattttggagaatatcacaataggatggtttgtggacagaatgaatttcctattgtgaatgtggactactcttactgaagttacaaaacaagttgactgaaaatttaaggaatgcatgttttaatgaatatagactaactcaagttttctttactttttgagtcacttttatcaacttacaggttttttttctaattgccttttcaaatttcttagaacaaagtcattagtagtgttttcctacgattcttgaattcaatttacctatggtggaattccctttttcctctcattaattgtgtacttatgcccttttttgtcattgtcggtaaaaagagctctgtaagtcttttcaaagacccagagatatttctgctgtttgtgttcttgatgcttgccctcatttcttcgtacctatttcagtattttctgctcttgtcttcattattttcttctttttaatgtcttttgcttgctttgttcgtccttttattcttattatgaaacgtttcaggcacacaaaaaggaataaaataatatgacacaggttgaatatccctcatctgaaatgtttgggactagaagtgctttggatttcagatatgtttggatttattctggaatatttgcatgtacataatgaaatatcttggggacaggacccaagtcgaaacatgaaattacttgtgtttccttataccttatatagaaggcctgaaggtaatgttatgtaatttttaataattttgtgcacataacaaagtttatgtgccgtgaatctggaagaaaagaatgaagagcttgcgggggaggccacctctgaaggaatggccgagaaacttcccaagtgaaaaagctgtgaggcttcagattggaggagggcgcaagggcccagcaggatgtgccaaagttgtgctcgggcacatcaggaggaaatcaggccccacaatgtcacctccaagcacctcctggggttgcctgtcctctctcctcttcctgctgagcccctgggtccaaggacctcccaccttcaaaaaagtaaaaacagcacagcccagacccaggggtaaaattcatgtcatcacttcttcctgggccagcacccaaatacctcctgagccacaggaacacgatgcctctgtggccctgacagccactgccgattgtcctgggaggggccttcagggaaccgcacaggaaggagggtgcagctcagcccgttttcaaatccagcaggatgttcatgacctccctgcagacactaatggacagaacgtcacagcagtctggtgagcgatgatgtcagtgcattattaaattcaaactggaggggaagttttgacactaatcaatgctttttatcccacccaagactggcatattcccgagacaaatctcagtggttactgaatagcttgcagacctgggctgccctggggaaactgccatgcaagtctgtccttcccacctttctgcagatgcacgcagggctctcaggaagcaatttttttttttttttgagatggagtctcactctgttgcccaggctggagtgcaatggcatggtcttggctcactgcaacctctgcctcccaggttcaagcaattctcctgcctcagcctcaggagtagctgggactacaggtgcatgccaccacatccggctaatttttgtatttttagtagagatggggtttcaccatgttggccaggctggtcgtaaactcctgacctcttgatccgctggcctcagcctcccagagtgctgggattacatgtgtgagccaccacgcctgaccaggaagcaattttttttagctcattaacatggcaaagacagatagccagggccttctgagagctgtaaatgagcttctcacctctctgacagttttcagcagacatggattcctcagtcctagagctgctggctgcattcatccttcactgccacagagctccctcacctccctcaggaagtggcagagcagttggcggttcccaggccccccagggaagccctggcaggtgcttgctggggttgggtctttaccccagaacccagcaaaatgagcaccttggtctgggaggagaacgtccctgaaaggcccttggacagtattagcagctcaggggcaggttctggaaaggccttttccggttaacaccactgaatggttcatggggtcagagcaggcaaaacgagcaccatttcctcccaagaaacacatttttcccactgtctgacagttgaaaatatttgtttactttgtagaaacctaggatgttttggcagcaagcaatttatgtcactttgaaccacagagaatgcctctgaaatgatgatatgggtcaatgaagaagcaaagtttcttaactgaagtccatttcatagaaacaaatgcggaaatgattgtaattatgagggatgggcccactgtggcatttcccaatggtgacagtcaggctctacccctagcccttggagtcaaggccataaagcaaacggccaaaggtcccctcgtatcgtctgatccgacggctagggttggaaggtgggcagcctcacgggagcatggacctaggtagtcgccaggggcctgtgtgcagaaaaatttctcatttgctttgacacgctgctgttgctgtcttgaaattctcaaagattttatctcccaacctatattttgtgtgagacatcccatgaggcgacgtggtgcgcgcacctgcagagaagacaccccaatctgcacgcccacagcgcctcgcccgccacccagtcccgcagcgcctcgccccccacgtgtctgtctgtgctcatgtggccctaagaggccactcctctgcttacccagagcttgctgcaaaccacaaagtgcaacagtgttctaagaaacacaaacgaccaagggtcccaccctctctcccactcacattgctttcccacataagccaccatttatgctgaacgtggccgtgtggagggaggggaggtgggcagcccacagtccttctcatgtgtgagcaaaggtggagaatctcggtggacaggggctgtttcatgaagggaaataaacacagccgagtgagtttcacacagcatttccaccgctgtaatgagaatgaaatacatatgcatgtttgagctgtgacagatgaactatgtagttgttcagattctgcatgtgaattaaatgttctttcatttgcatttgaaaccagcaacgcacgatatacagatgaatggtaaccttcatgttaataattcaaaaatcttaatgtttttagaatgatgctgaatagcaaataaaaatcccatgacaagtcaagacggagattgtgaaaggaaacatcttatactataactagttcctttaggggcacttttccttgatttctgaactaaggacctgtatttgcactttgcacgggccgtgcaaattaaacagacagcattgcagggcatgaacacagacgaaccacgaccaactcagctgtcccgaggctctgtgttaacggctcctgacacactcccctcctccctgttctgatctgtttgcattaatatgcgctcaattgtaagaagctgaacagatgtatttattcagaattcccaagcagctaactagaactcccaattctgagtcatcgtcttagctcccgaggtgcttagcagaatgctctgtatttatcagcttcccggttaacctacacaccactccccagctcttgctggtttgagttatgtgaaccttcaacatcattagggaagcttctaccacacttagtactgataagcaaagtgcattcacacttcctgaggatttaatgagtggcaccatctaaattaatcttaagaacaatcccatttgctgggcgtggtggcccattcctataatcccagaactttgggaggccaaggcaggtgcattgcttgagcccaggagtttgagaccagcctgggcaacatggcaaaaccccatctctgccaaaaaatacgaaaattagctgggcatggtggtttgcacctgtagtttcaactacttgggaggctgaggtgggaggatcacttgagtccaggaggcagaggttgcagtaagccgagattgtgccgctgtattccagcctgggcaatagagtaagagcctgtctcaaaaaaagcaatcccctgtcccatgagatggtatgacctcctccaatctaggaagctattgattgcaagacagaccattactctagtactgctaaggaaaaacaaacccgctggcagttaaactatgatgtgctatttataaaagatgcctcctaatttcagtgatgggaaaacaatacacacctgagaaatgatgacattcagggtggtgggtactgtgacagccacactgctgcttcctggggactctgcatcctctccccagacaccagctgttgagggctaggggttagccgctgaatccctccccatcaccacctgagcccaagggaacagccactccctaagttacagtctcttgctccctggaggtgaaccaccatcagtgatccctcatgtgggacacaaaggcctagcccccagccttggttgggtcaaccctgaaggggaaccccagctccggctgcagagcacctcacaggatcagctcggtcctcttaaactgcattccagctcaccttctccctctgcccaattcagcttccctcacctgtacgggggttaccccagatcacccccagtcaccgactgcatgcaaatctctgtctcagagtttggtcccagcacattcaacctagggcatgtaggaccaccctcgtttcacgataaacaaccaaaacagggcagttacgtgatgtgcgtaagatggcacgactcacacgtgccgcagctggaacttaaactccatccggactccaaggccaccctgttgtctctccacaatcaatgctcagagcacagcctgcaactgtaagaggcccctaagctctttcaagtggtccatgaggccaaaactattttcataaaatactaagacatactttgcctttctcacgtgtactcttttatgagagaacttggaacagtccagaggctatgtggcaggaaatgacacagaatgagtgggaggcagagatgagaatccaagtgttttctgttaaatgaaacaatgagatatgcaaaagcgtgaaacaagaatgtaaaaatgtaaaacaaaaatgtcacacttagcacttttttatgttttggaaaatatagctactgtgtttataatgaaataattttatgatttattttaaagtgaattaataaacagcttttctaaagtgttggcaattttaatttctaaggtaacaaatgtggatagcactaacccaccaaaaaaaaaaaaaaaaattctttggagtcttcagtaattttcaataataggatgtgatcctgagaacaacattttaaaaatcacggctctgcactctgctgctgggagtttggaattccgctctccattccacaccagccgaaggaccccaggaacaccctgtaatccctctgtgattccgtctctttaatctgctaaataaagagatgtaacttccctacagcaaaaggaaagcaccagtagaattctgtaagttaaaactactgttaaaattttactgctctatactatatccagtattcccttctccattattctatgaaaattttaacaaaatgcattatactaatttaccatacaggattaaaatgtcattaagcttgcaatgtgtaaaccttaaaacagctggataaaaatttaagacaggaataagaagaaagccattcatattgttggtatataaaacaagcttcagagagtgttagtcccattttattcatggaagaaaataaatatgaagacactgaaatcacctggagaatttttaggagatgctgatggcaggcctcatatgagacaaatcaattcagaatctttgaagggtaagccccagacaccatggtttccgaggctcccaagttattttaatataacgtcagggctgacaactactgctcctgttgatgaagagggtcaaactctgaaaactatttgaagaaatgtattctgagccacatgtgggtgaccaatggcccaggccacagccccaggagagcctaagatcatgtgcccaaggtggatgggcttcagcttggatttctacacactagggaggcataagacatccaacaatacactaagatgtgcacaggcttggatttctacatgctagggaggcataagacacccatcaatacacataagatgtacacaggcttggatttctacatgctagggaggcataagacatccatcaatacacataagatgtacacaggcttggatttctacatgctagggaggcataagacatccatcaatacacataagacgtacacaggcttggatttctacatgctagggaggcataaaacacccgtcaatacactaagatgtacacaggcttggatttctacatgctagggaggcatcagacacccgtcaatatgctaagatgtacacaggcttggatttctacattctagggaggcataagacatccgtcaatatgctaagacgtacacaggcttggatttctacatgctagggaggcataagacacccgtcaatacactaagatgtacacaggcttggatttctacattctagggaggcataagacacccgtcaataggctaagacgtacacaggcttggatttctacatgctagagaggcataagacacccatcaataccctaagatgtacacaggcttggtccagaaagatgggaaaacactaagcagggtcttccagggcataggtgaattcaaagatttctgaatggcaattggttgagtttatctaaggactgggaatcggtagaaagagtgtctgggttaagataagggactgtggagaccaaggtttttattatgcagatgaagcctccaggttgcaggcttcagagagaatagatggtcaatgtttatcagacttgaaaaggtgccagactcttaattaattccctcttggatcagggaaaagacctggaaaggaaaagggattctctacagaatgtagacatttcccaggagagacagctttgcaagccatttaaatatatcgcagaaatatattttggggtaaaatacttccatttctttcagggcctgcaatctgccatgttggtaccttatagctgcaaaaggtctgctttgtctgtcttcacgcctctgttccaatgttaacgctggtcagctgtgcctggacaccaagggaggagggtaggataaggtgtgtccaaacaccccttcccatcatggcctgaactagtgtttcaggtttactttagagtgcccttggccaagaggaagggtccattcagctggctgggggacttagaattttatttttggtttatactctaaagccaagagtggcttctttccttcagtgcagaggaatccaacggatatttttaacaaggaaaggacaacagaaaaaatagggattcatttttatattagacaaaacatagagctaaagatagagggagagagggagggagggagacagtggtggagggaggtggagagagaaagagaaaaaaagatggatgtggccatggcagcattgtttttgggtattccccaattcccacataaaacagacggagcaactagacaaggaaatcaacaaaccaagatcacacttaaatcaaactgaagtgaagctgtccccagctagtgatccccaaggcgatgtccagatgaacgttgaggagaggaccagagaaaagcagccttaggaagtagctgtagacatcagtgaaaatggcaaagaaccttaaacattccctccttcataaaagcaatgagaaaaccacccaaaaatatcagaatcaacttttacagaactctggaaattaactaaaggctagcagaaatcagagcaatttactcaaaaaaaaaaaaaaagaaagaaagaaaaagaaagaaatggctgaatctcagcaagaacagcgaacttcctggcatcttaactcaccctatttccagctccctctcctcagctctgccacaggcttgaaaatgagcagcccacaatggcagtaaaaaccaacagcctggaagccaccagaaagcacagggtggggttagagtgccttcaaagccccattcccagagaattgtcactacttgacctgtctggttgttccctggaggacccactggaaaggctgtctttatttcatccaactcaaagctcacatatgtgaaaagtctttccctgggggcatttgttgaaaacatttagagacaatgttttacttaccagccacctgaggtagaggataatggttgggacaaacaataggctaaccagaaagcttgaaggaaaagctggaaaatgagatgtgcacaggtgctttgcaaagctctgacacgatccttggaatatggatggccacaacacatggagggctgtgtgcctgcccaggctgtgcacactcagggaagacatgaggctctaagctctcaccactggctgatgtagaggctctgggccagcatgaagtgaaggctacaacagagctgtgaactgcctgtctgatggctgaaggtatgccccacactcacacagaaccctcagcagagactgaggcttgtttctaggcatttaaggcaatctgtctggtcatctgaccactaaccaaactgagcagagacttggtggccacacatgatgaaaaaacacaaactttacagaattagttcagaatagtcactaagcaagcaaacaacaataaacagcaacaacaacaacaacaacacctaaggagagggaaattctggttttcaaagttgccacactatgttatttaaaatattgagttttactaaaaatttttgaggcattcaaagaaacatgcaaatgtgcctcttccacaggaaaacaatagaagctgttcttggggaagccaaatggcttacaagacaaagactttaaatgagctgttttttgttttttttttttttttttttttttttttttagacagagtcttgctctgtcatccaggctggagtgcagtggtgtgatcccagcctactgcaacttctgcctcccaagttcaattgattcccctgcctcagcctcccaagtaactgggattacaggcatgcaccaccatgcccagctaatttttgtatttttagtagagacggggtttcaccatgttgggcagactagtcttgaactcctgacctcaagtgatccacccgcctcggcctcccaaagtgctgggattataggcatgagccactgtgcccagactaaatgagctatttttaatgtgctccaaaaactgtaagaacaatgtctaaagagctaaataaaagtaggaaaatagtgtctcatcaaatagagaatatgaataaaaagatagaaattatatttcaaaaataattgaaaaattcagtacagcagctcaacagcagatcttagcagcagaagaaagaatcagcaaacttcaggataggtcaactgaaattatccagtctgaggaacagaaaaaaaaagaataataaaaaattagaaacctgtgagagaccatccaatgtactgagatacacgtaaaggaagtcccagatgtaggagaggaagaatgaggtagaaagaatatttgaagaaataatgacccaaaattcccaaaactagatggaaaacatgaatctacatatctaagacactcaatgaactccaagtagaataaactctaagacagccacacctagatacatcaaaatcagaccttcaaaacccaaagacaaagtaaatctaatgaaagcagtaagagagaagcaacttgtcacacatgttatggactagatatttgtcccctccaaaactcatgttgaagtttaatccctaatttgggagtatcaggagggaggaggaaactgggtcatgagggctctgccctcatgaatggattaatccactcatgaattaatgaattaattcatgtgggttatcacaagaggggacctggtgactttctaagaagaggaagggagacctgagctagcacactagcatgctcagcctcctcatcatgtgataccctgtgccacctcaggactctgcagagagtccccaacagcaagaagacccttacctgattctgcccctcaaccttgaacttctcagcccagatacctgtaataaataaattccttttctttataaattacccagtttcagatattctgtgataagcaacagaaaataggcaatgatcctcaataatattaacaactaatttctcatctgagactatgaaggccaagaggcagtggaatgatatattcaaagtcctaaaagaaaaaagtctatcaaccaagaattctatattcagaaaatcgatccttcaaaactaaaggagaaatcaatacattcccaaacaaaaaacaaagagaattttttccaacaacccttccctagcaagttctaaatggagtactttaggcaaaaatgaaaggacattagacagtgagttgtatccagatgaagaaataaacagcaccagtaaaggtcattatttagtaaatatgaaagacagaacaaatatttgagtatgtaacatttattttctcctaattttctttaaaaaacctgcataaagcaataattataaatccatgttgataaacatacaatctataaagatataattttcatgacaataacagcacaaaggagggaaagagaaaaaatgacagagagtgtttgaaaattaagttggtattaattcaactagattattataaagatcttaatgttaatttgaattaataattaaattaatattaacttggtgttaataaaattaaataatattaatcttctagcaaacactaagaaagcaactcaaaaaataatcaggaatgaaaagacattattactgatcttacagacataaaaattacaaggactatacagaaatactataagtaatcatatgccaacaaactagataatctaggtgaaattgacaaattcctatgaagacatgaactactgaagctgactcaagaagaaatagaaaatttgaatatgcctataataattaaggaaattcaatgagtaatttaaaacctcataaagaaaagcccatggtcagatggcttccatttgcaatagcttcacttcaaatgtttaaggaagaattaacatcattctttcacagtcttccaaaaaaaataaagaaagaatactcttcaattaacttgatgtgatggttaatattgagtgtcaacctgatgggattgaaggatgcaaagtattgatcctgggtgtgtctgtgagggcatttccaaaggagattcacatttgagtcagtggactgggagaggcagacccaccctcagtctgggtgggcaccatctaatcagcttccagcatggccagaataaaagcaggcagaagaacacaaaagtagtttagtcttccagcctacacgctactcccctgcgggatgcttcctgccttcgaacctcggacctcaagttattcagctttaggactcagactggcttccttgctcctcagggcctattatgggacctcaccctgtgatcgtgagtcaatactccttaaaatactcccctttatatacacatctatcctattagttctgtccttctagagaaccctgactaatgcatttgacaagttatgtattactataataccaaaaccaaagatatcaaaagattaagagatatcctttataaatacggacataaaaattctcaacgaaacactaagatactaaatccagaaacatataaaaagaattatacagcatggtcaagtaagacttatcccaggaatataagattagttcaaatataaaaactaaccaatgagatacactatggtcatagaatacacatgctatgatacagactgaatgttgacatcctccccaaacgtacgtgctggaattctgatccccagtgtgacagcattaggaggtgaaggctttgggggtaattaggtcatgaagacggcgcccatgcaggtgggattagtgtccatacgaaagagatcccagagcgctcccttgccccgtctgccacatgaggacacggggggaagatgccacccatgaaccaggaagccacccaccaccagacaccaaatatgggggagcctccagagctctgagaaatcaatgtttgctgtttcagccacccacgccatgtgatttttgtgacagcaactcgaacaagagaaaaattggcaccgggaagtagcagcacggctgtgacaaattcctaaaaatgcagaagcaactttgggtctgggaaacttgttgaggctgagtcttgaggtgtgtgctggaacaagcctccttcgccatggatgaatttttaaaagtgcttgtgttgagagatcaaaaggaagacaaagcagtatctcttagagaacagctcggccatcatgaatggaatgctgggaggatgcagacagagcattctgtgaggcctgggaaaggaggaacacactatcggacggtggagaagaggctgtgctcctcgcagagtggtgaggaccatggccgaatgcgttcatgctctgggctcctgtggaaggtagagcttgtgaatgaggaattggaaacagtgcacctcagtggcagagggcctcacaaatggccggccggagatgggggctgggtggaaggagccactgggcctgctcgggaggttcctccattgccctgcgcagcctgagccagacagagcgcaaatcccacggagggcgagccctgagccggacagagcgcaagtcccacggagggcgagccctgagccggacagagcgcaagtcccacggagggcaagccctgagccggacagagcgcaagtcccacggagggcgagccctgagccggacagagcgcaagtcccacggagggcgagccctgagccggacagagcgcaaatcccacggagggcgagccctgagcctgacagagcgcgagtcacacggagggtgagcaccacgcgtgactccaacacacccacctgtgctcaccagacgtgagccagacgttctccctccccaaccccacaccacacatctgcctggaggtcgggtagggggtggatctcagctcctctcagcaagaaggaaagcctccaagctccaagggcccaggatgggaggtaaaacaagacaggcgagcacagggagggcgcaaatagagtgggcaaggaggaggcagaacccggctcccctgacctgtgccggcaagcacgtccccagcagcagctccccggatgccatcccagccaggacccgtgcggccagccttggatttctgtgttccagtccacattatttagggatttattttccttctcttttaaggaatgataacactgttttatgtacatatttggtttttttgctttttgcttctgacatgcagctcaataagtcagaagattcttaccaggaaatgaatccacagtcgttttcatgacagcaaattgcatgccaacgagtgacatttaaatgctgaattttaatggcttgtcagaaaaagtgaaatgtatttaaaaaaaaatcatacatgagagagcagtgtgtctgcccatgaaataatgctgcctgtagtagacaagaatggtaaaaacacagtgaacgtattttgttctgtgatgtacacatctacctggaggaagaaggttgtgaaattaactcccatttaccctcctcttcgtgcagaagactctgaaggccgcgcaagcagctgtctgtcaatgaatctgacaactgcacctgcaagaagtggcctggatgaagacgacaggcagaagcacaggatcaactctgtttcaagcgcagttaccaagacagaatcatttctggaatcctgaaaaacctgcatatgaacatgctcacgtgtagacacccacacacatgcacacacacctgcacacacactcacatgctcatgtgtagacacccacacacctgcacgtgtagacacccacacacgcacacacctgcacacacatgtgctcacgtgtagacacccacatacctgtacatgcactcacgtgctcacatgtagacacccacacacatgcacacacacctgcacattcacatgctcacgtgtagagacacacacatgcacacacgtgctcacatgtagacacacacacgtgcactcattcacatgctcacatgtagacgcccacacaaggcaaacacacgtgctcacgtgtagacagccacacatgcacacacacctgcacatgcactcacatgctcatgtgtagacactcacatgcacacacacgtgctcacagacacccacacacatgcacacacacctgcacacgcactcacgtgctcacatgtagacacgcacacatgcacacacatgtgctcacacagacacccacacacatctgcacatgcactcacgtgctcaggtgtagacacacacacatgcacacatgcacacatacctgtacatgcactcacatgctcacatgtagacatacacacacatgcacacacccctgcgcactcattcacatgctcacgtggatacccacacatgtacacacacgtgctcacgtgtagacacccacacacacgcacagacacctgcacacacatgtgctccagtgtagacacccacacgcaaaacctccctactcaaacactccccccatgtgaggctgacaaaactcaggaagacaccaggatttgagattctttccttcaagtgtgcatgcatgtgtgcctgcctgcacacatgcatgcacacctgcacactcattcacgtgctcacatatagatacccacacacacacacctgcacactcattcacgtgctcatgtgtagatacccacacacgcacacacacctgcacactcattcacgtgctcacgtgtagatatcccctacacgtgagcatgggtgtgtgtgcatgtgtgtggatgtctacacatgagcatgtgtgtgtgcaggtgtgcatgcatgtgtggggatgtctacatgtcagcatgtcaatgagtgtgcaggggtgtgtgcgtgtgtgcatgtctacatgtgagcatgtgtgtgtgcaggtgagtgtgcaggtgtgtgcgtgtgtgggtatctacacatgagcacgtgaatgtgtgtgcaggtttgtctgcgtgtgggtatctacatgtgagcatgtgtatgagtgtgcaagtgtgtgtgcaaatgtgtctgtgtctacacgtgagcatgtgaatgcatgtgcaggtacgtgtgccttcgcagcatgcccaccttccagaagcctgcatcctggactagacacaccaatggccctggcaaccaaagaggcctcctgccacagggtcgtcctcctgccacggggtcatccccagggtttgctggaaatgcccaccccaggacacaccccacagctgtgtcagaaccagctgggaaggtgtcagcaattctgtgtccccacaatgcagaagatgacttttcactgtctagagagtccaacagcccaggacacacagtccctggggatggagctgggcagagggctccagctgcccaggccatgggcagttctgatacacctgggcagacgctcagccagggcctgagcaagactggagatgcagggctgcctgggacctctgtctctatgcaaggatacctacgaccccccatctccacatggggctgcctgggacccccctatccccatgtggggctgcctgggactccgtctccataaagatgctcttatcctcaagaacaggtgccaggaatgtggacatagcctgacactcggcacaatattaattttctctgagatggttttccttaggagttaccttttgccattatttggttagattattgtcatgtaatttaaattcatggatatatgagacaaactagaaaaagctattgctttaaaatcataggtgagaaaactcatctctgttggggaattcggggccactagatatttttctatccctccttttgaaactcaccttaaatttcttggtttttttctagtttgtcaggctgagagtcttgtgcattctctggtttcatttcatcccaggacgcccacccaggcagggccccggagcccttgtggcactagctcccatgacaagggagctcaggtgaactccggcaccctgcccccgccacatctcagcacaggatagcacagaaacgtgatgatgttcagtgccagttgccagcacatggtgatagctacatacatacctagagccgggctgaaattacgctcaggggaagttctgaaagagtcacgcccattctcattgaaagacccctggcctccactcgcacgtccagccatcagagtggcaaaagctcatctgtttgctccttaaatgaggcttttccctcttctcaagataataaagtgaagggtgaaacacagagtaaggctcacaagacaagcaaactcagaaaatgtgacacagttgaatatttacacaaccttccttcaatatggctcgctccatgtttgtccctgcgtgggcagcattccgtctgtgtcatctacattgatacccatatctacgtgccctgccaagcctggcactggcctgcgcacagcaccccatcgccaaacgacagtggcacatatggagcaggagctgggcccaagccgccctggaggctcccgtggggaaagggctcaggagtccagtgtggcctggagtgtgcatcagggagctgcccggcgccctggcccacaccgccacacgcgtttctctcaacccgcagtttggctttgtggagggttccccatggactttgggctcaggtgacttgggctttgtttgtgggtggttctgtgtaatgcacaggcaccacccaaaagcagacacgtgtagcactacacaccacccatgctgggaccccctgaaggacagaggtgaacccggaacccctgtaggacagaggtgaacccgggacccccttaaggacagaggtgaacccgggacgccctcaaggacagaggtgaacccgggaccccctaaaggacagaggtgaacccgggaccccctgaaggacagaggtgaacccgggaccccctgaaggacagaggtgaacccgggacgccctcaaggacagaggtgaacccgggacgccctcaaggacagaggtgaacccgggaccccctaaaggacagaggtgaacccgggaccccctgaaggacagaggtgaacccgggaccccctgaaggacagaggtgaacccgggaccccctgaaggacagaggtgaacccgggacgccctcaaggacagaggtgaacccgggaccccctaaaggacagaggtgaacccgggaccccctgaaggacagaggtgaacccgggaccccctgaaggacagaggtgaacccgggaccccctgaaggacagaggtgaacccgggacgccctcaaggacagaggtgaacccgggaccccttgaaggacagaggtgaacccaggacgccctcaaggacagaggtgaacccaggaccccatgaaggacagaggtgaacccaggactccctgaaggatagaggtgaacccgggacgccctcaaggacagaggtgaacccgggacccctgaaggacagaggtgaacccgggacccctgaagaacagaggtgattggaaaccctcctgtgagcagaatctccagcagtgcacctggctggtgattccgcctggaaggagaaacggccagatgtgtgattacttatgaattaatgggctgtggccagtggtttggctggagggccagggactcggagagaatatggttggaaacattgttgacaagggcaactggggaagagacatattagatagacgtctatgaagtggtatgaagtactaagatatgaatgtcccgtgtgaatgttctccaaagagtgacctcagcagaggaggattttaataaccaagtggatagggtgacctgttctgtggacaccagtcagcctctttccccagccaccctgccgttgccccatgggcccatgaacaaggtggtcgcggtggcagagttggaggtgatgcctgggctcccactcaacaaggccagccctgctgtggccacccttgagtccccagtcagccaccacaaagaccatccctgagtccccaacatgacatcattccccgaggtgatcagccagccgccggggggcaggtggttccgcaggcagcttcccctgtggaaggggtggggaatggtccttgctggactagacgcttactccagatgtggatttcccttccctacgcacagtgctcctgccagaactaccctccgtggagtcagaacgccttatccatcaccatggtgtccacacagcactgcttctgaccaagagccctcacttcacagtcaaagaagcgcagcagtgggccggtgctgtgggaattccctggtcctaccatgttgccatatataatttttaaattatcataattttaaaaattatcttctcatcacccctgcagggaccacctgcaacaaaaatttcacaacagtgacaggcagaggctgattctctccaggccgagccacgcctgcactggacccagccaggcccagataagcagccgacgcctgcctactttgtgccaggcccagctgcgggccactgcagcctcctggcatctcctccctcagacacaggaggcagcaggcctgggctcctccaaacccaggaacggacgatcccagtaggaagcacccatgagcccagcgcccggctcccacctgccccttccaccaccacactcgtggattcagtccgtcccagctcctcaccgcccaggaggagaagccaagcccgtgcggtcgctcagtgcggcagccgccgagcctcggcccacgcccgccctacctgtgccggaaagcttctgcaacgccacgcgcaggcgctgcagggccacgggcgacacctcgtagcggtaaaagtccattgccggaaccttctggcaccttccaaacactccatctgtgagaagggaaggagataagacagaacgagacgtttcattttcagagagcaggaaggtgtcacacacgtccttgcaatgcgttctgatcatgtgccgccgtgaggttttggagcacggcgtcaccagagggctgttaggacccgggagcacccggaggatgctggtttgtgagataaaaaccgagcatcacggaaaacacaaatgccaaggtggagagaaagtccagtgtggctgcaatgttgtcactccactttcctccataccccccgagccctccttttatgtaatttcacattttttatgtaaaacttgcctctgacaactcagtgacaacaaaaaaacaaagtcaataacattccaggccagttttccagatgaaaaacagaacacccaggaaatataaatattactttgcaggagctacaaggatcggcggagacgcctctccctgggctgcgtgggaggcaagcacggcttcccgggctcctttccggcggcgcaggagaggcgcggggctggcgaacggtgtgggactaatggggactaatttatttagctcgattccatttgtctgaaatggcagactctgctcatcaacatcctttccaaccacaccttctaattaatttagtccccaattagtctttattcggcgaattgttcactttgagacaagcttcctgtggggtttcaaacattcaaattaccttctttggtgcacacaaaaggttaattcaggcgctactgcttccacacagggcggccatctgcagcttcgggcggggcggaaggggaaatggtctcttttattgttcactaggtttcgccgtgcagcttggctgaagaaagccattcaaatgcaacaagtgtaattagcagaaacacatttgcccagggccaggctgacggtaattgctggtctgatattgcatatatgctcacgacgacggggccgggtgattagcagaaaataacctcgagtattgcaagcgtcctgcgggtttctatgggactttgcaaagcccagggaatccgggaggcagcctggcagctgcgcgggcgggcggacaatggcaaggaggagacgccaggcccgcgccgtttccctccgtgcagcccggccgcgccgcctcctgtccgagagccggcccgagatgcctgcgaggccacacaaaggcggagggctctcggggacgcgtctgcagagcccggcgccccccaccgtccgtgatggacaggccgcaccacaggcgggaacacaggcagatgtgcccgctcctttgccttcctcagacacgcaccattcagtgcaagcaggagtgggaaaggggggaggagggagaaaggggcaaagagggaaaataaggagcgacttcaaacatacccagtgttcctactctgcttttcgaatgaaaatatcttgaaaatagaaaggcaacaagcaggaactgggcagcacgtcgagacggcccagctcccgtgctcacaatgcagaacaatcctaggcctcaggaccaaggcctggggccccagaggagggagtgagccacgggccaggaagaaccaaaagccaggttcctggacccccaagcggggcccaagtcagtgaccacctaatcctaggccagggccggcggcctcttccgatccctgaggccagggaggctcagaagcccagggctccactcagccgcagagcccgcgagctgcactccccaccctcagaaggaaggcgctctcggccggccccagagcagtgacggtgccggctgcctgcagctccccggcctcttgcgcacattggaaaatgcacccccggggtggacgtgcgtggccagctcagggcatggcagagcctggctggtccgggccccactcggccactccgggtgtctgcacacagggcttggtgatttggtgccaaatataagagaagcacatctgtgagtagccaacgcttcgcaacatgcagctgaggatccccttcccaggcaacctcatcaaatcattcagcttttcataaagaaaaatggcccaggacaattcctatcaattttggaacgttccaagcaaagcatttctcaagcataacagcctcattctttaaattttgtttcttgcatacaatgtcataaatatattttaaaattatattagactttcttgaaaactttcttttaaacatttatttagaatatatacaatataatgcataatatagtttgtgcttttaaaatcagttttagctaataattttagctacttgacagttgaaataaactaaccattgattctctttgccttagactatccctgtgctgaatgcagtggacacagacaccatccccagtgcattgttaatagactttatttttagagcagtttagattactgcaaacttgagtggaaagtagggatattttccatgcatcctcacacatgcacacacacacacagcctcccacacacacacacagcctcccacacacacacacacacagcctccctcacacacgcacacagcctccctcacacacaagcacagcctccctcacactcacacagcctccccccacacacacagcctccctcacacacacagcctccctcacacacacacggtctccctcacacacgcacacagcctccctcacacacgcacacagcctcccttgtacacacacagcctccctcacacacacacagcctccctcacacacacacacagcctccctcacacacacagcctctctcacacagcctccctcatacacacagcctccctcacacacactcacagtctccctcacacacacagcctccctcacacacacagcctcccttgtacacagcctccctcgtacacacacagcctccctcacacacactcagtctccctcacacacacacacagcctccctcacacacacagcctccctcgtacacagcctccctcgtacacacacagcctccctcacacacacacagcctccctcacacacacacacagcctccctcacacacacacagcctccctcacacacacacagcctccctcacacacactcacacagcctccctcatacacacacacagcctccctcacacacactcacagtctccctcacacacacacacagcctccctcacacacactcacatagtctccctcacacacacacacagcctccctcacacacacagcctcccttgtacacacacagcctccctcgtacacacacagcctccctcgtacacacacagcctccctcacacacacacacagcctccctcacagggtatttgcagatattaattttccacttttttgggtaaagaccaacacgagtgactgctggctcatatggtaagagtatgcttagttttgtaggaaaccgccaaactgtcctccatggtgacaatcagactaacagtggccgtgccatttttcactcccagcagctgcgatggcacccccatcgcccatgtcctcaccacagtgacaatcagcctaacggtggccgtgccatttttcactccgagcagctgtgatggcgcccccatcgcccgcatcctcagcagcgccaggtggcgtccgtgttcccgcgtcctcggcagcgccgggtggcgtccgtgttcccacgtcctcggcagcgctgggtgacacttggaggcgtccatgttccagcgtttggctgctgtcataggtgtgtatcggtatctcatgattttttatccaatgcatttttcaacaatgatattcatccttatctccgtatttaaaggacttcatgatgtgggtgtcctttattctagtaaatactcagcaataaggcttgttgaagatgattgtgaccagaaggaaggagcccagaagctcccacagatcatgcccaggttcgctgctacctgcttgattttaaggggatactggattcccccaaatatggatacgtgcctagcagtgaaatagaaaattaaggaaatttctaaatacatctggtagaattgatttttatgtggccagaattttgaaactattgctttgttcttccgggtcacttggctaataggcaggaccccaaaaggtctctatgaacatactagagaaaaggactggaaagtcaaatctcaatcaggaaagcatcaggtgcgatgagactccggagtcgggacgccaggggtgatctacacagcaggggtgccggagccagagaaccaaagctcccaccagtccaggctgagctccaccgtctcagacgtgcagtgcggcctctgaaacaatcccgggaagtggcacactgaagtcgcctcaccgccgaccatttaatcaccctagaaaccacccagagcccgtaaccctcaggcccctcctctgcgggactcctgccttcgtgttcttgggacacagccaggaccccacctgggatctgagcttgcttggggtttcctcatgaactctcttctacttcggactctgtttcctgtgccatggccctgcagcctgtcgacatgaccctatcgtcgaagcccggactgacccgtccagctctgcagccctgcgggccatgctgagctcccagctggaagtgcatcaccgcaccgcagtggaggcaggaggccttgggtgatggagcccatccacgagactttcagaaccagggtcctgctcttcgtccagaacgggcattccatgcgcaaccttaattccaagtctcactgctggcaactgagttcaaattgggggctgtctgaaaatcatgggagatgagaacaggtttgcctatgaaaactgtgggctccctgtccacccgtccttggctactgtcaccatcaaaacactcatgtgtgcaaatatatgtgtacgtgtcaatccttatacagaaacacgtgcacagctgctaactcatacacgcacataagcacagccgctaacgtgtttaactgccaaacttactgtgcgtgcccaaggatgccgccaatccaacatcataaacccttccggcaaacagacactgcccgtgcctctgcgcggaagcctaacccccaggtgctcctcgatgacggcttcgtgccttctccctctgtcttccctgcagcgttgggtgctctcatcaacgaggctcatcatctctgtccccagcattgcctgagccttgcaaagccccttcctgttctgggagcaggtcagtgctatgcctgctgcttggctgcctccgccccacaccctcgtcccagggaagccacagctctgccctgcatcctgcttgcatggccaggccaggacagccgggagacacgcacacagaaaaagcagacactgcaggctccatgctccagagcttccaggatcctggggcaacagatgttcaccactgatggttcggttataattgtggacaggctgcaaaaaagggcacgagagcacctgacagagggcactgacctcacccagcggtcagagaacgaacagcggccgacctgaggacatcgaggacactccaggctaagggagcagctccgtgcatggcagcatccagccccggtgggcgacggggagggagcagttccgtgcatggcaacacctggccccagtgggcggccaggagggagcagctccgtgcatggcagcacctggccccagtgggcaacggggagggagcagctccgtgcatggcagcacctggccctggtcagccccagtgggcagtggggacaaggccttgcagttctggatcaggcaggagaggacaccaagctggtcaagccactcaagcagattgtgcagagcctgcgggaatcagaggcagtggccttcatcccaggagctagaggaggccacctccacttgggtggtgttccaggcagggcaggctcttgaatgggtctgcgttttaaaacagatctccctggcaagggctggagattgccaggagcccatggcgggtaaacagagcagccccaaccaggggatggtggctaagtgaggatggtggtcatggagaccagagacctggatagactggagccatctgcaaggtgaaccttaggacaacacacatccctctgccggcagcagcaaccaggcctttccacatgctacccagcccatgcacagacaggcttgtgggggaggggaatattctgggagacgttctgtagaatgagtctttttccaaaacaggaaggaaggcaggcttcttgctgccctggctgggagaggcgagacatggaaggcgtcccccgacaagaattctgcctggcctggaactccgatatcagggactcaacgaactggggggcctcacacccccagagttctgggatgcaacccccttcactgtgcagacagaaggctggaccccacagaactccaatctcagggactcagtgaaccagggggccccacatttcagagttctaggacgcaaccccttcactgtgcagacagaaggctggaccccactgcctctgggaccggaatggacagtgctaaagacagtgagagaaggaatgcccaggatgcagagcagcggatgaacagggcccaggacaatggacacaaaagctttgaggagcaaaaggtttgcttagagacacttttattaacagtaatctagaattgggtggtcagtttctttcatttgaaagaaaatattgagcattttctgtggttggatttttggagaaataagaaaaagagctcatttatcttggtaatttgttttaaacagtggtccttagagcactgttcccacaggccaaagtaatttcattcgcaagcgtcactgtccccaaaacacaaacacaggcctcctccaggaccaagcttccagcccacttctattctcatatagtctgtggggctgcatacctccctccaaccttacaccacacgtgtgtacacggtgcatgtatgcacattcatacctgcatgaaccaacacacacattttcacacacttctcccatgcacgggacactcacacatacacacactcacacgcacccacgtgaacattccaacacatgtacacacacacaagtgtgcacacactcatttgcatgcacttgattatgcagacacacacacaggagcacgtacacacacatttgcaaacgtgcacacacacacacacacacccagacacactaactcatatacaggtgcacacaagcgcacatgcacaaactcacacgcccacacgcgtacgctcacacacagtctccgcatagacaagacggcacctcgcctctaccgccctgcaggaccaccctctccccggtgacaccgtgagttcctggaaggcagggatcacagctacagcctcttcacgcccccacagcatctggtacagtgccttgcccccggtgtggactaaaaggatgttagtgaatgactataactggtattttcccatttgtctaaaagaaaatggagatgtccgtggaagtgtttaagaccatcagctagaagcctcatttgttgaaatctcacatagatttacaagtcctcacccctggcagtgacccacttggatgaaagactcactggggaccaaaaaggctggtggtgggggcaccctaggaggggctggcatgagtctcgcaagttctcaggtggccatgcgcctccaccccatcccgtactgtctctctgcttgggctcagagggccgattgacccccagcatttctatccccagctccataagtgaagcaggtgatcctagtggacctctgttcttcagagtaagggtggggctctgctgcccagggtgcccccagagggtcctgttgcttggagatactgagcctccactctctgtgacacccatagcactgacccagaaccatccaattggagcaccggaaagctgtggaccgaacaaggtggctttgataccctgtgaggaaagtactcttgccacactttgcttaggtgatacgcccaggcctgcactaaacgacatcccgagtgacacgtccaggcctgccctagaggatatcctaggagaaatggcccagagacgctaactgtgcatctgctgagaaacgtcactcactgcgttaccccacaattctccacagagatccacagggggtcccccagtccccacaattatccacagagatccacagggggtcccccaggccccacaattctccccagagatccacagggggtcctccagtccccacaattctccacagagatccaagggggtcccccaggccccacaatctccacagagatccacagggggtcccccagccaggagcatcttccttccaccaaacgccgtgaacacgaccagctcctgggcagggacacctcctgcttacaggcgcctgtggcacagattccagtgaactaaccatctgcttttcccctttttctaatatctttacctacttttacttatatgtctttttttttttaacatttcttatttatttatggaaatataacaggacttgggaattaatgaatacaatatgatcacttaatttagtatttcaaagtgaggcaattagcttagggcattgtttgaaataaccacaatgcgcatacctattcaatcatttgtgtaaacagcatattaaggtaaatggtatgcacgtgaaaactgatttatctcagctgcctggaaactatcagaacaaagttcttgaattgtgagcaagaagggatgggcagaaaaggcaccccaattacgaagcctttgcagatgagaggcgtgggaggctgtattccgacaagaagggcaggcgagagacacccggcaaaccaccgggcaggcagaaccccggcggagcaagcactagcacgttccagggctgggcagggactgcgaccatttctagaatcgtcacaaagccatcgctgagacagacactcaggtttgcagaatactgtctacagtaaacaccaaatgcatccgctcttgcggctgccagctgaccctgcccagacaaaaggaacgggcagtcagtctcacagcagctccctgggaacacacctgggaagcccaggaggggaacgcggcctcctgggggtgtcccaggcactgaacccagagcctagaaacagcaacgttgcagggctcagggcgcactttccagagagaatgggaccacatccagggccccacaggccatacccgccgcaggtcttgagtctggcagccagggagggagcacagccgcctctcatgaaacaatggcaccctgctgtgcttcttcaagctggtctgtcactcactccctccctgcatccaaacaaggcaaggcccagaggctgcggtcacccaggtggccagtgagcaccaagcagcaccagtgacccctcgtggctgcctccctgcagtgccagttcttcatccgagacatcgctcaggagccctgctctggctcaggcctgaagatgccagtggcagactcagtcggccagtgtgaggggccaggagacgagacactgctgcccagtacagcaggagaattaatgcacacttgtacacgtgtgcacaatacacaagcaaccacatacacagacattcacagcatgcacacacaatgtatgcagacacatgcacatatgcagacacacaaccacataatgcatgcacattctcacatacacgtcctcacacatgctctcacaggcacacgttctcacacacatgcacattctcacatgcacacgttttcacacatgctcacactctcacatgcacacacatgcacagtctcacacatgcacacatcctcacacatgctctcacatgcatacattctcacacacatgcacattctcacatgcacgtttcacacatgctcacacactcacatgcacacacatgcacattctcacacatgcacacatcctcacacatgctctcacatgcattctcacacacatgctcattctcgcatgcacacgttctcacacatgcacacattctcacacatgcacatgctcacacgttctcacatgcacacatacacattttcacacatgcacacacgcacacattcacatgcacatacacattctcagatgcacacacatgcattctcacatatatacacattctcacacatgcacatgtacacattctcatctgcacatacatgcacacattctcacatgcactcattctcacccatgcacattctcacacaagcacacacatacacactcatatccacacacgtgcacacattctcacatgcacacacacatgctcacattctcacacatgcacacattctcaaacacacacgtaaacattctcatatccacatacatgcacacattctcacatgcacacacgtgctcacacatgctcacacatgtacacattctcacacatacacattctcacatgcacacacgtgctcacacatgctcacacatgtacacattgtcacacacacattatcacatgcacacacatgctcacacatgctcacacatgtacacgttctcacacacattctcacatgcacacacctgctcacacatgtacacgttctcacacatacattctcacatgcacaagttctcacacacatgaacattctcacacacatgcacatgtacacactatctgttctcacatgctcacacatgtacatgttctcatgtacacactcactactcacactcagaatagcagaaggagccctcaccagcctgggaccgccatgctccaggtgtcctgctgtaccaggctaggtcaccctttcattctttcctgcctcccctgctggggtccctcaggaccctgcctctctcccactgccccctcctggtggaggctgccttgccaaagtaccttcaatctgtaaatcccggtgccctgggacactggagctgcctctgaagtcccctccctgcagggagctggcagcgttgccagggttccctcggtcccatggggcttctcaaagcagcaccacagacggaggagcccactgctccatcagggtccccaggggtgcagcaacaagaaaaaaatctccccagctatttttggaggagggaaaagtaattacagctcagaatcactgccctgttgaaaggaattctccagagggagaaaaagccctttatctgaactgatcaagcacctgccatgcacatttctgcaaggaagctgtaaaagtgctcccattctgcaaggaagctgtaaaagtgctcccattctcagggagtagaaactgctgtcatggcatccagtcataactgctgcaaaaattccaggaggccaaaggtgaatcctgagagacagcaatggcttctgaggcccaaggaagcaggcactggctcaccacacacccaggtcagatttaaggagccgttggatccgtgggctgcgtccaaggcaggactgctgtgaagtctgagcagcttagttcgtaatgaaacctgaagataagccgagaccctatatcgctggaaattcctttattttcaaggatttcgttacagttcagagcagccactgacaggcagcagaaggcaggggacagagtgacagtgcctgggagcggccagcacagcctatgcatctgcagagcagcgtgaggctctgactggggaggagccccacgtccgggcagcacctgcacccacagcgggagcctcactgtccggagaggccagcttcccttgtgtgaggagcagggcccccattcctcccaccacccagatcccagtgaggcctgggatggtatatccaggagaggccagcttcccttgtgagtgtgagtgacgtctgcaggtgtcaggtcttatggtgagagtgtgggtgtcagtgacatctgcaagtcactaggagcggggcctccattcccccccccccgccacccagggatcccagggaggcctgggacagtaaatccaggagatcccagcttccctgagcgacaagcgggacctctgttcctctcgccacccagggatcccagtgaggcctgggacggtaaatccaggagaggccagcttcccttgtgagtgtgagtgatgtctgcaagcatcaggtcttatgatgagattgtgggtgtgagtgacatctgcaagtcactatgagtggggcctccattcctcccgccacccagggatcccagtgaggcctgggatggcaaatccagcggcgcacagcccactgcaccgagggaggcgcacgacagaagccacagcttgagggtgtgagccggcagtactgaggagcccagcagacaccggccaggcggggcagggggaagcgtggcgggtgggaggcccttctgggaggtgaggagcaggctaggaggggaggacagtgaagacagtgccaagaacacagccagtcatgcctccctcacggagcaccagcgcgcccagcacttcccagccttttacctttaaggatgccttaaacccccaccccaagcccatgaggctcctcctccatgcaacaggctgtgtgccgaaaccagccccgggtgctgctgttagcaggcggacggctgagaggcgaggaggtggggccttccttacacaggccccaaggacggctcacgctccagccacatgaggacacgtgaggaggcaccgtcgatgagccaggaggggactcgccagacaccagacgtcaaccctgccagggcggtgaccttggcttccagccttcagaactgagaaatcaatgtctgctgtttctaagccccgcaataggtggtactttgagcagccttcatggactaagacactgcgtattattatcccattgacgccatgtggaaattaaggcacagggaggttaaggaacttgctcagagttggcctgggagtcgcaacccaagatctgtccacatggtcccacttcaccgctcgaggctgtgtcctctacggagactcactttcactttagactgtagatgccagcgtctgactgagaaaatgcggtcaccatagctacatggagtgactggcagagtgtcctattctgcaaccaactcacaaaatcctcaggtcttgtatggcgactctcaccataagagctcacgcccgcagacgacactcacacccacactctcaccataagaggtgacatctgcagacgtcactcacacccacactctcaccataagagctgacacctgcagacgtcactcacacccacactctcaccataagagctgacacccgcagacgtcactcacacccacactctcaccctaagaggtgacacccgcagacgtcactcacacccacactctcaccataagagctgacacctgcagacgtcactcacacccacactctcaccataagagctgacacccgcagacgtcactcacacccacactctcaccataagagctgacacccgcagacgtcactcacacccacactctcaccctgaggtgacatctgcagacgtcactcacacccacactctcaccataagagctgacacctgcagacgtcactcacaccaacactctcaccataagagctgacacccgcagacgtcactcacacccacactctcaccctaagaggtgacatctgcagacgtcactcacacccacactctcaccataagagctgacacccgcagacgtcactcacacccacactctcaccctaagaggtgacatctgcagacgtcactcacacccacactctcaccataagaggtgacatctgcagacgtcactcacacccacactctcacaataagagctgaggcacaaagaggtcactcacatccatactctcaccataagagccgacacgtgcagacgtcactcacacccacactctcaccataagagctgacacccgcagacgtcactcacacccacactctcaccataagagctgacacccgcagacgtcactcacatccacattctcaccataagagctgatgcccgcagacgtcattcacacccaaactctcaccataagagctgacacctgcagacgtcactcacacccacactctcacgataagagctgtcacacgcagacgacactcacacccacactctcaccataagagctgacacccgcagacgtcactcacatccacactctcaccataagaggtgacacctgcagacgtcactcacacccacactctcaccataagagctgatgcccgcagacgtcactcacacccacactctcaccataagagctgacgcccgcagacgtcactcacacccacactctcaccagaagagctgtcacacgcagacgtcactcacacccacactctcaccataagagctgacgcccgcagacgtcactcacacccacactctcaccataagagctgacacccgcagacgtcactcacacccacactctcaccataagagctgaggcccacagaggtcactcacacccatactctcaccataagagctgacacccgcagaagtcactcacacccacactctcaccataagagctgaggcccacagaggtcactcacacccatactctcaccataagagctgacacccgcagacgtcactcacacccacactctcaccatacgagctgtcacccacagacatcactcacacccacactgtcaccataagagctgacacccgcagacgtcactcacacccacactctcaccataagagctgaggaccacagaggtcacttacagccatactctcaccataagaggtgacacctgcagacgtcactcacgccgacactctcaccataagaggtgacacttgcagacgtcactaacacccacattctcaccataagagctgacacctgcagacgtcactcaaactcacactctcaccataagagctgtcacgcacagacatcactcacacccacactgtcaccctaagaggtgacacccgcagacgacactaacaaccagattctcaccataagagctgacacccgcagacgtcactcacacccacactctcaccataagagctgacgcccgcagatgtcactcacactcacactcccacgataagagctgacaactgaagacgtcactcacatccacactctctccataagagctgacaaccgcaaacgtcactgacacccacactctaacgataagaggtgacatctgcagacgacactcacacccacactctcaccataagagctgaggcccacagaggtcactcacacccatactcccaccataagagccgacacctgcagatgtcactcacatccacactctcaccataagatgtgacacctgcagacatcactcacatccacactctgtccataagagctgacacccgcagacgtcactgacacccacactctcacgataagaggtgacatctgcagacgtcactcacacccacactctcaccataagagctgaggcccacagaggacactcacacccacactctcaccataagaggtgacacctgcagatgtcactcacacccatactctcaacataagagctgacacctgcagacgtcactcacacccacactctcaccataagaggtgacatctacagacggcactcacacccacactctcaccataagagctgaggcacaaagaggtcactcacatccatactctcaccataagaggtgacacctgcagacgtcactcacacccacactctcaccataagaagtgacacctgcagatgtcactcacacccacactgtcaccataagagctgatgcctgcagacatcactcacacccacactctaaccataagagttgacacctgcagatgtcacttacacccacactctcaccataagagctgaggcccacagaggacactcacacccatactctcaccataagagctgatgcctgcagacgtcactcacgtacacacttctcaccataagaggtgacacatgcaaacgtcactcacacccacactctcaccataagaagtgacacctgcaaacgtcactcacacccacactctcaccataagaagtgacacctgcagacatcactcacacccacagtctcaccataagaggtgacacctgcagacgtcactcacacccacactctcaccataagagctgaaacctgcagacgtcactcacacccacactctcaccataagaagtgacacctgcaaatgtcactcacacccacgctctcaccataagaagtgacacctgcagacatcactcacacccacagtctcaccataagaggtgacacctgcagacgtcactcaaacccacactctcaccataagagctgtcgcccgcagacgtgactcacacccacactctccccaaaagagctgtcgcccgcaggagtcactcacacccacactctcaccataagaggtgacatctgcagacgtcactcacacccacactgtcaccataagaggtgacacctgcagacgtcactcacacccacactcgcaccataagaggtgacacctgcagacgtcactcacacccacactgtcaccataagaggtgacacctgcagacgtctctcacacccacactctctccataagaggtgacacctggagacgtcactcacacccacactctcaccataagacctgacactcgcagacgtcactcacacccacactctcaccataagagctgatgccggcacacgtcacacacacccacactctcactataagaggtgacacctacagacatcactcacacccacattctcaccataagagctgacacccacagacatcactcacacccacactgtcaccataagagctgaggcccacagaggtcactcacacacatactctcaccataagagctgacacccgcagacatcactcacacacacactctcaccataagagctgaggcccacagaggtcactcacacccacactctcaccatagagctgacacccgcagacgtcactcacacccacactctcaccataagagctgacacccgcagacgtcactcacacccacactctcaccataagagctgtcgcccgcagaggtcactcacacccacaatctcaccataagagccgacacccgcagacatcactcacacacacacgcgtcactcacactcacactctagccataagagctgacgcccgcagacgtcactcacacccacactctcaccataagaggtgacacctgcagacgtcactcacacccacactctcaccataagaggtgacacatgcagacgtcacacacacccacactctcaccataattggtgacacctgcagacggaactcacacccacacatgtcactcacacccacactctcaccataagagctgacacatgcagacgtcactcacacccacactctcaccataagagctgacacctgcagacgtcactcacacccacacgtcactcacacccacactctcaccataagagctgacgcccgcagatgtcactcacacccacactctcaccataagaggtgaaacctgcagacgtcactcacacccacactctcaccataagaggtgacgcccatagacgtcactcacacccacacacgtcactcacacccacactctcaccataagaggtgacacctgcagacgtcactcacacccacactctcaccataagagctctcgcccacagaggtcactcacacccacactctcaccataagagccgacgcccgcagacgtcactcacacccacactctcaccataattggtgacacctgcagacgtcactcacacccacactctcaccataagaggtgacacctgcagacgtcacacccacactctcaccataagaggtgacgcccgcagacatcactcacacccacactctcaccatagagctgacgcccgcagacgttactcacacccacactctcaccataagaggtgacacctgcagacgtcactcacacccacactctcaccataatagctgtcgtccggaggcgtcactcacacccacactctcaccataagcgctgtcgtccggaggcgtcactcacacccacactctcaccataagcgctgacacctgctgacgtcactcacacccacactgtcaccataagagctgacacccgcagacgtcactcacatccacactctcaccataagaggtgacacctgcagacgtcactcacacccacactctcaccataagagctgaggcccacagaggacactcacacccacactctgaccataagaggtgacacatgcagatgtcactcacacccacactgtcaccataagagctgatgcctgcagacgtcactcacacccacactctcaccataagaggtgacacctgcagacgtcactcacacccacactgtcaccataagagctgaggcccacagaggacactcacacccatactctcaccataagaggtgacacctgcagatatcactcacacccatactctcaccataagagctgacacctgcagacgtcactcacacccacactctcaaccataagaggtgacacatgcagatgtcactcacacccacgctgtcaccataagagctgatgcctgcagacgtcactcacacccacactctcaccataagagttgacacctgcagatgtcactcacacccacactctcaccataagagctgaggcccacagaggacactcacacccatactctcaccataaaagctgatgcctgcagacgtcactcacgtacacacttctcaccataagaggtgacacatgcaaacgtcactcacacccacactctcaccataagaagtgacacctgcaaacgtcactcacacccacactctcaccataagaagtgaaacctgcagacatcactcacacccacagtctcaccataagaggtgacacctgcagacgtcactcacacccacactctcaccataagagctgacacctgcagacgtcactcacacccacactctcaccataagtgacacctgcaaatgtcactcacacccacactatcaccataagaagtgacacctgcagacatcactcacacccacagtctcaccataagaggtgacacctgcagacgtcactcacacccacactctcaccataagaagtgacacctgcaaatgtcactcacacccacactctcaccataagaagtgacaactgcagacatcactcacacccacagtctcaccataagaggtgacacgtgcagacgtcactcacacccacattctcaccataagagctgtcgcccgcagaggtcactcacacccacaatctcaccataagagccgacgcccgcagacatcactcacacccacacacgtcactcgcactcacactctagccataagagctgacgcccgcagacgtcactcacacccacactctcaccataagaggtgacacctgcagacgtcactcacacccacactctcaccataagagctgacacatgcagacgtcactcacacccacactctcacaataattggtgacacctgcagacgtcactcacacccacacatgtcactcacacccacactctcaccataagagctgacgcccgcagatgtcactcacacccacactctcaccataagaggtgaaacctgccgacgtcactcacacccacactcaccataagagttgacacctgcagacgtcattcacacccacactctcaccataattggtgacacatgcagacgtcactcacacccacacgtcactcacacccacactctcaccataagagctgacgcccgcagacgtcactcacacccacactctcaccaaaagagctgacgcccgcagacgtcactcacacccacagtctcaccataagaggtgacacctgcagacgtcactcacatccacactctcaccataagaagtgacacctgcagacgtcactcacccacactctcaccataagagctgtcgcccgcacaggtcactcacacccacactctcaccataagatccgacgcccgcagacgtcactcacacccacactcgtcactcacactcacactctcaccataagagctgatgcccgcagacgtcactcacacccacactctcaccataagagctgtcacccacagacatcactcacacccacactgtcaccataagagctgacacccgcagacgtcactcacacccacactctcaccataagagctgaggcccacagaggtcacttacagccatactctcaccataagaggtgacacctgcagacgtcactcacaccgacactctcaccataagaggtgacacttgcagacgtcactaacacccacattctcaccataagagctgacacctgcagacgtcactcaaactcacactctcaccataagagctgtcacgcacagacatcattcacacccacactgtcaccctaagaggtgacacctgcagacgtccctcacacccacactctcaccataagaggtaacacctgcagacgtccctcacacccacactctcaccataagaggtgacacccacagacgtcactcaaacccacactctcaccataagaggtgacacctgcagacgtcactcgcacccacactctcaccataagaggtgacacctgcagacgtcattcacacccacactctcaccataattggtgacacctgcagacgtcactcacacccacactctcaccataagaggagacacctgcagacgtcattcacacccacactctcaccataattggtgacacctgcagacgtcactcacacccacactctcaccataagagctgacgcccgcagacgtcactcacaaccacactctcaccataagaggtgacacctgcaaacgtcactcacacccacactctcaccataagaggtgacgcccatagacgtcactcacacccacacacgtcactcacactcacactctcaccataagagtgtgacacctgcagacgtcactcacacccacactctcaccataatgagtctcgcccgcagaggtcactcacacccacactctcaccataagagctgacgcccgcagacgtcactcacacccacactctcaccataattggtgacacctgcagacgtcactcacacccacactctcaccataagaggtgacacctgcagacgtcacacccacactctcaccataagaggtgatgcccgcagacatcactcacacccacactctcaccatagagctgacgcccgcagacgttactcacacccacactctcaccataagaggtgacacctgcagacgtcactcacacccacactctcaccataatagctgtcgtccggaggcgtcactcacacccacactctcaccataagcgctgacacctgctgacgtcactcacacccacactgtcaccataagagctgacacccgcagacgtcactcacatccacactctcaccataagaggtgacacctgcagacgtcactcacacccacactctcaccataagagctgaggcccacagaggacactcacacccacactctgaccataagaggtgacacatgcagatgtcactcacacccacactgtcaccataagagctgatgcctgcagacgtcactcacacccacactctcaccataagaggtgacacctgcagacgtcactcacacccacactctcaccataagagctgaggcccacagaggacactcacacccatactctcaccataaaagctgatgcctgcagacgtcactcacgtacacagttctcaccataagaggtgacacatgcaaacgtcactcacacccacattctcaccataagaagtgacacctgcaaacgtcactcacacccacactctcaccataagaagtgacacctgcagacatcactcacacccacagtctcaccataagaggtgacacctgcagacgtcactcacacccacactctcaccataagagctgacacctgcagacgtcactcacacccacactctcaccataagaagtgacacctgcaaatgtcactcacacccacactctcaccataagaactgacacctgcagacatcactcacacccacagtctcaccataagaggtgacacctgcagacgtcactcacacccacactctcaccataagagctgtcgcccgcagacgtgactcacacccacactctccccataagagctgtcgcccgcagaagtcactcacacccacactctcactataagaggtgacatatgcagacgtcactcacacccacactgtcaccataagaggtgacacctgcagacgtcactcacacccacactcgcaccataagaggtgacacctgcagatgtcactcacacccatactctcaccataagagctgacacctgcatacgtcactcacacccacactctcaaccataagaggtgacacatgcagatgtcactcacacccacgctgtcaccataagagctgatgcctgcagacgtcactcacacccacactctcaccataagagttgacacctgcagatgtcacttacacccacactctcacgataagagctgaggcccacagaggacactcacacccatactctcaccataaaagctgatgcctgcagacgtcactcacgtacacacttctcaccataagaggtgacacatgcaaacgtcactcacgcccacactctcaccataagaagtgacacctgcaaacgtcactcacacccacactctcaccataagaagtgacacctgcagacatcactcacacccacagtctcaccataagaggtgacacctgcagacgtcactcacacccacactctcaccataagagctgacacctgcagacgtcactcacacccacactctcaccataagaagtgacacctgcaaatgtcactcacacccacactctcaccataagaagtgacacctgcagacatcactcacacccacagtctcaccataagaggtgacacctgcagacgtcactcacacccacactctcaccataagagctgtcgcccgcagacgtgactcacacccacactctccccataagagctgtcgcccgcagaagtcactcacacccacactctcactataagaggtgacatatgcagacgtcactcacacccacactgtcaccataagaggtgacacctgcagacgtcactcacacccacactcgcaccataagaggtgacacctggagacgtcactcacacccacactctcaccataagacctgacactcgcagacgtcactcacacccacactctcaccataagagctgatgccggcacacgtcactcacacccacactctcactataagaggtgacacctacagacatcactcacacccacattctcaccataggagctgacacccacagacatcactcacacccacactgtcaccataagagctgaggcccacagaggtcactcacacccatactctcaccataagagctgacacccgcagacgtcactcacacacacactctcaccgtaagagctgacacccgcagacgtcactcacatccacactctcaccataataggtgacacctgcagacgtcactcacacccacattctcaccataagagctgtcgcccgcagaggtcactcacacccacaatctcaccataagagccgacgcccgcagacatcactcacacccacacacgtcactcacactcacactctagccataagagctgacgcccgcagacgtcactcacacccacactctcaccataagaggtgaaacctgcagacgtcactcacacccacactcaccataagaggtgacacatgcagacgtcacacacacccacactctcaccataattggtgacacctgcagacgtcactcacacccacacatgtcactcacacccacactctcaccataagagctgacacatgcagacgtcactcacacccacactctcaccataagagctgacacccgaagtcagtcacacccacacacgtcaatcacactcacactctcaccataagagctgacgcccgcagatgtcactcacacccacactctcaccataagaggtgaaacctgcagacgtcactcacacccacactcaccatgaggtgacacctgcagacgtcattcacacccacactctcaccataattggtgacacctgcagacgtcactcacacccacacgtcactcacacccacagtctcaccataagagctgacgcccgcagacgtcactcacacccacactctcaccataagaggtaacacctgcagacgtcattcacacccacactctcaccataattggtgacacctgcagacgtcattcacacccacactctcaccataagagccgacgcccatagacgtcactcacacccacacacgtcactcacacccacactctcaccataagaggtaacacatgcagacgtcactcacacccacactctcaccataagagctgtcgcccgcagaggtcactcacacccacactctcaccataagaggtaacaccttcagacgtcattcacacccacactctcaccataattggtgacacgtgcagacgtcactcacacccacactctcaccataagaggtgacatctgcagacgtcactcacacccacactctcaccataagaggtgacacccgcagacatcactcacacccacactctcaccataagaggtaacacatgcagacgtcactcacacccacactctcaccataagagctgtcgcccgcagaggtcactcacacccacactctcaccatagagctgacgcccgcagacgtcactcacaccgacactctcaccataagagctgacacctgcagacgtcactcacacccacactctcaccgtaagaggtgacaccagcagacgtcactcacacccacactctcaccataagagtgtgccccgcaggcgtcactcacacccacactcaccatatgagctgacacctgcagacgtcactcacacccacattctcaccataagagctgtcgcccgcagacgtcactcacacccacactctcaccataagaggtgacacctgcagacgtcactcacacccacactctcaccataagagctgacacccgcagacgttactcacatccacactctcaccagaaggggtgtcacctgcagacgtcactcacacccacactctcaccataagagctgtcgcccgcagaggtcactcacacccacactctcaccataagagccgacgcccacagacgtcactcacacccacacacgtcactcacactcacactctcaccataagagctgacgcccgcagacgtcactcacacccacactctcaccatagagctgacacccgcagacgtcactcacacccacactctcaccataagagctgacacctgcagacgtcactcacacccacactctcaccataagagctgacatctgcagacgtcactcacacccacactctcaccataagagctgacacctgcagacgtcactcacacccacactctcaccataagagctgacacctgcagacgtcactcaaacccacactctcaccataagagctgacacctgcagacgtcactcacacccacactctcaccataagagctgacacctgcagacgtcgctcacacccacactctcaccataagagctgacatctacagacatcactcacacagtcaactcagtcagtccttatgataacccttagtggcataaactgtcatggtccccattccatattcagaaactagagcccagagaggttgggtgccttgctggagcccatagaggaatgggcagcggcaggaaagtctgactgacacttagcacccatgagggaggtacggaaacaggatcaaccattccagaccaccgggagctcaggaaacctcatcatcgtgctcacttgagccaagatccaggaaatattaagtccttaggggcttcaaaagcgaaggagaacggcagggtggacaagtgctgggttcttttcagccagcacatgccgatgaccagctctgcgttgcagtgagctgagattgcgccattgcactccagcctgggcaacaagagtgaaacttcatctcaaaaagaaagaatgtaaccatcaaaattaaaacttctgtgcatcaaaggacactattagcagcaggaaaaggcagccagggagtggggaaatatttgccctcatctatctgataagggatttgtatccaaaatacataaagaaccacaactcgacaacaacaacaaaaaacctgattaaaaacgggtaaaggacctgagtagacttttctccagagaagatgtacaaacagctgaaagcacagggaaggcgcccagcatcaccagcgtcaaggcaacgcaaatcaaaaccacagtgagacctactgcccgctcagcaggacatctgctatcaaaaaacgaaacgaagcaaaaccgaaaataacgcgtgtgggtgagaacatggagaaaatagggccctgtgctccgcgggcaggaacgtaacctgatgcagtcgccgtggaaagcacacgggaaaagttcaatgtggaagtagcagatgatccgacagccccatttgattttacacccaatacctgcaagcagggctcgcgcagaggctcaggcagccatgctggtggcacatgggctgtcgcgactgctcccggtggaatcagccccatttctgattttacacccaacacctgcaagcagagctcgcgcagaggctcaggcagccatgctcgtggcacgtgggctgtcgcggctgctcccggtggaatcagccccctttctgattttacacccaacacctgcaagcagggctcgcgcagaggctcaggcagccatgctcgtggcacgtgggctgtcgcggctgctcccagtggaatcacagctacaatcgagctcaggtaaaggcttccatggagggtctagactgcatttccaggcaccaggatgagtttaaattcagctcccaaagaagaccagtgaacacaccaatgaacatacacttcacactgccacaccccaagataagacccagaaactcacattcagggaaagacagcccctcttacatgccacccagacccccatacgagagtgtcagaccccagcaccttccaaaaacacaaaatgtccccctgccgaggagccagcacctgggcccttagaagccgtgacaacgagcagcaaagcgcagggcctcacccaagagatacccaggacagcacagacgggggaagctccagcaaccccacacaggccccaagaagccaccagccagaccaggctcgggaagagctgtcttcagcaggaacaaggcagtttagtaactagaagcaatatgggatggggctgagccatcatcaggagctccgtccagtggggagcattggccccagtcgcaggcaagggaggctgtttcaagtttaggcctccagaagaggcagctcctcgaccaaactgaagacacataatttcctgttaaattaacacttgcaacgccttgcacccaggtcttgaatgctaattatactcgccggcatttaatacaagacaccctggagtctgggctgaaatgccacacaggaatctggaatcgcataaaacgtggaaaaccagacttttctagcccaagaatgagtgagatgtaaaaatcaaagaggtcccacacgtaacccaccaagaaagaacaagtgaggctgtgttgctggaggtggtcgctctccccaagctcagtcctgacagaaatgacgctctgacggtgcacgatttgcaatgtgcaggaacagaccccagcacctttcatcggtgggtttaggagaggggcccaggggaccctggcactcctctgatgagaaatcaggcaccagcttgtgcatctgtttccctggaaatcactgcttccctgttggtttgcacatgtcctgtcagccctgtgaggtgagaacccagaagctgatggacgatacccaaaacagagctttaggcagaagacagcttggacccaaggcctcagttaggccatggagggaaagtatggtgcggacacctgggaccgcagtgggcgggagaaattctggaggataaaatgttgggccccagtgctccatctctgagggtggaccctgctgcctgggagcagtcctggcaggacccccacagtccacgtgactgatggtctaggcctatgtctgctcaactatgatggcataaacacccctcccagcagagccttgaaactaaagaagtcatctgagtgactagacgttaacaaggagagaaaacctaactgcctgtctcctggccaacgggaagacaggttttttgtcttactttgggttttgtcttaatttgggttttttgtgggctactctggtaaccagagctttgtctggagacagcgtgttcttataggaggccacagagggttttatgaagagtaagcttcggaggctcaggaggacttgtatttttgagcagggtggagcaagagaaagaacaaagacaaaggccaccggttttggaagccccaggtagaaggagacagggtcttccacccccgtggaaaaacctcctgaagctacaagctggggccaaagctggtgtggcagcagtggtcacccagagctttccaatgccgtccactcatcccaggtggggaaactgaggctgaggaagcaaaatgacttggtcacacacattttataatttacaattgtatatatatatgggtgtccattttcacacagctataaagaactacccaagactaagtaatttttgaagaaaagagatttaattgactcacagttccacagggctggggaggcctcaagaaactagtcatggcaaaaggcgaaggagaagcaagcaccttcttcctgaggcggcagaaggagtgggggtggggggagtgctacacttttaaaccatcagctctcatgagaactccctcactatcacgagaacagcgtggtggaaaccacccgcatgatccagtcacctcccaccaggtccctccccaacgctggggattacaactcaaggtgagatgtgggtggggacacagagccaaaccatatcaatgggtacaaggcaatgctatgatttatgaatacaatgtggaataattaaatcaagctagttaacatatccatcacttcaaatacttaacatttttgtggcaaaaacatttggaatttgttctctcagcagttttgagatgtataaccgtctactgttatcttcatcacactgtacaatcgaactcaaaaaattgcccctgagatttgtgccctccacctgttatctccccattccctccacccctggcctctggcgacctcagttctactctctgctactgtgagttcaattgttttcagttccacatatgagtaagatcatgcggtatttgtctttctgtgcctggcttatttcactcagcgtaatgctttccaattccatccatgatgctggaaatcacagaattccttcctttttaagactgaatagtatcccactgtgtctttatccatccatctgtcgatggacatttaggttgattctatgtcatggccattgtggacagtgctgcagtaaacatgagggtgcagatctctcttcaacatgctgattttacttcctttggataaatacctcatagtgggattgctagatgatatggtagtttgttgtttgagaggcctccatacagttctccataatgactgtaccgatttagattcccaatagtgcacaagatttcccttttcaccacttcctcaccaacacttgctgtctttttaataatagccattctaacaggtgtgatatgatatcccattgtggttttgatttgcatttccctaatgattagcacagttgagcatcttttcacatacatgttggccatttttatgtcttcttttgagaaatatctactcagattctttacctgtcttttaattgggtttttcattttcatgctattgagttgtttgagcttattatatattttggatattaagcccttattggatgtacagcttgcaaatattttctccccatccttaggttgtctgtgcactctgctaactgttttgtttgctgtgtagagctttgtatttgatataatcccatttgtttatttttgattttgttgcctgtgctttggggatcaaataaaaaaaattgttgcccaggataatgttatgtcattttgccctgtgatttcttctagtagttttacagtttcaggtcttaaatttaagtctttaatcccttttgagtttttgtatgtggtgagagataagttctaatttcattcttctgcatgtggatatccagtttttctggcaccatttattgaagacactgtccttttcccattatgtgttcttgccacttttgctgaaaatgaattgagcataaatgcatggattcatttcctggctctctattctgttccattagttgatgtgtctattttgttttgttgttgccagtaccacgttgttttggttattatagtttcatagtatattttgaaatcaggtggtgtgatgcatccagctttgttcctttggctcctgattgccttggctattcagggttttatgtggttccatatgaattttaggattgcttttctatttctgtaaaaaaaatgccattggaattttgataggggttgcactgaaactatagattgctctaggtagtacggacattttaacaatattaattctttcaatcaatgaacatgggataccttctatttatttgccttgtcttccatttctttcaccatctcatagttttcagtgtacaggtctcaccgtctgggttaaattaattcctatctattgcagtcacacatttttttagtggcagcactcaccttcttgagtgaaccatggaggttgtggcatttgcttgtcaagggccttgcattcctgggggtgccccctctgctgttgtggtatcctaggatggctgtcaatccctaaacttgctcccttgcggcccaggagccacaagaacatctcattccctgcccagtcactggtcaggtgcaggccctgacccattccaaaccacggccccctcctacatgcttttctctggtggaagattctctcttttcatgcagattggttgctaagccctgtgaacaggagtgaacaggtggacaagcagccatcccaacaccacacaaagagagagaaactggagacaaaagcagcggggagatgctgcagatcccggccactgtgccagagccaccctgggttcgccattcacagccccagagccaccctgggttccccattcacagccccagagccaccctggggtccccattcacagccccagagccaccctggggtccccattcacagccccagagccaccctggggtccccattcacagccccagagccaccctggggtccccattcacagccccagagccaccctggggtccccattcacagccccagagccaccctggggtccccattcacagccccagagccaccctggggtccccattcacagtccagtatgccccacgtgagtctgtgttggcttctgtcacttgcagtcctgagtgctgagctgggccaggcccccaacacctgaggtccttccctccctcacagagttttcatgctcagttgtgaggtatggtgatggccacaggcccgaatcctaaccaccacagcacaggacttctcaaagagaccgtcactgtgtctcctgccccaacaaggtgaacagttctgggatgctaatccccactcactcattccatccccatcctggagcctcctggacagattccatcattaccctccctcaggaggaggcagtgctgagggtggcccacgtcactgcacccctgggtggtccctgagggcactgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggcccctgagggcagtgctgaggatggcccacgtcactgtgctccctgggtggtccctgagggcagtgctgagggtggcccacgtcactgcacccctgggtggtccctgagggcagtgctgagggtggcccacatcactgcacccctgggtggtccctgagggcactgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggcccctgagggcagtgctgaggatggcccacgtcactgtgctccctgggtggtccctgagggcagtgctgagggtggcccacgtcactgcacccctgggtggtccctgagggcagtgctgagggtggcccacatcactgcacccctgggtggcccctgagggcagtgctgaggatggcccacgtcactgtgctccctgggtggtccctgagggccccccgggccacatgaggcccacccccttcctgatgtccaagaacaagggcgttactagcgctcacgtgttcccctttgcagactaggtcacaggatacagcacggattccttccggcaaaaggtgctcagtaaagtggattgcagcatcctgtgtctcccctaaaacatcctcaaacagaatggctgcaccaagatgtatgggatctgtaccaagacatgggtaaaaagaaggccctggcatgttcacctgattgttactcaaaagccccacagatggaggctccattgagcattgaccctgaggccctaagagttgctgcccgaggagagatgctcaacatcagccggcacttccatctccgctccctctggcaggaacaaactccactgaaacaggcggctctttcccaagcaggggcaggactggctggttgccgtgttcccaggaaacatgtacagggtacctgcttcacccaggaagtgcagggaggttggaatgaaacctcagaaggatggagaggctgctcagaagatgctgactgcgggcctgcttctggtgtctgactgccgtctgcacccagaatctgcctgtcaattttgtcttcaatgattttgaaactcctgggggtgagggagctggagacaaatagtgacttagagtcccataacacatttgtccccatcaccccattggatctcagggctgcctgtgagccaggctgtgcaggaaggaaggtgccagagctgctgcctaaggtgccctagggacaggagagcccctgcctcctgccggccactggatccacgcccagtggatcagtcgctcatcaccggccaggccagtgcctcgcctcacctcacccagcctcacagttcagatgaggaaacagacccagaaggagcaagtagctggattctaggctatcaacaaaatgccaaaggcagaaaaaaccctgattttccaaaagggaaaaaaatgttggaatacaaatcaatttgtctgctgtttaccaaagctcattctctcccccagcgtttccaaatcccacccggcacacctgtggcccattcaggtgccagttccgtcaactgcctggaaatccctgcagagaacaacggcacacctgagcctcttccagagcccacagttatcccattacgaaatgaaaagctgctttggggaatgctgtgttgatgtgtcagcatcaaactgttatgcgggaggcagaaggacctcaccgacggcatctctcgccacctcgagggcacgggtgaggtgcaggaggaactcgtgctaccacctccacccacccccaggggttctgccccttcagaaggagggtccaggagggggactcacccgctggcaccattggccactgcacactattccccagctccctcctactgcaccccatgagccaccctcagttgggccccatccctgagtcccttttgggttcctaattgttgggcacagtctaagcccagggctccctgcaggcctgcagctgtctggggcgactcgtacactgtacctgctttccttcgttgctcacacagcagccgacacagtcactcaaaactcccatttgtgaaagtaagtggccttttaaagaatgctaaaacattacgggcactttagccccgcgtttcttactacacgaaacatggttacctacgagtgaaatggcagaaggaatgaccttattaacgcctcatccttctcaagggcaagagagtgcaactcaacaactccatgtgaacacctgccctggcatgcaggcagccgggccagtccacagccagtcacggccccacgggaggagccttctgagtgacagatatcattttcattcaggggggcttgaactctggccatcagaagagctggttactacaaaggtagcagaacaggaagtactgagaagaaagtgcacctttctgaccacccactcccagcccagctcccctcctgtctgctcgcctcctgtccgctcccctcctgtccgctcccctcctgtccgctcccctcctgaccgctcccctcctgtccgctcccctcctgaccgctcccctcctgtccgctcccctcctgtccgctcccctcctgaccgctcccctcctgtccgctcccctcctgaccgctcccctcctgtccgctcccctcctgtccgctcccctcctgtccgctcccctcctgaccgctcccctcctgtccgctcccctcctgtccgctcccctcctgactgctcccctcctgaccgctcccctcctgtccgctcccctcctgactgctcccctcctgactgctcccctcctgtccgctcccctcctgtccgctcccctcctgactgctcccctcctgtccactcccctcctgtctgctcccctcttgactgctcccctccctgccagctaccctcctgaccgctcccctcctgtccgctcccctcctgaccactcccctccctggccagctactctggagcaaacttacacaagcacacagcaggacccaaggatcagcttcgataggcattttccagaagtgcattagaatggctgcttcaccctcctgtgatgatgcctggaccctgaggtgggtcaggcccctcccgtgctgcagccgattcgtggctggattaaacttcttattgccccctgaaggtgaggtcaggcagcagaagcatcgtgcagctaggaatagaaggctctgggccccacacatttcagagaggcgtaattggggtaggctggtattggtaatcctgagtacaatattgattgacaaaaacgaatcacacctgagcctcaaagctcttagcccttccctgcaaagaaaactctctcttagaattaccaaatatagctttcaatcccttcaatctaaatgtttcaggtgagagcagagatagatttttcgaatggagacattaacctttctgagctgcagctgcctggctctctctgcctgttactctgtttctggaacatggcagctgctttcgccgcaccagggcctgcaccaggccacccagttacattcaggccaccctgggccaataggccagacactcgctcctattccgggtctcctaacagcaggccaacagatcacaccctgttagtatttagaataatcaagatttttatcagaagttgaagagaacagcagcatgtatttcactcaggacccttcattttacaaataagaaaactgaggtcctccacagccgtgctgcccactgggagcaccccctgcctcacaccacatcatccaataccacgatgcagatgtggtcctcactcttggccctgatggggcactctagcatcccactgttttccttaatagaaaacaacacaatagaagttaaggtcagagtcaaaagatgacacatcactcggggctttataaaatccaggactcatgtaaacaagtcctaaaactatgagtggacattcacttgctaagcacaatgttgaagttatggctgaaagcttactttacatttgcctaagaccacacttgtcatacacacctaaaaccatctgctgtcttctgagttctattaaaggacaatgagaaaacagcaattgaaatggggtttctggttccaaacggcaggacaggagcaagctgtctcaccaccccagcagaaacctgaaagcaaacatgcagtgctgagatgctgagatggtcaccagcaacatctgagaacccagaggtgaggatgagtcaggtcctggggccaccaggaacagaaaaaccccgaacagacagacagcaggagaaccagacccccacatctgcaaggcccctccccataacctgcctggcatccagtacacaaaagattttcccttgacacagtttctacacttagaaaggtgagataacaacagcttgccctgctcttgggtgccctggcaggagacctctccctgcctcaacccatggggagcatcctgagtgcctgaagggagaaacagccctgaggatggccagagacaaaggtgggggtggggctactgtccccagccctggaaactctgctctgcaactcggccaaaggaggcactcaatcagagtggccactcgcagccccacgctgcaggacctgtgctcccaggtcccctcccagccttcccacgttatcaggacatcccctttgggacatctgctttgggacaggcagcactttcatcagtgaccagagctgagttgaacctgggcttaaggcgccatctagtgccaaaaaggaggctgcaacctagcaagaaaacactccacaggtaaatcacaaagaatctttaagcaaacataccccagaaaaaccaaaacacccagacagagaagagataaataaataaccgttcagtgccaagacacagacacacatcaacaaaccagaaagcagcagacgggaccatggcctccccaaacggacaaagccaagaaccagtgactggcccaacaaagtggcgatttgtgagctctcatcaagaaatcaaaatggcagccctaaggaaactcggtgatccccaagataacaccaggaaatcaattcagaaagttaacaacagattgaaataatttttaaaaatcagacagaagtcttgaaacaaaaatacatttagcgaaatgaggaaattcatgacaagctcccaacagcagagtggcttaagcagaggaaagaatcagtgagctcaaatacacaatcagaggaggaaaaagaacaaagaatgaaagacaacctacaagatagagaaaattacctcaaaacaccaaatccaagaattactggtgttcaagagggagctgagtgagaacaagaggtaccaagcttactcaaagaaacagtaacagaaaactttctgaaacttgagaaaggtatagataaccagattcgggaaagtcagagaacaccagattcaacccaaatatgaccacctcaggcttttaataattaaactgtcaaagctcaagggcaaagagaagaccccaaaggaagcaaataacatctaaaggagctccaatttgtttgtcaacagacatctcaatggaaaacatacagaccaggagaaaatgggatgatactttcggagtcttgaaaggaaaaaaaaaaaaaatctgtcacccaagaatactgtatccagcaaagctacccttcaaatacaaagaagagataaattctttcccagacgaacaaaagctgagagaattcatcaccaccaaacccaccttacaataaatgctgaagagatctcttcattcagaaagaacaaaaatacatcgaatggggcactaagagggcagattctcattccaccttgccaccagcctgctgtgcaaacttgggcaaatcacttcacttctctgtgcttccatttcctaaattgagaccaatgaattcggtattttctaggatcctttccaatcaaatgttctgtgtttgcatgatgatagctagggtgctgcagcataagtgtctgtaatttagcttttgtgagctgtgaacattgcctgcctctctctcactctcctgccagctgctcacactgtgtcatctgtccgtttgtgtcaacagagaactgaggaaatgcaactgcagtgcagccctgcaatgggctggccaccagcaacaacggcaggagaggcaggagcagtcaggcaggctgggccccagaagcacgcagtggagaagcccgcagcagtgcagagggatgtccttatgagccaggacagagtcccctcatttgctggactctgcagaactacactggctgcatccaaaacccagtactcaccaccagatggcaacagggagaatctgcgtgcacaggagccagcctgaaggaagcatccagggaacgcaggggaagagcgtgagcgtgaaccccaagatgatggggtgagacctcgctcacaggcagatgcgaatcctccacgtggggatgcgggaaggctgttcttgccaaaggctgatgatgaccctgctgcctctctgcttatctgccctcgaaacagaatgtggttccaggcgccaccacccagcctagcagccgtcatgggcccacagtgattgagccctcaatcaaagcttttttattattatggaaaattacaagttttttcacaatgagttttcacacacatataaatcaatggaaaatgtcttcttggctgtctttatggtatttaagtaaatgattaaagttttcacagttgggataaaggacatccaatgtaaaagactgccatttctgaaaataaagacaatacaagctggtcatcactgttgacaaaaatttcctcgggaatctaaaataaccaacaagtcactcatttccctttgtctaacctactacatgcattttttatttataaagccccactcaacttatctttttcccctttcatcctgaattctgggagctcaaaggcaaccttaaggcttagttgcaggaactctgttgaccttgtgggaacatttgcttctttttccttccctatcacattcccacttcaaattcatcaactcatagagtatctttttgttgcttccttgggtttttttggacaaggaaagttgaacataatcaaaaacaacagtggtgaagtcctcacccaacactgccagcaatctgtggagcacagggcttcccacccggcagataagaaccccatgcacacctcttaaataaacaggctgatgctgagcaggcaccaccatccaggcaccatgctgagcgctgtgcgtaaagaaaatacaaagatcagccagacagagcctgtgctgcaaggagcccacattttatttgaggggccagataggtcacaattcataacataacaaagcaaaaggtgaaaagagctaaaaaaaaaaaagtagaaataatttctgataaattttctcttagcttttctatggggaaatcaggagaaatggactgactgggagaaagcttctggggaccaagtaaaacccatcacgatcatcatcgaaactgtggctgggaagatcctgggccccagcacagggtcaggtgggctctgtgctggccgggagagcggcctccgtctggctaccaggcctctctggactgcagagttagtttttctgcaagtaacagagtggaacccaatggcaggaacatctccaattccgaaattccatggtcctgtgcaaacaaccagaaaatagaaaccaagatttgaggacggaagaggaaccggacgaatgatgtgaacacggggcttgtttgcaggtagagtttactgggggaaagcatccacattacataaaagagaaaggagacaaaacgacgcccggcagtgggtgcccggcttgcaggcctctgcggcaggtctgtgggttccctggcccagcggcaccacccaaaggcgagggccaggctgtcgttgacgccctgtggcagcacctcagtgatttcaggggtggttttgactctttctgtggaggtgacaggaggtgcctccatcacagacacaaatggtggcttcctggcttgctcggtagacgccaggctatgctcaccccaaggccagaccccggacaaggccaggggctggcccaacactggccttcagggtgctgggcaacctgcatttgctgcgcagcccaggcccacccaaatcactgagggcgtcacacaggcaccgtcagctgcgggtgctaagaaaagcggcaggagaggaggaaggcagcttatctgtgcagccgtcagccatcagcaagcctgtagcagccactgccaagcaaccgggacccagctcttatgtcccgtaaggttccagggaccattccggggagaaagaagggcctggtcccagggcaggaagctcacaaggcaggaggcgcattgcgtccagcaggggtgtcccattgggacagtggcggctctcagaacccagccgccagccctcaactctggctcaccgtcccaccaccaactagagggccccggccaagccaagggcaaagtaggggacacacttacaatcaggggtgcatggggctcctcccctccccttgtgtgtgcatgtctctgtttctctctttctgtctctgtctctctctttttctctctctggccctcccacaaggcttaaggtggctccttagaatggaaggcccaactttgtgagttactcgaatacatgaactcagcccaggacagtgggaacagcagcccggctcacccctgcaggcggggactgggtgcccagcaagcctcgggaggctgccccaaaccaaccacagggagacctgagacgccctacgcccacctttcttccggcctggtcttaaactggtgggaggggcgtgggctgaggtagccatggggggccctctttcctgccctcagcttcacctttttcaggagcatggcctggaagctcagccattctcagaaggatgggctggaggagggctgcaggcggctctgcccttcctggcctccagagacacactgaaagcccagttatcacaatattcggccgacggaaatggtttcatgaaaatttaccagacttgaaagcaatgactcaaagaaatacgtgtatgtacccccacgcacacagcatgttattcacagaagccagacacagaaacaacccaggcgcccagcagctgaggggtggagaaacagaacgtggtctatttacacgacagaatgggactcagcctcagaaaggaaggagacgctgacacagtccacacctgcaccagccctgagcacgcggtgctgcctttagcgttcggctgcagccgggcacatgctccgattgcactgatacgtggcccccagatggtcaggttcacagaaggtacactgagtgcagccagggccttggggagggggagtcagcattaatgcgcacagaggttctgtttggaatagaaagttggcaggtggatggtggtgatggctacacagcagtgtgaatatcctttataccactgaactatatccctaaatggttaaaatggtcattcttatgtataagttactgaaagtctttaagaagtgataaaaggtttactgaataaatgagaaactggatgggagggacgccatccccactctaaggagtctggactatgaggttgatgatgagcatgacctcaaggccccagcatagctaatccaaccacaggaaggcaggcagcatctgggaggccccatcagcaaggccatggccggcgagtccctgctcagaccccagaaatccaaagtgattcacgcacaggtgggaagacgctatcaatactcacaactttaaccagacacaagtctacagaggcgaccatcactaacgttgaaaatgtcttggcttctgatttgaacaggatcagacctcaagcacgaaatgaatgctttaaataatggatgttttttcaagaaacttaatttggtatcacattggccaagaggtcatttggcgaggccaacacacagtcacaaaggaaaggtggtcctcagtgccacccaggcactccgctcggccagccggggggacccagctggagccataaaaggactgctcccaggtcaacacgaaggcctgcccaaggactcctgcggccttcaaagatttgcagcctgaggacaactttcagcaacaccgcgacactctaggttgttttttcaaagattaaacataataataattctgtaaaaccaacatgggtcatcattaattactgcaccgtgaccatggctatttaaaaacccagcctcagcacagtagctgacaaacattaatgagcagtaatgtacacgtggtgttgtcgatgaacggataatgaaagcaatttatttgaaaattaaaacatgattaagaatggcagcccaagcgagagcccagatgcctgaagaaggcattcctgatggaatggccttcttcctctgacagtttttaatatacagcaccttagcttggcccctccttggtgcccaagacctaacactggagatgtcagctgtggagagtgagaagacaagcccctcagtgggacatctcacagcgctccttaagagcagcgtgtgaaggggacacggacgctgcatccttcctcacccagacaacccacagatcccaagtccacccacacccaggacgacgcacagaccccacatccaccctcacccaggatgacgcacagaccccacatccaccctcacccaggacgacgcacagaccccacatccaccctcacccaggacgacgcacagaccccacatccaccctcacccaggacgacgcacagaccccacatccaccctcacccaggacgacgcacagaccccacatccaccctcacccaggacgacgcacagaccccacatccaccctcacccaggatgacgcacagaccccacatccaccctcacccaggatgacgcacagaccccacatccaccctcacccaggacgacgcacagaccccacatccacccacacccaggatgacgcacagaccccacatccaccctcacccaggatgacgcacagaccccacatccaccctcacccaggacgatgcacagaccccacatccaccctcacccaggatgacgcacagaccccacatccacccacacccaggatgacgcacagaccccacatccaccctcacccaggacgacgcacagaccccacatccacccacacccaggatgacgcacagaccccacatccaccctcacccaggatgacgcacagaccccacatccacccacacccaggatgacccacagaccccacatccaccctcacccaggacgacgcacagaccccacatccaccctcacccaggatgacgcacagaccccacatccaccctcacccaggacgacgcacagaccccacatccaccctcacccaggatgacgcacagaccccacatccaccctcacccaggacgacgcacagaccccgcgtccaccctcacccggggtgacccacagaccctgcatccaccctcacccaggacgacgcacagaccccacatccaccctcacccaggacgacgcacagaccccacatccaccctcacccaggacgatgcacagaccccacatccaccctcacccaggacgacgcacagaccccacatccacccacacccaggacgacgcacagaccccacatccaccctcacccaggatgacgcacagaccccgcgtccaccctcacccggggtgacccacagaccctgcatccaccctcacccaggatgatgcgcagaccccacaccctggcaacccacagaccccgcgtccaccctcacctggggtgacccacagaccctgcatccaccctcaccaaggatgatgcgcagaccccacaccctggcaacccacagaccccgtgtccaccctcacctgggacgactcacaaaccctacgtccaccctcccccaggatgacccacagacgccatgtccacccctccccaggacaacccacagactcttcatccatccttgcccagaccccatcacagctggctggagaaggacgctgtgaaaacctcttttgctctttcttgctgctcaggccatccacacctggcagaaatccccactgcccagttccactgaagccctgggctccaatattcagacctgagacccaaacagccctccagagagagctgagccacagacgatctggagccccggagccagccctgccctcaggacaggctgttagcagatgcccaccatggaccttgggggcactcccggaccctcctgggggatcctaggcaggcatggatctgtgttcccccaacacagataccaacaagggccccaggaaggtcagtgcctggagccaggtgtgggctcaccttcaccacagatggtctggctggggcaggccctcctgagaacctgagctggcactgcccagtcctcactgtgtctctgcctgagccctgcctctccctcatccccctcttcccagctcttcccgctgagcctggaccctgcctatggagctcatccccgcttctctcctcccttcgtttcttggccctgaatcccagccccttccccatcgtgggttccatctttcctccgtctgtctgtcactcatcccgtccctgcacctgtgctaccatcaacctcccagcctgggcctcttttccattaacaaacagcccagcccagactagaaatgcagagaagccacagctgcaccagcaggcaccacctttcctggacctccatcgccccagctctcctaactcagctctgggctgtccagaggaggaggcagaagaggccgcccctgcccgcccggcctcagcctggtgtctcccaaggccagcactgtcctgtgtggcaagaggatgaagggacagagcccctgtgcccggcactttcctcaggccaccctggccccaaagcacaggaagaaaaaaatgtccacaactcatttactcacagagaagaaaaatttgactttatttgtaattaaagatggcctaattaaggcaatgtgacaattctgcccatcagacctcagaaaggcaaaggactttgtgggataactcaggttgctggtgaatgacatggactcatctacattttgttgggcacaaattaggtgtcccctctgcaagggacaaatttgcaacttgactgaagttttaaaatggccaagccccaggagccccagtttctctgctaaagatatattctaaggagataactggatgtgcgtataaaaccgtaagtcaggtttgtccatcacaaccacgctcatcctggtgaaaatgcagagaatcagggaactcgagtccagatgagaggtagtggagaaggaaggcaggggtctgaaagccctgcagatttccaagggttagtgttcacttctggggcccaaacatcccaggggcagtagccccaaagccccagatgggactggctcagtcaccgtccctctggggaccttgagtcagaattaagagtcagaattaaagagaagtctcaaaacgacgccactggagacacaatcgcaattcaggccaccatgttgtaggtggccctggtccccatgatccatggaacagaggcggccccagctgtctccgcaggattatgcaccgcgcgtcatgagccgagggggacaggacccgtggagcaccactctcgaaagccctttccctggggccagatggccagcaccatggacagcagctcgccagccttcgctgagcctccaccagagaggcaaggggaggacactagggaggccaggagaggctacgggaggacgctcgggaggccacgagaggctacaggaggatgcttgggaggccatgagaggctatgggaggacgctcaggtgctcgcagaggccctgagaagctatgggaggatgctcggttgcttggggaggccgcctcctccagagcctctggaactaagtcacacccacgctggaaccactgcgagcccaatttcggaaaaaacaaaacatacaagtgaaactcagcccacagctctgaattcattctctgaccagagaggtcctgcagccccgtcgaagcctgcacacaattcctggtgagcgctttcctgaccacctgacctggaagggcctcacccagtcttgatcgtcacatttcccagacaaacataaaatcgtgcctgcctaggagagaaccgcgcatgctgatacagtgagacaggcagggtgccagaactccgaggtgagacacttagggtgtcccagggcgctcggcccccagagctctgaggtgagagagccaggagaggtcgggagggggcggggcacgggcctgggaagcggctggcctgcagctcaggaaccccagtgtctgggtctccacggatgcctctggcaggtcagggagaggaggtggccgatggagagagtggatggaggagtctctggtgttgatcacagtggactagaatatgacagaaaaggggacttcaggctggcagacaaccacacacacacatgcacagacacacatgcacatggggagacacacacacgcttccccagacatcgcctcctgccggacgctgtttcattcttctctttgaaaggcgaacgatgaggcagtcagtgaccttctagccaatggggctttgggaaccaaatcaattccttaagaccaaaaaccctgcctctcaccatgcttcccccagcagggtctgcagagcccccatcctcacttcatctgcctctcgccatgcttcccacagcagggtctgcagaacccccatcctcacttcacctgcctctcgccatgcttcccccagcaaggtctgcagagcccccatcctcacttcacctgcctctcgccatgcttcccacagcagggtctgcagagcccccatcctcacttcacctgcctctcgccatgcttcccccagcagggtatgcagagcccccatcctcacttcacctgcctctcgccatgcttcccacagcagggtatgcagagcccccatcctcacttcgtattcaggtaagtgtgaccaagaatgtctctttttctggtttataaatcaattttttaaagatctcctaagatctgagaatacaagcaaagagacagtcacatgtaagcttaataatgaggttcatattaaaggcagacagatgttcaattaaacatcagacttcacgctgacacgctgagagtgaggatctccatgcataattctccgtcccagccccagatcccgggagttttgatcacacagctgggaagtcgtcatccaagcctcggatgtgtttgtggggcatcgtctatagccggggctcctcccctctctctgtccacacacacaggtctccaggcatgtttacctctaaatacacaccctgccaaggactgtggcctggaaagtcataggcacttgacttctaccaaaaaagaaataacggaacggcatgagaatggtcacacctgagcaggcagctaacagcaacaggttcactacacacaaccacccttgcacatatgcgtgtgcacccacaacacacacattcacacacacacacgcatgtgcacacacaacacatacatacattcatacagacacacacgttctcaccctaaagtcatggtcaaattgggtggtttactccacactattttaataaatagccttcactcttcagacacaatctgaaaaaaccccagactcgaaagcgtttcccataactcaggacaaggaatcacgcaagtgggaaaccgtccttgcgagcgcctcacgtgagccacagtcaccgcacaaagtctccatcgcgttggacggtccgtgggaatttctcagggctccggaggccagcggggctggaggcagacctcatcggcacttctgacaacggcaatttttgtgctcctcacaaccaacgagggtgtgatttttcccatctgtcttcccttcctcacccctcccttccccttctcttccctttgtctctcctccctctcttcctacaaaagaaatcacatgacatcgattccctgatattcagatcaatcagctggagtgacaggaaacacgttcgctcccattggaaacagcacgtgctccagcagagctcaggtgttgttgaagcccgttagaactggcatgcgtggagtctgctcccatgcatgcatgcacacgcacacacacccacagcatccctgggagaagccgcagcccaatgcacacgcacacacacagcatccctgggagaagccgcagcccaatgcacacatgcacacgcacacacacccacacacacacagcatccctgggagaagccgaagcccagtgcacacgtgcatacacacacacacacccacacacacacagcatccctgggagaagccgcagaccagtgcatgcgtgcacacacacacacccacacacacacagcatccctgggagaagccgcagcccaatgcacgcgtgcacacacacacacacactgcatccctgggagaagccacagcccaatgcacacatgcacatgcacacatgcacacacacccacagcatccctgggagaagctgcagcccaatgcacgtgtgcaaatacacacacacacagcatccctagaagctgcagcccaatgcacgcgtgcacacacacacgcacacacacacagcatccctagaagctgcagcccaatgcacgcgtgcacatgcacacacacccacacacccacagcatccctgggagaagctgcagcccaatgcacgtgtgcaaatgcacacacacacacagcatccctagaagctgcagcccaatgcacgcgtgcacatgcacacacacccacacacccacagcatccctgggagaagctgcagcccaatgcacgtgtgcaaatgcacacacacacccacagcatccccgggagaagccacagcccaatgcacgcgtgcaaacgcacacacacccacacacccacagcatccctgggagaagccacagcccaatgcacgcgtgcacacgcacacacacccacacacccacagcatccctgggagaagctgcagcacatgtgtaagctgccaataccctgcacacggctctgtgactggagataatgaggaatcgccatggcaacccgggaacaagcccacagcgccttgtttccccgaacgcagagccccggcagcccctccatccaccgagacatacacggctggaaggacgtggtgctgcggaccatgggtggttcttctgccacatttgctgggacttgtcctaaggacattttcaatttctgaaatcagtcgccattgacggccagggttctcattcctgaatttttgtctttgcttctggttaccagagatccaaagctgcagtcgtttagctggtttctgtttccaggggtattgtgaatggaaataaaccatgaaaatgaccgaagacgtcacaaggaaagcaaataggatttaaaacagcaaagcggtgcctttgccaattccagggagtgtttctgctacataaccctgtctgtgctgggcagtgccgctcccgtgcacccaggactggaaaagcatagcttaggggttcaggggagaaacagtgacctctgcatcagaaaagtcctagataagttgccaggaaaggcaacagcacctggaatgagagacaagctcaggactcgtgccccaggctgcagggacacccacagagctgacttctcctcggtcaaccagcccccagtgctcggaagcatctggcccaggcacaagcatgctcctgctgctacggcagctgaattgggaagtatggcgggggcacagatgccccaggtggacggccaggcctctggtccacacacaggcattcactccccatgtggccatgagcccccgattctccaagtcctgtgttctcacctgtaaaatacggaagctatgctagacaactgctgacttccctcacctgagctctgtggtactcagatatcctcactggtgggaaagggaaaggccacggccatcatgggcaggaggacgcagtggttcacaggatggaggcaccaactgggaggctgggcggtggcactcacactgtgctggagtcaggctggctcctggggagcacgtcagtcacctgcttaattcaccatgggttagctctccgcgggcgaaggatgacgaaattacgttgtaagtgagcctcagcattctgtcctttggaaatagccccaagaagtctgggataagctctattaatgttagtttttttccagagagtaaaaaataagctcttgaacccatccatggctatcagaatgaaggaaaagtcgtttgacctccttggcccagagcccatcagatgctcagtcattcccctctaaaatgcaactctctccataatgagttcattttcaaaagattcaattatatggaccgtttctccagacggtttacaaatttcaaccatggcagcagcatttgggaatggctcatctgctcccaccataacttagggccatgttcctgtttcaagacaccaaattcctgagtttgactttcccttctgcaagtttcccagaggaggaaaacctttaaattgagctgaggaaagaacaatatttgaccagcaccagaagtcaccgagcattttaatacaaaccttattgatgaggctttactgtccacaccactgcatatctaagtcagagaatttgtcctgtaattccataacttcaacagggcaaacgtttacagtacaggttgattctagagcctcctgcaccggcctcccaggatattcggcagcaggctgaacccaactggaacatccctaccaggagagaagcgggaccctgtaacagctgccacagcttccctgggaggcccccgcttgtgttgacttcagagaagcaaatcttgacttttcttagcgactacctaaagctttcattacaaactttcttgaaaaagaaaaaatggtattcctaccagcatcactggctgggctagcactgatcacagtgatgaccaggtagatgaagtagggtttccatacatgatggaagccgacagccacactttgaaaagctcagtgtggacttttaggtgaagttcatatgaaactgttagttcctggcccggcccgcccgcacagtaaatgagaaatgacaggtgtggaagccaggaggccactgctttgctgcacagggacgtccaaggaccaaggcacagagcagctggggggctccccagggaggaaggacagcactcagccccctcccctgcaggtccctcagagacccaaggcccagctgggccccaccatcctcgaccccccaagtcttcctccttgctgtggccacacagaaactgtaattttaggacgagagctctgccagacagaggtgaagaggcaggaattgtgtggggtccagaggaaccagagtgtgatggttaacactgagtgtcaacttgattggattgaaggatggaaagtattgatcctgggtgtgtctgtgagggcgttgccgaaggagattcacatttgggtcagtggactgggaggggcagacccaccctcagtctgggtgggcaccatctaatcagtcgctggcatggccagaatataaagcaggcagaatatcgtgacaagactagactggcctagcctcccagcctacatctttctcccatgctggatgcttcttgcccttgaacattggactccaagttcttcagccttgggacctggactggctctccttgcagacagcctattgtgggaccttgtgatcatgtgagttaatacttagtaaactcccctttatatatatatacacacatacacacacacacacacacacacatatatatacctataaagttatatacatacacgtatatgtaactaatatgatatatatatatctgcccctctagagaaccctgactaatacacagagtgtccaaaagtgaatcactcaacacatggtgagggtgccgggggtcagaacaggacccccccaacctggggccactgggcagatgctatcagcaccaggctgacttgaggccacacatggcatctgcctgaaccgagaggaaacgcctcccactgtccagtagagaaagtaaaagggccaaggggaatctgctcattcaccaatctgtttattggtaaatatcagccctgattacacatttcccgttataaggataaaaacgtgaaaacatagttacaaacatacacagagaaactggaacactgaaacagaaaaaccatgtgagagccacaaaatgattctgtagcacggaaaaggcaaacctacattgaaggtacaggaaaataaataggttttaaaaattacagttggaaacccatgtaaattctaaaaagcatctgatttgtgttctcaaatttaagaaaatgacaaccataaaaagcaagataacagcactccagaagtccccgacctgactgggcggcagacagactgagaaggaagtctgtgaagaggacagtgtggtctcagcgggcaggaggcccagtcagaaacaccgagggcagaactgtcccgggaagtcacctcagtcacacgaaagccaccgtgaacaggagcttagctacagacgatgggaacgaggtgatcaacactgcaggagaaactggtgcacggcggtgactgactggggatttggcataaggacaactgccttttaaaggctgggagaggccagcgcagtggctcatgcctgtaatctcaacacttagggaggccgaggcacaccgatcacctgaggtcaggagtttgagagcagcctggccgacacggcaaaaccccatctctattaaaaatacaaaaattagctaggtatggtgacacacctgtagtcccagttactcgagaggctgaggcaggagaattgcttgaacctgggaggcagaggttgcagtgagccgagattgtaccactgcactccagcctgggtgacagagcgagactccatctcaaaaataaaaagaaaaaataaataaaggctgggagggctgggcgcagtggctcacgcctgtaatcccagcactttgggaggccgaggcgggtggatcacgaggtcaggagactgagaccatcctggccaacacggtgaaaccccgtctctactaaaaatacaataaattagctgggcgtggtggtgggcacctgtagtcccagctactcaggaggctgaagcaggagaatgccataaacccaggaggcggagcttgcagtgaaccaagattgcaccactgcactccagcctgggtgacagagcgagactcctgtctcaaaaaaatttttaaaaatcaatcaatcaataaaggctgggagaaccagaataaatgaaagaaagcaacatgcaaaagtggaatacaaaaaaacttccacttccaaagatgctcatctgaagattcagagtttactaaataccacacaaaattaacaatttttaaaacacccttacacacaactgtttttgaattctaaagaatcaaacgaactatcacaatgaaagagttttggtagagcagcccattataagaaaaaaagtaaaaaatgtagcagcaattgtcatttgggaaatatgagaaaaaataatctcactcggtcataacgaaaaattttcagatacctaggaacaaacttgaccaggtatgtgactgcgcagggaagaaacacgggcccacagtgtggacaaggataacacggccaagtgaccctgacagcaacatggatctccaatggcttagatggattcaagtaaaacctttttttggtaggaaaaatttaggtgaaaaaaaggaaggaaaaaattaggtgaatagttatcagatcctataataagagagacttcctaaacaagcaaaggaaagcaaaaaaaaaaaagattaatttcacttcatgaagatttaaccttctatttttaaatacatgagaataaaatatatccttatgttttatttgattaacatttgtaacaattttaccaataaaattcataaaagaaaacataaacttagcataagaaatgaaaaccaaaacgaggaggcatattttcctacacaattaaaattcttcactaataaacatccacattgatgaccttgtgacgcaacaagcacctcacgcttgagagaggaactttatgcaagttctcggaaggaaaattcagcaactctcaaaaatgcacacaccaagtgacctaggaatttcacttctaggggaatgttctaaggaaatgattcatatgcggaaaaccgttcgttttcaaagatgtgcttactaagaatcagacattgagaaacaaaggaatttccaaccgtaggtgaataattaaattacaccacattaaagatcatatttataaaacagataacgtgacatgctcaagatatagtacttattgagaaaaggaatataaacccatggatgtaattttctaaaagggagagatgaacctcacacagctggacgtagcgcactcagcgtccgtcgtggccccggggatgaggttctgtgagtcacgccacagacaccctctgccatcagccctcctgggcgctggctgtgtgcggaagaccccctcgcagggccacaccttccggggatgagcacctctggctgagcactgcaggcacagagggaggcttgccccgagccccagcagctctaagaggtccccgtggagtctcacctgcccaccccgtgctggtccccagagctggacccccaacgctggtccccggagctggacacccccaggctggaccccggagctggcctccccagtgctggtccccagagctgatccccccaacgctggtccccggagctggtccccccaacgctggtccccggagctggtccccccaacgctggtccctggagctggacacccccaggctggaccccagagctggcctccccaatgctggtccccagagctggtccccccaacactggtccccgaagctggtccccccaatgctggtccctggagctgatccccccaatgctggtccccagagctggtctcccatgagctggtacccggagctggtccccccatgctggtccccagagctggtctcccctgtgctggtccctggagctggtccccccaacactggtccctagagctggtccccaccacgctggtccccggagctggtccccaccacgctggttcccggagctgatctccaccacgctgatccccagagtgccccaagacagccccagcatctagtcaccctctgattcagcttcatgggcatctcccttttggtttttatttctgttttttatacagcttgcattatctttaagtgcaggaaaaaatatatatattaagcaaacaaatcaaaaggcatgcatagtcctgacaggcagagttctccaggctgtgattcagcacccagggtccaagcagccacatagggctgctaagactccccgacctgacagcttccgggcatccctcctgcaatctggggccacctggccactctagaacaccgaaggtaacactgagcagggccactacagggaggctgccagaggatgcgctgcacagggcagcacggccgaaggttccacccagcggcctcttaaatcaaggacttccaggcagaggaaactcctgtggccacacccccaagatggctttgtctgtaaaggagcgttaacatcggcatttataagactaatatgacagcagatgtgctttcctctgacgcccgtacgctgcggaatcgcattatggaaatagagtgccaaatggatgccttgacctcggggcccggcctattctgcacaaagatgacttctgaaatgagttttttgctataatttgctcttgcctttgctaaaaggttgaaggcacttctattccaactgagtgtgagtaacgctaatttcatagcgttagctgcatgttcttaagcacgtttatcttcagcaagtacagttctgttgattgaaagaaagaaatatttctttttagtaaactagtattcccaaaggctgacagaccatctttgtatcacacacagttactaagggttcctttgcttaatctcttcagaggaaaaacagaccagctgccactgaagcaaacgaagtctctcctggcacccacatttggttgttttaggtttggagatggttttctgtgcaattaatgtgattcatccatctttgaaatgaagaattacactgcagtgcggccagttcccaccggatgaaagttgaagaaggagcaggattggaaatattcaaataaatagcaactgtttcagcccatgcacctgcagagtagcagccagcctgcaggccaggaaagggagacgctctcatccggcagcatctgggcgccctctctggatgggagtgtggggagggccctcccgtctctctgcgtctcagcctttgccaagcccagcattctgtctctgcctacctggtgcatggataactctcaaatgcacagatgagaagatgagacgctgtgggtgctgggctgggccctgagggaaacgggcagagtgtgatgactgttcccacggtggcaacacgacgcccacgcgcccggcactggagtcagggctcaggcagcgggcccttctgaccctcgcagtggcccttctgacccttggggcaagtgcacttaccatccccaccgcaaacagaggaaacagaatctagagctgaggggtttgctctgggtccaagcagcagtgaaggggaagagctgggtctcaaacaccaaaaatccaatcacaaagctcccttgtcaggaggagggagccacctccaggacagaccactggaaatggaactctccacaaacaccaactcaaaaggccaatgctgcaggccaagaacacactggcaaaaggctgcagagccacccacacactcactcgctcctgtgaaaccagaccctgcagctcctcatagacacacacctcaatatcaacagcgcagaaactccactcctggacactagcccgagagaaacaaaacacgatctgtaaaaaggattgtacaagaatgtttagagagactttattcataggcgccaaaaactgaagaaagaaaaaaagaaagaacaaagcccgtcaacaggaaagtgggtttgaaacatggcgcatccactcaatggaactcccctcaaaacagagacaaaccgtccacacacagcaagtggacagatggaggctggaggcagaaattaaagaatgccctgcggaaatccagaacagcaagctttagacctggagaaaccaagcatatcgtgcaaaggaatgggagaagtcatttccggggcggggatgtggtttcatgggaactttctgggtgatgtaaatgttctaagtcacagcacaggcaggggctgcatgctgggtgcatttgccaaaactcacagaattgaatacttcaagtctacagatttctactatatgtaacatttaactgggaaaatgtaacagaaaataataaagggtggggctaaaatcccttcctgcttaaaaacacagagcatggtggcctgaggcgcagaggaaaagatagatgagaaactccacatccccgaggctcagcagcagacgtatttcatgggggaaaccagctctcagctgcttcacgtggcagtgagaccctaaatatgagaggcagtggccggccagagcatgaagtcagaaaggtgcctaaacctggcagcactgggcctccccacagctcccaactcaccagaattataccaggcaagtgcccacagggcatcagcagagggcttgtcatgtgattcactgctcatttagtccctcattcagcaaatgtttacagagtacccaggacacaggcatagtccaggcacaatgagggcagcagacaaggcagctgtgtcttggggcagacattttaggagagcatgcaaggcagccaggctcaagctcctggtgtggccaaacccagccatctcggggatgtggtgggacagcacagctgaacattaaatccattgcaactacagttttccctgagaaaagcatcactgatatgggcaggtggcagaaaaattctgggtagaagagggtagttccccggcaaaggccccgccctcaagcctggaaacctgtggccctcaatgggaacaggcattcctgtttttgtgcccaaatgttgccttttggcctcccatgcctgcctatcctgtacccatgtaaatgccaagccccaggctccactagtggaagagcggaggaacagaagagtggcgtgtcagggaaggagagaagagaaggagcgtgtgaatgtcaagaggagttcggctggggacagtcagaaaggagattggctgcgggacggccaaactccaggggaagatcccttcccactccatcccctctccagctccccatccatcccactgagagccacctccatccagcagtaaaatcccccacatttgccatccttcaatttgtccctgtgacctgattcttcctggacgccagataagaacctgggtatcaacagggcactgagctggttaatacttaagccatctgtgggtggcaactgctaaaagagcactgtagcacacccaccgcggctttgggagtcacagacaccccacccctggatgctactgcagggccagagcccaaaagcactcaccccggctcctgcacctgcctatctgtgtgctctcccttccctaaggctctttgagcacgcagcagccaaacagatgagccacacccgtcacacgtcctgcatgcagggtcaggggactcccccacagccctgtcacacgtcctgagaggggggtcaggggactcccccacggccctgtcacacgtcctgcacgtggggttaggggactctcccacagtcctgtcacacgtcctgcgagggggggtcaggggactcccccatggccctgtcatacgtcctgagggaggggttcaggggactctcccacatccctgtcacacgtcctgagaggggggtcagtggactcccctacagccctgtcacacgtcctgagaggggggtcaggggactctcccacatccctgtcacacatcctgcacgcggggtcaggggactctcccacagccctgtcacacgtcctgagaggggggtcaggggactcccccacagccctgtcacacgtcctgcatgcggggtcaggggactcccccacagccctgtcacacgtcctgcacgcggggtcaggggactctcccacagccctgtcacacgtcctgagaggggggtcaggggactcccctacagccctgtcacacgtcctgagaggggggtcaggggactctcccacatccctgtcacacatcctgcacgcggggtcaggggactctcccacagccctgtcacacgtcctgagaggggggtcaggggactcccccacagccctgtcacacgtcctgcacgcggggtcaggggactcccccacagccctgtcacacgtcctgcacgcggggtcaggggactctcccacagccctgtcacatgtcctgagacgggggtcaggggactcccccacagccctgtcacacgtcctgagaggggggtcaggggactcccccacagccctgtcacacgtcctgagaggggggtcaggggactcccccacagccctgtcacacgtcctgagaggggggtcaggggactcccccacagccctgtcacacgtcctgagaggggggtcaggggactcccccacagccctgtcacacgtcctgagaggggggtcaggggactcccccacagccctgtcacacatcaagcacgcggggtcaggggatgctcctgtttcatcatgaatctggtagcaattaggtgcgtgtgtgttaataaaatctccatgtgttatggaaaaatagttaaatgtaaaatgtatcggtcttcaccaaagaagagcaagggatggccagtaagtgcaggaagagacagccagcatcatcacgcataagaaaaggggaccccacttggacaccaccacgaacccacaggctggggaggaaaccccagcaatgcagagtgctagggaggaggcaggcaactggctggctcggcttgggggtggaaatgcacacacaattttcccgggactcagcaatcacaggctttgtcatggacccaagaggaatgaaaatggagttcacaggaaaccggcatcggtggtttatcacagctttacgcacgacagctgaaaagtggaacaatccaaatgtccgcagctggagagctgactttcttacacccattccagggacactacctggtaataccaagggacgggctgctggtacggccctgcacggagggtgctcaagggcagggtgcaggcagaagcctcccccacagtccacacagcacagggcccgtggctacaacacagacacagcaagcacagcacagaaccagatccatgagggcaaggaagagctctgtgtggtccagatgtgacacagccagtcctggcgctagctccgggttttctgggtgtaacacagccagtcctgatgccagctgtgggttttccaggtgtgacacggcaggtcctggacctggctccgggactatacacctcctcctgactcctccagctgtgcacttagaaaccgcattttactgcatacaaatcatatgattatacaaacctgaacaaacctgacacaaaagcaaataaaagctattggcctcaggacaacccttgaccttgacaatggcttttttacataatggttggaggctgtcccctcagctcttgacattcgctccccagggcatgagttttcctaaaggggcctgcaagccccgcctgctgcccagaggcttccccaggcacctccttcttggtgcaggagggccctggacccactagggacttaagctccttttccacagaaacacagcaatggttctgaagggggaaccgcaggtcccagtgactcatggtgaccacacgcctgcatccgaggatgacttcagccccctgtcctctccccacagtgagctgctccccacaggccccctctattgcgaatgccctgagtcaagctgcccagtcttcatccagttatgctgaaaaccccactcttggttctctgccttgatatcaccacgtttccaaagaaagtgtgcaaaactcctgggctttggagtccagcacactccagggtccagggtccagggtccagggtcaacatccaactcagttgctttctggttataggctcaggcaggcacatttgtcaaagaggtgttttaatcaatacattgaagataatgataattccttccatgcagcactggtattagtaatagctgagatattatatataaaatacttgacaaaattcttaccagaaaaggctggttggctgttacgatcaaggggactttaatgggatggggagaagaccccgctcccagtcctgtcatctgtgaatttgttattaataagtatttattgacagtgcatctgcacgcactcctgtctctcagagctgtggaggggaagagctccctgcagggtgaggcagggtgcggggtgagaagtgctgggttaggacaggggctgcacctgccaggcctggccctgtgtgcatggaaggggtgggagagcccccagagtggggaaggctcataggctgccccctagagcagagaacagcaaggtcaggtgtccacacgtaggatgctccctccagcagcctgcagaaggggctgcggaccccagggtgggggtgactggggttggcaggaggaccggggtagggaatacggttctgctgtgcaacacgcctctgcagcagtggcagccaagacccaccttcatagatggtgtctgttcagtaaatgtttgatgaaagcaaagacaggaacagaggaggggagggaaggaagggtgggacaaagagccacactaattacacaggaaggaaaagctgcatcctcagaaactgcagccaaactcacactcacagcccacaggtggggggctcccaagaaatggtacagacgaaagacaaaaacaactccgaactcaaactcacacctcacgggtggagcagggttcctaagaaatagcacagacaaagatggagaagactccacattcaaactcacagcacagcccacaggtggggcggggttcctaagaaacagcacagatgaaacagaaagactccaagaaggccaaagtcagtagacccacaagaggttcatgggggttcaggtggatggggaccccctagctgtattagtcctttttcatgctgctaataaagacatacctgagactgggtaatttatgcaggaaagaggtttaatggactcacaattccacatggctgggggggcctcacaatcatggtggaaggcaaagaggagcaaagtcacatctcacatggatgacagcaggcaaagagagcttgtatggggaaactcccccttataaaaccatcagatcttgtgaggtttagtcactatcaggagaacagcaagggaaagacccacccctatgattcgattaccttccaacgggtccctcccacaacatatgggaattatgggagctgcaattcaagatcagatttcagtggggacacagccaaaccatatcattatgcccctggcctctcccaaatctcacgtcctcacattttaaaaccaatcatatcttcccaacagccccccaaagtcttaactcatttcagcattaactcaaaagcccacagtccaatgtctcatctgagacaaggcaagtcccttccacctatgagcctgtaaaatcaaaaacaagttacttgtttcctagacataatggaggcataggtatttgttaaatacagccattccaaatgggagaacttggccaaaacaaagaggctacaggccccacgcaagtctgaaatctagcagggcagtcaaatcttaaagctccaaaatgatctcctttgactccatgtcaaacatctgggtcatggtgatgcaagaggtgggttctcatggtcttgggcaactctgcccctgtggctttgcagagtaaagcctccctcccagctgccttcacgggctggcattgagtgtctgagacttttccaggcacacagtgccagttgttggtagatctaccattttggggtctggaggaccgtggccctcttctcacagctccactagacagtgccccagtagggactctgtgtgcaggttccaactccacatttcccttctgcactgccctagcagaggttctccatgagggccccacccctggagccaacttctgcctgggcatccaggcatttccatacatcttctgaaatctatgcagaggttcccaaaccccagtacttgacttctgtgcacctgcaggctcaacactatgtggaagctgccaaggcttggggcttgcccccctctgaagccacagcctgagctccacattgactcatttcagccacaactggagcagctgggacgcagggcatcaagtccctaggctgcacacagcatggggaccctgggcccaacccacaaaaccactttttcctcctgggcctcagggcctgtgatgggaggggctgctgtgaagacctctgacatgccctggagacattttccctattgtctcagggattcacatttggctccttgttacttaggcaaatttccacagctggcttgaatttctagtcagaaattgggattttattttctatcacactgtcaggctgcaaattttctgaacttttatgctctgcttcccctacaaaaccaagcacccaagtcaccttttgaatgctttgctgcttagaaatttcttccgccacataccctaaatcatcttgctcaagttcaaagttccacaaatgtctaggacaggggcaaaatgctgccagtctatttgctaaaacataacaagagtcacttttgctctggttcccaacaagttcctcatttccatctgagaccacctcagcctggactttattgtccatattgctgtcagcattttaggcaaagccattcaacaagcctctaggaagtgccaaactttcccacattttcctgtcttctgctgagccctccaaactgttccaacccctgcctgttacccaggtccaaagttgcttccacatttttggttatctacagcagtgccccactctaccggtaccaatttactgtattagtctgttttcatgctgttgataaagacatacccgagactgggtaatttatacaggaaagtgatttaattgactcacagttccacatggctggggaggcctcacaatcatggtgaaagaccaagggatgtcttacatggcagcaggtaagagagagtttgtgcagagaaactcccccttatagaaccatcagatcttgtaagacttattcactaccatgagaacagcacgagaaagacccactcccatgattcaagtgcctcccactgggtctctcccacaatacatgggaattgtgggagctacaatttaagatgggatttgggtacagacacagccaaaccatatcactagccctaaggcaggtgccagttacattgtctcaccagagcaccctgagagccacagccaggagagaaatggtgggcaggacccactacaggtccaccctggtgggcatacatgtgcaggcacctgggcaacgcagctcagcacagcctcatgactccaactcccctccgtgaacagccccgggggtcaggatgtggaggaggccaggaccagggaggatggggccactgcatcaccaccctgggctgaagacccctccaccatgtcctgggtaagccacacaacctcacccactttttggtgtaaaacaggtaaaacagcatggaatttgcaaagtatcccatgaatgcgactgttctcctccccactcccctcttctctcctcagaaagtcgccatgaaggaaagaaatgcataaatctgtcttctgcaaaaacaatttttccagccccattctattcttacagcaggagtccccaacccccgggccatgaaccagtacaagaaccaggccacacagcaggaggtgagcagcaggtgtgcgagcattcccgcctgagttctgctgcctgtcagatcagcggtggtgttagattttacaggagtgcaaaccccattgtgaactgcgcacaggagggacagaagctgcacactctgtacgagaatctaatgcctcatgatccaaggtggagctgaggcagtgatgggagtgctggggagcagctgcaaacacagattaacatgaacagagaggtctgactgcacagagatcacaatcaatcaattgcttgcagacacatatgaaaaccctatcagtgggctttagagtggcaaatgagttggaaaaaagtgcacaataaacatattgcacttggatctttccaaaaccacacccccaaccatggtccatggaaaaactgtcttccaggaagctggtccctggtgccaaaaaggttggggaccactgtcttacagcctattgataaatggcacactccgtcagtatcccacagtacattaatgttcatcatgacatgatgcctggagaacattaaggctcctattaacacatgaggggccctgaagacccacctcctgagctaacgtccaacaagagttcaaaagacacacctcatgcagaactcttattcaacagaatttgaagaactattttgaagaattatttttgtaactcattcaaaaaaagtgatcagaggcaaaagcagcatgcagggtcaggcacttctattagtgaatgtatctatttgatataatccacagggccagtatttgcttcagaacagagcaatcatgcacataatatcatccctataaacaaaatgggaaatagcatggacttaacattccaaagtataatatactcttccaaaggagagattgccctcaccctttgtggctgccagtttaaagtgcagagttttgccatggaatgccctttcaattttttattaattacatggaaccaaagactttaaatagcctccgggatcccaaaaaatgatattttaaaattatccagctttactgtcagaaatttaatttgaagttcaaaagtcaagataaaactaaagtcatcaaaacagaaggacaaaagaactttaagtggtcaggaaagaaaggtgtgggtttgtgttcaattgcagaagagtctcagggtgagagtttatggaaaccccaactagagcccacctgctcaggtgtcttcacgcacacatatgtctcagagaggcacacagtagcagcaaacaactacggccagtttgtgatgttaatgacttttttacagaattacgtaataacgtcattagtattttaaaccctttggcatatgagagccactatgctccggaaagcgtgatcacactgaaggaatccttttcacttgagtccttggcttgaaaatgccactgtttggatggttacttcctgttgagaaccttgaccattttcagggacagaactttaaactctgcttgaagcatcccgcgcatcctctgtctcatcgctggtcatccatgtccctcacacactcatgatttgcgtgcaccaactgtatcacaacctgctgggctcgctcaaggtacttggcacacatgtctatttgtctgctgtcacccaggtggccacatttggaggtcaccacacaggaggaggagctggtaagggcctgcattgcccattaattttgaggatttatggtaccctggaaaccaaaaggacctttcggccagacaccaacacatctctcaggagcacaacacagggcagaagcagccgggatgtggggaccgcgggctgtaaactattaatgcaagatgccaggggcagcacccaacctccagaggtttttcccgctgatctcagtgaaaggtaggcactgacagtatccacagtgtgagagggcaggggctccttaacagttacagatctctgtatgcaaatgaaagtacacaaagccagacacttaggaagaaggcgcttcaacaggcacaggtgttactgcttaagccaagacagatgagtataatgtagagaaaccctgtattacaggagggattaagccagaagggtgtttgtgggagggaatgaaccttcccttcatcaaaaatcactgcaaactgtgtgcataacacccatctgtgtgtttaaaataaaaaatttcatttactaataagtgattacatttgacccttaaacatgcactctttgtaaaagttaccaaaggtaccaaaactgaaatactaattgccagaagacattttcacgagtcagagggccgaccaaacacagatgtcagggtgcacctctgcagcatgtgggctatgcgcatcagtaaaatcacctgcccgccctcacagcagtatttgctgcgcatcagtaaaatcacctgcccgcccccacagcaggatttgctggtgtgacttccgccctcaccgcagaagaatttgctggtgtgacttccattcagtgcatcaacgtcccctaatggagtttctgatgtttaaattttccgttccacactcccaccaatgcccctgaagcatggaataataaatacgaaaccatttgtcctcttctgataacatcgacaagaacctaaatgtcttctttgtaaaccaatcataccacactatgtgagtcccactgtaacaaaagctactttaatataaaattctgggaacaattccagagacaagagtcccaaccaattaaggcaagaaagacaccactggaaaaaaaaaggtttcaattgaaccgatgaagatgtactctgatgacatttcagattttgaaaggatttgaagaaacattaagggtgaaagtgcaacaaccaagtagaattggcctctactttaaaatctcactgtatagcaagcaaagagagctgttttgagataaaatggaaaatcagaagtttgggcatccatgaaacattcttgttaattaaaatccagcataaaattccacaccttgtttcatttcagtgatttaaacaattacattaatgataataatgccttaagtcaacaaaggaggtccatacaatttttcccttttaatggggtttagatattactcaaagtttacaaatgctggcatacagaaaagcacaagttcaggcctgctactgatgagctacgtgataccagaaaacggtttcaagtccgtttctaaatttccacagtctccaggaagaagatgggttggtgaccttgtgcgtctctcctgtggtgaacaccatggatttcatctccaggaagagggctctgctgtgtttccctccatgagcagatgtgcccctcctcccatgccccgagtccctccttccgtgctcctcctccctcctcccattccccgagtccctcctcctgtgctctgagtccctatttctgtgcccctcctccctcctcccatgccctgagtccctcctcccgtgccccaagtccctcctcccgtgccccgagtccctcctcccgtgccgagtccctccttctgtacccttcctccctcctcccgtgccccaagtccctcctcccatgcccagagtccctcctcccatgccccaagtccctcctcccatgccctgagtccctcctcctgtgccccaagtccctcctcccgtgccccgagtccctcctcctgtgctctgagtccctatttctgtgcccctcctccctcctcccatgccctgagtccctcctcccgtgccccaagtccctcctcccgtgccccgagtccctcctcccgtgccgagtccctccttctgtacccctcctccctcctcccgtgccccaagtccctcctcccgtgccccaagtccctcctcccatgcccagagtccctcctcccatgccccgagtccctcctcccatggtgcaggagctgcctccgttcatccaggctcattcatccaattcccctcgggaccagggtatgcacttttccaggtagcttgatggggtcaggggagcttatagctatggatgggtgcaggagatggggccagtggggacatgaacctggagaaagcataactgaacacactgtcgatcatccaaatgcccaaacatttaacctggaaaaaaatggatccttcaatccccaatcttatccaccatcaccaaatgtagatgtacaacctaccagcgatcaagttcaggcaacaaaaaacagaaagcccagcccttcacaggctcctactgcatcgactcccagctcttgctgtggtggtttcaagtgttaatgcagctctccagagttttagcaaatctgctaccctaggagatgaatgggaaggtgttagcaatctgccaccctgggagatgaatgggaaggtgcttccacatcctccatgatgaacacgactccacacggcccgatcacccacctaagcactcgccacaggggtgggctgaggatggggggactgtggcttctcaccctctgggatcgcgtctgcccaggctcttttgatgacgcgtctctgtggcagcatgtgttctagaacacgggaggctctgcccaaatgcctctgaggccaaaccgggacccagatccccaggaggctgggaaagtcctgccctaagtggcctcagcttcaaccagcggctgccctggcttcagggcccacacggacagatctcctggtaccacatgggagaccagaaacctttccatgaaactttcagaactgtaaacacagatgcccaattcacatagacactgaaatcacatctgcaagccaaataggtcagggagggctcatcctgcaccacaggagggctgaggtggggccaggaccacgctcactgccttcgctggggtctccgcaggctccagagagctggaaggcagatggtgaccacaaagacaactcttgttttgtaagacggtagccaagggcgcatttacaagtggagtgcgatcgggttacgatgttggaaagcactctctgggtcctggggggactggactccagggggctgcggcatccctgtcagctcagcttggcccggccaggcccggggatgcagctgaaggcggagagctgctgtgaggccctgggaagacgcggtggccaccaccatctgctgaatctgctgacttaaaggcaatggtgctggatggtctcatccaggcggaggctgcagagccagggcgaagtttcctgaaggagatggaatcctgctgtagatggcggcaacatgaagagctgtcaaagtctccaagccgctgccctgtgggattcggacaagaggctgcagcaggaacccgcctctgaattcccagcccaccagctgccctgcagatgtcagacccgccaggcccccaatcggtgagctaatgccttgaaatactgtctctgtctgtacacacacatatatctctatttacacacacatatatctatttatacacacacatctctatttatacacacatacaaaccccctgctgagtctgtttctctggagaaccccagctccacagcagccttctccccacagaaaatactttcggaggattcccccgaccccaggatgtagccacctctcccctgtgtcggcttcactctgcaggtctcggcaaggagcacccctgtccacactgaacaagaagcccctggacccttccgagtggccatcacctgatccacggccacatcctccacgggaagccacggttcacgtcaatcccggcaccaaggtcccagaattcacagcttctgggctcggtcccgcaagaccacccccccatgagggccagtgcagatggacagccaggccacctgcatttcttcccagccagcgacaaactcggctgcccacaacctcctcgggtgcaatttttctttggatgacacagaacttgggaaagcacttcactcaccatcactagctcttataaaggacacagctcaaggagagccaaactgagggacgcacggggcagggtgcagggcacacgtcacacctgccctgggtgcaccaggctccctgcacctccacgtgtctgccaacctgcgagctccatgaacctctcacttagttctctatgcaggtttcacgtacataggcatgatggattaaatcactggccattggtgattaaccccccaagagttgggggggcctgaaaggcccaaccatctaatggtgccttggcctttctggccaccagccccaccctgaagccagccagggctcccagccacctctcagcacacaaaagacactcatcgccccagagactccaagggtctcaggagccaggaaccagacacaaactccaaatacatacgttattattaacccacacacagatgatacaaaacttctttttcaccctccaatgctcagtgctgagctcagctgtgatcgatctgaaggaataggtcaaccctaagggctaagctcggactggcgattagaacctacaaccatggaggcttgatttcacccaacgtgaggcgggcccctggaaggagaagggctccagatgcaggcagggcagtgcctgggcctcaaagtctgcgaagagaagctgaagggaaacaggcgtccgaagggccacacctgggccctgaagccctcggcaggaggcaggtgcggccactgaggccacaccacacttcagtgagtgattcctcacagaatgaaacacgacacacctgctgtacataaagttgtttttaagatcagcccaggctgcgacgcatgtggaggacacgcagccgtgtccatagaccacacgaagtgaaagcgcactttgactgtgaaatccaattactttggatttaagctctgaaatgcaagttcattagaaaagagatgtattgtgccttctttctgtggtggcccctcaattaatcctctggtcattgaagaatgaaaaacatcaacccacaggcttcccttgcacagacaccagagtctgagtgaataattatggttttgattctgagttatgaaacaaacactcctccttattaaataaattaaaaataatgggatctgcgaaagatcaatacacaagaaaggtacatttgcaataacggctgccgccgtcacaaatgcaattctagactcagccaccagcctggctgctggaaccaggccctgcgagaacacggatgacaacacagatgcacggataaatcatcacgcgtcgcattcccagaatagaaaatgggctaaacgcaagttctgtccttcctgctctcctttgttcctggccacatcttagttttcacaaacgggctcttggagaaaagaggtgagagcctcagcaaaggttgtgggatgttaatggacacatccagaaagcagggccctggcccaagacgcgtggtgaggcagccccaggtgctgtcctccggtgcagccaggcctcctgcatccacctcggatgactctgtaatgacgctgttcacatccacagaagacaggaggatcctacggagggatgaagcctctcaaacgtctacacgatactcagctgcgtttattcaaaccgatcttctttgtgccccagctccatccccgccccaccaccctgtcctctcatcccccggctgctgagtgtgcacagaggcatgtccccttgaactcagaggcgccgtcgccctgggccgtgtcctcccacggctctcatggtcacacagctcagtggctgctatgtggaaatggcctctccttgcagccaggggcagccggcacctggaacagcaatgaactcgactaagaagttattcccatgcagcgagtggcactaagtcgcagccgaaccaatttgcttcatgggaaacacatttgccttcaaagaacacgtaaagtggaatcagcagccagacggagttatgaggtgagacctgcggagtctctgagctggaggcccttctgccccaggacagtcacagcaggcaccccgaccccatcccttctccagcctcgcagtaggaccatcgtgctggagggcctcggccaaggtaggagggaacacaggcatctggacaccgagtggccgcaatgctgctcactgtggctctgggagctgagcctgtcccatgccaactgctgtccactgcccggccaggcttgccccgtcccagagggtgcagaaccaccagcccctcagctctcagcgcactttgcgggagagctggccgatgtctcccaagccttctcttctcgcgcatcgtccccttaactgtcagctccactctacaaatgtcctctcaaaatgcgaagctcaaggtgggtatgtcatgccccaaagaggctacgaaaaatggaggggcaggaagggcagatgaaaacccatcccccacgggtgccgcgtcacatgcactgtgtccacgtggcaggctctgtccgctgtcagggccctacaggaacaagccctcctgaaatggtgtgaaacccacccccacctccactaattcaccacttccaaattcgaggggtggaaatcatcctaactacagactagattttcttccctcttgcgacggttgtaacgcaacagccatgtttcacgttcagatgtacagctgcaggaacaaatacttcttattccaaacaccctaacccagcagctgctgctcccttaaagataaaaagaacctgcacgagagacattgacttccattccctggagggaccctctggggccaatggccgaggagaaaggggctgtgagcccacgccatccctccaagcctggaagcccaggcgccaccctcccttgtctgaaaccgcgctccctctcctggccaagctgcaccaggcccgaaatccaggtccgggccctgacacccagctatactcacaggcccatctctccttcggacgctgactgcagaggcccgtcgggaaagagaccatgtcctgggaaggtctctcagccacagcagcctcccctagcttcttcctgaggcttaaggtcaccatgaggaggatacaaatgtctcattttatgatgagaaatgcccacctaccccgcaggaggagaggccttcccacattttcccaccagcacccatgctgcacatgccccttgagatgcaggcccaacccctgccaggacatagagcagctggagtcccaccccagcccctcacagccctgaccagctgcccaggctggatgcagccctgcagccctggggatgggaggaggcaggaggtttccccagtgccaggccctggtcagtaccgggggcgggggaggaaaggagctgcacccccagccagacaaggccacaaacagggcacaacagtgagcagcactgctctcaccagaatttaaaagcaaacagatttgccacctgggatgacgccctcaggaatgagcacctttgagacagggagcccgcctgtgagtcgagagtcctccaccaggcccccagggtggcttcaggagggaccgtttgcagggcagggatgatgcagtactgggctggtgcggggggagtagccatacccaggggagggaattgtgaggactgggctgcctttgggggtgacctttggccaagggacaatggccaggctggggcttccgtggggagggaatgagggtggacctcccctctccctcccttcatctcctgtccatcctcagggtgaggactctgatgtggccatgcaggtcaaactccccgaggaggagaggggctgggtcagggaccaccccagcactggacacagggtgtggacacaaaggcaagcctcctgggcactgtggatgttccacaagatgggtccactcatgagaccgtggctgagcggcaggcacagggcaaccccaagtgttctgtccatgcgtcagctcacacgaggagagggcggcggggatctgctgcacacccagcgttgtctggggaaccatcctggcatggagcagggcctcacaggacagctgcttctcttggccagcaagagctccacgtgggggcacggccccagcagccagtgaggatggcagaacatgtgggtgcagccctgtccttgtgtccgtgggggaggagtcaactcaccggggtctgaccacatcaaggtgctacagaaacacattgtagatcaatgtgtttcaccaactgcgaagacacaaagccgggccctgggtccagtcagcagccaaggggcagggtccttggaagccaagccggagcctcgccaggaccccacaggcttcccggtatcccctgcggacaggaccatcctgctctggttatctgtccacatcccaaagcctcatcggacctgcaggtatgtctcaccccaggcagcccctctcggtagaattttagaaataacttccttccattaaggaagaacagggtgatgagaactcctcgagcacgcctgtcaacctcagtgtctagaaccaccagcccctccagggaggctgaaaacagcaagtccacagagagaaagggctgcacaggcccagctgcccaggcccctgtgcctgctgcagagaaggaaggggagtcctttccaggggcctctgcaccccaggtggccctggtcttactcgatgttggctggaaaggagactgggcaggaagaaaacgggagctggaaaccatcccatcctggtcacagcgcctccaacgcaccctcctcaccccacggcgtctttaaaaaggccgaaacctgggtttgaaaatcctgcaaacatccaagagactcaaatgctgcgtgataaatttagaaaggtcaagtgtacttaacacgctctgccacgaacactgaaggaaaattaaagttcagcctggtttccttaaacatcatcaccagggggcacgtcggagggacttcgctctgggagacgccttgcaggacgaccccgggcaacttcagcctccacacaaatgacacagaaatggttcccagaacaaaaaaggacactctgagcctgacaggggatggaggtgtttccctcagacaacataaaggtctcaggcccggcacctgctgcagaccggcctcagctctgggtttctccctttggtgaatctgcaccttttggaagtggaagtcatctttcagcgtcattttcatcagagtttctagcttttcacagcttagtgggggatgcttcccaatagtgtgatggctctaatgcttttcattataatctcatcgcctaacactggtgaagaaggaatcatgacgtgattgcaacacacttcaaggaagcccacaccgtcttcatgatggaacatcactcaggggcttctcaaacgtggtgagcagcctgggttcaatgtatatcaccttccatcacctccctccccagccaaggccacgtcccctaacacacaatcaaacccaaaccccaaggacaccactgctctgggacccccacccttcatctctcaccccttaaactgtgccatcagcccatccactggcatcctgggtaacaatgtcccacccccatggacacctcgctccccctctgtccctcacagatgcgtggcccccctctgtaccccacagatgcctggacccttctctcccacagacacctggaccccctctgtcccccacggacacctcaacccctctgtccccgacggacacctggaccccctctgtcccccacggatgcgtggttcccctatgtcccccacagatgcctggacctctctgttccctgtggaccactggccccactctgtcccccatagacgcctggctcccctctggctcccccaccaaggagcaggtataatttttcttggcacaaaaatccatggctgctttcagggccacagggagggcattggaggccacggaagtgtgagaggcacaggtgtgtgcagggaacacctgtggaactgctgtcccagcctgcgacggggatgctgctgcctcaccaggagtgacccaggttggcaggtcggggatgagcccccgtggctgtccaagcccacctggtgagaatggagcagccctggttccctgagcacccccttcagagctccgggtggtctctaagtactggctgctcgtccatccccccaggcgcagaaagtgtcaaggcacaaaactcactcattgatgaggggagcagatttttgctgctgggggcctaagaaaggaagacgagctagcgtcaaagcttccagcattcaggacggggcgacaaggactgtaggcaactcacaaaaacacagagggtgtgcggcaggggctgcccctccacctgactcagtgttggagacccgacaccctcacctcctaaacagccctgaccagaggcatttaccgtgtgcccaaaagagaccgaatcgtcacagggacagtgggacagcggccaggctgtgcaggccgcatctctgcaacgcgtcagccagagaaagccgggggcaccccagccagcactcaggaggccctgcccgtccacacgacacctgggccaaccagccctttctgctgtaaaacttcggctcctctacctgcctgagtctttgccaagcacgagggacagtgactgacccctcgttcccgccagcctgagtaagtagccgcgttttcgcctgggtggtctgcaaggttcacccaccttccaggagcctccggagtctggggtggaggggctgcagtacccgagcacggccgctagatggcacgcaggcgcggtctcgacctgaatcccccgtgcgggcacctgcgcccagggctgtccctgcacaagtgaggggtgaggggtgaggggcgaggggtgaggggcgaggggcgaggggcgaggcgcgaggggccaggggccaggggcgaggggcgagggggaggcgcgaggggcgaggggccaggggcgaggcgcgaggggtgaggggtgaggggcgaggggtgaggcgcgaggggccaggggcgaggggcgaggggcgaggggccaggggcgaggggtgcggggcgaggggcgaggcgcgaggggccaggggtgaggggtgaggggtgaggcgcgaggggccaggggcgaggggcgaggcgcgaggggccaggggtgaggggtgaggggtgaggcgcgaggggccaggggcgaggggccaggggcgaggcgcgaggggagaggggcgaggggcgaggcgcgaggggcgaggcgcgaggggcgaggggcgaggggcgaggggcgaggcgcgaggggagaggggagaggggcgaggggtgaggcgcgaggggcgaggggtgaggcgcgaggggcgaggggtgaggcgcgaggggcgaggggcgagggctcccggcctgcgccgccttggatcccaccagccccgaattcgggcagagcgccatggagggcccagcctggagggggagctcggagcctgcagcaggtgaggtcgggctacagacttccctctgccccctggtcacagaggtgagagtggggcctcatcccagtcccgccgcgacccatggggcagagctgctgccctggcccaggcacgcacagcttctcaacagccacatcgcaggctggccctggcctccccaaccagagaccaagctcccaggctgcagaggcagcgaaggccgggacacgcacagggcagcgggcagccagtgccacgtgggctgaggaggcactccctaacgggagacagcgcccagccagggctggttttctcaccgtcattgtcaaaggccttttgagcattttcacacacacacacaaagaagccgtttaaaacaataaaagtgtagtgctggggaaatgattaatgcatatatctctatttcaaacccgcaaaaggaatcaaaacaaaaagacctttaaagagacacacaaaaaggtgacagcatcgtgaggtgaagtctgtgtgtgtgtgtacatgtgcacgtgtgtgtgcatgaatgtgtcacgtgtgtgcacgcgtgtacatgcatgtgattttgttcacatgcatgcacatgtggagggagcgagctgctcccctcctcgccgagtgagttttgtgccttgcccgcttcctgtgctcagggggatggacaagcagccaggatgttagaggccacccagagctctgaagggggcactcagggaactggggcagctccgttctcacagggtaggcttgtgtgtgctttgtgtgcacgtgtgtgtgcatgtttgtgtgtgcacatgtgtgcatgtgtgtgtgtgcgcataccatctccccaagccgcctccacctgcacacaccagcggtgacccgcctcggggtctgtcctgttttgccacaacagctgtagagaatgccaagcagctcagcagtggttcccaaaataagactgttgagagcccagaaatagcccccagagaacactgtaaaagccccaagacaaggaaaaagtacacgagcttgtgacatgatggtacaatggcctcaaggaaattgcagctttggaaagaaactttattttctgtcttttgaaacaaaccgacatcctgtcctctgtggagacccaggccccgctgaagtgctctttcaatttgctcttttaatttgctcttttaattattctgaaaggccatctgctgtaagagtgcctccctgatttaaactatgcctcacaccctcaaaacttacacttcagcattttttccttccttgcgtaatctcaaagcaaacaagattcagagaggctcacttcctgggtaatgcaggagatgccctccgaggtagggacaggggcttgtgcccaatgtggggccactctgcagagaaccacatgagctgcgcccatccaggatgctgccaggagcctgcatccagacaccctcagcggttgtgaaccagccctcccagcggcaggacccccgagcagttgtgaaccagcctcagggttgccctccaagtggccaggggacagggctgacatgaagcaggtcctcagatcgagaccagctctggaggcccaaacaaacactcctcctgtgccctgcaccctcaccttcccttccagagaaatagtgtgtcctgccccagctcaaaatagggacagcacagggctccacccaggaaagctgggggccgaaatgtcataccatttgggcaggtctgggcctgtcctgccactccctccccaccccccagtcactctgtgcctccacttccacatgacaacaacatccctctcagggctgagtctcctcccctgcagagaagatgccttgtgaggcctcttgaccaaaagaaacaggaaacaaatacagaataaaagtataacagtgaataaaaacagctacatgcacacacaactgtgcaaagcaaaacaaaacaaattgaaaagcacaagcagggtgccacggcctgacagtaacaatcaaacaggagggttttccaatgccatgaacgtaaatcgaggtgtgcatgataacaaggagtaggaaccggagggacggccactgagggtggaaccaaagcagggaaatgagaggatgatgagtccccactgatcctgaggctgggaaaatttgcagactcgaagattctgtagtgctgatacatccacacattccatggtcctgagggacactgtctagcttacaaatccatctgtaactgttcaaccagactagcaacccgtcattcatcattcataggagaatgcaaaattacatcatgcacaaagtgctcccccatgtatcaactgcatttgaacagatttgtgttttcaaaaccagggtggtagcaagattgagtatgcccagtaaatgctagatattattatcccactagacactgaaaacggtcccctttcctgggttgtgttgctggccttgccacaggcaatgccgagggcagctgcctcatcctcccccacactgttgcctcacctggtcacaggtgggaagccaggtggggctcggtgagtgtcttctaactgtttctgcattgctagaatggggtaaacaaagaacaaagaaaacatacataaagtacattctttgttctgttattgccgttgtcaaagttaactctctcttcttattttagggtttatttttaaacatcatgcttgcacatagtttgaaaaatctaagtctggttggggaaatgagcaaacctctaacccaccttttccccacccgcatttctactccccagaggtaagcaccctcaactcatttagctgactcttggttttcatctccatatctccacatgacacattcacgttgccatttctcagctttcagatttaggatgtatctattttctgactgctacagaagatgggcctacctctccataacacatcactgtttccaagcttactttctctttcccagtttagttacattacaattttcatcagatcagtattatgtgcttacaatattgtgactttgtaaatgctatccccaactaggctatgtagtacgctgtgactagtattaattttttttctttttgttttccctggagttataaatgtcttatgtatttgcttagtgtccacagtgtctcttcctttcacagtgtcttcttgtttttcctggagttatacatgtcttatgtatttgcttagtgtccatagtctctcttcatttcatgctgtcttcttccatgtggctgtcagggctctttcattagaggctttccataagtgtccagtgatcctgggatgcctgctcatatttaataaggggcacaaagagctgatttagaattgtgtcacctggtgaattgttgaaagtgggtgtcagtataggagaccctgctgagcagtttcactgggaaaaattttctctatttctattcccacagaagcagacctggaataagaaacaattgtagttggccaggtgtggtagtgcacacctgtgatctcagtgttttgggaggccaaggcaggagaatcacttgagtccaagagtttgagaacagcctgggccacaaagtgagatctctgtctctataaaatcatttttaaaaattagccaggcatggtagctcctgcctgtggtctcagctacttaggaggctgaggcaggaggattacttcagcccaggaggtcaaggctgcagtgagctatgatcaagccactgcactgcagcctgggtgataaagcaagatcctgtctcaagaaaagaaagaaaagaaaagaaggaaaagaaacaagggaatggaaggggaggggagaggaggaaatttttaaaagaaaaaaagtgtgacaaggaaggttgggtttccagtgaaaggtgcatcaccagccagctcctactgcaccggaaccatcccattcaaggggtggtgtagctgaggtatttaaacgctcactccttggccgtcagttggagctctcccagcaaggggagtgggaagcgggactcattagtccccaggcacttgcagtcccacagggagcgaagctgggaggggcggcgagtctgcagaccagcaccagtctgggtttgccaaactccctgcatgcaagagatctgctgtgaccacacctgcagggtactcaggccacctttcatactggggtgaggagaggaagtaaacgcttttctcatgtaacagatgcctttatgtcatcgttaaagctgtgctttctgacagtctttagaggttttaatgaggatgcctaaacttacgaggcccccacaaacatcaagaattttgccaaaagaaatgacgtaactgatggatattttttgaagaccaatgtcttagtcacttttgaaccaagcagatgcgctaccctatgtggacagggcagtcgtcatgcacagaacccatgctgtcccatctcccccacactcaggctggagcagcattctggctttgtttttgttttgctttattgctctgtgtctaccagacacacagctcctcagaaactggacagaaagcctcctgacatcaccacaacaaaatcacagccattaagtccaacgggattgctttatggtggctcaagcccatttctctgagctccaaagccatcctgacatcattatgctgcatcattatgaagccaacacacatctaacaagaacacaagatgcgctttgtcatctcagctacgattctccttggggtgaaagtgaggggcgctgggagttgccctcttgcaggtcccaaggcagcatctccccagcaactgagaccagcctcagcacaggacaccgtggtcccagccacaaatgcagacagagcctctcaggccaacctcagagcctctctggagtgcaggcatcctctacacaaacggaggcagccctgctccatgcctgccatgcagctgagacggatcctcaggacacgtcctgcctgcaggtgagctcctcaaacaccaaccagcagcccccgtcccaccccccgcattcccccagatcctgtaaagaacatcctgtaaagaacctcacgaggaaagccgagcagacagcaaacccagagcttccccgactgcggtgggccctgctccgcctcctgtggccaaggccgctcatcacccaggaaccgacacgcacgagatgcagaatctaaaagagaaagcggcaccgccaccagcaagcacaagagggacgtggggcctgatgacggaggcagcagtgatgcctgcggtgccaggggctctccgggttcctgaccctctgacagttcacctggaaggcgggctccaagcccctcagacccaggctcatcccgtgagcaaggaaggctgtgtgtatggaggctccatcccctcgtttgttatttttactgggcttcttcctctttttccagcagtgaaaaatcttcagagacctccaccagggagaaaatagaccggaagctccttctctgtgttgctgccacccaggagccgctggaccccaagggagcagcatggaggcagagagacctggcccagcacagaagcgaagctgccacgggacggccccacgggtgccaagacacgatggaccccaagggagcagcgtggaggcagagagaccctggcctagtgcaggagtggggctgccatgggacagccccatggttgccatgacacactgggtcccaggcattctagtgaagagctgttaccataagaggaactcaaaaagggaaatgctagtttaataactaaattcttaggaagaaatgtctttagtaaaatatcttgatgatctgataatgcacaaaattattcccgagacaaaatttgaaggggctgaaaggaaaacaaaaggacgaatggctggtaattcctaagggagaagctgggaagacagaggggctcaggggactgacggcagcctggaaaccagcaggtgcccagtggagggaagacaaaacgagagcaggggtgcctgaatccatagagatgtccacactgccgcccagacctcccaggcctctctccatccagaccgccagtcaagttcccatctgggaaagggggtctggccggtgcccagagccagggagaggtgggaaacggggtgtgaaagagagatgaggaaagggggtctgaccggtgcccagcagggtcagggagaggcgggacacggggtgtgaaagagaggagatgaggagtcagcacatccagccaccccctccaaacacacctgggaaaagggagaaccccggaggacagcccggtgggagagtggctcacaacaagtccacatacatcttgtgggactcagggaccagccagacacaggaccagggtatacaggtgctgacttttgagctgtccacggcactaggaggcacatgccccagcacctccccaaattggaaatctgggggtacaacctctgtacacacatgcattccagctcgcaaatgagcacctgcctcagagcttcaccttgactctcggaggtggggctggctcatgctgttggccagtgcaccccacgccctcttctctgctaattttgcatctgcactgaatttacgttggtgggagtcagcgccctccaactccatggagacaagactctgctgtgcacactgctgagactccaatatcccacgtgccaggggcttactccatatttggcagataaattaaagccccaaaatgcagagtcatcgatgagtctccttccaatgcagctgtccatgcggccttgggcaagccctgcgatgttcctgcagggaagggaaggtctgggtgtctgcagctgtcgtgcctgctctccggaccctgcgcccgccctagagggatccaagggccatggccaggcagggtggtgtcatggacagctctggtcccacggtggagggacagggtggtgggggctcaacccaggccagggactgtctgtcccttcctggctttgcccagcagaaagcaaaactctgatgagggagaatcatggggtgcaggggcagcaggtcagaaaagaaaagcctcctctgtgattctccacagcaaagggacccttcccagagctggcactgaaaacccatgagcagccccatcccttacaaccaaacacagctccgtttgcctcccacggcttcttcatatgcttcccagggggttcattctcgctctgtttggagacaccacagggttttggtgaaaatccccccacattaaggtctggaccaccttcaagctgtgcacttgggaggttgagcagacagaatgcacgtgggcacgtggccagagagaaacctgccccatcaggccaggggagcacatgtgagcacctctgccagcagacccctcaccagcaggaagccaagtgaaagacacaaacgcacccatgcaggccctgccgtactgatgtgaaaacgtaaataaccagagctgacctgaagagcatgtctccaccaggctgcaggcaggagtggcaaggattccaccctgacatgcaggccccaccccagcaaccctggacaggcccgggcacaggcccagctgccctcgttctgcaacagctcccaggtaatcctcatgggctccaggtttgagaatcgtgcccggagcaagcacatttaggcccaaacccctgggtgtggcctttgttactccaagggccactctggtggcacgtcaatcaccacagagaggtcacttctgttcacgctgcctgtcggactggaagtgggctaaggtgggcagcaggcaggcagtgcggcagccgggactgcgagtgcctggggtctgaggatcgcacaccaagacccactcggggaggggtcctgcacccccactctgaaaactcccaaaaccccacgaggctgaatcttgattcccccagagttctgaaattctgatgctgggatgatgcactttggaaaaaaccatgatggctggaaagggggaaatgaatatttgctttatgcctttagctagcacaaaaagtcacctaattaaggtaatgaggtttaaaatgtagggtaaaagtcacaagaaacactacaattccatttttataattactcatgtccttaccaaagaaaaggaagtccattaggacagacacaaaaatgacacgaagacgttgtggtgggggaatcccagcatgcgcagtcttttcctggtgatttgcagcctctggactttctataataaaaggtatcgccgtgacaataggagagatcaactttacaaacatcgcttaatcaggacacactgtggccccaaggcttataagtgaccctttcactggacgtcaccagaacacctgtgtgcagggtggggacacgtgctggaggtttgtgctgctgtgtcacacgtgggaagacgtcagacctttcctgagccactagccaggaacacatgcggacagactttgatgggaggatgctgaggagacagagattctgtgtgtgcctttgaaggttctccagttcaggcattaaaacctcctgctgcaggggctgtggaccccttaacctgctgaccccggggcaggcgctgaggccaggctgagccagtccacaggatgaagacaccaggacccgtgaggacgggggctccccaggggacgtggctttgggcaattgctggctgcattccttaaatccctgtttggttatatccaccccaacaacaccagtcactcgggagtcctgtgccagaaacacaagccagggcctgcagtcctcggcctccagctccccagcctcagctccccggcccccagctccttggcctcagctcccgggcctccagctccccggcccccagctctccggcccccagctctccggcttccagctccccggcctcagctccccggcccccagctctccggcctccagctccctggcccccagctccccggcccccagctccccggccccagctccccggcctccagctccccagcccccagctccctggcctccagctcctcggcctcagctccccggccccagctccctggctcccagctccccggccccagctccccagctcccagctccctggcctccagctcctcagcctcagctccccagcctccagctcctcggcctcagctccccggccccagctccccggcccccagctccccggcccccagctccctggcctccagctcctcggcctcagctccccggccccagctccctggccccagcaggagctaagttgttacagggtttccccatccacaaagacagcatcacgaacatccacaccccctaggatgcctggagtccacatcctcccggggtgcctgggagatctctagaattcctgggtgtcacatcccctaggattttggggtcctagcaatgccaacacctagacgaaggtcaggcatggccacagaggccaccctagctataggaaaactctctgaaagcttcgatgttagctccaagcagaggcttggtccaggagggctgaaatcctcccatttaaaacctctgaaaatcttgcctttcacaaacagccccctggaggaaatgtttttttagcatgatgcctgataaggacacaacacagagctgcagcgtccgaccgtctctcctccacactggaagggaacaacaaacaaagcctccgcaagcttgctaagaaacggggcatgcacaacactttactgcagcaagagacgatttatccagttatgtggtatcagatatttttaataactacttttctgaatccaaccaagatccggccctctatactcttaatacagtgaaacttatctgtgtgtggagcctgcacttggaaaactcggaaaaccttcccagaagcaaagtgaaatgctgcataccacgaccacaagtggcttatccatgcatgtggccgcacactgagatcccggtggctcatccgtgagacatgtggccacacactgagatcccgcagtggctcatccgtgagacacgtgtccgcacactgagatcccgcagtggctcatccgtgagacacgtggccgcacactgagatcccgcagtggctcatccgtgagacacgtgtccgcacactgagatcccgcagtggctcatccgtgagacacgtggctgcacactgagatcccggtggctcatccgtgagacacgtggccgcacactgagatcccgcagtggctcatccatgagacacgtggccgcacactgagatcccggtggctcatccgtgagacacgtggccgcacactgagatcccgcagtggctcatccatgagacacgtggccgcacactgagatcccggtggctcatccgtgagacatttggctgcacactgagatcccggtggctcatccgtgagacatttggctgcacactgagatcccggtggctcatccgtgagacatttggctgcacactgagatcccggtggctcatccgtgagacatttggctgcacactgagatcccgcagtggctcatccgtgagacatgtggctgcacactgagatcctgcagtggctcatccgtgagacatgtggctgcacactgagatcccggtggctcatccatgagacatgtggctgcacactgagatcccgcagtggtgcttatctcaggaaggaagagctggtcatgcctggagccccctgcatcatcatcggctccttccccagggcaggtgccgctctggaagcctccccagtctctcccgcggacctgagtcctgctgcagccactcgctggcatgtgacactgaccatgccctgagacctgccctgttcacacacctctagaagactacctctcatccccatgccactggataagtggctgactgcctcctggatacctggctaaacttcaaaaatgctcctgattttgtttttttgtattagatttgtgtttcggctcatttcgttcctctgctgttataaacagaccctggatgacagagctccaggatcacagcaggcactccaggcaaattgctttatctctcaacatggaatcaggaaaatgctgtaaatactggacaaagtctgtcctgcacaggcctcgcccacagcaaacatggagctgccagccctgaacaatgagcaaggctgagcgtgctcaggctgtcagcaaggaaccctccagggagacccagcaagagaaccaacatccgcctgtgaggaggtcgggctgcagacaagcccagccctgggtcctgcgtcctgggtcctgggtcctgcgtcctgcgtcctgggtcctgggtcctgggtcctgcgtcctgcgtcctgggtcctgggtcctgggtcctgggtcctgcgtcctgcgtcctgggtcctgggtcctgggtcctgcgtcctgggtcctgggtcctgggtcctgggtcctgggtcctgggtcctgcgtcctgggtcctgggtcctgggtcctgcgtcctgggtcctgcgtcctgggtcctgggtcctgcgtcctgggtcctgggtcctgggtcctgcgtcctgggtcctgcgtcctgggtcctgggtcctgggtcctgggtcctgggtcctgcgtcctgggtcctgggtcctgcgtcctgcgtcctgggtcctgggtcctgggtcctgcgtcctgggtcctgcgtcctgcgtcctgcgtcctgggtcctgcgtcctgcgtcctgggtcctgtgtcctgggtcctgcgtcctgggtcctgggtcctgcgtcctgcgtcctgggtcctgggtcctgggtcctgcgtcctgggtcctgggtcctgcatcctgcgtcctgcgtcctgggtcctgggtcctgggtcctgcgtcctgcatcctgcgtcctgggtcctggattgagacagaagaccctgggccgctcaagcagagcccggctgcagccccaacctggaatccgtccttgccacgaagccgatgtggaaccatcgccgtgctcagtggagggaccatgagttcatggcgtgattagctgggaggtttggaaacagcaaaagcaaaaaggcatctcccacaatgtccagtgactcaagtctacagagcttgtgtgcaaattcccttaaagtccctcctcatcttcagaagatatccaatgactcaagtctatggagcttgtgtgcaaattcccttaaagtccctcttcatcttcagaagttgaaataggaaaggaaaaggcaacacttagaccaaatgctgaagtcaacgtgacatgtaggatgtgatttgttaagttacactgacatctggtggccttcagtgttagaagagaaacacacgagatcctgtgatctgaaacacacatgatcaaatgtgcctttgcattttctttggtattgaaagcagacaacaccagaggcagcattaaacattaataaaatcatgaataaattaataagaacaccactatgcatatttttcaatttaataagccaaaagtataaaggatgattttcttcttcctaggccaaatcttcttaaggagcagattacagtagctttctctacagtggaatttttcaaatagacttttaagagaagaagaggaagaagaagaaaaccgtcaccactgtgtatcagcccggaggtgggtccctgcctgtgagaactgcacgtggtggactcatactgcatcttcagaggaagcagatgttcattacttatttccagaaaatgacatttattactgtgttgcaaaatcaaaatcataaaacaagcaatttgatgggctcagaaaaagtccaaatgataagaaaaggtaaattgcataatataaataaggtgtttcctccgtgtttgcagaaatacaccaaacgtgtgaccacccttcgtgaccggactacagcaataactaagccagtggggtaggaaggagaatcggatcaaaagttcacattttgatcaacgtcacatatgcttgagataaaacgctgctaacgtcaacactggactcaccccagtcatattaacattgacacgactcaccccagtcatattaacattgacaccaaacacagcctaaaactctgttaccacaaacatgacttaaacgatacaaagttaacctccatatttgctatacattctagtaatgactttgctctccttaattaaaaaaaaaaaaaaatcaaaagatcatcctcccagaccagattccaagctcagtgctttatgtacacaatcatatcattttcgtaacaccctgaaagttctgttttcattcatgagaagcccccgcaggtaatgcttggtttacgttaatgagtagatgcagactgcagtgcatctactcatttggggctcacctggggcctcacctccaaaggggctcctggagatggcagatcctgtggggcccacgctgacctctgcagccagaagccagccattgcctgtgttcagggctggccctggcagcatatggggagatgtgtgcaggagcaggcagtgagcaggctggggaggtgggcagtcctcagcttaggagaggacctacccaggcataagcgtggacctacccaggacctacccaggcatgagcgtggagagggcacagaagacctggtcagtctgaggaaggaaagagtggctgctgctaacagatagagtcaggtcaatttccccagggctgccttctgaagctggtttccatgttatgaacatgcctgaaaaggaccgtggttaaagcagctcaaactccggcaggagaatttacgaagcatccaagcccctcctctatgtgaaccaaagggtggctgtgagggttccgggggtctctaacaacagaaaacctccactggctttcaacctcacctgccagggaaggggccaggtagggatcgcgcaggccccctcagaccctcgctctgaagaacaggtgccctcacagagcatgccgacattcagaactgtcctgcagaatctggcaagtgttttaagaattgacataaagagctgagaagatgtgttgacgtcgcctctcaaaaaatctggctttaaaaaataataataaagctagtgtttttttgagcagcttccatgaacttgccttccaaagttttctgaaaacttgagaagatggggtgtgcccccacagccccagctgcctgaggttcgctgaacagcctgggtggctccgaggcgtccccgcagattcagcctgatcactccttcggtttcctcctacggctgcaggcagacctggagttcatccgggtgacctccacagtctctggccaccttccctccatttaagaaaaagaaaaacagcccatgtctgagccacctccccaaaccctctctgccttcaagcatctgacaagctaccctcaccacacaaggcccgctccctctctagagagcctctcccgacaccaaaatgtcaacctaacacgacactcaggacacagctgtcatcccgaaggcaggagatgtgggggaaaggacacagaatgaggtcacgatgccagagtcaccctcgtctcatccccgagtacccaggtgactacagacaggagaattaatctccttctcgtgggatgaagtgacagagtagacacctgtgagcccacttccagctccagttaaggtttcctctggccctgaagttctgcgactctgaggcatgtggggtgaccaagggcagaggctcccagtctgtctcaaactacaggctttgagcaaggtgagcctccctaagcttcggtttccccaacttcggtaaagtgaaataacaaaaccacgagtggctcttaacttctctgggaatgtccagccagagcctcggaatgtaactacgtggaaacagggtcctcgcagacctcattattgaaggaccttgaggtgagatcatctggatccagggtgggccctaaatgtagtgattgacgtccctgtagggagaggagaagacacggagacacagggaaggggtgttggtggagtcacgggtgggaggccccggagggacagtgcagacaagtgcccaggtgaccccagacacggagacacagggaaggggtgacgggacagtgtgctcatggggtgggaggccccggagggacagggtacacaagcacccaggtgaccccagacatggagcgtgagtaggaaattcacttggtggtgtcaggccacagagatccggacaggctgggctgcccctgcgaacccggggccctctcctccctggcacagccttattttcactcctgcagctcccgagaggaggcctcgctcttccacctgtttctgtgtcatgggacccttcacagagcaggcactcaaaacccatgagcaccccatcccttacaaccaaacgcagctccgtttctgcctcccacggcttcttcacacgcttcccagtgggttcattctcccttccccacgtaaagatgtgtgcagccacagctttccggccaccttgaaatgaggtgacatctccagtcgcttcccgtgatgaagtgcggggcctggcactgcgcactgctgcccctgctgggtcctcacagctccttcagcagcctctggggtctcacctcctggtcccctgggcccttgcacatgcccggccaccactctctggtccccccagcactcacggctcacctcctgggagccaaggcacctgcaagtcctgctgtcgtcccgggaacaggggtccccttcccgtgggagatgggatcccccaggtaacacagccagtcagagggcagcatcagaactcactcgctgtccttgtctacactaagcactcaacttcaagttgggaaacctgggtaccaagcagccaaccaacgccaatggaggtggaaggcgccgccccgcggcactcacacccgcctcagatgggagcatggtctcaggggccagggcccaggtcttatccagactcagctgctctgtgacccaggtcagtcactggccttcctcccgggctgcttctctgtggctcaggggacaataggcccatctcgttaggctgccgtgagggtgaaatgaggctgcgcacatgagactggggctgagaacatgcgtgggccaagaacacacctgccagggcccatcgcagcaccctcatcagctccagggcccatcacagcaccctcctcagctgcagggcccatcacagcaccctcctcagctccagggcccatccagtgccctcctcagcaccagggcccatccagcaccctccttagcaccagggcccatctcagcaccctcctcaacaccagggcccatctcagcaccctcctcagcaccagggcccatccagcaccctcctcaacaccagggcccatctcagcaccctcctcagcaccagggcccatctcagcaccctcctcagcaccagggcccatctcagcaccctcctcagcaccagggcccatctcagcaccctcctcaacaccagggcccatccagcgccctcctcagcaccagggcccatctcagcaccctccttagcaccagggcccatctcagcaccctcctcaacaccagggcccatccagcgccctcctcagcaccagggcccatctcagcaccctcctcagcaccagggcccatccagcgccctcctcagcaccagggcccatctcagcaccctcctcagcaccagggcccatccagcaccctcctcagcaccagggcccatctcagcaccctcctcagcaccagggcctatctcagcaccctcctcagctccagggcccatccagtgccctcctcagcaccagggcccacctcagcaccctcctcaacaccagggcccatctcagcaccctcctcagcaccagggcccatccagcaccctcctcagctccagggcccatccagcgccctcctcagcaccagggcccagctcagcaccctcctcagcaccagggcccatccagcaccctcctcagctccagggcccatctcagcaccctcctcagctccagggcccatccagtgccctcctcagcaccagggcccatctcagcaccctcctcagcaccagggcccatccagtgccctcctcaacaccagggcccatccagcgccctcctcagcaccagggcccatctcagcaccctcctcagctccagggcccatccagcaccctcctcagcaccagggcccatccagtggcctcctcagctccagggcccatccagtgcccttctcagctccagggcccgtctcagcgccctcctcagctccaggacccatccagcaccctcctcagctccaggacccatccagcgccctcctcaacatggctcccttccctctcgccactgagcagacttgataacagatgcaagctcgttccagacccacaagaaaatccacagcaagacaaattttgtgccaaagttgggttcaagatcaaaaacaatcctttgtatctcatttgtaataagtcgtaggggctcacgagaaaaggaaagataattcaattttgaatgtatgtttacatttcctaaacagctcacttagcatctgaacccgaatgcacacaaaaaaataaaacattgtctttaaggaaataaaatgcagtgggcctaacatggcccccaattggccaagtcctcttctcaactaggaaactggccactgtccactctgggcctgtgactaacacagatgaggatctcttgtccttaaccttttccgactcccctcccagaagatggcagggctcaagaggcctgaacgggaaagccccgtgtgggctccatggcgacctcagcaggcgagcccacccctctcccgggaggactaacagtgggaagacttctgtgggtgggagatgaggaccccagtctctcagcctggtgtctgtaaaactaggagaacgggcccatcctgcgggtgctggggagcctgtgggacacacaggaagcacttgtgtgtccaggcccagcggtcctgacccagccttttcagctcaacctgggccacccttaaacatggaggcaagggccaggtgtgatggctcacgcctgtaatcccagcactttgggaggccgaggcaggtgaattacctgaggtcaggagttcgagacaagcctggtcaacatggagaaaccgtgtctctactaaatcacttgaacctgggaggcggaggttgcagtgagccgtgatcgtgccactgcacttcagcctgggtgacagagacagcctctatctcaaaaaaaaaaaaaaaaaaaaaaaggaagcaaggggattcctagtgttccagcagggggagaactgtggttctagcaaatcctctaccaagtgagtaccgtgcacttccagagcgtagggaatcaggtgctcaaccccgaacggcccatagcagagctctcccgatgatgcagggcacaccaggagtgaggacagcagcactaaaccatgaggttaagacaaaggggctgacagggagcagtcacctgtgagaatttaaagagcagaattaacgggctggagcattaagccccaaaggacggatccaggagggtgcccgggcggttaacaatggctattcaggcctaagaaggaaagaaataaccttaaaatagaatcccatcccatcctcctggaccagatttcactacagtaattgcatctgtgaggaagagagctgcaaaggaaattagatgttctccgggctcagctgtaagtcatacatcagagccacccactgagaattcccattaggaagaagctggcacgagctcacatgcgggctggaggccgcccccgcttccacggcccaaaaagctgtccccaccgaggtcctcgatctggcataattgccggcattgtgccgtgcctcccgccctggccacatcaatgtggctcattcttcgaggctccactgaacgctgggagctgtgttgaaagtgggggaggggcatccactgatgaagcttccggagcatctccatccagccagctccctcacaccaactgaatgagccagcgtgctgtaaggaaaacactaccagtcatccacatgaggaggggcgggggaaggtacctctgcctgggacaaaagcctgcaaggaaaacaggagctgagcactccagccataatacaaccagctactttcctgatgatacaaccagctactttcctgatgatacaaccagctactttcctgatgatacaaccagctacttctctgatgatacaaccagctacttctctgatgatacaaccagctacttctctgatgatacaaccagctacttctctgatgatacaaacagctaatttcctgacctaccaagaggccagaaaccacacctcaactccctgcttcccaattaatctttactctgcagtccccactctgggccccagcgacagtattggtgaagagacgcaaagctgatgaatgacgtcaaacaaacaaaaacaacctgtagcaggtggcttcaagaaaccctcctgctttccttcctcaggggagagagccagcagccttgctgcctgggtttggaagggtcaccccaggccctacccaccatcctctctaagcccccaccagctgcttcagccctggatgacactggacaccacctgggaccctgaaaatgcaggtgcctgggccccacctccaccagattcagatgtcactgctccggagtgcggcctgcttaccagacttatctgagcactcccagctactgtggatgtacagaaagggtttagaaccatgggcccattctaccaacaagaactgcatataccacgggccccgcctcagagttattgttgaggacttgtccccccaccccaccctacaatggctcattaatatcccatacacgcaaatcctcgtcaaagaccctcaatgaagtatgcaggccacccatgcctcttcctcattcaattgataaatgagaaagtttcttaaggaaaaattaaacaaatcaggtgatttagcctagttttagtcactaagaagggacttcagagtagttcataaattgtctctaaggattttcaataccagagcattcctcagagggctgggtggtcccctagaagcccctgccacccctgtgtctgctgtggctggggctccacatccccatgacgtgtctggtggcagccaccacagtcctgtctcttctaggaatctaagtgttaggttctggtttcttctcttccacatccacctttggtgttggtttcagaaacagcaaatcctacaatccacggttcccaagcctgactgcacacctgaaccatccctaaatactttccacacaggtgccttccctgggccccatgcactggaggaagccttctgtgaaggtccactttggggcccaggaatgggaatccagcttcactccatagtcagccaggcttgggacaactgtggtggatgatctgattgcatccgactgtcctcccttgcaggcccaacccacagggatacatggccaaagtttagatatgcacccccagcccccaaccacacagtccagatttcaattacatggcatgttaaccgagtaactacataaagtacaaagtgtgctgccaggtgtaggcaacaaaccaccacatgttaacagccatgtgggattggtggctgcatggggattggccagggtgcctgtcactcagctcagcacagacagcaaagcatggagctgtgtggccacatcatctcccagggagaaaccaaacaacatttcgcagaagtgaattatcagaagaaagaacagacaaacaaagatataagtgcaccagagaatgaaaagggatggtgctggaagtgaaattccaaagaaaggccagggggcaggaaacagacagcctgctgggaaacatagactggctaccatgtgggacactcacggtgctgcaggaacctaaggaaggcaactcatccgcacacagcagggaagtggctgtgagggaaacgatgatatccaggggaaatggggcaataagaccttcacagtaaagggacactcagaggcacttcaccaccacaaaatggcaaagcacaaaatgttggagggcaatccagactcagaaagggattgacactcagcaagccatggggagaatgctcacaactatcacagcctagacaaggattcaagtgccacacacactacatcgagatgctctacctctcactgtccccctgtgctaagtcacagtgcactacatcaagatgctgcagctctcagtgtcccactgtgttaagttgtggtgtactacatcaagatgccgtagctctcagtgtcctggtgtaagtcacagtgtactacattgagatgctgtagctctcagtttccctgctgtgttaagtcacagtgcactacaacaagatgctctagctctcagtgtcctgctgtgttaagtcatggtgtactacatcgagatgctgaagctttcagtgtcccactgtgttaagtcatggtgtactacatcgagatgctgaagctttcagtgtcccgctgtgctgtcatggtgtactacatcgagatgctgtagctttcagtgtcccgctgtgttaagtcatggtgaactacatcgagatgctgtagctttcagtgtcccgctgtgttgtcatggtgtactacatcgagatgctctagctctcagtgtcccactgtgttaagtcatggtgtactacatcgagatgctgctgtagctctcactgtcccactctattaagtcatgatgtcctacatcgagatgctctagctctcagtgtcccactgtgttaagtcacggtgtcctacatcgagatgctctagctctcagtgtcccactgtgttaagtcacggtgtactacatcgagatgctctagctctcagtgtcccactgtgttaagtcacggtgtactacatcgagatgctctctcagtgtcccgctgtgttaagtcacggtgtactacatcgagatgctctagctttcagtgtcccgctgtgttaagtcacagtgtactacatcgagatgctctagctctccgtgtccccctgtgttaagtcatggtgtactacatcgagatgctctagctctccgtgtcccactgtgttaagtcatggtgtactacatcgagatgctctagctctcagtgtcccactgtgttaagtcacggtgtactacatcgagatgctctagctctcagtgtcccgctgtgttaagtcatggtgtactacatcgagatgctctagctttcagtgtcccactgtgttaagtcacggtgtactacatcgagatgctccagctctccatgtcccgctgtgttaagtcatggtgtactacatcaagatgctctagctctccgtgtcctgctgtgttaagtcacggtgtactacatcgagatgctctagctctcagtgtcccactgtgttgtcatggtgtactacatcgagatgctgtagctctccgtgtcctgctgtggtaagtcatggtgtactacatcgagatgctctagctctccgtgtcccgctgtgttaagtcatggtgaactacatcaagatgctctagctctcagtgtcccactgtgttgtcatggtgtactacatcgagatgctgtagctctcagtgtcccgctgtgttaagtcatggtgtactacatcgacatgctctagctctccgtgtcccactgtgttaagtcacagtgtactacatcgagatgctgtagctctccatgtcccgctgtgttaagtcacggtgtactacatcgagatgctgtagctctccgtgtcccgctgtgttaagtcacggtgtactacatcaagatgctgtagctctcagtgtccccctgtgttaagtcacggtgtactacatcgagatgctgtagctctcagtgtcccactgtgttaagtcacggtgtactacatcaagatgctgtagctctcagtgtcccactgtgttaagtcatggtgtactacatcgagatgctccagctctcagtgtcccactgtgttaagtcatgttgtactacatcaagatgctgtagctctcactgtcccactgtgttgtcacagtgtactacatcattgtcagactcactgttttcatttccatacacacttagattataagagtttgtaacgttttcacaacattacaggtcatgaaacaatcctcattttcctataagttattccagtggctcacatagtccttgccacttctccttcaccatgcaatgaggtacaacctggtattggttttgtgcttgactctgaccctcttgccatcttttgtaaggttctgtgtttaaatattgcatttcaggcagctgtggtgttgccagccttgaggcagggttctggagcctgaagacatgtgtccttggcagtaacctgtgtgtagacccacctttctgaaattagacccagatgctatctcaaagctaaaagtcattttcttgacatcaagcatttttggcctggaaagctccattttagaaaacggctgttttgcaaacattatataagctgtcaccagcaagaattccgtcactgcaagaattccttcactgcaagaattccatcattgcaagaattctgtcactgccgtaatcactcatcagagactgaggaagtctcagtcaagtgcacggggcctcgggactctcggaggtgcccagctccacagacccttccacatgggaaggcagcagagtggctgctctctttcccattccctgctctgggagtgtcagccctgactcacacagccctccttccatgtcacgccaggagcctcaccacgcagcactgcagctggaatgagtgaaatacctgatggaggacttggagaagagagtcgaattcacaagcctccagcactcggtgtggccagcattcaccactcagggatttctaagatcacacgtgatgtctgaccggactcagaagctcacacgtgatgtctgaccggacttggaagctcagcacttcgttattttattatctccaaatccaaaagaagtggcagtcattacttcaaagcccactcctgaaggaaaaggcccactgacaccagtgctggtgatgcaatccacctatgttagcattggaccccgagctgtgcctgaacctcggtgcctgcattctttactcaacaggcatctgttgaaactctgtcatgttggccactgttacaatcttgtgcacaggacctgacccctaaggtctccagagctttggggcattttatcagaggttcctgccacatttgtgtccagcacaacagtgagtaaagaactgggaacatgttctccctcccaattcctcccgttttccttcccaaggcaggcaggacacattgtctcacggcgagctggccttaccctgaactcagagcatcagcaccccaaagctgcagtgaggaggaagagactgcccacccgcgaaaaggcccctcagtcttcagccaacaccacaggcacagcttcagccctctgactcttgctgaccacgggttaccttggatcttctctcctttgagggcaactgagccacatttggctcctttcagaacatagaatcttggctttgtcttttcctgggcttggggtacctgggactccagcttcaggcacagggtccagcacacattccttcttcttcaccaaaagccaatgagatcagcatagttgcaaagctgccttatgtttttaatgagaagagttatttacaaaaagagatggcttgacaaatatcgtgcataagcaatcccaccagtgcgcattgcccctgagttcccttccctctgagacccaagctgtcatggctgtgagccatgcagatgaggtcctccttgtcatcctagtgggcttcccagaagatactccccatcatccgagtgggcttcccagaagataatcccagtgactgagtggttcctgcctcccttctccggccacatttgtgaaatatgtaagcagcatgtcttccatggaagcggggatgaagtgacggctcggagtcagtttcctccgcgtccctgttgatgagacgtggcagttgcatgaggggcaggtcacaggcggttgtggcttacagacgccctgggttccaacagggcctgacagagatgtccaattccagggatcaccttcccattcttgatcggacccataacatcttagaaagcacaatatactcagttctgcccatgtcatcctctgctcaagtatctgagttcaaggtcatttctggactgaggattcccgtaccccattagacgtgtgtggctcagatcttcagtccaggctttggaatcgagggccagccgcaccccttgttgctcccattctggctggtggtcccctggtgcacctgtcatgtcctgcacagctctcaggcctttggttgaaaagctgactggaatcacacttgaaaaaagagctcagcctgtggatattagtgacacccaccctggtaggaaatgaacatgtaaggctgagtttgtttcttggagttttcctatttattttaaagttggggtgacaagcactgggtttttgaacactgagcggagggcaacgtttcattatttatgcaaagtgcatcgacaaagcgacattgaaagtttttgccatattttcctctttgtagtttctccaagtgagatatgtcaagaagcagctttcctgtgatgtgcctcagaaataaatggaaagaaagaaacgcagcagatggcttggattaaatctgaacagtgataagttctgcttttaggacagctgggtaatgtactctttgctcaaaaacatgtttgatttgaaacacaaaaacaatcttatggtttccatgaaaatgaaagaaaaatgaagctgaatcgtggagtaaattgctagttttctccgcagcatgttctgggctgctttgggagccatatgctctgtttgatgtaaatgagatggaactgaaattaaaaagttttacatttaaaagtagtgaccaaacctattcatcaatgcctttgggcattctaataaagaatttttattagccctaaggtttggggttaaaaaaataaagtttgtcttaaccctgaacaacttgggcccaccttcattttcaggtctgtgaaatattcaagcaacagatgctgaagctagagaccaagttactgatgagggaggtagtttggttcttggcaatcaagttctgcattaataatcgagcctcatcacagaaatacttcaaatccacttttcacagaatatctactgaaaagtatcactaaaacgcaattttgctagaatccattaattttacgagctgactgaatcttcctcagagatcaaaaactgcaaaggagctagactacaaggaactgaatttcagtcaaccttttaagaaatgcagatcagaatgcaaatcctaggtaggttcttaaacagcaaaagacagcatccacgtctctgcaaaaggcttgaactctttggccagcttggttggggagagctggaatggcaggttgagaagtaccaacaaaccccatcaatggcagcttccaacaccatctgattttctgaatttcaaatctggacacggaattgagccggaaaactctgaatgctgccagattctcatttcagatgcacacacatactcttacatgtctcaaagaaagtaaaataaaaggaagatagaaagaaggaaaaagaagaaaaagaaaccctgtagtccacatgaaagagcaaatgccatctgaaggcctcagcagctacacgggatgtcatacctgggctgacgctgccggcttctggggccacccttcggacgtggtctcagtcacacccaggctgacgctgccggcttctggggccaccattcggatgtggtctcagtcacacccaggctgacactgccggcttctggggccaccattgggatgtggtctccgtcacacctgggctgacactgccggcttctggggccaccattcggacatggtctcaataatcttcccgagctcggccagctcacaggagctcaagcttacaagtagttggtgtgtaatttgcatggtcagtagagacaaagaaaggcttcaaagccactgcacactcctgctgctctccagagataaagcgaggagagggtgacgatagccaatcagggcccacgccagtttcccagataggaaccatggccgataaacccgagaccacaggtgttccatccctgctactcagcccaaagcaacaaggaagcctgaggtgacaccacaaaatgcaaatttatctccaacgctgtcacttgttaagatagcaaagaaatgagccttgatccgtgaataaactgtatacatcaactcatctgggaaacaagcaagaaacccaagagaaaccacgggggagaaaccgggatccatgttctatcccctgctgctgggccagacctgagcagcacggcagtgaaggaagtggatttggggggcttccctccacccacagtaaccttcctttgctgagtgatgcaagcctgacctttccggggagcacccatgacctcgtggggacacggtgaaccctagggacatgaaatggtcccgccctagcttcctctccagtgccctgcctgtcctgcccagggcactcccaaaatgtctcaacgaaaatgttcttagaggggaagaggtctcagagattagcccctctggttcctcattttttttttttgagacaaagtctcactctgtcacccaggctggagtgcaatggcaccatctcagctcactgcaacctccacctcctaggttcaagcgattctcctgcctcagcctcctgagtagctgagattactagtttttgtatttttagtagagacggggtttcaccacgttaaccaggctggtctcaaactcctgacctcaagtgttccgcccacctccgcctcccaaagtgctgggattacaggcatgagccaccacatccagcccctcattttctagatgaggaaagagaaactgggacattacagtccctttacggccaacactggaatggaatcctgaaaactgctttgcacggagttctgctgtggtctgtagtttgcatgtatcatttcctttaatcctcacaactcccctctaaggtggtaattaccttattttcacttttttagacgagaaagattaattcggaagaggctaaacagctccaaggtctccgagcagagaggcagccgtcggattccggaacctgctggaccaccctccaggcgcccagtgatttctccagggtggacacaggcttacgtgtggcgcaggagtgctctgtgacgtacacaaggcgcatcccacaggtggatgcagagaggccagagaggggaggcacctggcaccatcccgttctgttttcggtgcggcccgttcttcgggctttattaagcaactgcccacgtggaagaaaagcaataatgaagcaaggcgtcgtatcgattcccccagctgtaatggaattccgtcaaggagcaaagcgaggcgttttcagaaactctgcctgttaacgtttattgctcccaaagtctgattataacacactagctccgggggccgagtgaacatcacttcacacaaaaacagggacaacgtctgtgaccaccggagatgaatattagtgaaagaactgactctcccgattcctctattaacctgtctctggctacattcaaacaaatcatatgtgtgtacggaacaggctcatacacacatgccagcacgcgtaatgcccagtggtcagaaaatgctcttcaaaccggggactgagacgcccgcagagcgcggccctgagagccctgagagcagagtcaagcacgatgctgctgcctggccccagtggccatgcatgtgccgcaccctcgagaacatctggggacctcggggcccacaggcattaaccatcagcttaatctcccacgccaggtgtgctcagcaccctcgagaaggtccggggacctcggggcccaggggcattaaccatcagcttaatctcccacgccaggtgtgctcagcaccctcaagaaggtccggggatctcggggcccacaggcattaaccatcagcctaatctcccataccagctcaccaggtctggggcccgggtgtttcggagaaggcattctgtagttataactaccatccaccatcaggtgactgtcggtaaaggaggggaccctccttcatgtggccatcacttgaggccttaagacaaaaacaatcatgttcattgctgctaagaacccaaaacaataggctgaaagtcctgctgatgcactgccaggaaagacgcagagtacgagaccagtctagctgaggcctgcgcaccgccgggaaagacgcggtgtccgagtccagcctagctgaggcctgcgcaccgccgggaaagacgcggggtccgagaccagcctagctgaggcctgcgcaccgccgggaaagacccagagtccgagaccagcctagctgaggcctgcgcaccgccgggaaagacgcggtgtccgagtccagcctagctgaggcctgcgcaccgccgggaaagacgcggggtccgagaccagcctagctgaggcctgcgcaccaccgggaaagacgcggggtccgagaccagcctagctgaggcctgcgcaccgccgggaaagacgcggggtccgagaccagcctagctgaggcctgcgcaccgccgggaaagacgcggggtccgagaccagcctagctgaggcctgcgcaccgccgggaaagacccagagtccgagtccagcctagctgaggcctgcgcaccgccgggaaagacgcggggtccaagtgcagcctagctgaggcctgcgcaccgccgggaaagacgcggtgtccgagtccagcctagctgaggcctgcgcaccgccgggaaagacgcggggtccaagtgcagcctagctgaggcctgcgcaccgccgggaaagacgcggggtccgagaccagcctagctgaggcctgcgcaccgccgggaaagacgcggggtccgagtccagcctagctgaggcctgcacagcgccgggaaagacgcagagtcagtccagcctagctggggcctgcgcaccgccgggaaagacgcagagtccgagaccagcctagctggggcctgcgcaccgccgggaaagacgcagagtccgagaccagcctagctggggcctgcgcaccgccgggaaagacgcggggtccgagtccagcctagctgaggcctgcgcaccgccgggaaagacgcggtgtccgagaccagcctagctgaggcctgcgcaccgccgggaaagacgcggggtccaagtgcagcctagctgaggcctgcgcaccgccgggaaagacccagagtccgagaccagcctagctgaggcctgcgcaccgccgggaaagacgcggggtccaagtgcagcctagctgaggcctgcgcaccgccgggaaagacgcagagtccgagaccagcctagctggggcctgcgcaccgccgggaaagacgcagagtccgagaccagcctagctgaggcctgcgcaccgccgggaaagacgcggggtccgagtccagcctagctgaggcctgcgcaccgccgggaaagacggagagtccgagtccagcctagctgaggcctgcgcaccgccgggaaagacgcggggtccgagtccagcctagctgaggcctgcgcaccgccgggaaagacgcggggtccgagtccagcctagctgaggcctgcgcaccgccgggaaagacccagagtccgagtccagcctagctgaggcctgcgcaccgccgggaaagacgcggggtccgagtccagcctagctgaggcctgcgcaccgccgggaaagacgcggtgtccgagaccagcctagctgaggcctgcgcaccgccgggaaagacgcggggtccgagtccagcctagctgaggcctgcgcaccgccgggaaagacgcggtgtccgagaccagcctagctgaggcctgcgcaccgccgggaaagacgcggggtccgagtccagcctagctgaggcctgcgcaccgccgggaaagacgcggtgtccgagaccagcctagctgaggcctgcgcaccgccgggaaagacgcagagtccgagaccagcctagctgaggcctgcgcaccgccgggaaagacgcggggtccgagtccagcctagctgaggcctgcgcaccgccgggaaagacgcggtgtccgagaccagcctagctgaggcctgcgcaccaccgggaaagacgcgggtccgagaccagcctagctgaggcctgcgcaccgccgggaaagacgcggtgtccgagaccagcctagctgaggcctgcgcaccgccgggaaagacccagagtccgagtccagcctagctgaggcctgcgcaccgccgggaaagacccagagtccaagtccagcctagctggggcctgcgcaccgccgggaaagacgcggggtccgagtccagcctagctgaggcctgcgcaccgccgggaaagacgcggtgtccgagaccagcctagctgaggcctgcgcaccgccgggaaagacccagagtccgagtccagcctagctgaggcctgcgcaccgccgggaaagacgcggggtccgagtccagcctagctgaggcctgcgcaccgccgggaaagacgcggggtccgagtccagcctagctgaggcctgcgcaccgccgggaaagacccagagtccgagtccagcctagctgaggcctgcgcaccgccgggaaagacgcggggtccgagtccagcctagctgaggcctgcgcaccgccgggaaagacccagagtccgagtccagcctagctgaggcctgcgcaccgccgggaaagacgcggggtccgagtccagcctagctgaggcctgcgcaccgccgggaaagacgcggtgtccgagaccagcctagctgaggcctgcgcaccgccgggaaagacgcggggtccgagtccagcctagctgaggcctgcgcaccgccgggaaagacccagagtccgagtccagcctagctgaggcctgcgcaccgccgggaaagacgcggggtccgagaccagcctagctgaggcctgcgcaccgccgggaaagacgcggggtccgagaccagcctagctgaggcctgcacagcgccgggaaagacgcagagtccgagaccagcctagctgagtcctgcatacctaactccgccgaggacttacattctgatttcaggggttctcttagcctgtcaccaagtgtttaaagaaggttatgatgaaaccaacaagccaatccgagtgtctttaaactggggccacgaatgaaattcactcctgtaagagggcaggggagctggggcactctctcatcccaaaatggaaaaacattcatttttaacagtaataaaacatgaggtggtgaaggcacagcggcgtcggacgtgactcgcagcgcatccaagacaaggggcctgctcttggtggctcagaagacgagggcggcagcaagaccctcgggggaacccttagggaagtcaccgggttgtccttttaaacgatgtgtgccaccgcacagaaactgcaaaggagaaaactaaaattatttgtaacccaccgatctgaggaaacggctgctggcattggctgtttctctccatggttgagatcgcagtattgggacacttttacagctgcctttgtcatttaacactattccaccggaattttcttatgttcttaagaaactcctaagaagtataattttagtacctgcaaggtatctgtcacagagtcaccattactcgaccaggcctctgtttcacacagtcgggtcgtttttagtcagtgatccaagggggccgggcggtgaaccaagtctaacggaggcagtcacagttcagtgacagagttccttcctggttctgatggggaagttcagtcaccgtgtctgtatgttacttactcgcttctttcagggtcttttccaataaagacagctatttttcatggcaatggaaattataaaagcagctaccgtcatgcagatcgtcctgggggcatcccagctgcaccctggtgccgggacagccttactgcaagaaaaacagggtgtgggaggatttacgagttccagctgagccagctacatcaacctgtgggcacgtggcgggttggtggccaagcctgaactgagaccaaggctttggactcctagcactggctgtctcgcttgctaaaccgtaatagtctcatctaactgctctgtactaagaacatgcttccggatccaaccgatgtgtttcggaggtgccctacccattcaggggcagggtggggctgtcacccagtcgagaggctttcctgaagccgagagcactgggaggcagcatctgagacctctctccacagcaggagctcccccacatctccagggaagaacacgttccagcagatccacagccggcacaaaggaaaccttaggaaggtggtgctaggctctccacgctggtccttagcagctgttcctcctgcagctcagagctcagcatcccttctccaggaccttcccgccatcaggcactctctgcaccacccagctccaccaccatctctgcctcgttcccacggaccgtcagcccaatgctgggtccccactgcagcttccacaaacccttagacccgctggtgatgtgctagctccctcattcccggcctgggagagcctggcctggtcccacctccctcctgccaccctccgctcaagcacatggccatcccaacagcagagccctgtctgagaggaaagaactcagctccagaccgccagcaggcaaacatatggaaagatgggctcaactcagtttctggtttttcactaattcatggcttttttattaaatgcaatcttaatacagatggatgcaggagtgggtttccataacaggccatggatggtgagctaatggcctgaaatgtcaagtccaaatctccaaacaaaagtgatcatttaaaaggaagatgtgtgtagccgtactcgtgggacataaactgttctttttcttttcttttcttttttcttttgagatggagtctcgctctgtcgtccaggctggagtgcaatggtacaatcttggctcactgcaacctctgcctcctgggtttaagcaattctccttcctcagcctcctgagtagctgggattacaggtgcacgctaccacgcccagctaatttttgtatttttagtagagatggggtttcactatgttggccaggctggtctcaaactcctgaccttgtgatccacctgcctcggcctcccaaagtgctgagattacaggtatgagccaccacgcccagctgggacatgaagttttcttaaacaacaatgctttgtaaggatcccaagcagcagaagaatccaactgaattgaaagtgggctaaagagtgcacaaactcagcatgggatgaggtgagggagagcagcctgctggcgctcacaggctgaggggcctgtagacccggaagtcggtaccacttgtgggaagtctctggtgaagatgaaaaccaccccaggcacattcacagaaatgctctggggtttgtggaccctgggcatgttcccagaagcgctctgtggtttgcggggcctcgcacggctcagcgcggcaccccctccctgtggattcccgctctgagagtcaagatcactgcatgggagtgcattgcttcttgtcctaattgacagggaacatttggtggtgtctccaccacaagagacgcagcatggctgcgggaccagtgaagccataaagcccactcggtgccttgtggggccgacaccgtgtcactgcaggaagccgcagcccggcctggatttccaggaagcaaggccagctcagcacagacacaactcccatgacagcttgaacccagctcacccccgctatgagagaaacaccgggtgactgacctggagtgaaaacagcagtgaggaagggggaagagccccccacactctcagaatggtctctggacggagacccccaggcagtggccatctgaccctggctgtgtctgaccgtggaaccaaagcagacatgtttgagcagaaccagagcagacatgtttgactccagtcagcccttgagggagctggctaacgaggaccacccaagaccccagaacatgacaaatgcaaagagcttggactgaggaaagcaagttcaaattcttcactgtgtgattccaagcaaatcagaaccaaattcttatctgaatgttttcagtgacagatcaaagaaaagatcccagccagcgtgagccccaggcacacactgcctcacagcgggctcacactgggcccacactggcttacactgggtatacactgggctcacactggctcacactgggctcactccgggctcaacactggctcaaactgggcacacaccaggcttacactgggcacatactggccacacacttgctcacactggcttgcactgggcttagaccaggcacacaccaggcacactggctcacctcgagcacacaatggctcacactgggcacactggctcacaccaggcacacactgcctcacacgacacacactgggcacatactgggcacacactggcttgcactgggctcacaccagacacacagcaggcacactggctcacatcgagcacacactggctcacactgggcacatactggccacatactggctcacactggctcacactggccacacactggctcgcactgggcacacaccaggacacactggctcacatcgagcacacactggctcacactgggcacatactggccacacactggctcacactgggcacatactggctcacactggctcacactggccacacactggctcacaatggctcacactgggcacacaccaggacacactggctcacaccgggcacacactgggcacacactggcttacagccacccacccgagggacaggctggtgccaggggaagctgtgtctgagtgctccatcatgttatccgggacctgctcgtccctctctctgacctgcctgctggacaccaacaccagccctcaagtgccagcagtgacaagcccacctgagcagaaatgcagattctcgtccagcatcctcagagtccaatccactctaacaggatcccctttggtcacatgacccctcctgagccaatcactgcagccaggaccacggaacattctggctgactcacgggatgccttgtccagggcggggaggactcagagttctcgctggacctttaatgacgtgtgagggagaagagaaacacgacacggtcagggagacgtcacaggttttccccagatcctcaggggaaccacacacagtgactcatgaggagcggcggggccttgagccagggcgaaagcaccgggcgctccaggatcccaggctccttccctgaacaagcatccaaacctctcaagctagggctgactacaaacgacaaagtcctgtaacacagagctcagatagcggatttcaaacgttttgttcatgaaaatgtaacctctgtgtcgtcttggaacagtgttcaggagggggagggtgcaagctctggcccaggccccacctctaccagggaaggcaaacatcacttaaacgcctgcagcctcctgcgaaggttttctgagactatcagtaaagataatatgttttcaagctcctggaatatgtttaaagtattatgcaaacaaacaacagctattagaaatatcactttacaaactttttgttgagatactatgcattccaaagcgttcaccagtgagaagtacacagcttggtgctgcctgaagacgcagcctggcccgggatttccaggagcaaggccagctcagaacagatgcaacccccataaaacagagcttaagacaacctcaccctcactagaatggcttacactcctgctacaaaagaaacacctggtgactgacctggagtgaaaacaggaacgaggaagggggaagaggccccgcgccctgacaaatgtttacagaacaaacactcccacccagacatagattcataacccacaagccccgcccccatcctctcagtcaccatcattctaaattccaggctgaacgtcagctttgcctgtttgaactgtaggtccgtggaatcacactctctgctctcctgaatccggcttctttgcgcaatatcccatttgtgagagtcacctgtgtggctctgtacaacagtagctggtggttttttattgctctgtagtatttaattgcatggaacatcccacagttatttctacattcccctgtgcatagacgtgtaagttatttcagttgtaagctgttataaatcaagctgctgggaacattcttaggcctttttgtatatttaaggatgcatttctattgggtatgtactcataggagtgggattactagaccataaaagacagatatattcagcttccacagatacgaaccaagctgctaggcacattcttgtacatgtcctttgcatacctcagtctgcatttctgttgggaatacatgtatctaggagtgctattatttgatcacagggtaaaaaaaatacatagctacatttgtcactttattctgaagtttacaggcaaaagctgctgatgatacggattgatagcgatgtccacttttcattcctggcactggtaagttggtccttccttctgtttttcttgatcagccttgccagaagtgtatattcacatcttttaaagaagcaatgattggttttgttcattctctctaccgtacatttgttttctattacattatttttctttttattatattcttatatttctttaacttcaattttctgttctttttctacactctttagacatatgtcattttcaccttttcttcttttctaataaaagcatctaaggttataatttatttctaaccatagctttaacttgatcccaaaattcccaaaattgtttaatattgtatttttattatagttcagttcacaatattttcagatttctattgacatttcttctttgacaaatggggtatttagaagagtactgcttaatttccaaacatttagattttctagggatttttttttccatttgtttttagcttaatttctttggccaaagaaatactccgaatgatttcaatctttagcaatatgttaagatttgtttatctgatcaaaacatttccgtctaatagatggtcattttcaatatgtatgctgtgtgcactggaaaagaacacaggttctattttgatagttgcagtgtgtccattagatcaaggccattaatcccgttcttcagacctgcttcagcatgtctctctaaatacatgacaggacacacacaccaataataaaaacaaacatgcataaaaatgtgcattattctctccggtaattatctcaatatttgctttatacatttgaaaattatatcaggtgcatcaaatttataattactgtgtgttcctgatagaccaacccttatatttattatggccctttttatctcggaaaatgcttcctgccttaacatctactttgtatattagtttagatataccagctttctttagggtagtgttttcattgtattctcttccagcgtttcaaacttttatatctcaacattgaaggtggtcccttgcaagcagtgtggttttgttttttagtgacaatctttaatttttgagtggagtatttatctcatttatttacaatgaaattactaatatattgggatttatatcgactatcttaccttgtttttttatttgtctcatctgttttatttttccttttatcctttattgctttcttctggatggagtatttttattattattttgattccctttcttagcttgttagctattctttttgtggctattctagaaataataacacgggaccttgatttatcatggtgcaacacacatcacatcccacatggtgtcagaaaaactggatacacacatgcacataacaaaattggaccgttaccttataccatacacacacacaaatcaactaaaaatggattcatgccttaaacataacacctgaacctgtaaaccgcctagaaggaaatataggaaaaaaccttcatgacattggtcttagcaattattttttggatatgacaccaaaagctcaggcaacaaaagcagaaacagacaagggagactacatcaaactaaagtttctgcaaaagaaacaatcaacagtgaaaaggcaatctacagaacaggataaaatacttgcaaatcgtataactttttaaaaggttaatgtccaaaatgtataaggaactgctgcaacccaataaccaaaaacaaaataacctgattttttaaacgggcaaaaggacctaaatagacatttctcacaagaagaaatacaaatggactgcaggtatacaacaaaaatgctcgacatcactaatcgccagcaaaatctaaatcagcactacaatgagctatcatatcaaacttgttaggatacctattatcagaaaaaaaaaagatgagtattggtgaagactgtatactgttgtgggaatgcaaaaggtccttatggaaaacagtatacaggttcctcaaaaaattaaaaatagaactactatttgatccagcaaccccactctgggtttttacccaaaagagtcaaaatcaagatctccaaagagatacttgcattcccacactaactgtggcattatttgcaatatccaagatgtggccacaacccaaatgtccatcaacagatggatggatgttttacatgtggtatatctagacaatgaaacattactcagccttaaaaaagaagaaaatcctgctgtaagtgacagcatagatgaacctggaagacatgagctgagcgaagtaatccaggcacagaaaagataacactgatgatttcacttagacgaggcatctaaaatagtccaatgcgtagacccagagagaagaatggtggtttccaggggctgggtcggggcagggtgaggtattgctaatcaatgggtatcaagttttagttctgcaggatgaacgagtgctagagatctgcggtacagatcatggctgtcatcaacaatactgtgccatgcacttaaaatgttaagagggtggatctcatgttatatgttctttccacaaaaaaggacatggatccctgacttattagtgtaacacgcattatcgcatcctggataatgccaaaacctgagaacactaactcctttaccttctgtgccaccaatattcgtgttgatttaccaacccattgatagttcccactgctatccctgcctgccttgtttcctggtttccatgtgggtttactttcctcctgccagaagcccctgcagtcttttcccaagagtcatctgttgatggagtctctcgagttctgtctgtcttttcgtaggagtcatctgttgatggagtctctcgagttctgtctgtcttttcctaagagtcatctgttgatggagtctctcgagttctgtctgtcttttcctaagagtcatctgttgatggagtctctcgagttctgtctgtcttttcctaagagtcatctgttgatggagtctctcgagttctgtctgtcttttcctaagagtcatctgttgatggagtctctcgagttctgtctgtcttttcctaagagtcatctgttgatggagtctctcaagttctgtctgtctggtcacgtcttgatttcatctttatacctgagaaacatttccagggagtagagaacttgaattgatggggtgttttcttccatcacatgcgaggttcatcacacttctggtctccatggtttctggtgaaacaattcatcaatagagattaatttcctatgatttttctctgcttgctttccagattttctcttaaactttggtttttactaattttagagtgatgttcagaggtagggttttctttgtgttcattctgtgaggttgaactaaccacacaaaactgccaatattcaactgttgtttacctttaaaatagctatataatagattttttaaaatccaagctttggtgtctttcttcaggtttgaaaaaaatcatagctctcatcgcctcaaacattgcttctaagctgttttccttctcctcttctgggactccacctacacatatagacctttccaacagatctcctctgcctcatacactccgtcctgtactttctctcagttttgatctgttactctgcctcattatttcccagggaccttcttccagctcactcatctgctcttccttcatactcaatgttttgtgatgcccatctattgagttattagattcagctctagaatttccatttgattactttgtttatagaatcaatttttctggtgaaattttccacttaccctttattttcttgaacatatcaaccacagttattttaaaatttgactgcaacaagtataataactatctgtgggtgtactgttgtcatctgtttttgtgtcttggtcttgcttcttgacaactgaaattcagacattacatatgaaactgcagagactctgggtgagtctatcttcttaccttcctcctcactagacagccagatcgagggtagatccccttaactcaagggaggcctgagacaagaagacagacccatcattcttggaaggctcagtcacctggggtttatcctcacacctatggcatgacccatccggggctgggacctgggatgtgtgcgatggcccctctttcttagaagttcctgaattccagtttcatctcttcagcattatgagactgccagaaatcctgctctgcttttccatagctttctgatcagcctctgattcaactcaagaatttggcaaatgtgtcagaggtgaaagccacaggtgctgattgcctctgtacctactttctctttgggatccagtctcctcagggcctggtaacctttgcaatgcaaacatctatttgtgtgttgatgaccctatgaggttgccaagtgctctgtgggtttcactgcctcttctccacagcccttgcctggtttctcagcctctttcgacaggaatcacaaatgcccccaggagacaggcagcccgcagggagtgggctccctaacagtgcccctccgatgggtcttttttaagtttttttggccaggggctgtggctcacacctgtcatcccagcactttgggaggctgaggtgggcggatcacctgaggtcaggaatttgagaccagcctggccaacatggtgaaaccccgtctctactaaaaatacaaaaattagccaggcgtggtggtgcatgcctgtaatcccagctactgggaggctgaggcaggagaattgcttgaacctgggaggcagaagttgcagtgccactgcactccaacctgggcaacagagtgggactccatctcaaaaaaaaaaaagaaaaagttttattttatttttaattgacaaataattgtacatatttatgggctacggtgtgatgtttcaacacatatatacattgtggaatcatcaaaacaggctaattaacaggatcttggcctctcaaatcccggttgcctccgcagctccccaaagcaggcattctgtggattttacccagcacttctagttgttccccacaggaaatctgatccgatgcaaacagatcattatagccaagagaaggtcagttctgatcgttgttgattttcctggaatttgctaatgatgaatcgtgctgtgtgaaaatacactttaggctgatgcccagctgattagcatatagggtttagtgacatttccactgatagtgacttcctcaaagacactctgaccaggggtcagcaaaccagagccccgggacctaccccacctgtcttttcatgtagggcctgggaaaggaaaacaaaccttgggactccaaaatctccaggctaaagggaaaagtcaagctgggaactgctcagggcaaacctgcctcccattctgttcaaagtcacccctctgaggctgccctgagacaaatgcatctcattgctccctctcccctattgcttatgtaaaaatgcagattcactgagccaggctcaattgtgtattcactggaaggctggtcaaggactcaaaagaatgcaaacttttgtctcttatctatttctaacctggaagccgccatttccagtcatcccgccttactggactgaaccaaagtatgtcttacacatattgattgacgtctcatgtctccctaaaatgtataaaagcaaactgtgcccccgaccacctcgggcacatgcctcaggcccccgtccacctcctgcgcatgcctcagcccccgaccacctcaggcacaagtctcaggacttcctgaggctgtatcatggatgcatccttcaccttgccaaaatactttctaaattgactgagacctttctcagatattttgtgctcacaagcctttgagctaagaatggtttttatatttttttaagggttgtaggaaaaatgagatggagacagggacagagaagaagtggggaagagagaagaaaggaggagaaggaagagaagaagaagaggagaaggagtaagatgaggaggaggaaacagtaatctttgtggctttcaaagccaagatatttatcatttggtcctttacagataaagcttgccaactcaagttcatgaccatctctaattcttttaaatatcaagtcatgatgtgtattaatataaagattgcatattaaatgcatcttccatagacatagaaagtaaagatatgaaaatcagtttgtactgattgtaagacaagtctctgaacgaccaacaagatggcccagtctgtggagctccaggcttatttacggggtgcacctcgtagtgcccacaaggaagctagatcttttggaaataattctgcaatgtggaaataattttgcaacgtggaaatactgaggcctggggctgactgatttattgatgagaaacccagggaggcattggtttggggttctgtgacatcatgttgaggcatctgcatttcctatcacactgtactaaatcagttagaaaatatcttaatttccctatcctcacatgagtcttactgggtcctgacaacctcctggcctctcaccctaatgagtcctcatttctgagtggacatttctcccaaattcagttgcaacaacagatggtgtgtggccacagcccataaaggtagagactcatgctcaaagctgccttctggtaggcaaagtcgccacctcgaacacaccctccaaagacttgacattcagataccaaatgctccaggtccagctcccaaaagctagatggattgtccgttccattcgggcttcaaatcagaggctgtggtggctgtggtatctcaggactggtgcagtagggttctagcacagcttcaggcagacttcctcaacaacagtgatggtgatggtagtggtggtggtgatagtgaaagcagtggtggtggtgatgatggtggtaatggtagtagctatgggtgtggtggtgatgatggtggtgatggtagtgatggtaataggggtgatagtggtgatgtggtaatgatggtggtggtggcagtggcggcggtggtggtgataatgatagtggtaacaatggtggtggtgatggtggtaatactggtgatggaggtggtcgtggtgatgatggtggcagtagtgatggtggtagtgatagtgacagggtggtggtggtggtgatggtgataggggtggatagtagtggtgaaggtggtggtgatgatgacagtggtggtgacagtggtggtggtgatgttagtgatagtggtgatggtgatgggggtggtagtggtgatggtggtagtagtagtggtggtggtggtgatggcagtgacgggggtggtggtgggggcagtggtattggtggtggtggtgaaggtggtggtggtgacggtgatgatgatggtagtgatagtggtgatggtggtggtgatgatggtgatggggtagtagtggtgttggtggtagtggtggtggtgatggcagtgatgggggtggtggtagtcgtggtggtggtgacagtggtagtagtgatggtggtagtgatgggggtggtagtgatggtggtgctggtggtagtgataggggtggtagtgatggtgatggtgatagtggtgatggcagtggtagtgatggtggtgatagtgatggtgatagcagtggtggcagtggtggtgatagtgatggtgatggtggtggtggtgatggtgatagtaatggtgatggcaatgaaggtgatggtgatggtgatggtgatagtgatggtgatggtggtggtggtgatggtgatagtaatggtgatggcaatgaaggtgatggtgatggtgatcagtgatggtggtgatggtgatggcagtggtggcagtggtggtggtggtgataatgatggtcatggtagtggtggtgatggtgatagtgatggtgatggcagtggtggcagtggtggtgatagtgatggtcatggcagtggtggtgatggtgatagtgatggtgatggcagtggtggcagtggtggtgatggtaatagtgatggtgatggcagtgatagtgatagtgatggtgatggcagtggtggtggtggtgatagtgatggtgatggcagtggtggtggtggtgatagtgatggtgatggcaatggtggtgatggtgatggtgatggtgatcagtgatggtggtggtgatggcaatggtggcagtggtggtgatggtgatagcgatggtgatggcagtggtggtgatagtgatagtgatggtcatggcagtggtggtgatggtgatagtgatggtcatggcagtggtggtgatggtgatagtgatggtcatggcagtggtggtgatggtgatagtgatggtcatggcagtggtggtgatagtgatagtgatggtcatggcagtggtggtgatggtgatagtgatggtcatggcagtggtggtggtgatagtgatagtgatggtcatggcagtggtggtggtggtgatagtgatggtcatggcagtggtggtgatagtgatggtgatagtgatggtggtgacagtggtggtgatggtgatggcagtggtggcagtggtggtgatggtgatagtgatggtcacggcagtggtggtggtggtgatagtgatggtggtggcagtggtggtgatggtgatggcaatggtggcagtggtggtgatggtgatagtaatggtcatggcagtggtgatggtggcagcaaggaaatcattctctgattacctgacatggttaaaaatctgagagcaaagatgagctgagaatgtcatcatacaatgtgtaaagaagctgagcctgagaaccctgaaatgcatggtattctctatgtgcaaacgtacgagagctgaaagtgaccagttacctattcatggttatcatctgcatgatgaagaaacactgcaacctaccttttctccactagagggttggttcactagataatggcacctgcatgccatggatgctacgtatcagtattcaacagtggaagcccactcagcattcaggagtaagagatttggtaagtgataagaaaaatttgcagaactacaggattccatttttgttatgtgtgtgcccagaagagcatctaaacagacatttacccgaatgttcttcaccatgattattttggggctttaggatcgtaaggaggtgattctgattttgtggcttgtacccttctgcaccacccagccatgcagcgttccgcctgcttccttttctcctgtgtgctttaattctagttacaggaaacatgcatatgaaaaaggcacggaagggaatgtatgtttccttttttgtcagaaaataaaatgacacgtttccatttttggagaagttaaaacagattttatctcctgccaccattcttgccttacggacaagaggaggacagggcctccaagcaaatgagcacattagtgagttaaaagaaatatttataaatctagagcatagtctttggcctagaaagacggtactaaagcagacagaagccttttcaggaacacaaataagtattaaaaaaaaaaaaaaaagcaaaaaaacaccttttttgttccctttaaaccagaatgactcttaacctggtcaacaagcacattgcaaatgtcttgttcccactaggtggccacaggtcactgggcgagcgggtctttgtgggcagaggcaggagcggaggctgcggaggacgctccaagcccatcttccgtggctcagcccagcggctcccgcggctccagggcagcgccaggcatggcttctccccgaaggcacagaaggctccgaagttgccacctcttgcctgagttgccggaaatccaagggtaggtttatatcaaatcagcagacaaacttgacttctgggtaaaggctaaaatgaatcaacggagaactgacgagactgtttccccactgacgggtctgtaagagttgggggctgcccgccgcctggtcagtcacgctatgcagctcttaggttgaatcctgggctgccctggctaccaggatgcctcagggaggggaggaagcaggaggagcggcgtggggcgactcctcccaacagggggagcagcgtggagcaaatcttcctgatgggggagcggcgtggggcaaatcttcctgccaagcgtgcgagctgcttgtccccacctgggcgagccacctcttcctaccaggggtgcccatgaggtccttcctaaaagtaagactcagcagggagggttccaaggcctgtggccagcaggtgaatcacacaggagcttcctctaccatgtgaggctctgggggtccttgtctgggtgacggtgtcagagtggactgttggccaccagcaacggggctgcctgggacggccaggggcagagctgctcccatgtggcaccctaccccgagtcctgggtgtctgggctcacacccatctctggcctaccccaagtcctgggtgtctgggctcatacccgtctctgggtgtcattccagcagcaccttctcctcctttcaggatggccctgttcagtcagggtcctgccctctcccactgcacggggaggtgctagagaagggagggggcctgtgggcactgccactcacccctccaacaggcagggagacaggcacctgccccagggatgctgcagcccagcacccctccggcagcctcgcctggctccagcaagagcggaatgttcacaggcctgtccaccgtcacctcctaacaggtcctggagaggccaggccacgccagtgccatcacagactgtgctcgggaagctgaggtgagccccagccggccgtgagccccagcgcccaggcgcctcctcccctgttgcagccccactgggtccccaagtccccacccacggccagtgtttgtttctccctgaaaacctgatttgacttcactcaaaatctccacacctgctgcaaacgtcagtttgataaacctgacgctgccctcccggctgggggcaggaatctctctaccacctgtgtgagaagaggccgagcctcagagtcccaggccaaaaccctgttagagcagcttagacacagcaccaagacccccctagacccagagtgagcctaaaatgaaaagcaagtgaaagcctcggaccgtgcagctgctcgccagaacgtctcaggaaaactggctgcggcctttcctgtggaatccaaccgagatggcctcagcctgtctccctttcctcgtcctcagtgctcctcacagaccccaagacccacagggcctgcgtcacatgcacagaagccaggtcctctcctacggccatttttgggatcccaagaaagcccccagtgtcccctcactgctgtgcagcttacaccccaagttcattgctcagggcccgctctctttcatcaacaattctccccctgcatcctcttgaaaacgcggccgcacccggcggggcaccatgccagaccacggccctctgcacagcagcaagcccaccacagcgtgtggaccgtgagacctgccaccgtgacttctccccaaaagggcctgagctgggcttaaccaggagggctggggagagctggatgcccttcaccctcgctgggcaagagcctcctcccaggcatgtcccagcctcagggctttgtctccagagggggcaggccctgggtgacacagcccctcagccccactgccctgtccccgaggctggccagcccttccttatctgcacagcctgaagccttgtgtggctgactcggccctgagcttgttctcaccaccaaaggaagagccaagcgcccccacctgctcacctctgccctgactgtcctcaccctggatcccttccctaattaaatccccccgtctgcaacccaggcagggagtttccaccacactctacactgcacagcagcctccatcgcaggtggtgccgtccctgagtgcaggcgccagaaaccccaaggaggctccttggcagagcctgagccggaccagtgaccccgcggcctctcgggaacaggtcagaggctctggagggccttcaggttcgtctggccctaatctccacccacccctcgcctctgccccagcccataacggggccgtcctccaacaatgagtgggcaaaggtgcagggctgaacgcagacagccgcctgctgctcatcaagggaacagcttcctgccgcatcttggggtctatgctgcctggtggggccaggagaccctgagagggcgctctgccccaagtcagcctgtccctcctttgccccagatggctcctgctcccacctcctcctgtccccgtgagccacagagcagcagacgcatcatcagtggacactggcaagaccatgtcagtgctcagaagcctccgggtcagccctcagaccaccccatgtgagaaggtaaaccccggcgcccaggtgagccctcggaccaccgcatgtgagaagccaggacactcagcatgagcaggtaaacccgggcgcccaggtgagccttcggaccaccccacgtgagaactcaggacacgtgagaacccaggacactcagcgtgggcaggtaaaccctggtgccccagcaccccaggctcctgccccacccagcccaccaacacacagttgcccaaagtccggattcccagctcgccccaggtcttcctgggcacattctgtccttgcaaaccacttagaggttgagggactgtttatggggtgggtgtgtgcctgaatgtgtgagagacagagaaaaattacccccaatctataagctataggtaagaaaaagtacattttaattttacattaaattgaatactttcaactatattttaatgtggaaattcccaggccagtatgaggtgttgctgtggtcggaccacgctgggcccactcacgatggagtctgtcgtgagagctggagccccacccaagccacagctgcccccggcaggcaggccccacccaggctctgcaatggacacacggagacccacccgagccacagccacccccagcgggcagaccccacccggactctgcctgggccacagccgcccccggcgggcagaccccacctggaccctgcctgggctgccatggacacacggagcagcttgaaaatccaatggtccctggtgtaatttcctcagagattacttggttgatgagaaaagcagtaagttttgttgtttggtttcatctatctggatttttggtgagaattctccactgctccctgtctggggagaagcccagccccatggcagccccagcctctgtccaccatcaggcacgctgggctgtcacacagccacctgtccagggcacccatgacatccggaacccacctcaaatctggcttctgtggactgaaggcggccggcctgcagcctcctagctcctgttcccacggcctcacggcatccgtcactttcgagggtcatcacaatatgaccagaagcccacgggtggctttgaaagagatgaaggcggtgacatacgtgcccagtaaggacgcagctaggatgccaggtggggcaggccaacagcagctccaggcaggaccaggatggcctctgattgtcaaacagatttaaaatttttgctctgaaacactgaaacattccttcccaagcaaggacagagccatgaatccacagccaatctggagttcctctctgggcctgggcagcctctcctagctccccagacaacactcggtgcctccctgcagcctccaccgttaagcaaaagcgtggatgtatgaattccaatttaggttttagctaatgcttgcattccagccattaattgccttgagctaaatacctaattggctgtataaattccccaaatggaattctttggcaccaaaaaaaaagaggaaggcagctaataaccactacagagcacaagacccgtctccataattaggccctgacggactcaggccagggcggcaccacctgcccagctgggcagcccagaagcagcagggccccagggagcccggtggctcagccacacatgctgcccacgcggcccgataaggccgacccgcccagcttgctcccgctgccagagcctcttccccacctctccaggaaacaaagccacctgcacgggtacccggcctgccttgcgtcctgccaggcccctggaaagcaaacatccctccaaggcctgggccagtggtgggctgcgtcaagctgttagccaagcgggcagtgaagacgaaggctgccccgtagccagggagctgacctctctgcgcaggtgccggggtacgagcaccagcagagccgagagcgggggcagtgctgaagcccctgctgccatccacaaaggggcctcagagggttggaaatgacaagccacggtcttgccccaccccggctcctggccatgctacccagccacacggcacagggcaaatgccagcaggacacaggccctcagcccggcatcatcgtcagcccgaggatgctgggccaggccaggtgccgactcagcagggcagcaagagggcctcactgctgagggtgaagccaagcccagcatggcgtgccccactccagccactccaccgccagggctgctttctgggaccactcccaggatgaatctcacagggaaggccacaggccaggtcggcaacaacatgcccccagcagagtggcccagacacaggagcaggctgggtgtctgagaatcatccttagaacacagagagaagtggacttggaaggatataaatcagaacggtaacattattttagtatttattatacattttctaaatgtttcataatagccatgtattgcttcttaattagagaaaatagtaagttagcatgaaaaccccccaaaaagagaagagatctggggaggaggagggaggttggtttccacactgctttcatcaggccagaggcaaacagaagtctccgcagacccaggtctgggcagcgctgcagtgcaggagggtggggtggggagggggtcccctccagaggagctgagtcttcactggcgcctgatgctgaatttgaggcccccaggggagcccctcagcgggagggccgtagcatgaggggctcctcctgcagctcccactcctgggccaagggcatggggcagtcccaccttaaggtcagagctgaactgacaagtgttccccggggctcccagggcaggccccagtgagagttcccctggcactgctgctgggggcatttccagcctaagacgggttcaaggcaaccccactccagtccagccactagaacgagactggactgtccaggtgctccagccccaccagcgtttccaatggtcaggagcaacggcgttgggtggttaggagaccagtgggatgccacatatctgtggggatgaggggcacggcactttgcactttgtgtcactgtggtgtccaagatggaattaaggtgacacccccgcctcctctcaacagatgttcaggacatgaagggccgtgacaggcagcacgtgcccactcagctggattccaggttcctttgtgggactcggcaccacctgtggacaacagggtgtgtttagggtccagggactttcacaccagaggaaaagtaatcctgacttctcttccctcccagtgaacactgaaaacaatcaaacgtcaaagtccgttttctcccaggtcatgcgtggggtagggatggtgtctccaatgacagataccaaaaccaacaattccaggtacatgtcaatcccacaactcaagctcaagaagcttccagaggaagcaagggctggcccaagggcaggtgagggtggtcggcccacagggccctcccggagcagcagcagatacaatcatgctatagttcagtttgctcgaagagtggagtgtcagccttggctcaggagtcaccaagagaggacgatgcacagattcccacaacagcaagacacacagcgcagtctgagtccaaacaaacaccaataggcagaagcaagacacacagcgcgggccgagtccaaacaaacaccaacaggcagaagcaagacacatagcgcgggccgagaccaaacaccaacaggcagaagtgaacccgtgaggcttaattcatagtcaggaacatttggaggagttcagcccttacttctttgccttagtgatttccaaactcatggatgccacttcagtgtggtaatggagccaggatgagtggagagcatgtcacacatcagtttcccgcagcccctgcactggtgacccttagttcattcacaatcgcataatcccttgtgattttcctggcaaacaggaacactaaacctctttttcttcctaaaatatttggtttacaaagttaagcaaaggcaaagctacaacacaaaacgttgctgtagtacagacgaatccaaggtggccacagcacagatgaacctggtgaggatgccgtggtgccacagactgggtgactcacacagaaacgtcctcatggtctggaggctggaagtctgggatgggggtgccagcacagtctgctctggtgatggcctccgcctggcttctcaccgcgtccttacatggaggagagaggactcttcctcttcttacgagagcactggtcccttcacggaagccctgccctcaagaccccatctaacccaatcaccgcccaaaggccacctatcccatcgtgggagccccaccctcacgggtgatctaactcaatcacggcccaaaggcctctcctcccagcaccatcccctgggggtttggccttctacacactgagttcaatgagacacattcagtccataaccgctgcctcagagaatgtcttcccacacacaaggacacatacacacacactggtgaaacacaactgagattcattcttgctttttttaacctcatagatataatagagaaatgcgcacaaaaacgcatcgtatagcaaacaatattaagtgaatattcatccaaacagcactcaagaaatagtcccgccagcagctggaacccccacccctgctgcaccttcatggggagccaccgccgacttgatggaagctgtgctcacggccgcgcctgcctctgcaccagattcacagggcctgtcgtctttcacaccttccttctttcactcagcttcatgtctgtgagatgatccgagtcgccccgtcatggctaaattccactgttccattgtatgaaaataaaataatcttcctctcctccaccaccaaagtgcatgtgggtcacgtccagcctggggagactgtaaacgatgccacctacgcgcttccttgcgcatctccctgaccaggcgtacgtgtgcttctgctgcgtggagggcaaggagcgaaacctcagccgcagcaaacacacctctccacattccagcacacctgcccacctgctgtccaagcccccgaggagctcagaggttgtgtatcacagccaggtgcttccaggaactccccgccccacgtcgcagctgcacctggagctggtgcttccggtttttgcccgtctagtaggggagctgctgaatttcatacggcttccgtcttcatcactccaatttaataattaggttgaagaccattttacgtatttctcagtcatttgaattttctccttagaacttctgaaatgttttgcaaatgtttccttcgttgccttgttctcagtgatttgtcagggtcctctctgttttgaacgtgagatctttgtcggttacatgtcatttacatgtgttgaaaatattgtctcccattctgtggcttgtcttttaattaattctctttacggtgtcttttttactaagagttattcttgattttaatatagttgaaattatcagtaatttcctttgcaattagcactctttgtgtcctgtctcaaaaccttcctctccgccctaaagtcatgaaacattatattctcagttgaaaacctttatagtcttgcctttcacacccatgagcacaggagttggtgtctccgaaagaaattcggtccaggttcatcttcttctaatatggattccagctgttctcatcttccttttttatttcaaaatgtcttgaggtccttctgtgtcagcccatctacctaactccgtcttgaagatgaaccacaacttgaagggtgtttagaacgctcgcggttttttcctatgataatgtttcacagaatcattgcgcatttggttctttacacccaggcctgaacatccatcacataacttcccaggagtcaggctggtgagttaaagttatgtgaattttaatttccttagatattgggctgtcttccttaaaaaaattaattccatcgcaaaattattaaaaattcccccacgttttcttccagtacttgtaaaattccattatatttttaagtctctgtgccatctggattttattttggggtaaggagtttgggagggacccagctatgtattttccaaatgtctggccagttgtccccaaatcattactgaataatacatcttttccccaccgatttaaaatgtcatcattatcatataccaaatacccatacgcatttgggtctatttctagactttctattctttcccttcaatctgcccgtctgttccccactctggcttaagtgtcccatcactgcaaagcactgagtgtgcaagactcaacgccccacacacaactttctttttcataacttttctgtttagtctcatgtttgtgtctgaacctggactttaaagctagttcgtttaatttcaaaaaaaattgttaatatgctgttgtgataacttacatgtataggtttattcagagagaattcatatccttacagaattaaaccttctcacccagaagcactgtctcccctgcccagcgggtcctccccatctcccagtggagaccatggacctgccgggttcaccgtcgccaggctcctcaaggccttccccattctccctggttcacccaggagctctgagcacgccacgcacctgcccctgcaaccttgtcccgggcggcctcctgccaccccaccgatttcccctcccactcacagactgtggcatctcaaggtgaccttgggctggagagccaggattccagcggacacctctgggcttggggggctcgataagacaggtggagtgagtgaggtcaggaggggatgaggagggagacacaaaggaaaggaagtgaccagaacctttgggaaacacaaagaaaaactatgcaagaagagaaagtcccaacaccacagttagaagtggcacatttggggcggctgttgcaggatgaagcaggagcatctcttggaactgcacaaagagtcttctcctccagagtaacacggggtcttactctgttgccccgtggctcaggggcacagagggccccactcggcttgtctgcaatcaacgctggtacagctgcaacacagggagcaccccgaggatccacccatcactgcagctgcagggctgggcatgatgcttttaacttgacagtgtgaaaactaaatgttggctaacacagcctggacgtaggggaattgaaagaggacagtcctcaccgtacggtgcagggggcaccacagggttggctaacacagcctggacataggggaattgaaagaggacagtcctcaccgtacggtgcagggggcaccacagggttggctaacacagcctggacgtaggggaattgaaagaggacagtcctcaccgtacggtgcagggggcaccacagggttggctaacacagcctggacgtaggggaattgaaagaggacagtcctcaccgtatggtgcagggggcaccacagggttggctaacacagcctggatgtaggggaattgaaagaggacagtcctcaccgtacggtgcagggggcaccacagggttggctaacacagcctggacataggggaattgaaagagaacagtcctcaccctacagtgcagggggcaccacaggggctacacagaggaggactgagtcaactcctgatgagatggtgtggaaccatatggaaaagtggcagctgccgcaggacctcaacgtgggagaggctactgttgcccctgggtgagctcaggaaagaggggcaggatctgttgcttcttattttaagccctatattactcggcttttaagtgaaccatatatatgcattactgtcacacaaattaactgaggaaaattgaaagcctcatgtctcctaagtactaagcattcaactgacatttgttgtgcactgaccatgtgcagggaaccgacggagacacttagaaactcagcaaagcagacaagtctcctcctatgaaactcacattctaggtggggacagacaagacacaatgcacacaatcaccgatgtcaggattggggacggttgctatggaggacagacaagacacacacaatcaccgatgtcaggactggggacggttgctatggaggacagacaagacacaacgcacacaatcaccgatgtcaggattggggatggttgctatggaggacagacaagacacaacgcacacaatcaccgatgtcaggattggggatggttgctatggaggacagacaagacacaacgcacacaatcaccgatgtcaggattggggatggttgctatggaggacagacaagacacaacgcacacaatcactgatgtgaggattggggatggttgctacagaggacagacaagacacaacgcacacaatcactgatgtgaggattggggacagttgttatggaggacagacaagacacaacacacacaatcactgatgtgaggattggggacggttgctacagaggacagacaagacacaacacacacaatcactgatgtgaggattggggacagttgttatggaggacagacaagacacaacacacacaatcactgatgtgaggattggggacggttgctacagaggacagacaagatacaacacacacaatcactgatgtgaggattggggacagttgttatggaggacagacaagacacaacacacacaatcactgatgtgaggattggggacggttgctacagaggacagacaagacacaacgcacacaatcaccaatgtcaggattggggatggttgctatggaggacagacaagacacaacacacacaatcactgatgtcaggattggggatggttgctatagacaaagaagagatgaagagggtgcaggcttgggggcaggttcagtgacagcagagtggagtgtggatcattgcaatgacgagagagcctcttttggccactctgttgacctcgaacatccccccaagcagactacacactgtcaatgtgttcaaaaacagagatgacggctgttgcatggaacagacatacacagcctcagcgaccccccgggggcccctcgaaatgtgtttgtcaggctgcctccacgcagcccacaggcatggagcaaacacacgctccacttgcttcatgatgccaagcacagaacccacttcaggaaaacccaagaaatggcccccatggacccccaatcccactacttcccaccctaaaaacaaaatgaacagaaacaccacacctccaggcagccagcacagtaagcttttcacttaagtttttattatagaaatgttcaaacatacacgaaagcagagaagataacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcatggacgccatcggccatggccacccatcgctctgcagagaagacaacggcatggacgccatcggccatggccacccattactctgcagagaacataacggcacagatgccatcggccacggccacccattgctctgcagagaacataacagcacggatgccatcggccatggccacccattgctctgcagagaacataacagcatggacgccattggccatggccacccatcgctctacaaagaagataacggcatggacgccatcggccacggccacccattgctctgcagagaacataacagcatggacgccatcagccacagccccccatcgctctgcagagaagacaacgacatggacgccatcggccacggccccccatcaatctgcggagaagacaacagccacccatcactcttcagagaagataacggcatggacgccatcagccacagccccccatcactctgcagagaacataatggcacggacgccattggcaatggccccccatcgctctgcagagaacgtaacggcacggatgccatcggccacggccccccattgctccacagagaagataatggcacggatgccatcagccacagccacccatcgctctgcagagaagataacagcatggacgccattggccacagccacccattgctctgcagagaacataacagcacggacgccatcggccacggccccccatcgctctgcagagaacataatggcacggacgccatcggcaatggccccccattgctctgcagagaacataacggcacggatgccatcggccatggccccccatcgctctgcggagaacataacggcacggatgccatcggccacggccccccattgctccgcagagaagataacggcacggacgccatcggccatggccacccatcactctgcagtggctcatgtttcactccatccgtctcccctgccacccctccctgttttccagggttgagggtggagtcagttagagaaaatctactacaccatattctgtgtatctctagcaaatgaggacttatctcattttattttatttaggggagacggggtcttactctgttgcccaggctggacggcggtgacacaatcacgactcactgcagcctccacctcctgggctcaatgattcccccgcctccatctcccacagcaccaggatcaccacaactcacccacatgagggctttaaaaaatgtcatcacaaacccagtatcacaccagcaacattagttaacagcaactggtctttaataatgttctagtatccggtcagtgctaaattccattaattaaaaaaaaagtcatcttgtagttaatttgtttgaattaatatccaaggagggtccatcatacgtctacacagcaatggcgcacgcagggtggattcagtgtttgtggtttgctatgaatctgatgagccaccaagaatccaggctgagtcttctgacccctttcctgatgcttatttcctgaaagcgtccttatctgtttgcacagtatccacgctctgcattcctcctaactccaatgaacatccccagaatccccaatgagaagaaaccgtgtccctcccagggctcctcagcatctcgggtgcaatgtctctggacacttccagcgggcaggtgtctaccctggccttgataagcagacaccactagccctgaaagcaaaggtgctacctcggcctgcgggaccacagcggatgcgcggccccagtcagcacacggtgaggggcgttaccaccaaacctccctctccagggcgagcctggcctggggggagtcacagtaaagccaccgtcaaaactccttccaagttcattagcaaaggtgctacctcggcctgcgggaccacagcggatgcgcggccccagtcagcacacggtgaggggcgttaacaccaaaactcccgctccagggcgagcctggcctggggggagtcacagtaaagccaccgtcaaaactccttccaagttcattagcaaaggtgctacctcggcctgcgggaacacagcggatgcgcggccccagtcagcgcacggtgaggggcgttaacaccagacctccccctccagggcgagcctggcctggggagagtcgcagtaaagccaccgtcaaaactccttccaagttcattatttacaccctgagtgttctcagcagggccaaaacttcacacctctgactgaattttcatccatttggaagggttccgggtctcctgggagttttagaaattgggagtgagaagacgtggttgaaaactgaggtgaaagctctaagagaaagttaatttggtgtctcctgggcacttcacagctctgcagtgcccagggttccattatgcgtccctcagtgtgaaacacagcaaaccttattaaatacccttctagcaaaatcccccatcctccgagcttggcctgtgctccgcttcctcctttcctgccccagacgccacagcaaacgttatttccccgacatctggtggttttcaaaggacaatgctcagaccagtgcaccaggaagtgggccgggcgagtgatctgcagtccatcgggatgtccaggagatgctgacacaggctgagaagctcggcccccagctcccaaagcttaccacggccacctgggggaaaagctgccatgtcttagaaatattgacactggcctcattccctgaattctgatttgtcaagaggtgtggcctgaccacccggatcttttaaagctcccccggtttttaaaagctctaatagtcagcaaaatgcaaaaccacgcccccacccaacagccccatgatgtcccacgaagtcgaccgccggagccctgacaccagcatcaccctctcgtgcggtctcccaacagccctgcagagccagaaccatgatcgtccccactgcacacctcggagagctgaaagttgcacagttatttactgagtagatttgggattcaaatccaaatcctactgtgaagccggtacccccataacaccaggctgggcgggctccacgctgcctaagagcagagactctgcctcatttccccttctagtcccagcaacaagcacagagtgagacctcagcacactaaccgtggacacacctttgatcccagggccccctgaggactgcgtgatcttcagaggtgcaccctccacgcagcacaggccagacaagggaaactgcagggagcactggcaaaggacacatgtggggaagacacgagaggcaggagacggcaacatctgtgggggcacaggagagagaggacagggtgccgcggccatcacagggtgacaccggagccttggtgtggctgccctgggctggacttgctgcacacacagggccacgaggactttgggaccacacgtgctgatgtctccactgtccagaggaagacaccaaggcttgaggctgtggctccaagtgcacacagttgcacaagcacacatgcatgctgcaccacaacacccagatgagaatccagagcccccactgcctgggatgaatgggctccagaatccagagcccccactgcctgggatgaatgggctccagaatccagagcacccgcctgggacgaacaggctccagaatccagaggccccgcttgggacgaacgggctccagaatccagagccctcgcctgggacgaacgggatccagaatccagagcccctgcctgggacgaacgggctccaggggcccgcaaaaggacgtcggctctgcaccacccctacctattactctatactgagccgcaaacccatgcacgcctcagtccaaatgtcatagcttctctttctcccactaccctgagggccacacacacatgactcggagaaaggccacagcctgtgtgtcacaggatctccctaaatgtccagtggcccctgtccagccgctgtggctgcccacatcatggtgctgggccctgccgtttctccatcatagaaccaccaagaggcaaccgagaaacccaggagcatggcaacatccacagtctccaggatggggccctatctacatgctcctcctagaggggctgtgtaccgtgagcacaggagggtcatccagctacaggatgggactctatctacaagttcctgctagagggtctgtgtgccgagagcacaggagggtcatccagctacaggatgggactctatctacaagttcctgctacagtgcctgtgtgccgtcagcacaggagggtcatccagctgcaggatgggactctatctacatgctcctcctagaggggctgtgtgccgtgagcacaggagggtcatccagctgcaggatgggactctatctacaagttcctgctacagtgcctgtgtgccgtcagcacaggagggtcatccagctgcaggatgggactctatctacatgctcctcctagaggggctgtgtgccgtgagcacaggagggtcatccagctgcaggatgggactctatctacaagttcctgctacagtgcctgtgtgccgtcagcacaggagggtcatccagctgcagaatgggactctatctacaagttcctgctacagggtctgtgtgccaagagcacaggagggtcattcaactgtaggatcggactctatctacatgttcctgctacaggggctgtgtgccatgagcacaggagggtcatccagctacaggatgggactctatctacaagttcctgctagagggtctgtgtgccaagaccacaggagggtcatccagctgcagaatgggactctatctacatgctcctcctacgggggctgtgtgccgagaccacaggagggtcatccagctccaggatgggactctatctacatgttcctgctacgggggctgtgtgccgtcagcacaggagggtcatccagctgtccggaaatgaaaactcacagtcaccaagcatacgcagtgccatctgatgagaattcatctgctctgtcctgcacggtcccatgggaaagtcaagccatggccccagctcccttcctcaaccatcgttcatgatcgagcttattctgatgttgatgcaagaaatgttccacccacctttggctggcaaagcctgcctagaaatatacaagaacagatagtagttccagtaaagcacagagtacctcaaaatagaagacattacagagagaaacgtgtgcacgctggcagctagctgaaaagtcagctgatccacataaagttggttaggaaaaatcttctagagatgcagaccatcattgcacaaactacaacatcctcaaacccaagacacactgcagagaaataacagctcttcctttctactatggaggattctgcccgacagtcatgtggcttcacttaagatcagaagtgacctggtcaagaagcatagaagaaacctcaaatttccaaattcccagtctttcatttttttcttggttctatgaacaataaaatcttacagcataaaggccgggcgcggtggctcatgcctgtaatcccagcactttgggaggccgaagggggtggatcacgaggtcaagagatcaagaccatcctggctaacacagtgaaaccccgtctctactaaaaatacaaaaaaattaaccgggcgtggtggcaggcgcctgtagtcccagctactcgggaggctgaggcaggagaatggcataaacccgggaggcagagcttgcagtgagctgagatggtgccactgcactccagcctgggcaacagagcgagactccgtctcaaaaaaaaaaaaaaatcttacagcataaaaactgaagcatacagaaaatggtgaaaaaaaatatcattctaggtgcattttcttccagtgttttccaaagcataattacgtactttttccaaagcactcaaattcattctgtagcctcggggctgtctcctgccactcccactgggtactacacgcgagcatttcccggaaccatggaaagagcctcttggccacctgctgtagaggctgactgcactgttccctgctatgcttggtcatatgggttgttttaaagtttttcaacattataaataaagctgtaacaaacgtgctttcaattatttttcacccacattttaaaaacacgtctttagtgtgggttcctacagtctgagttactgagcctaaagacactggcatatttgtgacttccaaggaaacaacccatactcaccccatggcagagaatccctgccttgctgcaggagccggcgcttgggtgaacgcctcccgtccttggatagaaccgcctgggtgcttcggttcgtacttctccttccatgctttcagaccccctgtgcttccgcccacgccctgtgctgctctgctttctaggtccacacaccagggcccctctctgggaccatcttgccccaggctttgatcccaacactcgccctatatctccaaataaaaataaattgttgggttctttctggaggagtttgggtgagcttgtttatcccaggatgtcacttctcaaaggcagtgcagatcctcatacagcgggctgatgctcctgaccacctccctcccagcaggcccataaagaccctcagacgccatgcaccggaggcccctgtggcttctactatctggcatttgtctggtgtgctggcatcatctataccacacccggcctctgtcacaccttctgctctcacatgatgcgataccgtacttgcatttgacagaaaacacacagagtcctagagatgatatgtgaaaattaaggggtgcctggtcctgtctcggccatgaaaatggtggtagagaaagagggaacacctgcctgttagctttcctgaggatgacaagtcatttactgccttaaaactaagacaaaaaggagtggttcctcaatgaattcctctcccctccttccaccctgagacgtgtcatatagctgcctcaggccctgtgtttctcacgtaaaacctgtgctgatgacaggttcattttcaaacacaggaaggatgtccagctcacagtccgcaaaactacaagctaagctgcctacgattgtgtggggatccaggaaaacagaggatgagttgaaggttgggacacagaccccttcaggcaaatccacacacagctcagttttattgaagaaaatcaataacataaattatttcaaatagcagtgcaacaacttgggggttacatttattttattcagcacgaataactggttctattcccttgtgctcattttagcagtgatgatttgaactcagatcattagtttcatgtttccccagcctggctgcacattacagtcaactgtactaaaaccataaaccccaaagccccagatgggagatgccgacttggtcagtctggtataggatctggatctgtgtacttttataagcttcctacatggttctagtcatttgggcaacaccaggtagaccaagcccctcaatatgcaagtacagaactggagggccaaaagggcaggtgagcccatcatcccctaactccatcttttctcatttctgtcccccaccccaaatcatcaccattgtcaccatcatcatcattactatcatcaccatcaccatcagcatcattactatcatcaccatcaccatcagcatctcatcatcattatcattaccatcacgaccatcattgttgtcatcatcaccatcaccatcattgtcatcaccatcatgttgtcattatcattaccaccatcatcaccatcatcattaccattaccatcaccaccatcatcaccatcattgtcatcaccatatcatcatcattgttatcaccatcctcattgtcatcatcattgttgtcaatatcaccgtcaccatcatcattgttatcaccatcattgttatcatcaacaccatcatcatcatcaccatcatcgtcatcaccatatcatcactatcttcaccatcatcatcaccatcatcatccttaccatcgccatcattgccatgccatttagtaaacaatcacttcatcatcaccgtcatcatccttaccatcgccatcattgccatgccatttaataaataatccttcatcatcaccatcatcatccttaccatcaccatcattgccatgccatttagtaagtaatcacttcatcatcaccgtcatcatccttaccatcgccatcattgccatgccatttagtaagtaatcacttcatcatcaccgtcatcatccttaccatcgccatcattgccatgccatttagtaaataatccttcatcatcaccatcatcatccttaccatcgccatcattgccatgccatttagtaaataatccttcatcaccaccgtcatcatccttaccatcgccatcattgccatgccatttagtaaataatccttcatcaccaccgtcatcatccttaccatcaccatcattgccatgccatttagtaaataatccttcatcatcaccatcatcatccttaccatcgccatcattgccatgccatttagtaaataatccttcatcatcaccatcatcatccttaccatcgccatcattgccatgccatttagtaaataatccttcatcaccaccgtcatcatccttaccatcgccatcattgccatgccatttagtaaataatccttcatcatcaccatcatcatccttaccatcgccatcattgccatgccatttagtaaataatccttcatcaccaccgtcatcatccttaccatcgccatcattgccatgccatttaataaataatccttcatcatcaccatcatcatccttaccatcgccatcattgccatgccatttagtaagtaatcacttcatcatcaccgtcatcatccataccgtcaccatcattgccatgccatttagtaaacaatcacttcatcgtcaccatcatcatccttaccatcaccatcattgccatgccatttagtaaataatccttcatcaccaccgtcatcatccttaccatcgccatcattgccatgccatttagtaaataatccttcatcatcaccatcatcatccttaccatcgccatcattggcatgccatttagtaaacaatcacttcatcatcaccatcatcatccttaccatcgctatcattgccatgccaatgagtaaatatcaccagtgccagattctgtgctacacccttatgctcattatcattgaccttcagatcaatgtattatccccattttagagataagggagttgaagttcagaaaggctaagtaattttcttaggataacacagctagttacagaggctatggtgttcttatcgcagactggagctaagctgctgagatacaagtccagattccagcaccaatcagctgtgtggctgtggacatttcctaaagcatgctgggcctcctctcctgggccttgtatgtggagatactaagagtgcccatcttgcagagtttgtgcgaagtgacactctggtggctctccagccttcaaatccagtcctatcaagatccatcatgattactcccccagagactgtcttgattctcccactggatgtctcttctttcccaccccgtgacccctttgaattcttaaaatgctttcttggttcttcattcataccacaccccttactcccttactgtatctcctgtacacatcatttatttaccactttatccctgcagtagacagaagctcatgagggcattttttcattatgataactgttttcactaacattcctgagcatctaatctatgccatctaatctttagtagatactgtactaaatattttatttgcagtatcacattaaatcttactacaaagaaggcattattgctatgcttactttagagacaagcaaactgaggcttagaaagagtcagtacttggaagcactgaaaggctcagctctcacagtccaagtaccagctgtttaaccactgcacagtttatatccttcccaagacactgccctgaatgcattgatccaggggcctccagtggatgcttgggaaaagccagctacctgccacatgtgtgctggacttgggctgggcaaaaacaaacctggtctctgatcacgtaagcctagaacccagaaagccagcagttatgggtgcagtcatgtgggctaagctactttgcctggggacccgcagtcacacgtgctgagcagctttacatactttcaggccttgaacccagatccctgcctcacgcctcacacaccccacttcctgttgcatgatgcatccatgcagtaataaaatggacatccttaaagcagataacaaaatccaactcatcattttgtaaaatttttggatgtacatttgaggcgtgcaacatgatgttggatacatacatgcatactgaggtggccactgtggtcaagagttaacacctctgcctccaccctctcctagaggcaccctctgggcaaattaccagtaaacaatccaatgttgttactacatacagtcctcacgctgtgcattaggcccctgggctcactcctcccacaaaactgcagcttcctaccctctcatccacatcttctcattcctcgccactcccaccccccaaaccataaccagctttccactctctgtttctatgtagtcaacttttttttttaagattctacatatgtgtgagatcatgcagtatctgcctttctgtgcctggcttatttcacttacttcacactatttacaacatcatgtcctccaggttcatccatgttttgaaaatgacaggatctccttttttaaggctgaatagtatccattgtgtatgtataccacaattgctctatccattcatccatcagaaacacctgtactgtctccatgccctggtgaatagtgctgcaatgagcatcagggtgcagacacctcttctgcccatttaatttcttctggatctataaccaaaagaggcgttgatggtagcactgtttttaatttcttgaggaacctacacactgtttccataaacagtgtgcaagttggccaggtgcagtggctcacgcctgtaatcccagaattttgggaggctgaggcgggtggatcacttgaggtcaggagctcaagaccagcctggccaacacggtgaaaccccatctctactaaaaatataaaaattagctaggcatggtggcacatgtctgtaatcccagctactcgggaggctgaggcaggagaatcacttgaacccaggaggcagaggttgcagtgagctgagatcgtgccactgtaggacagagcgagactgtctcaaacaaagcatccaagtgtcccttttctctacacacttgccaacacttgttatcttctgtctttttgataaaagccattctcacaggtgtgagagggtaagtcactggggctctgatgtgcgtttccaatgattagtgatgctcagcacctttcccatacctgtcagccatctgtatgtcctctttggaaaaatgttctattcaggttctttgccctttttaaaattggagggtttgggggttttttggcttttgggttttttttgtgtgttgtttgtttgtttgttttgctattgagttgagtgagttccttatatattttagatattaacaccttatagatctatggtttttcaacattttctcccgccctgtaggctgccttttcattttgatggtttcctttaccgcacggcagcttttcagtttgatatagtcccactcatttattttgcttttgttgcctgtgtttttgggtcttgtccaaaacttcttgccgagaccaatgtcaaggagctcttcctgtatgttttcagagttttacagtttcagatcttgtgtttgggtctttaaccaattttgggcagatttttgagaacggtgtaaggtaaggtcccatttcattcttttgagtgtggatgtccagtttccccgaaaccatttaaagagacggctcttaccccagagtctgcttcacacctagttgaccatatatggtcaggtttatttctgggctctttgttctgttcccatctcatccttttacatggcgtgtgtttaagtcactggccaaaacttgggtaattctgctgccaaagacctgggagcccccggggaaggccctgttgatgtttctgttgctgttgcgtttgttacactgtggcaagctgttcaaattcttgctttcaccgccacccatttaccctgtgctactttacagtagctagtctaggatgcaactggaattgtggggctcaagtgaaacaatgtgcataaaatctcccgtaaattataactcacactgcatgtataagcaaaaattgtggcatttttacagtcttcctacatcttcagctaatagccttaataacaaaacacagaatattgtcactcaattagactagggttatttacctaagacaattttgcattgcaatttgcaaattcttaaatggcaaattagtcatttgcattgatttgcatgtccacagagaaatatctttcatgctaattatgtttttgctaacaaaccatagaagtaataatgaggaaactgaattccctcaccgcacctttggctttgttacacaaagcacagctggcgtttcagggtgggagggtttcatcaggatcgtcttgcccagagatcctcaactctgatagcacattacagtcacctcgggaagcttcagagaaaaagaaaggacggcaaagcctgggtcccgcccccaccccgcccctcgccgccctcagctgacattctgattcactggcgccagtttatgtctgggcatcactatttttcaaagcttccaggtgtttccaggtgttaccaccggcatggctgacccccttgttttgcacgtaagaaatccaacgtgcacagagctgtggcttgaatagagaggggtgcgcagggtggtggcagggcaagacaagcccaagcttcctgactgatgcccagtcccctatgcttgtcccacaaagatcgagactctattgtgcatacaggcatgcacaccccccacccacacacactcccggtggagcaacagcgtgcacacccacgcacactcccgatcaacaatgtgcacacccacacactcccaatcgatcaagagtatgcacacccacacacactcctggtcaatcaacagtgtgcacacccaggcacactcctggtggatcaacagtaggcacacccacacacactccgggtggatcaacactatgcacacccatgcacactcccggtggatcaacactatgcacacccacacacactccgggtggatcaacactatgcacacccacacacactcctggtggatcaacactatgcacacccatgcacactcctggtggatcaacagtgtcaggctttcagactgaggaaaggaaaacactgtttttggctgtgcacagtggctcacacctgtaaccccagcacttagggaggccaaggcaggtggatcatttgaggtcaggagtttgagaccagcctggccaacatggtgaaatcctgtctctactaaaatacaaaaatgagccagtggtggtggcaggcacttgtaatcccagctactcaggaagctgagggagcagaatcgtttgaaccccaggagggggaggttgcagtgagccaagatagcaccactgcactccagcctgggcaacagagggagaccatctcccctgtctcaacaacaacaacaacaacactagtccacaatgaacacaccaaaaaaatgtgtaaagtgtgggtctagttcttttgcatctttttaaagaaagaagaagcaaaatcccaattgttgagtcatcttcccctgtggtcagcagcttgcccagctccaccgagcactcgctcgagagcgtttctgttccttgaaaacaaatgagaacgacaacagcaagatgctcctcaatcattaaaaacaccaaagagcatctgttcgtgccccagcaagtgagagagaaaacctggccaaaaaaaaaaaaaaaaaaatgcaaagaattgggagctgggatttgttctagtgccatcataaaagaattgggagctgggatctgtcctattgcatcacaatgggctgtcgccataacaggagctgggatttgtcctagtgcatcataaaagaattgggagctgggatttgtcctattgcatcataacgggctgttgccataacaggagctgggatttgtcctagtgcatcataaaagaattgggagctggaatttgtcctagtgcctcataaaagaattgggagctgggatttgtcctagtgcctcataaaagaattgggagctgggatctgtcctagtgcatcacaacgggctgccatcataacagggcctgacatggtggaaaatcgtcaagtagaaataaaagaatctcatttggacatagtttataagcaaatatggttatagcattttatttcaacaactggggaaaaaaacataaaatttattctgttttgcagaaaaactaaggccgaccaataggatttgactgttagagagacaacaatacattttcctagtgacttgtgggataaaccgcttgttgcttgtttttattttttacatttctgcatctttccagaatctcaagtaccctggatttgacggaacttctcccggtgggtgctcaacacagcgctgccttctcctctaagagctcagctcctgaaaaggttcacgcgaggatgctcacagcagccaaatgctgggaacaacctgtgtgggtacaagcaagacgtggtgtgtccctcgacggagcacgactcagcgacaacaggagcaaagggtgggggtaggaaggtagcgttgcgtcaccccgaccggctgctcagtcagttcccaatctagctccttgttgtaccctttccgccttctctctactgcacttgaccagtcttcaaaaaattaaaaaggaacaaatgtatacagtgggaggtgaggcaagagggggtcggagcattcaccgaggtggagaacaggctcagtacatcttcccgctcatgttacagtgaaatgcgtgaccttaggtgtgtgtttccgtgagattttatagatcacatggattttttttttttttagatgaggtcttgctctgtcacccaggctggagtgcggtggtgagatctcagctcactgcaaactctgcctccaaggttcaagcgattctcctgcctcaacctcccaagtagctgggattacgtgcgtgcaccaccatgcccgactaattctgtatttttatatttttagtggagacagggtttcaccatatttttagtggagacggggtttcaccatgtcaaaggttttttttgttttgttttcataaattgcactcctgtccaacctcacagtgctcttttaattggtgagaagctgagcaaagcttcctcctctctgaaggacaataggaaaaggccagcacgagaggccagcacaagagggtggggctcttctttggaggcaaagccagcctctcctgagccagctcccctcccgcctccccctcctatggaccacgcccactggacttaccaagggatcttcaacagggtctcacccacacacagcactgctggtctccagtctctgggatttcttctaattctgaggacaagtttaaaaccttactaatggctgggcgcagtggctcacacctgtaatcccagcactttgggaggccgacgcgggtggatcacaaggtcaggagatcgagaccaacctggccaacatggtgaaaccctgtctctactaaaaatacaaaaattagctgggtgtggtggcaggtgcctgtagtcccagctactagggaggctgaggcaggagaatcgcttgaacccgggagtcagaagttgtggcgagctgagattgcgccactgcactccagcctgggggacagagcgagactccgtctcaaaaaaacaaaaacaaacaaacaaaaaaaaaaccttactaacaaaattgatttcaagctaaatgaataaagaaaaggaaaactctctacaaatcatttctctgatttctgaattgaaaagcaaccaagaagactctgacaattggcgggcgccccggccccagggcccctctcaggctgggtgcgtgtctgttgcccgttctgtcggctgagaccactgtcagggcaaagagaagacatgggacagccaggaaatgtggcccacctgactccaatcatgcttccggccccgccacggttccggccccgccacggttccggcctcgccacggttcctgccccaccacggttccattcccaccacggttcctgcaggcatttcatgtaatgcaattattcttccctgcaacattcatctgaccaatacgtgaccatttcctctcttttgccagcatcatagagagttcacaagagacaaatcaaagtcaccgtgggtcccagtagcaaatctagaacctgcatcttaaggcaaagaacgatgaaccaccataaattccgtgggcctttgagaagccgaagggtgagctgattggaggaaggatgggaagacgcccgatcagtgtggttccagatcagattctgcctgtgtgtcacccacatttaacactaagggaccaagtttgtcatctgttaaatgagaacaaaaatacatgccctgttattgtcagtgacggtgcagaaatctaacacgataacatataaaacactcagaaaggcattaacccccatgcagtgcactattattactttacgccatttcagtcacaagagcaggtgctgggtgttattccagctcaagaatatctcaaagcacccaggcctggaatagagagagcaggttccaaagcagccccaggctaagctttgcacacagactcagaccatgaacatcacccatcagttagagggaaatcactcacccttcaatgcactcttaacacagaccccacctctatggaaactgcctcaaaagacagagcagaccaacgtcccaagaatgattagacggcgcctctaaaataacaaggccgttgcatgcaagggcccgagagctggccgtccacatttcctcccaactccaccttcagtgacactgcgtcagtaactgggaggcagcagtggcggcggggcgggggccttacactagagaacccggctgcaaatcaggtcccaaatgctgcaaatgctggtggttaagcatttgcccacactgcactgctgagccactgagattaggcctgaaattagttatgggttttacccacgcaccgaaagacatgtgtttgttgtatgcataatctttagaatccacgtttggttcgatatttctgctttaatgataaaaggttttgtgcttttcaaaatggtatggccacgcacagacattatccctccaaactcctggtcgtggctgaacctcagcagcttcacggtccccaagatcaatttcctatctcctccaatcctgttagcaaatgaaccaaaattaaatcaggatttggcagatttctctaaacactgcagccactcagagtcctgctaaggagaaagagcagctgtaaacatatgtgagaacccttgaagctcttcctgccataagcacacttccgttctctgaataaacccctctgacgagctgtttcgggaggctacatccacgcccaggacagccgggagggcaagctgcagcctctgcacggcctctgctgtgtctgtgcaccctgattgagaagcctgcgtatcagagacctccaagtgccggctcgcctctccctcgtccataatttagtgacaatctccatggcaactagactccaagaaaagagaaggaaaggtttcccggctctctgagcagcgggtgcttcgtaaactgcaaaaacacattccccaaacatggtgtcccaaggacactgtcagcctcagaaaatctagagtgatctgaaatgagctcattcaaacttgacctcagctttgaaaaccacacagccatccaactgtctaacagtcaaccatgatagattggggggaaaaaaacattttaaacattaatttttaaaaaaaggttggctataaatagcttaaaaaccaaatgttttaagtatttaaaagaaaataaattgggaagcgaaaactactccagtataaatctcagatattaacattccttggggctgatatctaatttacttaatgtctttcacacaggcccatgacaacccttcatggtaaaagcaaaaaaaaaatccctttctcctacgtcagtgacatttctaggtagacatcaagatctcgcgcttaggagaccaaaagcaaaagcaggctataagcaaatgaggtcagccctggcgctgggcgggtgcagcactggcccagcccccgtgcggccccactgtgtcccctcacagctggtcatcagccacagctaagccaggccaacccaagaggcacagcgaactctacaggactccacattcaaaacttgctccttcatcaaaaagcggagtaaaccgggagattcagccatgggaaggccttggaccccaggacctctggaaaacactgcgtgtaactggcaccccgagtcaacttttccctgagaaatgctcaaccccatttagtttttggacatgcctctggaaatatgaaaatgagtttcatctactaaacaattccttatcctctcaaatctctgaaatttaagggtttagaaagttaatttgataaatgggaaagtcaacccagcagataaaagggaaaacggtctttcaagagcatcttagtaaatgctgcaggttgcacagagcatgcccatgtgcccgcccaaactacgggccacctccaccagagtcaaccgcccagcagaatgtgggcacccctcctccgagagggaccctcttcccaaggtcagctaagaggcgggtgcccgtctgagagggacccttttcccaaggtcagctaagaggcgggtgcccatctgagagggaccctcttcccaaggtcggctaagaggcgggtgaccgtctgaccactgagggagtcgggagtggggctgcccatggctttggggaagcactcgctgttcagcgggagagaagtcaaagagagaggccgggtgatgccacggggtgccctgtgggactgtgcacactgcgttctgcagacatgggcatcctggacagctgaaaacagggcaatgatgcaaactggcatttgcgcctcctggtgccccacggagacaggccctgaggagcctggtggtcctcgttcagctccagggcagatgctggcgagggaggaaggtgatcataagaaccccggctgcagcacagtctccaaccttctcatgcagaagagctgggggtgcttgggaggcaccagtttccctgacgccacggtggcaggcgggagggctcaggacccgaaaagcaacaagctcccagaggagcagcctgtggatgccaccaacgagcacagttctggggaggccccgaagggccccgaggactccccggcttcccctgtctagggaggccccgaagggccctgaggactccccagctccccctgtctggggccagatgctgctcttcctcctgcgagtgggaacagcttcagcacctgttctagttcccttgattcaggcacccccggccactctcccagcgagaccatgaagatgaggatgctggagaaaggtgaccttgtgcacgcttcgcccctgcttaacaagccagccgtgcaccagggacaatcaccaaggacgggcccactcagcagaggaacccccagcaaaacaccctcgggagggcacgcccgcctccacccccagctgacacccacaccccagccgggcactccaataccttctcggggtttttaggacatgcccctgctgggctcactctccagcttccttgaatcctacctcccctctcaggcctgtggggtcaagcagctattctaactactgtgaaattgaacttccaagccaaggcacacacacacctggagaccgtcttggttaacgggtaatttattctcttagtggggattccagtccagtctacataagcatcattaaggcagtctcacggggaagaagtttgggagtcagatattagaacttcattgtgcagaaacacaaaacccagagttctttccttaaagtcctgacttgagggaagacttgaaaatccagggctgcacatctgggctcggaaacctgcatatcatacttactacgatttgtgttcctcccgccatttgtttgttggtttgtttttgagacagagtctggctctgttgcccaggctggagtgcaaaggcttaatcactgcaacctcctcttcctgggctcaagtgatcctcccacctcagcctcccgagtagctgagaccacaggcacatgccaccacacctggctgatttttgtactttttgtagagaaggggtttcaccatgttgccaggctggtcttgaactcctgagctcaagcaattcgcctgccttggcctcccacagtgctgggattacaggcgtgagccactgcacccagtcccactgttaatttagaaccagacacatcgtttctccactatttatgactttagttacaaagccacaccagatagcaccaaattcaaatcatatcaatgacgccgatgcgcacagctgtcccaacacaagacagcagggccatccgttgccagcacatgaatgactgtaagtcaccaacaactgccagccaaggacgcacgaaggatcagcctgtgtctccgtgaaaattcacagcacagacgccgctcgggagggagaggagagagaggggccccagcaggcaccctcaccctgtctgtgccgccaaggggcctgagagtgtgaccctgacaccgagtcaatctgcttctccgcctgaggctgccaggcagcctggaggctggaaaaaaaatgtaaaacatgttcctctaaaacgagggcgtccttagcggggatgctataaatacgcccaagtaagaagagacgcgagaacgtcaatctggttctgttcctcccgcttctccttcctcccagcaaacttctgaggagagaaaagtctggaaagtttgaggagcgaaccgcatcttcagagccattgggtggggtcacatgcatacatctgagctcacatgtgtgtgagacccaaactgagctgaactgattttaactcacctcaagtcactaatctgaagtctcaatatcacgtcactttttctgttaatacaccaaataaggctgagcttcacatagttcaattcagtcattcgtttccatctccttttaggttttattcattggaatttgggagtgcaatgagactgccagtcacacggagtgatgcggtctcgtgtctcacagctgtgggtcttcccgttgcctcagcccctctgagaggatgaaggggcggggccctgcccacaaggtggctgggacatcttagatggtccggttcattactaaccaataatgcaaagatggttagaccatttcagggccctggctgctagattttcttcattaagcacatatcatgcagtcctgtctgacattttaacacgcacagaaaacagggcacacagcaaacaggaaatgtctgttacctccgagtgggagtgagatttggtgaagggacacaaaaggaatttttactttttattctagatagttccaaactgttcattttgaatatatccatatacgtataattcattttttaattgattttaattgacacacctgaaagagaaaagtgggtaatactgtaatggccaacatcttcccttttcataaaatcagactttgctgccatcatccactattaaaataataccgaagtgggtcaagagaggcaaccgagaatttgattttaaagaatgtgctgaattttctattaaagcaaaaaactctttgacaccccaatagtgtatgcttcctgtaagttcaagaaatccatgtctatttccaaggcagcatcacccacccctcaccccaggttttcagcctggcctgggatgtggataggccccctgctgcctttctggaaaaagcaactgaaagctcagccaagccacggccaggttgctcttttcagcccccatggggaccaagctgccccaacaggcaggaagcacaggcggtgtccacaactctgcctccacacatccacccttggccaggaaagagggaggcacctgaagacagagaaggggagagagcgctggtcagcggagcagggacaggaccgagagcctgtggggcaggaaaccgagtgggaagagccaaggggtggtaggcaggccatgctgcagagtcaccacggagcgtgggacaggcacggcggcaaagagagtgggctgagtgggtcatcacacagcacgggagccgcggccccaggtgctgcttgaatgaagaaggctcagcccatgactgctacgtctggtccccaggacccaaactgtccagaaatcagccagcactcctgcaggtgcactgcagtggacggctagaggagggaaagcagcgccgtacagacactcggaaaactgcagactggaaggggcgtgaaagcacaaggtcttgatcattctcctggcattcggtgctgtgcgtagggtgagcaatggacgccactggggaagagtgggaaaggaaggctcagcacgtcggtaacgaatgaggaggcagaggcccgctctgcgtctcaaagaacgggtgggatgcggagccgtgacaagggcatgggaaagaaagtggagtgggaataacgccaaaattaacctgataaggaagctgctttcaacgcatccctgagctggacccacatggagaaggaccacacaccccaaggctgcccttcagttttgacttgattctgtgggaaagagggagccactgaaggtttcatatcaggatgactgtggggggcagacgagaaacacaacttataaaagtgggctctgacttgtgtacacgccgtacagagatgtaattcagtggctgtttaattagcaacttgtgtggcagacacgttcatattctcaatgacaaggagctcctacacagtccaagaaaaagacaaaactcagtgggaatggggcaaagatgggagcagtaacttacagaagcagaggtgaaagtggccccacaggacatgaaaacacgtgtcaccgcgacagtcactggggaaacacacatctaacaatacccacattgttgggggcagtggctcccgtgtttctcagctgtggacatgccacaggacaggacccacgagtgagtgtttcgggggcagaagaggtaaagaacagaggccggagatgcagacagaccgaggtgcaaagtggctgcctgagagctgcggcctagaacaagtcaccgaactcttctgaattccaatttcctcaccctaaggctgtgaatggggctcatgttactcaatgtgagtggggcggcgtggcacaggaggtactcagcctggactttctgtgagcgctcaatacaaaacagcctggacgttgctgcaagcggcctggagctcccgaatggtgacccactcgccgacagcctccctccctctctcctccgctcttctttcctgactaaagccttcttgaagtctggaggaagcagagtgaacgcttccgttggatgagctcagaactttttttcctctccattttcatgattagcaatcacaggctgcgtctgccagctcctgctgtgatctgggggacacccagagtgcagcagcaactctgagacgcagagctgttctgttttatggaactggcaaaaaatagaataataacttttgacacctgggaggctgcggaaaagcacaatgggtttgaaaaacagatgaggtagcaactgagagatctacgctctgtgaatcacaaaccactcagagagcctggaaatgctgaggccacatggcggagagaccaggtcctggctgctgcctgtgggggtgggcagaatgagccttgcattcccggaccctccagtgcccgaaggctgattctcggagagctcacagggtactacggggtggcgggcgcaagccagctctgcggcgcagtgggcgtcatcctcgctgctgtgggagcgggggctcctgctctggagatcgactgctgtttgggtaatgacagcagcaccatgcaacaactgagccactggttctctacttggcaggaatttcccaattgggattctagattccaagaaggtagggtctggcaactgtttctgcagcacaaattgaattcactgcttgatcaaacctaaataaagagtctgaggagcacgaccttcctaggagcacgttccagctttgttccacgtcgcgggggttgcgtctcaccctgaagccttgtggcaaccctatggaggagtccatcggcaccattttcccagcagcacgtgctcatcgcctgtctctgtgctaccttttggtaatttccacagtgttggatccctgagctgtgatccgtgatctttggtgttactgtcattgttttggggcaccatgaaccgtgcccatagaagacagtgagcataactgatcaatgctgtgtgtgttctgactgcgtaactgaccagccattctcccatctcgctccctctcctccagcctccctattccctgagacacaacaatattgaaattaggctaattagcaaccctacagtggcctctaagtgttcatgtgaaagaaagagccgcacctctctcactttaaatcagaagctagaaatgattaaacttagtgaggaagccatgccgaaagccaagaataggccaaaaatgaggcctctcgtgtaaaacagttagccaagttgtgaatgtaaaggaaaagttcttggagaaaattaaaagtgctactccagaaaacgagaaagtgaaacagccttactgctcatattgagaaagtctgagtggtctggatagaccaagccagccacaatattcccttaagccagagcctaatccagagcaaggccctcactcttcaattccatgaaggctgagagaagtgaggaagctgcagaagaaaactctgaagctcgcagaggttggttcatgaggttgaaggaaaggagtcatctccataacataacagtgtaaggtgcagcagcaagtgctgatggagaagctgcagcaagctctccagaagatctggctgagatcagtgacgaaggtggctgctctaacaacagattttcaatgtagatgaaacagccttacattgaagaagatgccatctaggacttccatagctagagagaagacagcgcctgacttcaaagcttcaaagcacaggctggctctcttgtgaggagctgatgcagctgaggactttaagtcaaagccaatgcttgttcatccgagggcccttaagaatcatgctaaatctatggctgcctgtgctctgtcactggaacaaagctggatgacagcacatctgtttacagcatggtttactgaatattttaagcccactattgagacctactgctcaaaaaagattcctttcaaaatatggctgctcatcagcagtgcaccagtcacccaagagctgtgatgcagctgtacaaggaggtgggtgttgtttccatgcctgctgacacctcgtccattctgcagcccagggatcaaaaaataatttccatttcaagacatatatacaaatattttgaggtagagtcttgctctgtcgcccaagctggagtgcagtggtgcgatctcggctcactacaacctccgcctcccaggttcaagcaattccttgcctcagcctcccgcatagctgggattacaggcacatgccaccatgcccggctaatttttgtatttttagtagagacagggtttcaccatcttggccaggctggtcttgaactcctgaccttgtgatccacctgcgtcggcctcccaaagtgctgggattacagacatgagccactgcacccagccaagacttatattttagaaacacactttgtaagatgacagctgccatagatagtgattcctctgactgatctgggtaaagtaaattgaaaacctcctggaaaaaattcaccgttctagatgccattgagaacacttgcgattcatggagggaggtcaaaatagcaacattcacaggagtttggaagaggctgagtccaaccctcatgcatgactttcagggattcaggacttcagtagaggaaggaactgcagatgtggtgggaacagcaagggaaccagcattagcagagctgcctgaagatgtgaccaaattgccacaatctcatgataaaactttaacaggtgaggagttgcttcctagggacgagcaaagaaagtggtttctggagatggaatctactcctggtgaagatgctgtgagcattgtgaaaatcagaacaaaggattcagaatatcacatcaacttatttgataaggcagtggcaggggttgaaaggattgactcttaattttgaaaaatgttctactgcgggtaaaatgctaccaaacagcattgcgttctgcaaagaaatctttcatgaaggaagagtcaactgatgcagtcaattttatttgtcttattttaagaaattaacacagttgccccaagcttcaagcaaccacggccctgatcaatcagcagccattaacactgcggcaagaccctccacccgcaggaagattacaacttgctgaaagctcaggtgatcattagcatttttagcaaaaacatttttaatgaaggcctgtacattgttttttagacatagtgctattacacacttaatagaccacagcctagtaaaatgtaacttttatatgcactggaaaactagaaaatctgtgtgactcactttatcgtcatatttgctttattgcagtgccctggaattgaacccacaatatctccgaggtctgcctgtagatgctaaatcagtggttttttttatattcacaaatgagcccattcactagtttttcttgggcaatttctgaagcacacttttgggaattgatatgcaatgtttatatagactggattcagaacacgctacctcaaaatatggcagggtggccctcgagaaaacggcagaagcagaccacagaaaccagaattcccccagccccttctcctcggaggcaggtcataagaccctcattccagaggggcctccctatgcccagaggggaatgtccttatctccgaagacacagaagcagctagaagactccagacaggccttgctgagcccttcagcctatgacatcagagcacgccctttgccctccgatcacacttctgcacaactgtccataaaaacaggcttccctgtttcctgggtcttcatttctgaaggctcccatgtgacatagaaaaccggtattaaataagtgggtagggttttctcttattaatctgtcttttgttacaagtctcagccatgaacctggagaggggtgagaaattactttttccccactatggtatataaatcttttatttgagggctatgggggtgtctcttgtgccatgaaagcatgattcatttattcttgtatccactcactcaataaataatttcccactgatagcctttgctgcttgctgtggccgaaaatccaaatagggttaatcacatagcttcaaagaattagggagacactctggatttgaatattctaaagtcttccactttggggacaacgctagtgcttttagtacctaagttgcaatgggaggtgattgtttgctggaaaaactcccaaatctgagagggacaagcttattgttctgctttgtgcccagatggtggagccagcattttcaaccatcttgttttgtgttgggttgaatgtcctgggagggagcccatctgtctggggtcagggaagtaaccccttattaaagaaatgcaattctctggctatatccttcactatgcttacctccttgcctaactgtatcctcagttcttttttctttcttttaaaaaacagctttattgaaacataattcatataccacataactcagccttttaaagtataggagttggccgggcgcaatggctcatgcctgtaatcccagcacttcgggaggtcaaggtgggaggaccacttgaggtcacgagttcaagactagcctgggaaacatagtgagactccatcactgcaaaaaaaaaattttttttaaatagccaggcatgatggtgtgtgcttgtagtcccagctactagggaggctgaggtgagaggattacttgagactaggagttcaaggctgcgttaggctaggattgcaccactgcacgccaaccttggcgacagaacaagtgcttgtcttaaaaaaaacaaaaaactgtaagagtcaacggttttctgaatgttcagagttccgtgaccacctcaccgtccacctcagagcctctcagtaccaccaaagggaacctgcccctctgccatcacttcccatgcccccaacactttccccagccctacacggccacaacctactttctgtctctaccgacttacctctcctggacttatttacttatttatttacttatttatttatttagagacagagtctcactctgttgctcagactggagtgcaatggtgtgaactcggctcaccgtaacctccacctcccaggttcaagcgattctcctgcctcagcctccagagtagctgggatcacaggcacgcgccaccacgcccagctaatttttgtatttttagtggagacggggtttcaccatgttggccaggctggccgtgaactcctgatctcaagtgatctgcccgcctcggcctcctgaagtgctgggattacagggtgagcctccgccctggcctcctggacattttgtataaatgaaatcatgtcccccgtgacttttgtgactcggtttcttcctctgagcacggcgattcccaggttcctccgcgtcagtgtgccggtgcttcctgcctccctttccacggccggacagcactccaccatcacagacgtcctcggttcctggtggttttctgccctcttcagtggagaaagggcttggaatagaagaagctgcagttggagacgtgaaggctgtggctgtgacgccgccacggggagtcggctgcaggaggagcctccccaccatcagcgtggccggcggagtgagccacgagcgcaagggcacccctcccagccgctgttgctgtggccccggccgccagcgtcccgggagggcacctgcggagggaaggcagacaccctgcaacggcccgcaggcccgtgtcacctgggccaccgagcgcagggcttgtgggtcgtcacagcataattcagccttgagccacgagacacggagccgacaggtgtgtagctgagccatcctcccccacctgtcagtcaccattcttccacctccctccaaacggagagcgcgacttgctcctcttgccctcctggacgtccgggatttccgcccctgggctccagcgctatggtgtggtcgtcctgacgcactcttagaagctcggccacccctctgcgcccctcctgctcggccacccctctctgcgcccctcctgctcggccacccctctctgcgcccctcctgctcggccacccctctgcgcctctcctgctcggccacccctctctgcgcccctcctgctcggccacccctctctgcgcccctcctgctcggccacccctctctgcgcccctcctgctcggccacccctctctgcgcccctcctgctcggccacccctctctgcgcccctcctgctcggccacccctctctgcgccccgcctgctcggccacccctctctgcacccctcctgcacaggcctctcctcctttctgagctcaaagggaatggtggttccttcatgtgcctccttcccacctctcttgtccttttagcaggaacatgctcacgtgaaaaactggaaaaccagagaaatatgaagaaaataaaagtcactacccagagagagccactattcacagtgtggtgtatttctttgagctttttctgctatccacattttcgcacggctgtcatcgtattagatgctcagttttggatcctgagtttttcatttactttctcccacctgcattttccgacgttattaacaactttttgaacacttctcttttaatgtctgcttaacatttgaatcatgtgaccataacatagctttaaagaagcattctcctttgtttaatattaatgatttgtctactgttttaaaattaatacaaacaccactgcagagagcagctttgtgcttcaagttttctttagtattttgggtaatggattattttattggggcatattctcacacatcagattgccgggtcacgggccacctcccttatgtggcgtgaacgtgctggccagtcagcgtccatcacgatcacgtcaggccatgctcccaccagcagggcgtgaaagcgaccagctcacttcccgacataagcgtgatctattttaatcttcatagatttgttttccttttttctattgtggagtagttgattattatgcctttagaatgtttaggacataccacctgtgtttggatgtgtcccatttaaagttatcaaccatgaaatcaaatccgctttaaaaattctttgaaacctgttttcctcatatttaggatgcccatgtaacagcatctaaactctcttttctacaagctgttccaggattatgtgattgctttatcttaagctttctcttccagaacccttacagttttttctataataaccaaagttactccagagttatgaattaccaaggaattgacccccagggtcactttaaagtttccaatcacgacttcctcctgagggagctggcctaaaacccttacagctgaagcattcgattacgttaaatgagcatgtgcagaggctgcagtttcatagttccaattgcatattgtggtaaaatatacgtcacattaaaatttaccatcttagccattcttaagtgtacagttcggtggtgttaattacattcacactgttgatcagtcatcaccaccgtctattcccagaactcttccatcgtcccaaactgaaactccaccaattaaacactgacaccccaactgtcccccagcccctggccccatcactctaccttctgtctctatgaacttgactatctttagtacgtcacatgcgtggaatcattcagtatttgtccttttgtgactggcttatttcactcagcataacagcctcaagctccccccatgtttcagcgagtgtcagcactcacttcctcttcaaggctgcgtactattccatcatgtggatggaccacgtttcacttgtccattcgcccatcagtggacactgggctgctttcgcctttggctgttgtgcattaactgctatgaatatgggtgtgcaaacagctcttcaagtctctgcttcctgtgttatggggtacgtacccagaagtggggttgctgaggcaaattaaaaactctatttttaattttttaggaaaccaccatactgtttccctcagcaacgacgccattttacattcccatcagcagcgcacaagtgttcaatttctccacattctcaccaacaccgattttcaggggttttttaatactagccatcctaatgggtgtgaggtggtatgtttatcttttgactttctttttattaataacctctgttgggcttttaaaaaacatatccaagcttgataagattatatattcctacacgtaccttaagaaaagagagggggaaagagagagagtgagccagagggagagaaagagaccctgcggctggtgacagaatgttctagactcgcagccgccccccaccgcaccctgggctgccgcacccctggcccgccagcctcgggctaaaccagtcaccatggcaaccataaatctgagccagcacaggaaccacttctcctatcgctccccgtcagcctcgcaaagcgcagttttctaagactgggcaccactggcttcgctgtttcctagaccttcagtgcatcataaaaaaaaaaaatcaaatatcatctgtttctacaaatcaaggcctgaatatgtgtatttacatttaaattgcttttcctttccaaggaatccacagtcattatctggatatgatgttgagacgactctatgtctgggaggcaagtcaaggttgaggagaaaaatgtctgagaatgatcacagtcggacacccaggccggcctttgtcaaggagccggggagacagcctcggcttttattctgctggggctacttacggctccaattaaattaaacacacacacctgcttccattatcatcaaaagctgttgagtccaggcagacgacgtaggattttcaatatcgctatttttcttaaggctgcctccaaattaaagctgcacggagtagatgccagggagccccagggggtcctaggctgggccagaacctcacccaccacccacactgcaccccacgagctgccggttcccacttgtcacactcggcacaggaatctcccgaaagaagagaaaacagcagaagctgccgccgctgaggacctgctctcctcttggcgcctccaccgtggcttcccttcccgaccccagaagctgcctaggcacagacacagaggtgcccccagccccaaaattccatccggaacccagggctggtcccacctcagggcgcacgagctcctcggtttcgcttctcagaccctcagaggcattcacctcggctccccctggatgcaccagtgcaggggaggcctgtcctgaaaggccccaggagggcggcaccccaggccagcgccctgccctgcacctcagtcccccgccggcacccacgtctgtgcagagattagtgggtgcgaggggcctctgggcaggccccgccatcctcgctaggattaaatccgctcctgcccacagtctgaggacagatgcgcagggagctggggaaagagaaggcctcgctcagtgcgccccgggcccacacgcagcccctgacttggagaaaggcggctccgcccagcgcttttctgaggatactggagtttaaccctcccctgcgcgttcagagcgcacagcgcccagttcaccagcatgacaggcccgggtggcgtctgccctgggagatgccctctgcctgaccgcgctggagggaaggggctctgcaggacccgctgctcgccgtatttcataataactgccgtcctcatgggctttcagcccaacctgaaaacacagcgtttgcactgttttcttatccgcctgataagagaggaaaatcagtggcttaaaggacgaaaaacctggccgggcgcggtgactcacgcctgtaatcccagcagtttgggaggccgaggcgggtggatcacctgaagtcaggagttcgagaccagcctggccaacatggtgaaaccctgtctctactaaaaatacaaaaaattagccgggtgcagtggcgcacgcctgtaatcccagctactcaggaggctgaggcaggagaatcgcttgagcccaggaggcgaaggttgcagtgagaggagatagccccgctgccctccagcctgggcgacagagcgagactctgtctcaaaaaaattttttaaaaaaggatgaaaaacttgccgaaggacagagcaaaacaaaatcagaaagcaagggttggtgcgagcgatgggcgcccagaacccgggcaacctcttctccccacccaccgaggccgcagcccatggctccggggttccatccgcctcctctcggcagcgcgccccgggcggccccagctccaggccagcggcggggctcaccaggctgggcgctgcgcacggcgggcaggagaggggcagaccagggcgcagcagccaggaccccacactcaccgttcacacaggcctcggacgctccgcagaggccctcctcgagcaggcagcctgcggggaaacagagaagagacgcggtcagctggaggggaggaggggggtgcccccgaggctgccttcctggccccctggtgaatttcagagaaaccgccggtcaagcaggctcctccgacccggcttttccgagatggggccgattattctgaagccagaacgctgcgcccctgacccggccacgtgcgaggcctcctggcctagtcccggagcccagctctcacctggaccaggcccacagctctgggctgagggtcaagccggcgtcatcacaggagactctctggccgcgggagcagcagcggggccggggcctccccttgaggcctcccctgggcccggcgcctcccctggaccgggtgctcaccgcacgcaccgcgtccctggaagcaaggctgccgggcgccggggagcggaggcttccagggaggtaacgagctccgcggggagcccggctgcgtgggaagcaaaccgtggcgtccgtggccacagacaagagacgcaggagagggtcgggagaggaaaggaggcagcggaggcagcagagacgaagacgggcaggaaaggccagcgcggctgggccaggccctggaggagacgcggggcagaggcagcgcctcagtccccacccaggaaggggctccagaagctccgcggtgcctgggtggccaggcgaccccaagccacgcatcccccgcggccgagcaggctggcaaaggttggcgttcggctccacgtccacgcctgtcttaaacacagagagatgggtccagaaagcaccaccccgctagggagcggctcccgcgagggcgtgagcaccctggacaccagaaccgggagggccccagggccactaggcgggagtcgcaccgccagcaaaggccaggtgtggtgtgaacgcgcagtgtctttcactcattcctgcaaagcacagtgccttcaatgctgcttcaccagccgacaaacgcctgttcatccgctaagatccctgtggaagccccagactctcccggggctgcccaggcgtccttttcgggactcgccacactgtgcagtgactgtggattgagtgtgtatttccctctcctggagttcaggagccgggcacacgcctgtttccaccctctactgtttcctcccatgccctctgtgtgtctggcacagggcaggtgcccaggagcaaatgggtgaacaaagaaactgaggaatctggagaaagttatgaattactgagggattcacccccagggtcacgttaaagtttccagtcactacttcctcatgagggagctggcctaaaacccttacagaggaagcccttggttgccttaaaccagcacgtgcggaggctttaaaactaaacgtcattccagacctaaggcagcacagagcctagcaggacccaacgctgggagttcacaggaggaggcagcctcgctcgtctcacaacagcttcacgagccttccacagttgcagggcggcccctggctgggatctgcttcctcccaggaggtggcctaggtgcagccctggcctgcccagccagtgcctgcccagcccagtgcccaccaccatcgcctgccagcagtcacaggcgggtggacaccccacccattgacgggagcctccaatccaagcagagattgtttttggtttgggggagtttttgtttgttttgttttgaaataacaatctcatgaaaaacagatttttttttttgatggagtcttgctcttatcacccaggctggagtgcaatggagtgatcttggctcactgcgacctctgcctcccaggttcaagcaatccccctgcctcagcctcccaagtggctgggactacaggcgtgcgccagcatacccaactaatttttgtatttttagtagagacgggatttcaccatgttggccaggctggtctcgaactcctgacctcaagtgatccacctgcctcggcctcccaaagtgctgggattacaggcgtgagccaccgcgcctggccagcatttcatttcttaatcccatttacccatcagctaaccccacattcagtctgcattctctgcattatttcttcattcaacaagtgtctgagccaggcagaggaggtgaacggcctacaggagcgtggcagggaacgttctgagagacacacacctggcacttgaacagcaggaggagaggcagacaccactccccacaaaagcagtgaccttgaaaaggtcagcatggaggttagaggtcctctcagatcctcacgcagtgacctccaaggctcccctcactgcctcccagagggagagcctcagctgtgagggcccctcccgccccaggcacacagaggcgcacagagaaggagctgggagcagtaaggatgtgaccacaccggagatgtgctggaggttagtccgatgtcgtggaacgtccctggtcccggctctggcaggagctgcaggactctgctcaggattctagggtgcatctccagcgtggaggaacagagaccttgggggaaggcagatgcagggatgctgcagacacagctcacgttctaactccatgtttgtcacgtggaaatggcagatgacggagctctgctaggagaggcaccgggaagaaagcccctgttttcttcccatctctgccttaatcgtggctgacagttagatgtgatctgaatgagatgtgcatcaaatgatctcttggatcctgaccttggaaaaccacctgttactggcatgtgcccaacctgattcgttactccagaggactgatgagaagtgacagtggaaaacctgcagcactccttggtgagaggcaaacacagcagcagcatttcacatgattaccagagctgcaaatgttatgcatatttcacccagccagtggatatgctaatttgactgctaagttatttgttctaaaattacgaaagagcaaatttcattttaagtatcagccacctactaatagtaattatgaccataaatcatccagagaaaagacattttctctggcagacactggttcaacccagcccaggcgcctcgggcacacgccttcctcgagtgggctccacacccgccatgtggcggcaagtggcatcctggacttgtgtaccctgtcggctcacagactgcatacactaaggtccagatgtcattctgaggccaagaagctaaatccacaaggaaagccaacagcggcctgtggggcccttaaccttgtgtgcccagcacttaaaactggaattccttcacttcaatgtattatccacccttttgcatgaaaacatgtgacattccccaaattctcaaattgctcctctgctgaaccctatagcagggctgtggtgctcaggggttcctcctcactctgtattcacagggtatccctcctgcttcagcacagagacaagcacatccagtcatgaatgcatgtgcacacatatacacacatgcacccacaagcatgtgcacacatatacatacacacatgcacactcatacatgcatgcagtcatgcccattcacaggcacactcatgcctgcacacatacacacacgcacacctgcatgcatacacacatgcacacactcatacatgtgagcatacacctgcagacacgtacacgtatgcacacacgtacatgggtacactcatgcatgcatgcagtcatgcccattcacaggcacactcatgcctgcacacatacacacacgcacacctgcatgcatacacacatgcacacactcatacatgtgagcatacacctgcagacacgtacacgtatgcacacacgtacatgggtacactcatgcatgcatgcagtcatgcccattcacaggcacactcatgcctgcacacatacacacacgcacacctgcatgcatacacacatgcacacactcatacatgtgagcatacacctgcagacacgtacacgtatgcacacacgtacatgggtacactcatgcatgcatgcagtcatgcccattcacaggcacactcatgcctgcacacatacacgcacacctgcatgcatacacacatgcacacactcatacatgtgagcatacacctgcagacacgtacacatatgcatgcacgtacatgggtgcacgtatgcacacgtacatgggtacactcatgcatgctgatcttgttctgattctgcttccctactgtgtcctcagaactctaagcagtatcttgtcaccattgtggtgccccttttttcttacccttctcaagatgaaaatggatccagttttgcaaggagtcaggctggatctgcctctcttaccccaatcactcctaagagatgtttatggagagtttgttgttcattgtggaaatacagtaaatgtgaacagagcccaccacctctctcactggctgggaggaagctcggcacatcctgtaccacatgcacctgctctgcttcctcccatctctgggcgtcgctgtggccaaggcagacatggcctaaaaatccatggcccctgcccaaccctgtctctaccaccaccgtggaaggcccttcctgggttcaggcttctcgcctgactgccatgagggcagagaaaggctgtcatcagcagcaggatgcacacgccttctgaaatgtgtgctacactttccactgaggcccataaaatccagctgatgtgagctggcatcccacagcaggaaccaaagagggaggaggggaggttcctggacagcaggctcagcaccggcacctgttgcctccaagctgcagacaggactcctcagaagcctgtgagctgctggccactcactaatcacccttcctgagaggggctcactgaagaccctgctttgaggctggaatgaccaaggccctgggatccaactgcaaacaggaaagcatcttcccagacagcaccaacacacacagcaacgggaacgccaggaccccgtggctgtgcaaacatggagatgcaggtctgttggggaagttgctgaacctgaactgggacagcccctgagaaggggatgcgggggcttcacctgtgtcagcaccactcacttggtacaaggaacacacacagatttcctcatctaaaaaatataacgaagcagagtgaagtaatctatacccagccttttcctccctggccccgccagcctcccccgctcttcagagctcacagactccacgcccaatccgaccctgttactgtcagtcactctgtgtctttgtcctgtccccctctacagccttaaaaaaaaccatgccagcaccccaggaaccccagtccctactgcctggagcaggtcctttgatgacagatgtcacctgcagcagtggcagtctcaccaccgtgggtttcaatgccagagcccatcccagatgtgattcctgtcaaagccatgtttcccacctctccctgcagaaaacgctagggcttacgacagcctgaggctctggggttatgttaaatcacattttttcctaggaacgaacgcatcatcatagaaaaggaaggtgcagtgtttgaagagatgctctttttaaacatcatcctcatttttaacattctggagagagagcagggtgcccaggctccaaccccacctcctctgcagcaaacacaaagccatgcacctggcaaagcctcccttctcccttgcattctcagatgtaaatgaggatgcgccctgcccactgcagggggggtaagagtgaagcgcctgcctgctggcaggtgggcattgcctgggccatagctaccccccaatctcagcatcccctcctggcagcacagacccttgggaccaaggagtccccacaccccactgaggttttctaaatgtttccatcggatcgaaaacaacgtgttaaaccagggcggcatccaggcaggaatagaaagccatttccacattaagaacccctattctaggaatcagcctgaaaagtgagagattaaagcgcctcagcccggaggcggggctgcctctgccaggctgggcgtgggaggacagagacccccagaccctcatctcaggcagccctgcggtcagggcatctggcttctgtggcccaaggctcaaatgaaagctgtgattgcaatttcaaagacaaaaggaagagggagagagggaggaggaaggctcctcccagatctgtctctgacaagagggaggcagccctggcagctcctgccaggcctgattgcccatccctgactgtggcttgcggacagggcttggggggcagcagggggcagcaggagacagcgctcagcccctctgctgagagcctatgaccaagggacctggcagcggcctggacggaagccagcccacctccacatgagagggactgactgcttccctgaaagcccagtcccagtctggggacaacccctgcagtgtcccccttccctgcagcctcccccttcccttcagccttccctccccttccctgcaccccttcatcttccctgcaccccctccccttccctgtgccccctctcccttccctgcagcgtccccctttcctgtggcccctccccttccctgtgcccccttccctgcgccccttccccacgccccttcccccttccctgcgccccccttctgagccccctccccttccctgcagcctcccccttccctgcgccccctccaccttccctgagccgccctccccttccctgctccccttcccccttccctgcgccccaccttccctgcagcctcccctccccttccctgcaccccttcctcttccctgcgccccctccccttccctgcaggcctcccccttccctgcagcatcccccttccctgcgcccctccccttccctgcgccccctccaccttccctgagccgccctccccttccctgctccccttcccccttcccccttccctgcacccctcccccttccctgcagcctcccctccccttccttgcaccccctccaccttccctgtgcccccctccccttccctgctccccttccccacgccccctcccccttccctgcagcctcccctccccttccctgcaccccttgctcttccctgcaccccctccccttccctgtgccccctccccctttcctgcaggcctcccccttccctgaagcatcccccttccctgcaccccctccccttctctgcagcctctcccttccctgcgccccctcccccttccctgcgccccctcccccttccctgcgccctctcccccttccctgcgccctctcccccttccttgtgccccctccccttccctgcaccccctctcccttccctgcgccccctccccttccctgcgccccctcccccttccctgctccctctcctccttccctgcgccccctccccttccctgagccccctcccccttccctgtaccccttcccccttccctgtgccccttccttgttccctgcgcccctcccccttccctgggctgccaagcaaggggctccgttgggtgacatgcagccccaccttggccaggtgacccagccccaccctgcccactgcacgtaggggtgggtgttgctcagtccccttcacctgccgatccagagtatggagccccccagtaagtcctccccaattctgaggctttcaatcacagccccagcccagcgttttggggacccgtcccttccttgccttggccacactctcagcgcagggcatttctggaggttgacacacatggctgcattcctcgcagaggagggtccacagccaaattggtagcaggaggagggataatcacccagaagattctggaaacttcagcctcaatgcctcagagagcaggaagatgggtgccccatcctgaggactgcacggtggcctggatcttagacctacaaggcaggaccccaaaacagttattaagtggcatgttctctgcgccgctgcacactcaattgccatgaacgatgggagctgaccgctggcaagttcaggccaaggtttctcctgcaggcatgagggcctgccccctgcacagcctctgggccctgttcctgcggggacacctgtccgtcccctgtgctgggaggaggggcctgaggctcacactccttccatgctgggcctgttctgccgggcacagatgtcacacatgagcaggagctgggagggcacacacaaacatggatgagtgaccgtgccttactgcaaaggtggatccttggggctcaggcccctccaattcacctccaccccatacgcctggtcagtccgctccatcacaacggtgatgtgtgtgctcagcagaggctgaaatggccaaggtcctcctcacgtctttggcttctgtaaagtcagttcttgtttgaagctggggccacaattctaaggcagttcctgatttcagatcctcctgttcacaaaatcagcttcccacagaaaaagaaccagctcactccaccctggaagaagggcagcgagctgggtaccaggacaaccatcaagtcctgtcatttatttttaggaaaaacaaaacctcttactttgattaatttccttatttcaggttcctaattgcacagatttatttaaactctcttaagagtaagaaattgtaccaaattcaggatacctaccagaattgtttgttttatttttaaagtccaggagttactttttgggaaccgcgctctccatgctacacattcctccttcattcgtttgaagacattaagagcagcaacctcaactatatttattctaaatggcacgtggttttaatcagctcttggtttttaatcggctctggttttttgtcctcgatttcctgaaatgggataataccttcaaaagaaggatgtttgctgagtcattcttcgggactaagaaaacatttctaaccttgctttcacagataaaaagttaaagacaagctttgaaaaagtatctgatgaaaatccttgaacattaaatactgcaggtgcaggtagccaggctatgccggggatgaaatggttaagctaatctcagagaacttcaaccggtaactctcatgtgctggattaaaatatagtatgacccatgaaagaacagtaccaaaagtgagaataaagtgaagaaaggtagatgtattgctcaggattgctgagacatggcacacgtgaaccacacagcctaccctgctgtaaacgtgaactttagacatgtggtacttcagacacataatttaaaaggtaaacaagctttttagcagtactgggctgacttagttgtagtctctgatgaaagaggaaaaatccagttcatagtttctcagtcattgttaaagcaccaaagccctctaacaaaaagaccttatcatctcaagacccccttaggaaatgtgagttatatcatcattatcatcatcatcatcatcatggaaacagcctctcccacactttgatgtgcatgtgaaccagctgggccctgttaaatgagtatttctattccctgggcctgggacggagccaaagattcagcatttccaaagcactccctggtgactcgtccgctgggctgcccaccacactgagaagcaagggcatcacatgtagaaatcatccgtaaattgaaaacttgggtcagcacattataaaaattgttaaaagtaaatttaacaaactctttacaatttgttttctggatccaaattcttcatcacccggataacaaatgattggccttatacaaattattttaggccaggcccagtggctcacgtctataatcccaacacactgggaggcctagaggtcaggagttcaagaccagcttggccaacatggtgtttagtctctactaaaaaatacaaaattagctgggcatggtggtgcatgcctataatcccagctacttgggaggctgaagcaggagaatcacttgaacctgggaggtggaggtttcagtgagccaagaatgtgccactgcactccagcctgggtgacggagcaagactccatctcaaatatatgtgtgtatgtgtgtgtgtgtgtgtgtgtgtatatatatatatacacacaccctccagtgtgtgtatgtgtgtgtgtgtgtgtataattttaaattaattatgtggggaaaatcatacatcaactaatttttacaaatgtattaggttcagttttaagactggatgtatatttaaatatacattgtaatttaattaagatttaaaagacaaaaactgcttcctggccctgatgattagaactcttacacttgagctaaaaaaaaaaaaaaaaaaggtttattttgaaaactttatttttaagtgatgagataggaaagaatattgccttctgctcctttagacacctgtccacaaacaccactcgcattgtgggtgagaggaatctgcacttacaataatgaaaagacaaattagatccaattgttactacagtttccccttttaaccctgatatttgctacaggcaactggatatgccacgtgagaccttatcagaggatgggactgacactttaggaggatagtctgaggtgaatttgaaaaataatttctttttatcttcctcttgagctcgctacatttccagtgtgctgggaattactaccgtccactgtagatacaggttaattgacacagaacaaagaagaaaaactacttaaaactctgtaaaagtcccccagggaattagcaagtctcagctggtggcagctctggagggcacaggtgctgtgggtcgttaacaaaaccaggcttgggctcaaaaacatttgaaaaatgtgagttgaagtttcacacactcttctctgtggaactccgaaccttcactattccaaagggccacgctggcttcccaggaaggatcctgcagacgctgccaaacgccccagccacaaaaacgtccacccgctgcctctcactggggcgcagcaaaccagacaacagaactgaagttgaaagacgtgaccagggctgttaaacgccatccagcccaacggttttcgctcttaagcccctgcagggcctgttagaacaaagctgcggggcccagtccccgagtttctgacctaatgcgtccggagcaggccagagaacctgcatatctaaccagttcccaggcaaggccggtgctgctgggccgcgctcctcacgcggcgggtcaggcaagcggcttgcacacgcgagggtgtgacaggctccgggccacgtccgctgggagctgggctctgcggcttcccgcctcccgctcggagtccaaatgtgtgaggctcggagcactcagggcgcccttccggtaatgggaatgttatcagctttatgaagtctggtgcttttctattttcattatgttaaagcttttttaactatgacattttcgtgccttcccaggcaaagcagcaacaacccacttgcggagccgcagaggggaaatcatcactccttcctggaaggaaagatgagttttatcatctcttgtgttttaagttatcctcagaccctctccccgcccggggctacagccaagcaaacagagcactgcccagggactccaagggtctcagagcctctgtaccccccgatttcagcagatggagcgccccagttcaggaggccccagtgctcgcattcctgcacccaggacgtgatcaatgggccaatcctgaacgggagaacagcctgccttctgctgggaagccctgttcccatccccgacacaacgccaggctgaggctgaggctgccttcttgtgaatcttccaaccctgtccccagtctgggaggcagatccaagaagacagctctgtcagcagtcgcagggggggacctcctgcctccagacagcacagcagagggaggggcagtgccagagccccggccaccctgtgttggagtcagagaccaccaaaggcgctgtcacagcggccttttctgtgtagccaggcagaaaagtcaccaaggaggccaacgcgtgtttcggcagccctggattttttgaagttttatttattgaggatatgttgacccgcctggagctttcattatcgatctacttagtgtcatagagtcaagttctacccctgaaagtgagacagcctgagccaccagcaccgcgcccagctcacatcgtggcttctaaccgcgtcaccatcctcctagctctgcggatgcctgcgatgtccgaactgccttaaggtgaggcgagtgtcagcactgaacacaaagcctcaggagtgataaagccgtcacggagtaaaacgcaccatcctctcctcgttccgactctctgctcctctccctagagcttgattccatcccagggccgggagaaaagtgagagaaattgatctcagcagcttcaagcacaagaagaactggcttgctctggggtaggcaaaccatggtctgccactgccatatgtttctgtattaataaagttttatggaaacacagccacgcccacttgcttacagattgcctatggccacttttgtcctataataattcaatagttgtgacagagactggcctgaaaggaaacaatttttacaaaaaaacttagccaactcttgatttattagaaggagatcaggttcttcacaagatcaaaagaaggttagaaaactgacttggagaaatgggcaggaaacaagacaggtgcccaccagaacactgtcacaaccacacagcaccatcacatctggaccagccctggacacagccacccctcaggggtccatggccaccagccccacccctgctcctcgggacgccttcctcccggctgcacttgccgagtcccctggagcacggaaaaggctgtgtcaagtggtctcacatcccccagttcacacagcgaggctaggtggacacacccaaacctggacgtcaccacacaccacgctgttgattccacagcctgattttacaatagaaaatagattcttttcttgtcaaattcacgctgagccacttttccctcacccccagccactgtgtccatcaactactgtgtccatcagccactgtgtccatcaactactgtgtccatcaactactgtgtccatcagccactgtgtccatcagccactgtgtccatcaactactgtgtccatcagccactgtgtccatcagccactgtgtccatcaactactgtgtccatcagccactgtgtccatcaactactgtgtccatcagccactgtgtccatcagccactgtgtccatcagccactgtgtccatcaactactgtgtccatcaactactgtgtccatcagccactgtgtccatcaactactgtgtccatcagccactgtgtccatcaactactgtgtccatcagccactgtgtccataagccactgtgtccatcaactactgtgtccatcagccactgtgtccatcaactactgtgtccatcagccactgtgtccatatgactttcaccactggccccttgactccaggatgggactctcttctcatccatgtgtaattccaaactcacatttgactcagatacccagtctaaacctttctggactctaatgtcacaataccagcttctctctaccctcacagctgtgtaccatgtgcaggtttaatcaacaggtccttgatgtcttcatctgactcactgaaacaagtaggaaaaaagaaagcagaagaggtggatggaaggatggcaccccttcctcccccggcctgtctccccaccaggtttcccaaactggaagcatccgttcattgcacatctctgaagaggcagagccggcaccacaagaatggaggacttggaagtaacagtaccgaacactgatgattctactgagagaatggaaagagctcctggttacgaacaaaaagttacagatattagtcatgttaccatggacaaatcactcactctgtctgcacctgttcacttgaaacattattgggaactggccagccacggtggctcacgcctgtaatcccagcactttgggaggccgaggcaggcagatcatttgagggcaggagttgtagaccagcctggccaacgtggagaaaccctgtctctactaaaaatacaaaaattagccaggcgtggtggtgtgtgcctataatcccagctacttggggggccaaggcaggagaatcgcttgaacccgggagtcggaggttgcagtgagccacactccagcctgggggacaagagtgagactgtctcaaaaaaaaaaaaatggaaaaaaaattattgggaattgttttatatcataaaagcctagaaaattaagaaaatgcagaaaatctcaaagaataatacaataccagttaactcattacctagagataaattccttgttaatattttggttttcagctacttttctttgcatatatgaaagacctggggtcatactgtacacacacctttaatttttgtccaacttatacatcctggggtccatgtccaggatgtgcaggtttgtcacataggtaagtgtgtgccatggtggtttcctgcacagagcatcccctcacctgggtatttaggccagcgtccattagcaattattcctgtgctctccctgcccacccccacaacaggtgcccagtctgtgtcgttccccccccatgtgtccatgtgctcccgtcattcagctcccacttataagtgagaacatgcagtgtttggttttctgttcctgtgttagtttgccgaggataacagcttcccgctccatccatgtccctgcaaaggacatgatctcactcttttctacggctgcatagtagtccatggtgtgtacgtatgtaccacactttctttatccagtccctcactgatgggcatttaggttggttccatgtctctgctgttgtgtacacacaactttataacctgcactttttacttataacacattgtgaacaattccctgtccttagtatttctcatcatgaattttaatcactgcttaataactatttctacacatgcacatcatctagctaaccaattccctcttgaagaaactttacattgtttccaatatttcccattaaaaataatactgcaatacgcaatcttgattgtaagtccttggagagatctctgattttttcctcttaggatacattcccataaaaagaattctagatattttaaaggtatatatgtaagactttcaaaatatcttgccaaattgccctgtcaccaacagaatatgagtgaaccttgaaacctcagcttcttaatttgttaaaatgcaaactatgttcccctcctcaccctatagggttgccgggaaaatccaaggctctaacaaaagttaaaacatgaactctgatgcaggtaggattatcatcgcatcataaatcactcagggacctgcctcttttttcccactatatcactgaggcataagtctgaaccactgttagtcaaaaaaatgcataaatgaaataaaataatataaacccatgggacacttctggcaaaatgaagcctccaggcaaggccatgctttgggacctgctgatgcgatttgctgccacctccagaaccaccaagacggagtaaaagcttttcgttccatgtgcagctgtgtgtgctccatgagcgtgcagaattctctctgttggctggttcccaggccattccttctctacaaaggtgacatctaatcatgcacaatggaacacctgtgtggtgtccaagtcccccgttcactaccagagaaaaattaatgcagggctgtcaacaggctcctaaggttaaataacaatagttttaaaatcctgagctgtaacacaaaggcacatttaatttgaaagcatgtatttctgcctctgccttttggtttagaggacttcattctgccctggacagtgagaagagggaatggggagaggaagaggaagaaaaggagtgtgaagtaggagggaacggaggagccggggtgggaggggggtggggtgacctgagcacgcgcctcactcctggaaccctgattcttccaccgtacacgtgtatgccatcaccatgccctgcgtccttaaggggttcaatgtggtgctaaataacatgagcccaaatagtgcctgccataagcaggcatccagtaatcccaagtggtggctgttaacaacacactgagtaccacctggcagctacagtgggtcagacgctgcaccgggtacagcaggaagcacagagcccaccgcgcgtcctcacatgtgatggccgaggggccacctcagggctgcagagggtgaggagggcaaagagctggaatttccagagggcttgggacgtgctctggtacagggcacacaaggccggtgctgagacactgtgcagctgggagagggcgagttctgtggggaagcacagagaaagcagaggctccatgggaggcttcggcgtcggacaaccccagtggaacaggcgggccattaggagaacacaggaaagtgagacacacacaaggaagtcccctctccccggaggtgccagactcaggtggggctgccactggcagcaatcatgaagaacatggccaaggctgcgggctccacagtgaggctgaggattgaacctgagtttgagcccagctttgtcctccttcagtagaatgactaagtgacaccggccacacaggtgtggtggcaattgtgcagagcaaagcacttcagaggcttcctgagccaagcacacgggagaggaacccacccaggccacctcccgcctagcacctactgcatctaatacccacacttcatttattttgcttaacatccgtcttctccttgaatgggagccctacaggcccggggtctacaggagccccatgaacagtggacttttggccaccaaggcagtggtgtgatgatggtgacagccacggaggagtgtggctactggcaggaagggccccgatcctcccccaaccccacctccacccaggcttggccactggctagctgtgacatgacaaggcggatgccgggggcctccgaaggcctgggtgtctcctcactcccccgcccctccgccatcgccataggaaggacacacctgggccagcccgatggttgcaagagcaggatggcaggtgcatgggcagagacactagggccagcccagcccggagcagccacaaccaatcatgaaggacaccgctctggttcggggtggtttgatggctggccaataccagggattccaacctgactagagaggccccagcatggtcagctgaggaacatcaggaggttactggggggaatgggctctgagctaggtttgaagggtggagaggcagggagaggggtgggtaagctatgggtcagaacaggcatccatgaggatctctcaggacccagggcttggatgtggggcaaggactgcacacatggatgtcagtgaggaccgtccaggggacagccctgcactaggcaggaaattgcacacagagaggtcagtgaggactgtccaggggatagcgctgcagtgtgcaggagactgcacacaagaaggtcagtgaggaccatccaggggatagccctgcgctgggcaggaaatcacacacatggaggtcagtgaggaccatccaggggacagccccgcactaggcaggaaattgcacaaacagaggtcagtgaggaccatccaggggacagccctgtgctgggcaggaaatcacacacatgaaggtcagtgaggaacatccaggggacagccctgcgctgggcgggaaatcacacacatgaaggtgagtgaggaatatccaggggacagccccgtgctaggcaggaaattgcacacacgaaggtcagtgaggaacatccaggggacagccctgctctgggcaggaaatcacacacatgaaggtcagtgaggaacatccaggggacagccctgcgctgggcgggaaatcacacacatgaaggtgagtgaggaatatccaggggacagccccatgctaggcaggaaattgcacacacagaggtcagtgaggaccatccagggaacagcctctgcaacaggcagtggacaggagaccgcatgcacggaggtcagtgaggactgcccaggggatagcgctgcagtgtgcaggagactgcacacatgaagatcagtgaggaccatccaggggacagccctgcgctgggcaggaaatcacacacatggaggtcagtgaggaccatccggggaacagccccgtgctaggcaggaaattgcatacacagaggtcagtgaggaccgtccaggggacagcgctacagtgttacgaaggtcagtgaggaacatccaggggacagccctgctctgggcaggaaatcacatacacggaggtcagtgaggaccatccaagggacagccccacggtgggcagaaggcaggtgggcaggcggcaggagaccacaggcatggaggtcagtgaggaccgtccaggggacagccccacgctgggcagggggcaggagatgacactgtggtcatccgaaagctttcgatggtcggcaggactatgaattgaaccagtcagcgggggcttccacaggctgctgagcagtgaggggacatctgagaaggtgtatgtggcacctgtccaagctgattagaacaaggagagtcaggagtgaggaggatgcatggatcatcagggccaggatgacagaggaggaacaggggaagtcagggtcaggacgagggtgtggccgtgactcagcaactgaaagaacacaggagctacccagctccaggggtgtggtgaaggcagcctgtggggagctggagaggagcaggtgcggaagtggctccgctcctgtgggtgtcggggcaacgtgggacgctcggagcaggtgcggaagtggctccgctcctgtgggtgtcggggcaacgtgggacgctcggagcaggtgcggaagtggctctgctcctgtgggtgtcggggcaacgtgggacgctcggagcaggtgcggaagtggctctgctcctgtgggtgtcggggcaacgtgggacgctcggagcaggtgcggaagtggctctgctcctgtgggtgtcggggcaacgtgggacgctcggagcaggtgcggaagtggctccgctcctgtgggtgtcggggcaacgtgggacgctcggagcaggtgcggaagtggctctgctcctgtgggtgtcagggcaacgtgggatgctcaggagggggcctcagcacgcaggaagctgagctcacaaggggtcggattgcaagatctcttcagaggtggaagctgatgcgggtggaggtgggtggtttctaaagataagaaggggaggaagaagatggggactgggaggggagagggagagagagagcagaaggatgagcttctgttgaagagagaggcgccacacacagcctccacgcagcctccacccagcaggcgggaccagtggacaggctgcagctcacagggtccttgctcaaaggcggcagcaaatgcaccatccacttcctttccttgccggcccgtcagtcacagcatcggaagaatgaatagtgctccctgatccctaacgtgcaatcggggctggagccggagacccctccaccctgcagtcagggccagcggggctgtctcaggcagcacatctaaaggcctctccaagccatgcacccaccctgcaggaaagagctcagcatcctggcatcaagtctgccattcaggccacactgggacttggtgtccagtcctcatctcttctttctagaaacccaagttaaagatcaaggtgacacagaaccagagcttagcagccaaaatcagaatagcacagatgcgtagtcaccccaaagcccatctgctttgttccgggatcccccagcctcatttccatctctgtcatgggctctactgacaacacactagcagaagagaccacacgtctgtcagcgcccacaggcaggtggcccaggggagcagggcctgtcctttgcccaggcctgaggccacacgggcagagtggcagtggagggctggcatgcacacagaggatggtgacttgcagtgctctgttccatggccgagagggctgtaagtgatttggtgcatcttagatagtcattccacccggcaagcaccaactcaaggatgttcatggccctcaaatgtacacttgaggccaggctatgaggggagcacgaagatagaggacgagacacaagtcaagccttaaaaagccattctctcggcagagaagaacaggcacacacaaccaagctgcccattccccagagctgctaaggagacagtgttcgcagatcttggatcagtggagacaccctgagagagacacctcagagcctgtactttccagatttcaaggccacacccctaaacctgtttcctggtgtgcggggacacatttagctgggcccggttctatcagggaatatttaacatagtttcaatgttacaacttggcatcctcggcttctccctcttgggttctgggggagccccaatgacagaacaacttagaagcccagggtgctccgaggaaacatttcaccaactcagcccacggcacccacaccaggtgctcatagacagctgctaaagaaatgagtgaattaatgacgctttctcaaattcgcaccccacaaaaacctcattcacactaagtgtgtgtgtttactctctctctctctctctctctctctctctctctcacccagagtccaggctaagaccatctcactctcttcagtttttatcttttccaagatttcatttcttaaaaagattctacccttctttgcatccttttgaactccctcttctattcctaaccctgttctcttttattttcatattgtaatcacaaaataattcacagatatcagaaattctcctatttgataaaaaatactgtaattccatgtaagagaaacagccatgttctttaaaaactgaggaaaagaagagaaagagaaaactatgagtaggtcggatgtgaatgtaaagaataagccgacaggtcggatgtgaatgtaaagaataagccgacaggacactgagggcgttttgcaggatcacattcttctcagggccgcttgctgggaaacgacatgtgtcgagttcccagcagtgggagggctgtcgtcgaggaggcccaaggaatgtaccttcccagcctcccacaggggattcctgccacccatgtgaggtcacatggggttggcaaagaaccttccttgagtaatagaactatcatcaataggtgatttgaatttgtttttctcaagttaaaatattgaaaacagttggtcaggagttgacggcaagaaatgccagatgaaattttctggcacctttgaccctgcacctctgagataagatggcagtgaaacctcctccgtgtctacccttcatgctcttaccttttcctttccctcctcacctcaaaatgtcgagaggcagctggatgcgctggtgtggtcaggatggctacgcaatgctatttgcacttcaagttttaccccctatcctgggtcctgggccaagacctaaagagcagtgtggtttgtgatgttattaagtggatcggacagagactatggaaatgcgaacgtgcacatcacatcaacctgtgcagaacttggaagggagaacccacggctcacagaggggctttttcctcctagttctcctaaaccatccacatcttgtagaacaaagaacaagggtcccaacacgaaaaaggaggccatccacacaggctggtgccatccctcccatacctgtctctgtagacatgctctgtgccttgcttggaaaatggaaacttctccaggcaaccctggccgcacagctttgcctctcacacaatcgcacacatcagcttcacccatgtttccggctaagcgtcatgtccccgcacacccctgggcaccagtgcaagacacggtgggaggcagcatgctcacagctccttgggtacaaacgggttgttctcacagaggccggaaagagccagggttcccacatgcacattgctaagtgaaagcagccagtctgaaaatcctggaaaaggcaaaactatagagacatttaaaagatcagtggttgtcaaggattccgggagaggaagggagatgtgagtatgtgaaatagatgatttttttagggcagtgaggctatttctatgttactgtaactgtggataaatgacatgcatttatcaaagcccactgaacttcacagcacaaagaggagccttaatttatgcaagtttaacaaaaaaaatcaaggatgcttcagatcccgggacagaatgccatgcagacggtgatgacagaatcctgcagcatcacagatgtgtgaagccactgacaccaacggggcaggagaaaaagtgctgacctacatagctctggaaacgagcagagcctgtaaaactgaaaggaaaagatcctgtctataagcactgtgctctagctgataaacttgtttcccaagaggtaccagctagcaattctgactctaccacacatgcatgcaaagtgaacaatgaggttaacagctggcaggtggcaggaggaagttctccctattggagtggaggttacaggtaagcaggaggcagcgtctggaataatccacatggtaagagcctggagttggagacgtgaataagagctcatggttagcttggtatagatacagatggtaacagaaatatttataaatatgtgtatattcctagatctcacagtcacacccacatgcacacactcacacacatgcatagtcacacacacacacacacatcttctcgctccgtcagctgacatgtcctacaggcaaggacatccccgcagtaatgagcacacaccacgcccagcacttgatttccaaaaccattctcagatagaagggactgggactgcttggagaaatggctaattctaagactgagacaggaaatacacaagatgagcctaaagcctcttgtagtgtcagaaaggaaggaagtgttttcaaaaagccataaagatggacgtattcaaagggacagtttgtgtgaggccacggaacgggctgccggcagccgaagctggaacaatgtgagcaaacaaaatgaaaagtgttatgttatagcccaaaatataacataaagtgttgaataaataaatgggaagaaagagacaaatctcctgtgcagaattccaaacaatttctgtctatcctctgccttcaaggaagcagagcatgacgcgtcactcacgagtgtgggtttacactgtgccttccctcagagagtgcagcagggaaagagggaagcggggtgagggggagaagccgcaaccctccccaccaagccactgagcacagttggtatccaccatgatggcgcacactgagtgtgtggctttgatctgatgtgatgagaaggcacttcaccccaatcttcctccccagaactcaaacacatcagacaaatccaggccaggggacattctacagactgaccaggcctcctcaaaactgtcagggtcctcaaagccaaggaaagtctgagaaaatgtgatagccaagaggaccccaggagacacgaccacgaaatgtatggtagaatcctggatgagatcctgggacagagaaacttcattaggtgaaaactaaggaaatctaaataaagtagggaatttagttaacagtcacataacagtcattggttccttaattatgacaaactgtgtactaatgtaggaagttaattgggaaactggatgtgaagatatgagaactctctgttctaccttcagttattttagtaaatctaaaactgtcctgaaaaatagtttattatagacagagagagaaatagccacatggtagaatatatgaagccatcaaaatgctataggttaatacttcttaacacagaaataggtttatgctacattaagttttaaaaaacaagatgtaaatgtggaagatagaaaaggcagccccgaaacttaccagtggtcatttgtgccgggcagcgggaatgttttggcctttgatcttccttttctgcttatctgtgtttcacattttcttcaaggaacatgttaacatctttttaacccattatgaaaaattatacaagttatgggttattcaaagctcagtaaaagccactgatacactaagttgatatttcaaagggtgtgattttgaagccctctcactacaggctttatcaacgcacgatgactgcacaggtctgtcttagctctaaagcacccagcactctgcatcaacaccacgggcatcaaatgaggcggatggaagcctacaaccctcaatcagtaacagcttgctgtttcgtccaggactgacatagaaggattattcagggggccctaatctttctcttctgtctgctgaggatggtcttacctcatcacaggtatacctggtatacctctggctgtttgtggagagcccctgaaaacacagcagtacattctcctcgtttatcaatgaggagggatggccacgaaggggagcggctggagagagggagtgacggagaatgcacagctgcatggagatgaccccaggatggcagcaaagggcattcctcagaatgacgtgggctgcccagtccctgaacaagcatgggcctggcaggggtgttcctcagatgtttgtgatgcaattaaacctctgtggtccatgaaagagaaggatctcagctgtgtccacttagggtgtccctgtgagacacgacacatccctgcaccccaggtgatggcgatgcctcccactggcaaaaaggatccatgtgtgcagcaaccccacctcttcctcagtgctcacgggtgcgtcaaagagaaacaaaagaaggatacctactttccaaacacatcatccatcaacatgcatgcagctgtttactggaatttgctttttcgttacttaagctaatgaggtcatttggaagatatttatgaaaataaaacataagaggatgaacctgccccatccatttggttaacaggaaaacatctcgcagatgtaacagccatggctgacttccagaactgtcaccatccgcctgcctcaaagtcactggcacgtgtgtggtttgctgctcctggacccgctctctcaggggcatcatcatgaggcctctgcagagccagaggaaagaaaatcatctgaagaagaggattccgtgaccactcttattttatctccacagtactgtttcttgcctaatttgtgccgaacatttacgatgacaaagacgatgatccgaaaacagcaggcagaacaaggttgcactatggcgaggagaactgggatgcggagagaaaggggcagccccgggcacacaaagcggccgcgtgcaccagctggtgtttccctctcagtgagtgtattttttttttttttttgaggcagtgtttccctcttgttgcccaggctggagtgcaatggcatgttctctgctcaccgcaacctctgcctcctgggttcaagtgattctcctgcctcagtctcccgagtagctgggattacaggcacgtgccaccatgcctggctaatttttttattttcagtagagatggggtttctccatgttggtcaggctagtctcaaactcccaacctcaggtgatcagcccgcctcagcctcccaaagtgctgggattacaagcgtgagccaccatgcccagccgtgcgaatgtaatttttaaaatccagcatctcaacatcaggaagaactttacagaccagtttcccttctcactcaatttggctgcatcacccactgctcccaatgggaggcgagtcccaggggctttttccacctcattccatgctcgcctttctacatcatctgttacatgctcaaggcttccccatcggcctctgcaatccctcttcccagttccttcctgtttccctactctccatcctcctctcctgattcctttccttggcttgttttcacccacgtgccactgaaataccagcgtctaccaaattttcactatcgacacctcccacgcttcatcctctgtctggtcgtctctccacagccatggctgtagtcaggaatgattcctaaatacgtttccacactttttccaagagttccaccttcatagtccagtctttctggacgttgtaacctctatcacacaaacatttcatacttgatactctaaggctgagccccttttcactgtccccctccccacctaccatgatatccacagacacgctggtgattgcacctcacagaagcctctctgggcttctccccacgccccggccgcctggccatctcttgcctcaaaggcctcctaaggagtctccatagcattaagtaatttaccttccaattcattctcctctctcctacaattaaaagtgaatcattccagccagcgcagtggctcacacacctgtaatcccagggctttggaaggctgaggtggaaggatcacttgagcccaggagttagagaccagcctgggcaacaaagtgagaccctgtttctaaaaaacacataatttaaattttaaaaaataaatgaaaatcctccaataacatgcagcctcttctgtatgaagccaaaacttccttacaaggcacaaaggtgctttccccttgttccttcccatgccctcaactccccagccccctcccagcctgccttgcacccagccctaggcagccacattcttggtgctttctgcctattgttcttggtgctgttcttggtgcttctgcctatagttcttggtgctgttcttggtgctcctgcctattgttcttcgtgctgttcttggtgctcctgcctattgttcctggtgctgttcttggtgctcctgcctattgttcttggtgctgttcttggtgctcctgcctattgttcctggtgctgttcttggtgcttctgccttttgttcctggtgctgttcttggtgcttctgccttttgttcctggtactgttcttggtgctcctgcctattgctcttggtgcttttcttggtgctcttgcctattgttcttggtgccgttcttggtgcttctgcctattgttcttggtgctgttcttggtgcttctgcctattgttcctggtgctgttcttggtgtttctgctattcctgtaacctgcaaggcttttctccacactacaccatggaaagtcctctctagtaaaccgtagcccagcagaaccactcgtgagtcctgtgattccttccaaaccactagacctggggcaccttgggccccagcatggtgcctcactgattttggactgggcacaacacgattcatccaaacaccacttgacaaaggccagcaggacagaacagtacaacgctggttccacagtgtggtcctcactgaagacagggcgggtggcattgacccccattcctgtcccacagttgagggctgccccacaggcttcctcctcacttcgggggtgcaagcctgcaagaccaaacagcccacagccttggaggaggcagagtgcgggcagcgccccctcacagaaccgcagcaacgacacctatcaccgcccaccacaggcgcactgtgggctgatggggtgggccacatatggggaattccagaacgtgaccctgtacctaaatccctgcagttcccaagtctccctcagtccttcccagacatctcttaaggggcctgactctgcctcagccccaccgccccccagcctgagccccgttccacctcctcactggcctcgctgcccctctgcaatctcctccaacagccgccaggatcatctttacaaaatgcaaaggtcatattgctcctgagctgcaatgccctcaggcagtcccctgcctttagggtggagtccaagccagcctcatggacagcgtctccagactcttccccaccatagccaggcaggcctccaggcgcttccagactcatccccaccatagccaggcaggcctccagatgcctccagactcatccccaccacagccaggcaggcctccccaggcacctccatccccttcgtcacacatcccacacaccccggtttgttcccaccaggccttcactaacatgccactgcagaaaaaccttccctcccccccagtctgactagagtccactcatttttcaggtaccaagttgcaccttgcttcctccaagagggctccctaattcctgaccgggcggggcacccctgcaacattctcccagctccctggactctccctggcccagctctcgccaactgcattgtgattacttaagaacttgctcctcccttaaaagaaaatagactccaggagggcaagagtgggtttatctcagttactgccatggtgtctataaaatagttagagcccaatagttcttactgaatcaatctatcaattaattaatagagacgatacggatttcatggggtgggaggatatgaacattaatagagacgatatggatttcacagggtgggagaaggatatgaacattaatagagacgatacggatttcacggggtgggagaaggatatgaacattaatagagatgatacggatttcacggggtgggagaaggatatgaacacacagggacatcagcgcttgtcctttctggacttagcaaaggccatactcagtagctcaggtgccaagtaagccagaagtgaagaaaatgcacagccaagccgggccagaacgtccacagaggctaaaggatacggctcaagctccacctttaaaagagggtaggactgagatcaacagaggatataaacagattaccaggacggcatgaccatagaggaaggacccacttgaggaggccacagcaggacaagagggaaggacgaaccttccccaaggctaagggtcaaacattcgagctgattaaaaatgttacttgaggccaggcgcggtggttcatgcctgtaatcccagcactttgggaggctgaaacaggtgaattgcttgagctcaggagttcaagaccagcctgggcaacatggcgaaaccccgtctctataaaaagtacaaaaattagctgggcatgttgctgggtgcctgtaatcccaggtactcgggaggctgaggcaggagaatcacttgaatctgggaggtggaggttgcagtgagctgagattacgccactgcactccagcctgggtgacaaagcaaaacaactctgtctctaaacaaacaaacaaaaaaacaatacttgggctccaggatgcccatcatcctgcagcagtttgcactgagctccctttatgccaacaggctcaggatccccaaagcactgcagcagagaacagccgtgcagcatctcaggccacacagtacacaggcgtcgtcactgtttccaagaacttccttggctgaaaagtcatttcaaactttggggctattttggcatctaagtgggaagagggagaaaacattaaaagaagtcccttagtgctgacactgtcctgccagccagcacatctcctcattttatgaagtcggactcatcccagctatctgtgtgagacactcagttggccatgacagttaaattactttttcataccgagaacagaattagtctataaataagtaaagaggtgctagggctgagtcagaagtgccgattccacctcaagctccttccctgcccgatctgcaggtggctctcagggcatgggggaccaagctgtgtttgagcctttgctttgcatgggtggctctgaaggtgatggaatgggctggcattctccagcactctctggcattttctgacattctccagcactctcctgcactctccatgttgatctgggtgactctggaccttcattctaaagatactcaagaatctagtggccatacaacatccccaagggagaaaggggccctttttctccaatgctgctgatgctgtttcccatcatataaggactttctcccatcccaagcagccaagggaaagaagtgactcacctcagaaagaagaaaaagggaagaagggttacccaatgcctcccccatggcatggaaattctccattttccccacaacgccagcacggtcacactctgcaagcaacacccatctgttctccttacattttccaactttactatcattagcctgaaaccaagctttcctgttcagtgcaatgactactctgccaaacacacaagttctgaacaggacatgtgccatgggaaacatttcgatttaatgagcttttccagtgcaacacagaatgattttttaaatcccagggatgtcccccactcaaacttgtcatttcttttaacaaaacaacggcaatgccaagaaaggaaagcattttctggccacagagtgggcccttcagctccccttccaagagggagccctgacacggaggcagaaggacttccatcccctaagaaaaacagagtttgggatcttgaacaaggtgcattggcagcctgggtctcacaccgtcccttctagagcaggaaggtgtggaaaggagagtaaaattccactattgtgaaattcccccttcagcaatgaaacggactctgagaacttatttttcctgaaaattattatttatgtccatctagatggtgtttctatgtttactgccactacaatttaaaacagttcatgcccttcggtagacagtttctagacgagtctttcctggatgtttgaagcaggttctccaccttcagctcagctcgaggcccctggagaaacactccccagagcaggatctccagagaaggctcccttccgtcaggagcaacagtggctccaaccccgacttccaagctctgggcggccttccactgttttgtgggtggtgataattccatttaaagtagcacttacatggttttttagaaaagactataactcctggatttttttcaaccatattaccaatagaaacaaacatacgaagaacgatcgggtggctgcttatcagaaaatcctaatccctgcctcagccatgcccagccaggtcacagtgagcacgtcctggtttccatgtctgagcaccagatcggtaaccccagcctcttcactctcatgagggtgcagcaaagattcagcaggaggatacacatggatacgctgggcaaaccacaggcaccctgcaggccatgagggcctggccgagatctcagccagccaaggaacaggagatttcagccacgtccctcttatctctcccacagcaggattccaagtgctgcagccaggaccttattccatgacttccctctgtgcgaggcgctcagtcctgcagacgcagtgacttcctgccccagctggaatgctgtctgcgtagtcatactataattttatttgtattatttttattgttgtattgttattttatatttttttccccagtactttcaatcctctgttggtcgactcaggcagaacctgagggtatgcagggctggctgtattcttgcccaaagggacctgagaaaacatctagaccaacgcacaggactgtgtgattcacccgaaaccacacagttagttgctgagttagagacagtactaggtgtctggcttcccaacagggtgaattatttctggaaattgttttttctccctgcatctaaatttaacaatgaggaaatctattagtaatcagcaagatgctgaagcagtaactccaaaatcagttgacgaatgatttctcaggagcagcacgctgggtgctggctcaggaggaaggtccgcatcggaatggtggactgtccaggtactggctcaggggggaggtccacgtcacaatggtggactgtccaggtagtggctcaggagggaggtccacgtcacaatggtggactgtccaggtgctggctcgggagggaggtccacgtcacaatggtggactgtccaggtagtggctcaggagggaggtccacgtcacaatggtggactgtccgggtagtggctcgggagggaggtccacgtcacaatggtggactgtccaggtgctggctcgggagggaggtccacgtcacaatggtggactgtccgggtagtggctcgggagggaggtccacgtcacaatggtggactgtccaggtactggctcaggagggaggtccacgtcacaatggtggactgtccgggtactggctcgggagggaggtccacgtcacaatggtggactgtccgggtgctggctcgggagggaggtccacgtcacaatggtggactgtccgggtagtggctcaggggggaggtccacgtcacaatggtggactgtccaggtgctggctcaggagggaggtccacgtcacaatggtggactgtccaggtgctggctcaggagggaggtccacgtcacaatggtggactgtccgggtactggctcgggagggaggtccacgtcacaatggtggactgtccaggtagtggctcaggagggaggtccacgtcacaatggtggactgtccaggtgctggctcgggagggaggtccacgtcacaatggtggactgtccgggtagtggctcgggagggaggtccacgtcacaatggtggactgtccaggtgctggctcgggagggaggtccacgtcacaatggtggactgtccaggtgctggctcagggggaaggtccacatcggaatggtagactgtttaggagaaaggtccacgtcagaatggtggactgttttaagaggaaggtccacgtcagaatggactgtccaggatggtgcatgtgcagggtgtgttctggcaccactgtgtgtgtacagcgaatcgctctctgtaacctggcccctggtgaccagatgcacttacaacatgcaccttgctgcggctagatgcagtctgtggacacagattaaggtgaagtgagggcatcagcatggtctggagtccgtgaggcactcggaccaccggagccagcccaggggttggcacagtctgcagggctcagcgtctcccctggttctcacgtggacattggctttccttgtcttgagagcagctcaccatcacgagttcttccaacagcccaagtcttcatttccacacacttgcttctgtgtgtggcagatgtggagctggagagaacagacctgccgtgagaagggagagggcagcaaagatcacccagaacttgctgggactgagatgaacaaaagttacccaaaaatgggaatttcaagaatagccaagggcttcaacagaggatgagctgacacttagatttagggattgtcagcatcaccgtggctgctgacatcttgaaaactggaaaatggggtctcagaagaacaagataagagcgcaggaggccagggtgtgactcttggggtccaggaggggacatcacaggaagcacaagttggaggggccagacgggttgcagccaggttggggtctggggagccccagtgtgaccaggggcgggggtggtgggtgagcctcagcagccagagtggtgcagacacgtcccacggtgagggctggtgcggacaagagattagccaaaggagcagccaccatgctgccgacagcgagtctgccctgaagtggagtctgccctggagtggagtcgtctgccctggagcggagtcatctgccctggagcggagtctgccctgaagcggagtctgccctggagcggagtcgtctgccctggagtggagtcctctgccctggagtggagtcgtctgccctggagtggagtcgtctgccctggagcagagtctgccctggaatggagtcctctgccctggagtggagtcgtctgccctggagtggagtcatctgccctggagcagagtctgccctggagtggagtcatctgccctggagcggagtctgccctggagtggagtcgtctgccctggagcggagtcgtctgccctggagtggagtcgtctgccctggagtggagtctgccctggagtggagtcgtctgccctggagtggagtcgtctaccctggagtggagtctgccctggagtggagtcgtctgccctggagtggagtctgccctggagtggagtcgtctaccctggagtggagtcgtctaccctggagtggagtcgtctaccctggagtggagtctgccctggagtggagtcatctgccctggagcggagtctgccctggtgtggagtcgtctgccctggagtggagtcggccctggagtggagtctgccctggagtggagtcgtctaccctggagtggagtcgtctgccctggagtggagtctgccctggagtggagtcgtctgccctggagtggagtcatctaccctggagtggagtcgtctaccctggagtggagtctgccctggagtggagtcatctgccctggagtggagtctgccctggagtggagtcgtctaccctggagtggagtcgtctaccctggagtggagtcgtctaccctggagtggagtctgccctggagtggagtcatctgccctggagcggagtctgccctggtgtggagtcgtctgccctggagtggagtcggccctggagtggagtctgccctggagtggagtcgtctaccctggagtggagtcatctgccctggagtggagtctgccctggagtggagtcgtctgccctggagcggagtctgccctggagtggagtcgtctaccctggagcggagtctgccctggagcggagtctgccctggagcggagtctgccctggagtggagtcgtctgccctggagtggagtctgccctggagtggagtctgccctggagtggagggaagtgaagccagatcgctgaggagtgcgaggaaagctgttggttgttatggtcaagccccagaactcgtagatggatgtccccagcccagtgcctcagaaggtgactgcgtttggaaatcaggtttttgcaggaaaaattggcgttaaccctcagcatggagtggggattggtcccaggacccccacttacgccaaaatcttcacacactgaagtcctgcagctgccccacggaatctgcatacacaaaaagtcagcttctgtacacttggctttcacagccctcaaatactgcatttttgatccatatttggttggaaagatccatgaataaatgagttcagacccatgttgtcccagggcccactgtagttccgatgaggccactgggggctcctccagcacagccaacaccacctgtgccagcatcactgcccttcgaagtgtggccccagcagcggtctcctgcaccctccgaaaagacagcccttggaagactgtggctcaggatgcaaggctctgactgaaccctcaagctggccctccatgcgaagaaatgctgcgtcccaggccctgcacagtgctggacttcccagctccaggctctggagccggctgcagagcacagcgtgaggcaggccctgaccgctctggaaggaaaagcacctctggcaagtagtccagaggtgaaagtttctctattttggaaactgggcatctgccaaggagaacacacggccccctaatgtgcaacaaaaccgtgagacccgagcagaagctgcagcagaaggtagcacgggcaggatgctaggccccaggggccatgggctacgcacgggccaggtttccagcctgccagccccatccagacttaaggacggaaagtgggaccaaggctgagccgctccgcacccctcgctctacagctggacacaggctctgcagaaatcctgagctggggccaccccagcctccctggcccagaacaggcgctcactgtatctcctcccttcctcctgagaggtcctacgggatggagtattaatagtgccgtgtttaattattattcagcataatcacacatattacggggatttttaaagatcctttcatgcacaatgagtatttatctaatgtgccctcctcattcccaagcagccctcgggggcagatgcccccatctcccaggacatctctgctggtctctctccacggcacctgctccacagccacctctctctgctgtgctcacacagtgtggaagctcccgcttcagcaagaggaaagccccgatgatacagggtgaagacgcctcccctcacagacctcagacctgtcccagagccctgacaggaagacccaagctctcctgaagccttagggtctcaacatcccaagccgacaatgcccccccattgactcggctctctgcagacctgcagacctgcagcccagcccctactctcccctctggctggcattgtgcagtccttccttcctcagcagcgctgtgtgggaagggggactatctgcccagtccctgaggagatgatgacttcctacagcttctgaaagggcccgctctggggggagccacatcaggcagacacacggctcctggtgttggcagggtgccggcggaatccagggcaggattcacttgtgtggcgaaggggtcacccctcgtgcaggctcaggccctccctgcccacctgtggcggcgaagggaactgacaccactccttcccggtgagctcggcagggctgcatctctcccgtgggacgctgcagagataaccaggtagagccacgctcacgagaaccaccagccactctgagctaggacggggcacaggcaaccacgttcccacaaacacagggtctggaggtctctccgctggtcacggcctcggaattccgacatgctggactgtggcttgggaaactgactcggttgttctccattcctgatcccatttcctgtttgtgggtgtgatggctgagttgtgcaccccaaagttcatacactgaagtcctgacccccaggacctcagaatgggactgtatttggagatgggtcttgaaagaggtgatttcagtaaaacgaggtcgccggatgggcccggatccaggctgactgggtccttatggaggaggaggtgaggacacagacacgcacagatggacaaccctgtggggcacagggaggagacggcatctgccagccaaggggagaggcctctgggggaacctgccctgccgtgctctcatcttggactttcggcctccaggactcagaaatgtctgttgtttgctaagccgcctggtttgtgggggtttgttagggagactgagccaattcatacagtggattccgccactttctttctaacacaatgaagatagagttggtgacctcctcaaaccttcataaaggcataacttgtaacaacacaagttatggtttgtgacaaatatcaccagaagccccaagcagagtcgagacgtgcgcagaaactgcacaagccaacctggctcaggcctgggagagcatccctccgaggagcatccctccgaggatcccccacagccttcccgtcctcggagcaaatgcagctgtgtccttcccgcaccgtgggcctggccctcacctccccccaccccacacccagcttctccaccagctccccaggcctcctccccacaaggcgcgtcctgggcctccctgaccccggccatgccccccgccaccggagccacttcactgccttccctggccacagctccctgaagacagggccagcctgcgtctccgtgtccagtccttggacgtgctaaatcctcagcgagtgtctgccaagacacatgtgatgagcaggtgaaggaacatgtctgacctcctgcttcagtgccatggaggcctcaccagccccaggccatgggctggcctctccatttcctccttctgagaataccgtggagttgggattgtgtttgcctgtttacagggactacggtcagtgtccctcccaggccgctggtccttcctaacacctggcggcccactgctcagccatgtgggggttgtgcacagggcagggctccgaggtgtgggctccactctgtgggggggtctcacagcagccacacagagctggccattccctcaccgtgacctctgcagagagtagaattgtctgtgtacatggggctggggccaggctgtcctccgccagctctcaccccaggctcccctggtcttcctgccccgtatcccagattcatcagcaccagccacatctcacctgccccacaagctgcgcctcggtgctgctgtctcaaccaccttcctgtgtagcagggaccacctacctgtgttgcttgtgctatgtctgttggtttaaagcccatctctgatcccgcccgacacacagcagggactcagcaggacactcagtctaaacgacagggtagggggcaggcagggacagccgaggagctgctcctgggtgttcctgtgttgtgtgagcacatggaggaagttggtgtgtactaagcagtgaagctgctagcaactggctgtgtaacagctgccaagtaacacatcatgtttccacagagctccagaggcatcagcctaaacaagaggctcccgagaaggtgcactcatacagtgtggtgggggtacccgtgcttgggtgcaggacaggcgggggcacccgcctgggcagcctccagatgctgctgaggtttgccatggggtatgaacgccaggtgacgtcccaaaacaggccactcaatcactccccagagccggtcagccgtctcttgccctgtgaaatgcacatttacaaagcgtcacctggtgtatcaggaacaggttcacttgctgtctcagacctgtgaatgcctacatttcagctgatttagaaccacgcatgctgggccaggctcggtggctcacacctgtaatcccagcactttgggaggctgagggggacggatcaagaggtcaggagattgagaccatcctggctaacacggtgaaaccccgtctctactaaaaatacaaaaaaaaaaaaaattagccaggtgtggtggcgggtgcctgtacttccagctactcgggaggctgaggcaggagagtggcatgaacatgggaggcggagcttccagtaagccgagatcacaccactgcactgcactccagcctgggcaacagagcaaaactccgtctcaaaaacggaaaaaaaaaaaaaaagaactgtgcacgatggacactggcctcggtgagtccacaacaggaagcaaacaaggattaaagtgcccggaattggaagacacaacatttcctacacagcctgagtctaaggtgatgaggggtggaaacaccagctcctcagggggccagccctgtgagggaaacgtgtgctcacgaaagtcagcctggccttcgagcccaccaaggggctttgggatcacacagccaggggcaaatctcagctctgcagcctgagaaaagtcacccaaatgcctcaatccccttctcagacaggcagacagacaataataacaatgatgcctgggacacaggacattagaatgcccgcagcactcacacagcacctggtgggcactaagcacccgtcgctgttggtcctggggctaacgctgatgggaggagcagctgcgtgcatatttacttctgaatattttcacattttaaaatcatctccattttgctttggaatgcgtggcatctctgctgtgcaggtgctgacacgccccagagcaagcattggctgtgtcggcagaggaaggtgggaaggcccaggggaggccagcaggaggacggactcaccaggacacccccaaggacagggaaggtgctgctgaccacggccagcaacgacgagccatggtgacagctcacacacagctgcaaactcacatcgctgcctctggaaccacagagtgctctgtattagatattttgtgcatttttgaccaaaatgagtcaaatgtggggagagtggcaactgtgtgagtctgggctccaatcagcagcgaagatgcagtgtgggaatgacagcagcttccctctgcggacacagcacacactcaccacacctgggctgtgtccaccagccccaggggctgtggggaggggcggtcaccagaaggggccaggcgggagcaggaccagctcacagtctccccaggcctccccagccagcatgagttctcagcatctcctctacacacatggacaaacaccacacacacgtgtacatcacacatgccacacaccacacatatgcacaccacacacgtgccacacacagcacacatatgcacgctaccacacacatgcacacatgtatctcacataccacacacaagcatgcacgccacacatgccatacacaccacacgcatgccacatgcacacccctaacttaaggcctagctccaagtttctgtcacaaccaagagggaaaacagagagaatgcaaaagaagtgagatccattcctaggacaggctgaccccaaaaataagtagaattacgtcagatatttagaacatggaattagtgatttggttccctggctagtccatcaaagcctgtcgatccaaaatacaatttaaatgccacatgcttgcaataaaaagcaatggaaagcaaggtctttacagtaataattaagtgaagcaatgaaattgaatccaaaattattttttgtttctcttcaatactgatgctggtacatgaggaaaacagaacaagcataattggactgaatgagggaaggtggcaatttgcggaggctctgcaggagctcctgggaatgctggggacctggacatcccacgccggcctccccgtgtgccacagactcagctctgctccctggagcaggtttcatgcactgggacagggagctctggtaccccacgacttaaacacatagagcaaggcggggggggttccatgtgggcaaggtgaagagaaagcccacgatggaaccagctacagcacacgtgtgagagcgtgtgcctgtgagcacccatgtgtgcatatatgtgtgcccatgtgaggtgtatgtgtgcaggtttacactaacatatgaaacagagtgagtgctggggttgcaaagacccagaccacaaagagctggtggcaaaggaaaagaaacatgcacactcccaagatctgtttcacagcagaacccactccttcctgctcctgaggggcgaggcaagaggtgtcgggccatgtgggtcccatgcaggttccaggaaggacgttcactcagcagagcaggggaatggcaggctggggggagctagtgatcaagtgccctcaaaacatacacgtgtgtgtgtgtaagcatgtgtacggatgtatctgtatgcggatgtgtgtggccacatgtatgtatatgagcatgtgcatgggggtgtgtgtgtgaacatgtgcatgggcgtgggtgagcatgtgcacacaaacaaaaacaaaccacaacagactgtgttcaaagcgagaggatccctaagctgcgatgagggaactgaatttaatgtcctaggttacagcccggccaacagctgccccaaaccatgcctgacacagcaaatttacagacacatcaccctacagcgctcaggtaacggcttcccagccacgccccattacccacgtcccatgctgccatccaagaaacgctccagggaagggaagccaaggctgtcagttcacatctccctctccagagtcgagctcaagcccgcggctgccaccctccatgaactgatggggaagggggccacaggaaggccccaaccccatccagatccaggcctgcgagcccaggggtggcacagaaacagcaggtgttccctgagagaacgacccagggctgtggcaaagccccctccaggctcagctcatcccacctgtggggaaggcaccatgaggcctcctcacgaggcagacgggtgtttgctgtggtggacagatgcccacatctcacgcgcagcctcctggaaggcagcagatgcaaacaccccagctgagaggaggaggctgaagcaagtgcaggaaagaacaaaaccaatgcaccactggaccatcacctttagagaaaaaggttaagaaatctgtatcacataaaacaacctccaaacaccaggctcgacgccctcacccaccacctgccctctgctcatagaaagaacgtggtgaacaggagcatattttacacaaacacatgcctcctcccagccacgctggctccaacctactaggcacctggaagctgaacgcatcactgcactcacacgtgcctaaacacttaggtgcgccgagaagcccaggcatttggggtttccactgacaaggacacggaaggcaaaaaacccaaagcaacgtgggtccttccctctgaagggtcagataaaccggcttattttattcttagaataggtttttgccacagtgaaaactgaataaacaacaaagtcagaaaggggcgtgtccatccacagactttaatcctgcattaacagaggctccctaaagaagggggtgccggagggaggtgcagaccgcttcagggttggcccagcacctgggtggtgcccatgcccccagtgtaaaaagatcctcagctcgtcgggcacgaccttgctttgttatctgctcttggcctctgtccattctcaagccacgtcacgtctctatgaccaggctcttagatgcccaaaagcgacattgggagaggaaactgtcagcccccagcgtggctcctgtggcttctgagaagccccagatgtcaaacaggcatcagagcattccagtcacgtgccccacagagtcatcacggagacagcagagacagccatgagatttgctcagactttcagcaaacccccaccgatgcctccacactggaagttggagcgtggtggaccgtgcgttataataaagttgctattgtatgtgactttgatcctacaaagaggaaaaaacatgggtaaaaagtaagaaaagaccaaaaacgtcactaaacttcaaaaacccgggacatgatgtgattagaggaacagcatggaacatggcaaaaaatacataacaaaacaacaaaaaccagcaacaggcgcttcctccagacacaccacggcacacttcaacctgttccttacaagactacattgagcgtgctggtgttaaatgcgtgcaggcttccgtgcaggagccctctgcacatggcagagagaatgtggcccgtgctgcactctgacgcgcagaccatcttgatggctcagggacggccaggctccaccacacctgctccctcctgactggcctctctctaccaagccagggacaaggcctcatccccagaaccaccaaaggattaacttaaagcaaaacaaacacaagcaaacagaacagaaatgacttgggttcctgtcactttgtgctcccaagccattccaagagaccagcaattaataactcgcaaagaattagctcacctccaacaaccacgggagcttgaaaaccacttccttccctagttttgttacttgcagaatgaactgattctcaaatccctggagatactgggctgagtgcatttgtcctaattacagcaacatcatcttcctcagtgcaccctcgctcacagggcagcgcccaagatctgcactcaccaaagtgagcctctcacagatggaatctgtgcaaactttaagtcccaacaaaactttgccaaactcacttgttgagcaagaagctcagaaatggagatttctaggaccctccgcatctggctgcaaatcccagacacaaaccatccaaggagatcgcacctttgccttccactgagtggcccaacgtggagtgctaggaagccatcaggagccagacagacctatgtccactcccggaggcaccgccaggaccctgtcctgcgtgatgggtctccctgcaacacacgaggagtccctatcccaggggccagaggggacgtcccgcagagaccgtcctgaccccagccctctgcattgcaccaggtggacaccacagaagctctagcctgaggcaccgagccgtcaatcttccatcaatcgatgaagctctcacctataacggacatcctttcgccaccacacagcatttaccaagctttccagggtgccctgatggacatgctcacaatgcctcggggatttcctctgaagatgtggatgcagaatgaacaccatgaaaacacagctcccactccgggtacatcccaaagtcgcacgtcaggccctccgtgccgccgtcacagctgctctctccccagccaccactgcctttgctggggatgccttgcctgaagatgcaggggctaccctccctgggcctccactggccagtgcaggttgtgaccacccaccccccgggctccatcagggatggctgtgggtgcaggttgtggccacccatgccccgggctccatcagggatggctgtgggtgcaggttgtgaccacccacgccctgggctccgtcagggatggctgtgggtgcaggttgtgaccacccacaccccgggctccgtcagggatggctgtgggtgcaggttgtgaccacccaccccccgggctccatcagggatggctgtgggtgcaggttgtgaccacccacgccccgggctccgtcagggatggctgtgggtgcaggttgtgaccacccacgccccgggctccgtcagggatggctgtgggtgcaggttgtggccacccacgccctgggctccgtcagggatggctgtgggtgcaggttgtgaccacccatgccctgggctctgtcagggatggctgtgggtgcaggttgtgaccacccatgccacaggcttcatcagggacagctgtgtgctgctcttcatttcccaaacgcagtgggatcaggcctggctggatgtctgaactgcgactctgccccaactgctgccctcattgccgtaccccaagagcctccatccatcttgcaatggagctgccactcagcttgtccaccacagtccctcctgaagacacatctctgcgaagctccccccatcacccaggccaaagctagcctaccacgtcacacagtggccatctgcccgggcatgtttcacctcggctgtgcagaccctctgaagacgagacattctccatatgtttcttggctccaggcagctcatcgacagataacatcctgctagatcagcagagacgacgcctgcacgttgggcagcctgcacagccagggagggcggggtgggaaacgcagcgggagacagtgaggtgggggtctggaagtcctgcctcgagcctcgtcagcaggcaggcgtttcagtgttccccagaactacacctcagtatgccctcgcagaaaggagcacttcacacaacatctttagagaccagccacctccaaagcctctgttcctcctgcattgcctcccaaatgatctcccagcctgggaatgtcagattctcagattccatggggtattcttttctgtggctgttactcatgtaatctaaggaagtgttgaagttctgagttaccctgtagcaaaggcatatcttgttccttccacaatctggtcgaagaaaacagcagctttgatctcagatactcttaactactcagtaccaagggaagttgtgggctttgagccaaccacacctaatgtcaatgctcactccctccccattcagctgcgtgaattcgggtaagtttcttacatgagctgagccttgtttttcctttctgtaaattggggatttaaaatgcccacctcactgggtcatggtaagaacctgcaatgggagggtacctgcatttaatctgtgctgttttcgttctcctgatacagaactgtgtcagaatcctgctttctgcggctggactatttgtcaactgcctgttagagcacctggggagcggctggggctttctctggggtcagaccatggcactgaggacttcttgtagcattcaggtggctattgaaatcatacaaaaacaattaataggcaaccattagaaattaggcaataaagttttttcagttagttggtcaactgtgtacacaacacaaagcagaatacagagtgtgtatatgtcctcaaccatgattgtttttacataaagtgtttaaaaaaaaagactggaaggaaacacagtaaatcttaatatagcggctatacttgattatatttgggattttttctttcattttctataaaatgtctaagttttccatccagtttatttttaaaatctgcaaaagtacttcaaaaatgagtaatctaaaagtctggttccatactagataagatgaagaaaaataaaatttcagttcacatccaaaaggttgggaccttactaaccagaaccccacacataaccacacaaaacactcaaaacaaccacacaaagcaaccacaactccagcccataccttccatttagttttgttgtggatgttggcgatgcaatgccccaaatctcattaagcccatcaattaaaattcaaaaatataaaacatgaaaactaaaataaagaaggtctgaaatgccctttaaattttgctgaaaatcatcacctcctcctctgggtccagacagggctagacagaggcttgcctaatgaaagtgattgtcttagatttgaaactttgcctggtttcataaacttgatgatgttttcaagaaaataaacaataagaagttaagtaagtgctgccctgccttgtctattgtgcaccaggcacacatgaagacacaagggccttcccagcccactataacccagatgggactcaggaagaccccacaagggcctttccagcccgccattgacaagatgagactcaggaagacacaagggccttcccagcccaccatcaacaagacgggactcaggaagacacaaggaccctcccagcccaccatcaccgagacgggactcaggaaaacacaagggccttcccaggcagccatcaccaggatgtgactcaggaagacacaagggccttcccagcccaccattgacaaaacaagactcaggaagacacaagggccttcccagcccaccattgacgagatgagactcaggaagacacaagggccttcccagtccaccatcgacaagacgagactcaggaagacacaatgaccttcccagcctgccatcactgagacaagactcaggaagacacaagggccttcccagcccaccatcaataagacgggactcaggaaaacaactgagcaaacatctgtcagtaggacacgggtggagacagactgtgccccggactgaatgtgtgagtcctcccaaaactcctacgtgatggtgttaggagggccctctgggacatgactgggccatcagggtggagcctcaggatgggattagtgcccttataggaagagactcaggagcccaccctctgctcgcccctgtgaggtcccagtgagaagacaggcctctgcaaaccagaagcaggcgctcccagacaccaagtctgctggcaccttgaccccacacttccagcctccagaaatgtgaaaaataaacatccattgtttaagcccgaggctgcagcatatttgttatagcatcctgagcggactatgatgaatagcatagccaaattaggataactggagagggatggcttacaagggcaagggtcaggcataaggaaccacaggaagaggctctctagttcagcagtaatgtcgtcgttagcacccaaggcccaaacgaggaagcagagtcatgcatgagagtcaactgtcaggaaacagtgagctgcagcccaaggacaggccagcgggggctgtcgccagggaggaagtgcagtccacatgccgtctctatccaagctccagctccctctgccattctcctgcctcagaacagggaaaaggtgctctgaagctgcgctcccttccactcagccagagaagaccagcagaccaggggccagaggcaggtgagtcaggacagaggtcaaaggacccacagacctgtgggacacagagcaggacgtggagggtgggcaccccgcagagcacccggcctcatctgccagcccagcaacgagcctggactgtgctgcaaactcgattccttgcatataaatgtgaacattaggctaaatgacccttacattaccagtttatctcaccagcgctttcagcctatttcttatttaggtctctgataaatgacttcatctttatttatgaatgttcctttccctgtaatatttgctagcttcaccttgacctcataaatgtaatttgttgtttcaaattctagtagcagaactgcattttaaaatgctgaaaagccatcactttagagctggtgagagaaaacattactttttttcattactcatttcttctagatttggaagcaaaatctggctttccaagcacggaaggagtagaccaccacagggacagagggtccccctgtggagctctcttccggacgctggcggaaaagagcacagctcgtgcacctttagaatcagtgcccctttttaggggccccctgtaagtggctttgtttctggaaaatgtggggacacttttcatactcgacgtagcccacagccaggtctgtgcaccgcatctcggaaagtgtttcgagacctgctcgtccggtgactggcgcacgctgcgctccctcacaaacactaaccccagtggttctcctcccagcactgcccctcacccctgcgcggcgtgtccctctgggaatccactcgcaggcgacctccagcgtgtgtctacttgctgcttctgtccctgttaccaccaaggctatggctgcaagtttccaaggaaaaagcgcagcctccgtgggtcgtgatttctgtggcttctataatgcgtgtgtgcctctcccagccgtcacacatggcgtctcaagtgccccagcccacccatgggacctgcagagacgcatcccagcgccctaggcactgagaataggtgggcgctcacctgacagtggcctcccatcctccactgccttgagccctttcccatgcactgcactacggacaccccagccactacctcatcccaaaagcaggcggcaccacggggcgggaagaggaactcaggtccgtgaacacctgcctcgtgcagggccctgactccagtgattctcgcagcctcgtaaccccaacaacaggccccggagctcagctttttattcccacttcacagatgagggaacgaagacacgacccacccaaactcacaggtgggcagggggtggtctgactcccagcccagtcccaggacctgctggaagtgaggcagcacgaaccccccagggctcagctctccaaatccaaaatggaggggtttcccttcacccctcagcgctctggagggaacgacaactgcagattccaaggtgtttcagggaaaagccatgccccccgtgtcagccagcacagcctgcaacgaccacactggtaacaaacaagtaactgtcccattttccctgaactatgtcttcaatttcatctaaaaatggaactatgaattccaatgagtcagagaatcttttaaaatgtatatttaaatgcactaagatattgagttgctatatatcacattcaccctctaggcacctgaagacacaagtgacagcaatattggctgtgtgcatttcattaaataggtttacccccaaaactgtccacttgccttttaaacatccttagggttgctgccttcaaaaacaagccttttgtttccacagagaaatgcatgcaagtggctcctccctgcaaatcagaacatctgaccctggcccagcaccggactcctgtcctggatgtggtctcaacagcacagccttggagcaaacccagggagctcgaatgagtgacggtcctggtgtgggttcagccataacctccaggacagatgagagcaggcacttctaaagggtggcccttccgagagggaaaggcctggagccttacgctggagcatgctcactctgggggtctagcgccgagtcccgggtcctgagggacacactgtgagcctggagttggtgacggctggggacatactgtgagcctggagctgatgacagctggaaccggacggtgcactgtgagcctggagctggtgacggctggggacatactgtgagcctggagctggtggctgctggagacatactgtgagcctggagctggtgacggctggaaccagacattgcactgtgagcctgcagctggtgacagctggggacatactgtgagcctggacctggtgacggctggaaccggacggtgcactgtgaacctggagctgatgacagctggggacatactgtgagcctggagctggtgacggctggggacatacggtgagcctggagctgggactggctgggacaggctggtgctgtgtggtctggtcagtgtccccacgtggctgctgcagcgggtgcctgagtggcctttgcagtcacacacaggcagggaccgggtcccatgccctggctagccaagggcctcactctgcatttcctcatggttcttgtctctgcagccgggggctcccaggagcctcgggcccaccaaggcatcaccctccctttttactccaagcgtattagggtctcctgcccagaagtcactgtcaatgcccttaacaaaaagggctgtcagcccctccctcgggccagaggagccctggagagctaaggttcctggggctgcacaagctcagcccccagcctctggggctccatggctgggcccagctagagagtctataaatgtggaggtgacgtgctgggtctcggggggcaatgaggagcccaggctgggccccccacctgtgctccatgggaggaaagcacatggccaagggggggtttctttggaggtggctctgctcccacccatgcccccaacacgcgtaccctccaaagggacagcagagcgtcaccaccccacatccagacgagaccacaagggaccctggggcttcgggcaggggtggggtcgccccagggcccaccgtgtgtgtctgcatggaggaagctctaacacctcccaccgccaaggtctcttctgcccttaaaattccatgagcttttccttcagtgtggaagaaccaacaagttctcggggcctccatcgacctgtggggttagcacttcggtttggctttctccattaggtcaccaaggccaatgtgccccagtggctggtaacaacgtgtgccacgtgtccagtatttaccgagcgccaagcacacaggtgctgcccacaagttaccttctttaatccctactaccacctgcaggataggaatccacttttttgcagacgggcagctgaggctcggagaggttaagtgagctgctcagggctgcacaggtgctaattggcaatgctgggatttgaatccaggtctattctgaagcctatggcctttctatttgccacaaatcatctaagtattcataaacactagtgtgcctggcacctcataaatcggtgcttctcatgtttgtcttgaagacatagggtaaattttttgctgtaaatttcaaagggacattcaaattctttggtttctctagggctttgatcatcagcacgtgcttggaactgtcactcagaactctgggctgtggtggcatttagtgcactgagttttgacctgtcctgagccctacaaacctaacttgttgttttctaaaattaaggccaaaatgccagcaaagcaagcattattccacccggttacctgcccacatctgcaccagacactgccaccgagggtccactggctccgtcctctccctcgtctgtggacctgaaacaaacatcacttccaccctgggcaaggtgtggctcacacagaacatcttcatagtaggaaagctggcttcggttctcagcagtgaatattcagattccacagccatctggctgtcatttcacaagctctttgcaaaatctggctataattctaccaaggtacgaacgttagttaatctgttgaagacttagctaagtgaactaaagaaaattaaaacacttgcttaaagcttgccgcagctcagaacccaaaagggctgcggacgcataaaaggggaagtatcagaggagaaggggccaaggccgctggggaagctgagagactgcagagcaccacgcatgcgcatcacacctgcttccaattcagggagctcagaactggctagcatgaggcttgttaagtctgttcatgaagtaaactggcctagctcacttcagaaaacagcaaggctttattacaaccatgaattaacagactgccaattgatatgctaattactaacatttctatatatttgtcaaataagatccctaaggaagaagagacaatgtgactatctggcttgagttacagtctttaacaaaataaaaccatgagttttctagatttttcattaattcaaaccagccccttctttttttgttgttgttgttttgtgttttttgtttgagatggagtcttgctctgtcacccagcctggagtgcagtggtgcaatctcggctcactgcaacttccgcctcccaggttcaagcaattcccctgcctcagcctcctgagtacatgggattacaggcgcacgccaccatgcccagctaatttttttgtatttttagtagagttggggtttcaccatgttggccaggctggtctcgaacttctaacctcaggcaatccgcccacctcggcctcccaaagtgatgggattacgggcgtgagccacggtgcctggcctttttaaattgatttcctactcttactgggacataagaaagctatgcaaaattcttcagtgcatcagttatgggaaagaaggaaccaaagcgcagaagggatgtgcccagcgccatttttaaatgtagctgaagaggctgcagcagcgtccatccctctcccagcggagcaacgctcaacccaagcaagtgagctccctctctgtcaaaaactctgcaagcaattttttcctctccttctaatattaaattgtttctgagtttgtcaaatactcacaagggaagttttctacgacattgatgtgggtcaacagcaagtccatgtccctgggttctgtttgcagaggaggattcctttcccatctgtcagggcaatgctgtggaattccaaagcccactgtctacggaacagccagcccattactggacatcaaaatgcctggacttctgagctccaaagggcatcaggagatgggggagccgcagagaccacaaagccccagctctcagctcccacgtcctcaccgcaccccaaagacagggaatgtcatgcgccgggttgggtcagaataaggaaaggttagaaactcttattttcaaaatagtctagccacagttttcttaatgaatgcctttatcagatttcatttgaagaaaaggtcttctgctttaaaaaggctgctcttgttcagtccattcgcttttcaaacaacaaaactgaggcccaaagaaatgaggatgtggctgcagacagcacccccgagcacggagctcaccttagtgggttcaatacgccagacacacctgcctccaaccctccccaccccgaggctctgaaggtgggtgggaagaaggaaggcccggagggaagccgccatcagctcagccacccacaacggccgccccgccggctgttcccagcagggctgtgcccctctagtccttggatggattttgcagagccttctaggaggcctgtctgccacacacgtagctcaattcagttttgcactttgttttccttcttgtggtaactaaaaacactctggcatgtaattcaaaaacagcattgagggtaactgcataatgtaaaaaaactgttaccaagatggcagaacatttgaaattatatttgcactttgggacatacagataaaaatgtgatcttatgttaagtgctgcattttccaaaaccacgttaaatttatgtgtgaggcctcgttgaacatgtagtaagtggatgttcttaaaattggctaattccatgtcaaggtttcatcagacatttcatctaccctctaaaattagtttgtcaaaatacacacacagttgagtcaatctctttcctcacaaaaatctactgagaccggatcttgtctgggtctcggagcccaggacaaggaaaggggtcagcctcccggctaagctgcctctgcaccaggctgcccctgcccacaaggcaaccctcaagaagcagctccgcactgtgggtggactgagccactgggcattcctccctccaaagggtccaaaaaccagggcagccccaactggccgggaaagctcctctgggctctgcccctctgcacggcaccagagttgtgcaaggaagcagaggaggcggtgagtgccccacgctcaggagtgcacccggtggagggggatatgtacacccgcctgggaggggccagaacccagtccacactctgcccgcatgatctgcctctccccaaaacagactatcattacccggtgtgactgggccaatgaacccaaaaacaggaacggcaacgttgactctaaagcaagcgtatccagcccacaggccacggcccacgagatggctctgaatgtggcccaacacaaattcataaactttcttaaaacattatgagattttttggccgggtgcggtggctcatgcctgtaatcccagcactttgggaggccaaggcggatggatcacttgaggtcaggagtttgagaccagcctggccaacatagtgaaaccctgtctctaataaaaatacaaaaaaattagcctggtgtggtggcacatgcctgtaatcacagctacttgggatgctgaagcaggagaatcacttgaacctgggacgtggaggttgcagtgagccaagatcgcaccattgtactccagcctgggcaacaagaaccaaactctgtctcaaaaaaaaaaaaaattatgagatttttttgcaattttttaaagctcataagctatcactgtgtgagtgtattttacgtgtggtccaagataattcttattccagtgtaacccggggataccaaaagattgggtgcccctgctctagagtgaacacagaagcactgtctggggcacctgttgtcctggggttcaaagccgctgccaccttcttcccttgcagttttctgctaacacttacacctgcccacactggtgctcacactcacgtgatcacacccactctttcttcttgtggaaagccccacgtggagcagaggggcatctggagctcctgcccagaaatgggaaggtgatctgcatcctcccaggccccctctggaagctccaggtccttcctgactccagcccagccccacccacggcgaggaaggcacctgctcggacacacctgggagctggctctcacttccagcctcaacatccaccgggtttttctggacttagctggctttcactgattttttcttttttgctaaaaggaactagaagatataaaacctcagagcctctatccacccagtcttcatctgagaaaagcacaaataacagattctttcagtttgcctgtgtctctcaccactaagctgtaagaagctccctccaaatgagaacgtcacacatgcagggaccagtcctgtgctgcagaccgacgcagtgggaggccacatgcgttcctcagcagctgcaaatacctgtttcttattcctgttaccattttctcgtattctcaagtagaactgtccctacatttcctttccttttctgcacccttccaggatggatgtgggtcacttttccaccctgagcagccgtctgcgggcctcagggtttgcgctattctggaatatcgttggtggggctgttcacaccccgctccgtgtggctgatgaggagctgagggccactagtcttgtcttggtgaaatcacagagcaagtgaccagcacattctctgaggctctggagttgctgtcacccccagcaatcctgtccctgtttccttcaaaatttcaaatcttgccaggcccagtggctcacacctgtaatcccagcattttgggagactgaggtgggcggatcacctgaggtcaggagttcaagaccggtctggccaacacggcaaaaccctgtctctactcaaaatacaaaaattagctgggtgcggtggcacgcgcctgtagtcccagctactcaggaggctgaagcaagaggatcgcttgaacctgggagacagaggttgcagtgagccgaaattacgccactgcattccagcctgggtgtctcaaaaaaaagaaagaaagaaagaaaaattcaaatcttaattacaggactttcaaaattccaggaggtaatttacctccagcaagggctggagaccaaaaaaactgggccaacggcccacaaacacgtgagccaggtgaagggtcatgcagaaaagcaggactgggtgtgagcatgaggacaggaagggggaaggggctggacacggcctgtctcctccctgagaggaaccatcagggagcctcggtatcagcatcacactcctggtgacagggacagagacggctccttccactggatgtacagagcgcttccagcagcttgagcttcacgcctgcccggagacggggtccgcgaggtgccagctttgcactgtcaaagggaatccctcccaggggaggacggactgagctctcagagtcctttgggcaccacagcccggaatggtgctggaatcacagccgccgggttaaggggctcatggcggaggcaagccccagtgtcccaggcgccatgatgtctaagtgactatagggccatgaagaaggggcctcctgataatccctaccagcagccaggaagcaccctgggaagcccatcgcctgttgccctcccaggccacaccttgacgtgggaggccacgggacagacgccacctctcccgagtagcaggtgggtgactacagaggtgctctgagggtcttaggcagagctggccatgcttgccttggtgaagaccccagccaccagcctgggaggcccggtcaccccacggccagcgcctgccaagttcttgtgagttgagcacgtctcacgtatgcaccaacatgcagatgcacacacagggcatgggcactccagaggggctcagcttatggttaacgctggggctgccttcatctcacgcatgctgggcagcctgggcacctggggcagggctgggggacagcccagccatcttcagggccccaggtgaggccacagccagcccatgcagagctcagagctcacggcagagcggcacagaaagaagctcagacccaggccctcctgccaggcaaggcccccggactcactcaccccacaccaccgatgtcaggggttctgtgcaggcaaagtggccttctctttgtattgattttgggggctttgttttttttaactaaacttttttttaactgtggtaagatgcacataacataaataaaatttactatcttatcagttttaatatacaattctgtggcattcattacattcactactatacaaccaccactgccatctgtctctcaaactcctttcattttgcaaaattgaacttcattccctgtaaatgctgactccccagcccctggcacccccaatcctatgctgactccccagcccctggcacccccaatcctacgttgactccccagcccccggcaacaccaatcctactttctgtcgctgactctgacaacactaggggctgctataagtaggatctcacagtgcttgtccttccgtgtctggcttattccattccatataatgttctcaaggcgcacccatgctgtcgcagaggtcagggctctttgcgtctatttttaaataaaacaccagctctggcttcaagggaaaggggcctgttggaggacggaagaggcagggaccctgctggtggagactggagccctgggaggcactcctgggtcttccagtgggtccagcagaggctgattcatgctagaaacaagggactttccatgcagggtccaggaatgcctcatcagccccccaccgtaccccctgtccacctggcctttgaggctgaaacactgcactcaagagcactactctgtcccaatatcaaggcaacgcttctcaaggacatgggctggcccgagtatcagtttgcagcaaaaactgtgaagattaatcaaaagccacctcccccagggaagctgtgactcccaggcacgaccttgcccatgggggtcacccactccgacccacaggggtggccgaggacctggatcccggggctgtgccatccctgcctccaggccagacatccagcaggtttcccaggaatctgcacacaagatgcagcaccctcggctcagactcaaagcggccagcaggagcaggcgacatccactctgcattgtccatgctctcctcatgtggatgaggagcaggaccagcactggaggagatcaggatcctgtcacaatgtaaggtcatctgtgcctagtggatcagacgctgtgaagaggagtgtgtgcaaacctcactgctctgaacggccctgatccaagagcagccggccccgattgtctttggttaccaggaaatgttagcagatgcagtccatgcactgccaccgaggtcactggtgttccttttctctttcaaggcattggtcaaactgagtgccttccagcatcttccccagagagcaccacccacaagggtgcacatgggctctgccatgctcccgttcctacctgccactccaccgagctccgcccgctcttggtgacccctcagcgatgaccagggggctcttcctacaccaaagcctctggctgcaagcacatttcttcatgactttctctttcttaaaaatgagtgtaaattttgcactcttctttgtaacatatgcctgtgtgccttttatgataaaggtgttttcttccttttcatcagatacactggatgctccaagaacaacacgggttctccgtgtgacttcacactcccccagcatgactctaagcccagtgtgggaccagcgtgaacccaggcggcctctagaggggaggcaggagccgccctgaccaccaaagccagcgcaggagggggctctacaggatgatgtgttgagtgggcacaactccacaaaggagaggaaccgcagtccgtgccaacagcctttcccaggaaagaccttccgggacctgccacccatctcctccttggcaagaccaccccagcccaggcacggccaacgcccggcccccgcttgagttggccttgagctccctccaaagaggagatgcagacagcagtgccaccccaggggggccgagggagcaggactgagaagctggttttccacaggttcttgtcatccaaggcgagcacaagcgggaaagaatggggctggaatgttgggagagaagggagtgtgtgatcagcattgtctgcataaatgattcaggctttttttaatgaaagaatcttatttttgaaactgaagttgacataaaagctcccgaagtgaatcagacggtggtggcttctccccaccatccactcggcaggggacagggtctccacggggagctggtcaccccacgtggacgccgtgccctgcctcctctggcgagctttgtgttcaccgggcggattctggcagacaccggtcccccagttgttgcagcgagactcagacccaacccctgaaccccagggatggcgcctcactgagtccattggatccgcgaagggcaaaggggcagccgtgaataggtaaaattcccgtaagctacggaggttctgctggctttgtcttctcctttgcaaaagcaaagtcctgcggaggctgggcttcgcctgagcgctcgctagggtggaggaagcagctgtgggcctgcagccagggctcgctccaaacgctggaagctccgcctcccagaggagatcagcccaggagtgggagtgaagaacttcgctccatcacaaagctctgaaatacagatggcttcggaaaaccccgtgagaacaccgattcactcctcctgtgagatgggactgcgtgtccccagagggctggcaactggcctccaagttttcctcttcctctttcttcctcccaagagcccaattaagaacttccagagtttagaaatgacttgggttgattatgtgtgcatgacgtgacctcactagacccagcacgaaagggaagcaggcctgggagccctcccccttgccctcgtcctggggtctgtgccgcgcctcgccgtcctcccctggaactcggggctgggagaggtcggcgtcaggaaggacctcatggggctttcacacgagagcacacatcctcagagccccccagcctcgttctgaaaatgaaagacggagatagcctgtgctctgagggctgcgcaccaggcgtcggggtggagattgactcctcgagctcctcggagccccagcgggtgccactgcccgccggctgagcccacgtcccgataggaagcctggggcgctcgcaggaagggtcacggatgctgcccggctccccaccagcctgcccctcaggacatctcctgaggctgccactgggaaagaacaaacttgggaatccaagatggagggcagcaggacgctcccacatcccccactggtcacttttggaagccatgcactcggccccagggcactaggcctgagtgctttaacacccagttcaggtgcctcccctaagacagggctgaggtctgggcagggagaggggcttgcaggcccacaggcccactcatggctggcgtggccacccacggagtctaactgcaatgactgagaacacaggcctgcccgaggctccccgggactcagccaaaggctcccagacgcctcccaggtggtttgacttttgcatctctgggaattctttcagcctcttcgtttattcattttacttcccctttacttgaggtggctttgttttcttttcaatgtctaatctatttctctcataggcgtcgttaatgggctgggacctgacttcctactaagtgtaattacctcgtctttaagtgcccttttcagtttttaaatcctgctgctgaaatccaacactggggagatgtcgtgaagcttttttaactccatcaggcggccgtcgcgcttcccttcacgctttccttcacccctccacggacatctggccctcatcccatccatgagtgacccacacagcacatttccagaactggcatttgtgacaggacacagcagcaaggaggcctgtccaccagcagcgaccgtgagcacggggcccttggagaaggagggaggcatccgcaccagctgctgtggcagaacaccagggcagggcagctgcaacaaccgacactcgctttgcacagctctgagactggaggtccaagatcagggtgctggcacagctgggctctggtgagggccctattcccactgcggatggtcactgccttgctgtgtcctcccatggtgggaaggaggagggcagccggctccctcatgatgctgtctcatggtcttgcctcagagccactctcgtgacctcacccaaccctaatcacctctggaaggccccgcctcctaacccatcccatcagggtggggctctaacacatgcatttgggggccccagctcctaacccatcccatcaggggtggggttctcatgcatgcacttggggggccctgcctaacccattgcatctggagtggggctctaacacatgcatttggggggccccagctcctaacccattgcatctggagtggggctctaacacatgcatttgggggccccagctcctaacccatcacatcaggggtggggttctaatgcatgcatttggggggccctgcctcctaatccattacattgggggtagagctctaacacatgcatttggggggccccagctcctaacccattgcatcagggtggggctctaacacatgcatttggggggccccagctcctaacccattgcatctggagtggggctctaacacatgcatttgggggccccagctcctaacccatcacatcaggggtggggttctaatgcatgcatttggggggccctgcctcctaacccattacatcgggggtagagctctaacacatgcatttggggggccccagctcctaacccattgcatcagggtggggctctaacacatgcatttggggggccccagctcctaacccattgcatctggagtggggctctaacacatgcatttgggggccccagctcctaacccatcacatcaggggtggggttctaatgcatgcatttggggggccctgcctcctaacccattacatcgggggtagagctctaacacatgcatttggggggccccagctcctaacccattgcatcagggtggggctctaacacatgcatttggggggccccagctcctaacccatcacatcaggggtagggttctaatgcatgcatttggggggccctgcctcctaacccattgcatcaaggtgggtctctaatgcatgcatttgagcccccgccaccgcctcctaaccacaccccattggggtggggctccagtacatgcatttggggggccccagctcctaagtcagcctgagaagatcagtgagaaaggtgaccatacattctggcaatacatactgttttttaaaaaataatttttctctagagactaggtcttactctgtagcctaggctggagtgcgggctggagtgtaggctggagtgcactgatgcaatctcagctcactacaatctcttcctctctggttcaagcgatttttctgcctcagcctcctgagctaggattacaggcacccaccaccatgccctgctaatttttctattattggtagagatggggtttcaccatgttggccaggctggtctcaaactcctgacctcaagcaatctgcccacctcagcctcccaaagttctgggattacaggtgtgagacaccgtgcatggcccgatactttcataatcaaaaaagtgtctacatacactgacaacaaccagtaaagaccacacgttttgtgcacttgacatgtgcatccaagggctcctgacaccccagagaaaccctagagagtggacactatcctccgtgtctacacactcaggcttaggagtctgcaccagcctccctgtctacacaaacaggcttgggaatctacatcatctttcccatgtacacacacaggcttgagagtctacaccacccttcctgtctacacctgcaggtttgggagcctaggctaccttccctgtatatttccacagacttgggagtctacactaccttcctgcgtacacacacatgcttgggagtctacaccaccttccccatgtacacacacaggcttgggagtctataccacccttcctgtctacacacatacaggcttgggagtctacactaccttcccctatacatgaataggctttggagtctacaccacattccccatgcatatacacaggcttgggagtctacaccacactccctaagcacacaaaggcttgggagtctataccacactccctgtctacacctgtaggcttgggagtctacacgaccttccctgtgtatatgcacaggcttaggagtctacaccagcctccccttatacacacacaggcttgggagtctagaccaccctccttgtctacacacacacacaggcttgggagtctacaccacctttcctgtctacaccaccttaactgtgtacagacacaggcttgggggtctacatcgccttccctgtctacacatgcacaggcttgggaatttataccaccctccttgtctacacacagaggcttaggagtctacaccaccttccctgtctaaatacgcacaggcttaggagtctatatcacccttcctgtctacacgcagacaggcctgggagtctacgccaccttccctgtctaaatatgcagacttgggagtctataacacccttcctgtctatacacaggcttgggagtctacaccacccttcctgcatttgggggatcccagctcctaacacattgcatcgggggggctctaacacatgcatttggagggctccagctcctaacccagtgtacacaacttccccatgtacacacataggcttaggagtctacaccaccctccctgtctaaacacacacaggcttgggagtctataccacatttcctcatagacttgggggtctacaccaattttgctgtgtaaaggcacaggtttgggagtctacattgccttccctgtctacacacacacaggcttgggagtctacagaaccttccttatataccccatctcttctaaaaatacaaaaaattagccggatgtggtggcatgtgcctgtagtcccagctactcaggaggctgaggcatgagaattgcttgaacctgggaggcggagttgtagtgagctgagatcgcgccactgcactccagcctgggcgaaagagtgagactccgtctcaaacaacaacaacaagaaaaacagagaccgaaaccagagagggtccttgtgcaactttgttttctgtccttggtcctgaaaccaggagacaattggttggttgtttagggcactgatgattctttaccagtatggtaaagagggtaattgctctgggaggtgaaaagtgcgtaagaattttgatcagtatctgtctatctgccatctatcatctgtctcatattgctttatctgtgttctctctctctctctctcccattatttattttctgagggtagagccttgaatactgggttttaaagttcttgattgctctcagcttgttctgggcacagaggatttaaggaatatttgagatttgaacaaaactgaaaaaagaccaactctgctagtcgcggctctggcccccctttttggtggagggggagtgggatgtggggttcttcggcccatgcctgctgctggccaggcccttccaagacgcagtggcctgggactataggatgtggctcccccgatccagcgcaggagcacagcccctccatgggctgtgtctggaatgccgcacatagccatctctgccccaaacagcagccccctctatatgatggggttttcgctcctgccagcagcacagacagccgcctcacctccccagcatcctcccagggaggctgagcccatcctcacccacgacccggggacacgtttaatttatccggcccctcctcgactaccaactcccctcaccggagatgcctgcctgggccctgaattctgaggctgcccacagcaagcctgatacagagtcacacaccagatgcacattacaaagagcgtcacagtggaatgagaggaaagcctgtgagaacaaacggatctccggtgctcagcagactgatctactgcaaatcacccccgacgcaaccaccaactccgccagaggaaatcacaagttttccatcttcagcagctcttacgactgcaagatcccacagctgccttttgggggaggttggggcttatgccttagggcgccagtcaggtccttccaggagaaggcggcaccaagcccagcgtcgaacgaagcaggtccttctcccttcacaagcagcatccacggctcagtggtgcccctcgcccccaccgctctgccctgccttcctcgctgaaacctcccaacactgacgtcaccggggtggggcaggagcaggaagaggcccatgctgccatgtcccatcccaacacaggggcagtcctgctgccctttcgttctctcccattgtgcccttggcagaagaatatatttccactcaactggcatcttccagctgtcccccagacccagcctccctcagctcccatggcagggttaggggcacaagcaccgcccgtcaacccttcacagaagctggcaacagagtcaggaatctgaagggtaaagggagctcttccgccaacaggtggccggtgttgcttcccagcgggttccacccactgcctagcaggccatctacatggggcagaccacagagacaggctccagcaagctcaggatgatgaagacacatcctatcttcgaggacccagctcgcagagaacaaaatctgtgaacaataatcacaacatggcacacacaacacacgtcccaaaataaatcttcactaggtacagagttggcaccaaatggctttctcctacaaaatcaaaacagccttggaatgtccttctttactagatcaacagatggttgtcatagatagatagatagatacctaataggatagactagatgacagatatagatgattgataaatagctgatagacattgttagatgtgaaagactatgttctattgatagatgatgatagataatgatagaggatagatatagatgggtgattgataggtggatatagatgatggataggtagacgattgacaggtaaagatagattagatagatagatagagatgattgatacgtaaagacagattagatgggctgggcatggtggcttacacctgtaatcccagcattttgggaggccgaggcgggcagatcacctgaggtcaagagttcaagaccagtctgggcaacatagtgaaactacgtctctactaaaaatacaaaaattagccgggcatggtggcgcatgcctgtaatcccagctactcaggaggctgaggcaggagaatcacttgaactgggaggcggaagttgcagtgagccgagaccacaccactgcactccagcctgggcgacagagcaaaactctgtttcaaaaaaaaaaaaaaagatagattagaaagataagttatataaatagatgtttgataggtgaatggagatgattcaaaggtagataggtagaggatagacagaacaaaacctggtctcctcccctcagagaacactgcagctcccgcgcaggtcagacggctcccgggcaggtcaggcggctcccgggcaggtcaggcggctcccgagcaggttgctcccacgcaggtcgctcccacgcaggtcaggcggctcccgcgcaggtcgctcccacgcaggtcaggcagctcccgcgcaggtcagacagctcccgggcaggtcaggcggctcccgtgaaggtcagggggctcccgtgcaggtcgctcccacgcaggtcaggcggctcccgcgcaggtcactcccacgcaggtcaggtggctcccgcacaggtcaggcggctcccacgcaggtcgctcccacgcaggtcgctcccacgcaggtcagagggctcccgcgcaggtcactcccaggcaggtggctcccgcgcaggtcaggcggctcctgtgcaggtcgctcctgggcaggtcgctcccgcgcagggcaggcggctcccgggcagggcaggcggctcccacgcaggtcaggcggctcccgcgcaggtcaggcggctcccacgcaggtcgctcccacgcaggtcagagggctcccgtgcaggtcactcccaggcaggtggctcccgcgcaggtcaggcggctcctgtgcaggtcgctcctgggcaggtcgctcccgcgcagggcaggcggctcccgcgcaggtcagacggctcccacgcaggtcaggcggctcccacgcagtttaggcagctcccgcgcaggtcaggcagctcccgtgcaggttagacatcttttctgccatcatgggctctgattccccaacctggtgccatggtccactcagtcgcttcttggccctgcaggtacaagccagccagtccacaaaggtcacggccgccgctccgctcaacccgtggctggctgtgctcgggtgtgtttcctcacctctctctctgaagagctgagaacaggcccctcctggcctacgctttctcatcatgtagctgtatttctgggctcacacctttagaacccactgagatttctaaagctcctcctctagtgagcaacctgggatgtttgtgctcaaagaaaacagcgtttccagagcaccatggcgcctagaagtgggctggccaatgtggtcaggaaggaagggtgacttgggaccctcacactgactgtgcatggaaacccccgtggtccactctcctagtgaggcacctcgccctcttcccagcattcccagcagcactattgataaagctctcctggtaaggcacctcgccatcttcccagcagtagctattggttaacttcatagacccccttttaaataattctttgtatttttgtttttagagacagggtctcactctgttgcccaggctggagtgcagtggtatcatcattactcactgcagccttgaacttctgggcttgggggatcctcctgcctcagcctcccaaggagctgagaccacaggcaagagccaccacaccccactaaatttttcattgttctggagagacggggtcttgctatgttgcccagcctggtcttgaactcctggcctcaagcaatcctcccacctcagcctcccaaagtgctgggattacaggcctgagccactgcacccaggtcttttaaaataattcttacataacaggtaacttcagtccagacacaaatactaaattagtagactccaaatgtattgttggattgtctctagcctatggccatgttctcttctttagatcctgaggccgcagggtgcagctttccatttgtaaactgtccctggggtgctgccccagggggtgctgagcagtgaacactgcccagctaccagttggtcccagggacatgaaggcctggcacctgcagagcccagcggaggcagggtacctccagccaatatttccaggcacctagaggcaggtgtgtcctcacaaatggagcctgtgaaaaaacaggtgcagcaatgagggacccaaaggtgagcagggaaagagtctccataatttggcacagagaggagcaggattctcctcagtattcacgccaagccaggcaggtccttgcaccttctggatacatcagtgctagactaaaaaaaaaaaaaaaaaaaaaaaagcagtaatctggagtccttcctctggggtgccactcagcttctctggacaggaggctctcagactgcacaccaagagatgaggcccagaagacagagacctctcacctcttaacacctccccaggtctgaccaggggttaattatgactgtatgtcatgtttccaatgaggaggagctggatccccgaggtctgcaggcagcagggaggggccacactggggggtccagaggcccaggaagactctcaaacccagacccagtgaggccctgcctggccccagatcccgacagagcagaggccacaaagtgatggttctcccggagcccccagcaggaattcttccagtgcttggaggagattcttctctcatgttttctttgttcttcatcaccccatttaaaaaggaataataagaaaaatattttgtataaaaatgaatttctattgctctcattacacaatgttttcttaaagagaagcaaaaaagaagaaaataaaatgcattcaccacatcctactcatacttctcaacactgtaatattttaacgatccatatgaggtcataccatatgtacttttttgatacctgactttttctttctcagaatgacacacttccatctttccaggccaatacccagcctggcaggactccaccatgaggcacatccacttgttcacctgcctccctcttaccgaatattcgttcccaatgcaaataacgactgtcccatcgcagggtgcagaggagataggctgttcactcagcctgagcagttcctctttctgagatgtgaccacaggaggtgaccgcggggatacctcacccagccagcttttcagggccccctctgaggctgcaatcacccctgcatcaccttttggccccttccctgccactccctctcacagaagtgatgtcagtaaagaatggacacaggctgcctccctcatgactggggtccttggtcccagggaccctggaaggcctggagcaaagaaggtcatctgagaggtgaggcgatgtcaaagaacaaaatcctcccagctgttgtctccccacttacatatttttttattgtggtaaaaatagaataaaatgtaccatcttaatcatttctaaatcttcagttcactagtgttaactatgcacattgttctccaacagatccccagaattttctcaccttcccaaactgaaactctgtcccgattaaacactgactcccctttcccctgctccgttccactttctgttcctgtgaacttgatgattctaaccacctcgtatcaaacagcatttgtccttttaggaccggcttctttcactcagcataatgtattcaaaggccacccatggtgtagcacgctgaagactgggtaataagtccaccgtgtggatggatggaccacatcttgcttaccactcatccgtcagtggacacttgggtggcttctaaccttcggttattgtgaatagtgctgctatgagcatggatgtgccaatatctgtccaggtccctacttctgatggtttcaggtatgtatgtacccagaagtgggcgtgttttaacgcttacctcatatagtttctgatcatgtgcacgaacacttagagtaataggcaaatgttttggcctcgctaggggacaaatggggggtttgcttattttacatgaattgctggactgctaggtgaaagtggaactgatattctttgagaccctactaagtgtcaacatgcagagaacacaacgtgtaagaacggtgaccacttgcgctccgcgcgcaggactgtgctgggaccgtgtggcggttcctcactgtgtccccaggcagtctcacaaggcaggtgtggccatcgcctcaccttcagcagaaacccaccatgagcaggggcacatgggcggcacttttcatgaagccctttgagaacagacatcaaccatgtgaatgttactccttaagttagagccaaagatatttggtttgccaaaaacacatgactagaacactgcatcttgaacagctttaaaagaaggcagctgtcctaacctgcatcctcccagcagggtacaggttaaaaaacctaaagcaacgcagccttgcatcgaagagaaatcttgtccatatgttgttccttcacgtgtgactgggcatcggttgattaatctgatttttgtagtccatgcatgtcaataaggcccattcacatgtcagaatgtgcacagggttattctgttagtgtggcaagaagggcagggcctgggaatcgggagccctgtttctaattttagtgaagtcttccacccttgatcttgatgaatacttgatcaagtcaataaatatcaaagattaagaaagattacgtagatcgggacattagattacttaattctcatagttccttgaagtcagaatttccaatgattctagaagtaataaccccagtaattctcattactacttcaaggtatttttgaaaattacaattctgtaacacccgttgccttagaagtctccccaggtctaagagataaacccctgcctgagaaaatccccctgacagctcttcgggggtgtggggctccttctgtaaagaggaaaatgccgcttctgcaggacatgggtgaccttgagcaactgcatgttttctcaccaaatacaaggaattttttaaagaaaagaccaaatggtgttacacaccagaaggtttgggtgatatttcaattttttttattttaaagcaagtataaactttttctgataattcattggcttctgcactgactcagaccttgatgctctaattgtggcctcaagactggcagctttggcctccccagggctggtcagaaatgcagaatattgggtctaacatacctcagaaaatgcactttgacatttaacaatcctgaatgactcaaaagcatagcacaggtctgtgcacagtccctgtgcaagacaagacacttccgacaggggagatggcccgggccaacaccaggaccaaactctcactaggggggaccgtgccaccccccacagtagcagcagctctccctacctcccatccccactgcccgtggccctggaacaccacaatttgggtgaagcattgcagcccagcaagcgtggtccccaagaagaggaacactgagaggaagctcactgagggctgagacactgagctgcagacctgcctctctctcgtgcgaagagattcacaaaggggccaatgaacacatgtcttttgagatctcatgacctccaagagaagtctctctgtcaggaaatgtcttagctggaactgtaacagaatgccacaggtcgggtggcctggaaacaacagaccttgatttctcacagctctgaaggctgtgaagtcggagagcagggcaccaggagactcggcatcccaaggtcctgcttcctggatcatagatgacgccttctcgccatggtctcactccatgaagggggcgaggaagctctctggagctgccttattagtgactgatgagctcgaatcccatcaggagcatccacctttgagaccttgtcacctcccaaagcccccatctcctaacaccagcatgtcaggagctaggtttcaacacatgcacttgcggggacaaacacccagaccagaacaggaagagggcaaatagccttactcctccatctgccctttacatgaaaaatataatcgtggaatcaactgcggcaacagcagcagaggaaatgcaaatcaatgcagcgaaacccagggcctgtcagcattaagacacccattccacctcccacaaacaaacccagtgttatgttaaagtttcctattattaatagtccatttagcacttgaaagccacaaggctgattgtgcatgaagccctgtgtgcttgcttgggagcctgaaggagagtgtgttgagtgataatggcgtgaaggcaaagctcttggaagaccgctggcctgaatcatacgtgaagccttgccacgtcaggatcaatgacgctcccaggggcacatacctcaacagaatgggacacagctcaacaatcccatgtatggacaatgtgaattaactaaacaacaaagccttcatcatgctgagtgcaggccctttaaagaccagaatgtgtccccatccgttccagcattagtgcatggcagaggccgagagcggagtgtttcccacagcaaatgtttcctggcccaggaaaacctacattgagggggcagggtgtggtcctcctggtttcagagaaatcaaccacggccacagcctcgtccacatagagcctctcgaagccttgcacggacaaagaaggtatctgctggtgcagtgccaccgaagaagagaggtcctacctgaaacctcacagggaaatttgtgccttctcccaaggcaggaccacaagtttgcagctcgagaccttgtccagggtcctaaaatggcttcttggaaaatatgaaattgctgaccgatccccagcatcaacttcgccaatagccttgtgcttctcgttcaaagcaagaagtacccaagtggaacgcagatacggcacgtcagtgagaacaaaagcatcacaaaatgcaagtcttattactgcagcagtttgcaagttggccgtgatgtctcataatatgaagtttgggtgaggcggtgccaaaacccagctggtgcaagctaaaaaaatgaccaagatataaggccgtggaaatgcaacttgattacaacaaacacttagtggagctaatcacacagcattcagatgctcccagcccaccccgatgggagtgttggatgaagaatcctgcagctctcgccggggacatctgaacatccttgttagctcagggcacaccctctgcagagactcacaggcatgtggcgtggcagtacatgagcactgatgtgtgaggggagaagagaggggccttccatctaggggcacagtctccctcccttccccttatccctcagattgtgaagaaacaagtgaggtctttgattagatgcctattttttagggaatggtcttttctgtttataggatctatgcatagcatatatttctaagattggggtcattccttacacctggatttgttctccagtaagtggttagaacttgggctctgatgccacagtgcctgggatgtctacgaaacacacatcatgacagctcctgcatcagggggctgctgggatgattaaacaaaattatacaaagatgatacaaagaaagggctagggcagcacttgcggggggcacagccagctctggatctgagttaactgttgccatacgtcttgttaatcacaggtctagggactgtcccgtacctccacacaaagacctacctcattctttccaacagctgcaggatattctgtggtgtgaatatgatatatttaactaacctcttgcttatgaaaaatcaagttgtttcaaatgagtattatgacaaaaaaaaaggcagcaatgaacacgcttatgcaaacatctttgcacatgtgtgcaagtaagtttgtaaggaaaattcctagaagtgggatttgggggtaatagaattgtacattttgtgatggatacagccaatcgacctgtgagcagctgagctgactcccacctccatcaccaggacgtgaggctgccaggcaccacccccatcaccaacaccagcaaggccagctgtgcggctgccatcccagtgctcctgaagcatggaaccaacacgaagcagcacggggctaggcagttgccagggagccaggagacgggtgcatgccaggccctggccccagcccccaagccccctgcccacccttcatgccccaggaatacctggcttgactcctcaccttccactgcaccctccagctccatctagaccctttccctcagcatggcagcttcacccacacatgtttatttaaagcacaggcaaagaatgccagtggtaaggccagagggcgggcagctcagcacggcagaccacagatcccttctcagcccaggaaatggctctgtggcccatatcagccaggaaaatgaagggtcacagacgccctgctgggagctaaagagaaatgtgtgcaaatctaaggagaaatgtgcaaggctcgtgccttccctgtggtgtgtgcctgctctttaatgagagttgcattctcctgagggagaccctgcgcaggccctgccccacgtaacggctttacacaaactctaaaaagtcatcccagccatgcatggacccagggatgctgacaccattcagaaaattgtattgtggaggaaggcaaggatgaaacaaacaaggcatggaggcttctgctctataaaactatgaggttcccaggaacatgacacagtccgtgctacatcagatctgagtatcaggatccagccgtatttgacttttagagctgcaatctatacaggcatatttgtggctacataaacatagattatcagaatggaactaaatatgcagcttttaaatacaaccacaccaaagggaactttgcaaattaccgggaactttgcaaattcccaggaactttgcaaattacctctcatcctgagaggtgagacagagccagctctgggctgtggctggtcatctcaaccccaggtgccacaggccatctggacaccacctctgctgagcacaaaggtggacgtgtccccaaaatagcagctttgctcagaattccaaacagggcctcagctcaatggtgagaaatcttaactcggacggcaaacttcccgtctgggatctgcaggcttcaacaactgtcaaagcacgggaaaatccccaggaagaaagtaagcaaaggcacggtagacgccaagggtccaggagtcgccctctgttacttcatgactccaacttactttctacacacaagacatagaaaccatctcatgcaagccccccaggaaccctggaggcaggcactgttcccgtagttacccgcacgtctagagactgtcccacatctccaaacacagatctgcctattgtctctgccagatgcaggatattctgatgaggaaaccgaggcatggagcttcttaggaactttccacaggtcacctgacactaagcccacaacactgtcctctaaatatttaggacacctatattttcctttgtgtcagccatttctctccctttaaaaatctctccctgagattatggataattttgataactttgagaatcaataaaattactctttttatccactgacatcagaagtggccaagcttggccgggcgcagtggctaacacctataatcccagcactttgggaggccaaggtgggtggatcacctgaggttaggagttcaagaccagcctcaccaacatggtgaagccctgtctttactaaaaatacaaaaaattaactgggcgtggtggcgggcacctgttatcccaggcactcaggagactgaggcaggagaattgcttgaacccaggaggaggaaattgcagtgagccaagatcgcaccattgcactccagcctgggtgacaagagcaaaactgtctcaaaaaaaaaaaaagaagtggccaagctttagctcctgagcaattccagaagagactcagccatcgagctgactgtagcctcccgaggacaagctttgggaaacaggccccatagcgggcacttggcagccccgggccaggcatcctgccacaagcaccgcacaaaaggtactctgcaggtgactgggcatttaaaggactagggagccctggacacttgaaactgaagtcctttctcaatttctgaattccctcctctaaaggtctccatcctggatcttgttagagatgctatttttgctgttggccacccttcgcggggtttggtaataaaagattgttaaagtggggttttttttgttttgttttgttttgtttgtttgagacagagtctcactctgtcacccaggctggagtgcagtggcacaatctctgctcactgcaacctctacctcctgagttcaagcaactctcctgcctcaatgtcccaagtagctgggattatagggagccgctaccacaccaagcaaatttttgtatttttagtagagatggtttcaccatattggccaggctggtctcaaactcctgacctcaagtgatccacccacctcagcctcccaaagtgctgagattataggcatgagccaccatgcccaaccaaaagattgttaaagtttaaaaaataaataaataaaagtctccaaaggagaaaggatttttcattttcttcttcattttttctgaaggggaggaaggtaaggagaacagctccctgtgcttctaatttaagtatctacattttcacaagtccccattaacatagccaatccttaacaaaggctagaatgtgggactgatcaaacattagagaaagccccattgccctcacgggccacctgcctggcacacacctgtgtgcacttcccacatatttatggtgtttatcccagcgtttgctgggctggagaactggccattctgtcactgtgacaaacaggcctgacgaggccagccgtgcctgcgattgcattttccactctccaaacagaatctattagacatgatgcaagcagagattatttttaggaaggcttttcattacagtgatgtgaaatgtcaaggctgagactcagcaggctctatgcagacctccggctcccactcattaagttcctgccacgtgctacgcccaggctgggccctggacaacacaagtaggtccccaattaacagccaagttaattaactgattggaaacacaggggaaagctgtcttgggcggggacatggccctcgaggagcaagcggactgaaggggtacgggcatcgtgccgaaaggggtagagacagcatggtcagggactctgcaaggggagagaacatcaagcccagtgaacactgggggctgcacccccccacacctgatgaggggcagagaaaaccaaatggtgaacccccatctcacctcatcccacccttccttgctgcccaggtgtgcaagatggggcacgggccatcccaactccaagtctggcctggacacagaaatgaccaacgtgctaacgacagtcagaagctgatgagactcttatctttcctttattaaaaactcttttgcccaggtgcagtggctcacatctgtaatcccaacactttgggaggctgatgcaggcagatcacttgaggtcacaagttcgagaccagcctggccaacatggtgaaacctcgtatctactaaaaatataaaaattagctgggtgtggtggtacatgcctgtagttccagctacttgggaggctgaggcaggagaatcgcttgagccctggaggcaaaggttgcagtgagccaagatcacaccactgcactccagcctgggcaagagtgagactctgtctaataataataataatgttttaaattttatacctgcaaacagtatctagctcaacttcctcatttcaagaatggggaaactgagatgcagagaaaggagatgaaccgcccaagctcacacacaatatagcgaagccaaacttttatatgtcactcccagaggcggtaggaacatcacatgcttccttttggagaccttggtttggagaagaaaaaaaaaaaacagcttttagagtagattttctttttttgaactactgaggaaatctgcaggaaaagagggtcttcaaatactggggtaaatcatatgactgacttgtattacacaaagctgagatttataacaaatactctaaacaactactcctggagcaaacagctttcacctatcacactttacagaaatattctttaaaatagtggtttctatttttttctatctttttaatttcacagactaataatcttttttaacaaactggggtaacctacatgtaaagttgccaaatctttatgtgtgtaactaaaaatgtttaaataaaaaaaaaaactttcctatcacacttcttttaaaaattactaacattaaaaaatattcctccaggcacaggattacacctgtaatcccaacacttcaggaggctaaggtgggaggaacactttagcccaggagtttgaggacagtctggtcaacatagtgagaccccatctctacaaaaaatacaaaaattaagcaggtgtgagggattaggcctgtggtccccgctcctggggaggctgagacaggagaatcactggagcccaaggcatgggaggctacagtgagctgtgactatttggctgcactccagcctgggcgacagagcaagaatgtgtttcaaaacacatataactaactgtacatgtatgtatgtgaaatctcaggaatttaggtattttaaggggaatacatctgacaataggaatgcagcgtttccacgggttgactggcgctggccgtgccctggaggctcctggcccagggaggccccgtgtccctgagcgaacgcaccggctttgggttgtaaaccagggagtttggacttaattcccagaactcaatcaccactgagcgacctcgaaaaagatcacgtgggcctcacaggacgagggccagacccagatgcgcccgcttgggcggacgagactccctgacaccctccccgggacgtcacagcggaggaaggctaggagctcgcgcacgccaggctgtggggccgaggggtccggctctcagggtcctgctctcagggtcctgctgggcccctcaccaggaagaggggacacggaggcagcagctcccagcggcctcgagggcgccactgacaggagcgcggggcacaaggctgcccaacaagaacgcggggcgcgaggccgcctaactgacaggaacgcggggcgcgaggccgcctgacaggaacgcggggcgcgaggccgcctgactgacaggaacgcggggcgcgaggccgcctgactgacaggaacgcggggcgcgaggccgcctgactgacaggaacgcggggcgcgaggccgcctgactgacaggaacgcggggcgcgaggccgcctgactgacaggaacgcggggcgcgaggccgcctgacaggaactcggggcgcgaggccgcctgacaggagcgcggggcggcgccctcccggcctccctcagccccgcgccctggccagcgggtgccgctcgcagacgggggagcccagagcccacgcgccaaggccgccaggcctttcctccctcgcgttccctcaggcgcgtcctccacccgtttcccccaggcagggggaagccccgagaagccgccgcgccgggctgagatcgggccccaggctctccgcggagccgtctccaacccctgcaggccgacctgggcagccaggcggggagcgcgcagccacagcccgcgtttccgggctccgtgtccttctggaggccgctccttggccatgggccctcggtcctcgccctgagcagcgcgccggggtataagggacgccctcagaggcctccaccccacactccaccgcgctctgccaaccgggacaaggtgttttgctgaataaataaattaatacataataaaggctgcgtccaaccagatgaggacagaaccgagcgccctccagcaccctctcccaccatccatcctcacagacggactctgcaccgtgagaaagcggcttcggcagctccgacccctcaactgacgcgtctccccgtggtgggtcccgatcccccggccggctctgccactgaagcctctccctgtgtcctccgtgccccccgagtggcctgctagcccgctctcccacacagtctccttgatgtgaagtgtcacccggcttgctgcggcgtgtctccgccgtaacacgtgtataccggctcagcacgcggctgggtacggtttgcaacgccgagagcccgcggagaagcttgagcctgtgagcccccgtctccgaccacggactcaccgggaagcaccaaggagaaccgcctcctcaggaaccctgtggagctcatggcttttgtgactgagactaaaagcatccataaaagcccgacattgtggaaagacacaaacgtgcatggacctggttacctctggccttcctctgctcagaagcccacccctgcagagcaaagcccgggtcccggatggcaaagccatacgcaggagccttcccagcagccgccgccatggctgacgcactggcaggagccgcaccggacactccacctagtccctcttcaggttttaatccattctgttttatttcatttgattttatttcattttatttccaagccctgtggcaaggcttggaatattttttgtttttgtttttgcttatttttttttaattatgccgtgtgttggcacacttcatgaaaagcacctatttctggccaggcacagtggctcacgcctgtaatcccagcactttgggaggccgaggtgggtggatcacctgaggtcaggagtttgagaccagtctgatgaaaccccatctctacttaaaaaatacaaaaattagccaagcatggtagtgggcgcctgtaatcccagctacttgggacgctgaggcaggagaatcacttgaacatgggaggcagaggttgcagtgagctgagattgcaccactgcactccagcctgggtaatagagtgagactccaactcaaaaaaaacaaaaacaaaaaaaaacaaaaaaaaacacacacctatttctttttttttttttttttttttcttttgagcaggagtgaaagtattaaaaagctttagagcaggaatgaaaggaaggaaagtacacttggaagagggtcaagcaggggacttgagggatcaaatgcgtggtttgaccttttgacttggggttttatatgttggcatacttctggggtcttgcgttacttctcccctgattcttcaaaaagcacctatttcttaaggatccaaaaaaataaaaaccaatttcattgctgctgtttccatttcttggcaaaaattaggaaacacaactaaataaatatccacggaataaaatggtgcatttattcaccaaagtcttatcacacgtggagatgaataagaacttcccgagccaagaacagtatatacaacatggaaaattctctagagttattaagtgaattaacctcatgaaattctactataagataagcactaggaatgcactggaaagagaaaggtgctagtgagcttctggaagcacagaaggttctgaaaggcagggaaggttctagaaggcagaaaaggttcaggagcttctggaaagcagggaaggttctggagggcagggactctgtcttgctcgtgtttgcaagtccaatgactagcacatagtaggtattcagtacaatgttctgaaaagaggtttctctgtctggctgtctagttgggtggaaaactgatcctcttcgttcacagtgagatagaggaacctgaaaaggataaacatatgaattcccctcaaaatgttgttttgtttggtactgggtagtgatgtgaacaactgtggggttaacttaaggctctagttatgctacctcctccagagaagatccactttgccccatctagcggctgaggattccagcagccctgacagccctgacccaccagggcactgagccagctctgtgcctacgaagacagctgtctgctgaaccctttctgggtgcagcctgctgggtcctaactcgagtctctgaggcataccagggacctctgcccaacagctctccgaggctcctgatcaggaccggctgacacctctggaaaacactgaccctaagtgccacatccctacccttctcctgggtctctgccctctgactcatcactgtgatccttcattatttcatacattttgtccagatctgtttttggtgccagggtcattgactcccttagtccaccactactggacacagcactcagagatctttgccacttaaattgctttacactttgttcttcagtaaaaaattattaagctgatataggaacagcagtttctaaataaagatgagactatagtacatattatcagcccactgattttgccagtatagtaagcttgcaagtatgagtttatactttctgaatgatttacattttattccaactaaataaataaatctcactccatgacattttctaagctgaggaatagttgttaattcattttgaaatgttcttagactaagaatctaaatttaaaagagtaattagcatgatgcatgatgaatggacaagagtcttctgaggcacacagtaatgtatttcttccctcattttacttttataaaaatacttaatgggaattaatgatcatcctctggtacagatgcctcatctgatcatcaacatttctttgtatgtcactaacactatacccagctaaacaattcaagatgttcagagaaatggaggggggatgggaaagggaatctgcttcctagaaatgcagaaaacatcaactttgggtgctgaggaggccagaatagatttttaaataaagtcaaacaattttcagaaaaagattatgttacttgtgaaaagtcattcgttggtatcaattttaaaaataaagagtcagcataggggtcttcaatccaatcctagagtagcagagctagaagcggtctggaggagtgaccacttctcctttctgactgccagtgctcaccacagcttcatgtctctggggttctttccttgaaaatcaaccaaccaagagctcgggtctctgtccaggaaggtcaacagcaagtcactccccatgcctgggtctgaatgtccttatgtggaagttacttatgaatcgatgaaactggaccagagactcttttccagctctgagagtctgtaattgatgtattcatttattcagcaaaaattactgaacatatatattgacatatgcccactcttagatgtcctaaaaattaagcttgatatatgggctaatgctggagccccacgagaccccacagcaaatggcctcttgggatctggtgccagaagagtgggcccccttgtgtcattctcaaactatgctgcaatttccatgggcctgtgaagagatttatggattaggtgacccattttaactatacgtaatccagagatttgaaaagattcttagaaaggaatcgtggattgttaataagacaaatacaagaaaatctgtacttccaatgggagctcttctttagacacattttgaagtggaaagcatcacagttagacccacaagaaggcaaccagaaagattaaaaatcatcgttcggactttctcaattatagatttatgcatattttcagtagtgatgagcactgttctcagcatatattgtgcatcgagacagcaaataaccatagattgaagctctccagattagacacttaaaaactaagtatctaaaatgttattaatcacattaataaaaattttagtgaatacaaagaagtttttgtatcttcagcaaaatattttaatcattagtgatgtttaatttctcattctcttaaatttgttttgaattttttattataaacatacaatgagttcagtagagcacatatataacttgtaaataagaatatgtatccggtaaataaatgcacatttctgttggtggcgccatcagacactgagacactgagaggaggggccacaagggggatgaggcagaagcctcctgccagtgagggcccaagagccctgtccagggcttgggcttccttcctaaggttagatgtggggcagctctggcagaagagtgataggatcagattttcagttgtggcagttactctagccagaactggaaggtggcatggaaggggccaatacttctttctttcttttaaagtttgttctgccataatttaggccaaattcttcctctgctacatgtgaggactgcatgcccggcagcttcctccacatgcatcaggctgctggacaggccttgctggcacactgggtgggtggctccgtggagtgtcctgcctactgcaggatgtcgaacaacgtccctgtccgccatccacctagtcccagcagcagaggtgagagccactgatttacacggcagaactggccaccaccagactactcaccctcttctccttcaggctgcaaattaaaacagacttccatcctttcttcaaaggacatatttttcttcccttttgtcatttattttacacaggaaagtagcatcttttaatagtctagaagaactatttcaacatttggaacatgctaacaatatacccacacatggtagaatctttcaaaatgaggctttgattttggagttcgtacttattttatctacaatctttgtcaaacatgttatcttatgtgaaatcacctgtaacaatctgggacattcttttttttcatagtgcttgacttaccctgaatatctgacgttctttcagagtgctatgaaaaatattaaatcattaaacaaatgttatatattatttaaaagtaccaataaaccaaacacgtcactttttaacatttgctattgactgatattgtcaataatgtagttggctagccccataagatgggttttactttttatcactgctcactgtagcctcaaactcctgggctcaagtgatcctcctgtctcagccttccaaataagtgagaccacaggtgtgtgccaccaggcccagctaattttttacattttttgtagagatagagtctcactgtgttgcccaggctggtctcaaactcttggcctcaatcagtcctcccacctcagcctcccaaagtgcttggattacaggcatgagccaatgtgcccggccaggttttacatctatatttcaacccctcagaacctgtggaggatacaagaggcataactacataagtatccaaatttttcacacagttgcatgtttttattttctcagaagggcactaaatcaacacatctcttgagaactacatcttacttcccaaagagacaaaatagttataaccaataataatttcagtattactagaaattataataaaaatttaaaaataagtagattgttttatagaaaactaaaccaagaatctaatctttatttttaaaaatattttccacttgaaaacatttcctttttcaagtgatcaaaatgcttccttcttgttaagctcacagcaatgaaaaactcatttaaaaaatgttctctgagtttgcaacatccccattccatatgctgtcaatactttccccgctggaagagcctgcctcttaccccaaataagcagcaagcaggaactcccaggcctgggtgaggtgtgtcccctggtgtggtcactcagacagagctgtgtgtctgcaaacacaccaagtcactcacagccaggcactgccagcccgggctgcctgcacagcaaccctgtcaggctcatgcagaagaagccgttttcagaccacactcgttttgcaagaacgaacatctctgtaaagttctgcttctgacgtcacagtttctctattccacacaactctgcctcaaagccttttttaagcacattccaggcacaagtgtgagccagaaaaagggctgaaaacatgaggggccctctcgggacaagccccggggcccacagcctgcaccaccagggacatgggggctgctaaggagcctcccaccagcacctctgcctgcctctcccgcagaggcctccggggagtaacatgctgctgatctgagtgaacataaggaacaggaacacaccacaaaggtcccacagaagcacagcatggggagccatggctgacagccagtggtcaagacagaggttctggagcaagatggaaatgcacagggcatctggctcccagtcctgcccgatgccacaaacaccatggggcctgcacaacactgagagctcccaaacaccacaaacagcatggggcctacacaacactgagggctccccaccctgcctgatgccacaaacaacatggggcctacacaacactgagggctgcccaccctgcctgatgccacagacagcatggggcctgcacaacactgagggctccccaccctgcctgatgccacaaacaacatggggcctacacaacactgagggctgcgcaccctgcctgatgccacagacagcatggggcctgcacaacactgagggctccccaccctgcctgatgccacaaacagcatggggcctacacaacactgagggctgcccaccctgcctgatgccacagacagcatggggcctacacaacactgagggctcccagccctcctgaatgccacagacagcatggggcctgcacaacactgagggctccccaccctgcctgatgccacagacagcatggggcctgcacaacactgagggctcccagccctcctgaatgccacagacagcatggggcctgcacaacactgagggctccccaccctgcctgatgccacagacagcatggggcctgcacaacactgagggctgcccaccctgcctgatgccacagacagcatggggcctgcacaacactgagggctccccaccctgcctgatgccacagacaacatggggcctacacaacactgagggctgcccaccctgcctgatgccacagacagcatggggcctgcacaacactgagggctccccaccctgcctgatgccacaaacagcatggggcctgcacaacactgagggctcccagccctcccgaatgccacagacagcatggggcctgcacaacactgtgggctcctaagaaagcccaaacagcaaagtgagcactcaccttgtcttcatttcctctaagaggaagactgttgtaacctgataaaacagacagataaaggataggatgtgaccacaggaatggggtccaccagagccaccgatccccaagtatgggatgtgatgacagggacagggcccatccagggcccacaggtctccccttggactctgacacaatcctaagtggatggagtaagggaaagggccctgtgcaaactctgaatagtgcactgggccctaacacagaccctgcactgcccggccacctccctctccccttgccatccccacaggccaggaagatgggcacagcaagactgcccacccttaccctgcaggccagagggcaaagcaagccagccagacactcacctcgcttcagaagagcaaagggaacaacacccacccggcaagctcgttgacaagaccaaaattcaggcacttaaaaacagtgcaacctagacatgccaagtatactaaaaaacgtgctctgaattttgcatttatcaaatattacataataaaacattttaaaagaaagtgtttagcatatctaaaaaaagtgtatgtactatctctttttattatactttctactcaaacttgtaagaaatttgtatgaatattatttaagtcacctttttttttttttgagattccagaggccaggcatggtggctcatgcctataatctcagcagtttgggaggacaaggaaggaggatcacttgagtccaggagttcaagccaggcatggtggcacatacctgtagtatcagctactcaggaggctgagtggggagaaacacttgagcccaggagttcagggctgcagtgaactatgactatgccactgcactccagtctgggctacagagccagaccctgtctctgtaaaaaaaaaaaaaatcatagattcaaagagtacatgtatacgcaggtttgttacgtgggtgtattgagtgatgccgactgttgggtttatgatgatcctgtcacccaaacgaggaacacagtacttgataagtagttttttgacccttggctccttcctccctcccttctttaggcattcccagtgtctattgttcccttaagtcctacttcttctctttttttttttgttgttgttgttgttgagacagagtctccctctgttgcccaggctgcagtgcactggcacaatctcatttcactgcatcctccatcttccaggttcaagtgattctcctgcctcagccccccaagtagctgggattacaggcacctgccactacaaccagctaatttttatatttttagtagagacggggtttcaccatgttggccaggctggtctcgaactcctgacctcagatgatctgcccacctcagcctcccgaagtgctgggattacaggcgtgagccactgcgcctggccaagtcccacttcttttattcaagggctttacagtcatcaaagggatgatgtgaaataaactccaaagggctgtcaccatcagttactctcatcatcacaacaaaaccaggcctcatccttattgatgtaacctgtttggatatgcctattaagaaatataaatgatattactctttaaaaggtaatggcaatgcttttgcaataatctctattgtcagttcatctgagacttggattttctaaagtaatattgtttctaacaataacaatattccatcctgtcagccaccacctccaacattaactgtagaaacctggagcatccaaaaataacaaccactatgacttatcagaaactctgtggttaccaaggactctcccacccatctcaggtaatcctctcaaaaacatgaagaaccaggtattttgctcaaggtgtaaatccagagagattataggtgaagtctttccatttctcttgacttctaatatgagtgcaagtgcaaactgtaaagattatctgattggaaagataaggtgacctctcaatctgtcaacacgctgcatggaagcagtactgtcatttaatttgtgctcttgaaacagccacatattccctattccctaccatatttgcagaaatcaccagcagtttctgactctgctagaatcctctttctatttcagtgaaaaagccccatttctgttaccttaactgatcataatttcatgttggctatttcatagaatcaaggaccataacagcataacaaagcaggcacatggatgccgcaagtcttctaccacaagaatgggtgccgctccataggaactgatggctgtgcttcccacagcagctctaaccacagctgtatctcagtgcagaacactcaaatcagatggaagtccagtggtctcaaccttggcctgttttcaggaaaagcagagaaagagattcaagaactcttagtaaaagagatgtgagggacaaaatggacttgaggtgggaagtcatcagacagcagctcctgccactgctttacctatgttccatcccctgcctccggctaagaaatggagcttgcgctggtgtgcacagttgagtcctctagaagagcggctatttcagagaatgtacacattgtggggtcagcctcaaattgtaccacagattaactgctgctttgagctggattaaaatcacagcctctgactgccaattttattagcggctccatccatttacaagttgaatgtatttcacatttggaaccagaattcacttgcatgattaatatgaagtcctttcctttcagaaaccaggtcagccttccttctgaaaattccttccgccaaacaaaccatttctaaacatgccctttgtgctgtatacagaacactgcatcagaagccttttcaaaatgacctttcagaaccacgtggtgacggagcacccacatcacatgatagaaaattctacactttccttccaccagcatagttcagaaaagagtagggagtccctgaaccaaccccctgcctgcttgccactctaaacatcaaacctaaacagaacctactcttaaataaatgttcttaggaaagtaatccctctctcatcccttattctgaagtgggtttttgttatgacaagtctgagatgagagctcacttctttggtgtttgtgtcaccacgtttttaaaaacctgacggaagcccagaaagcattcggaacataaaatttttatggacacatcgagtagtgaatcctaagggtggcattttcattccctgccattatgggaaggacaaaagtctccaaaaataagtcgcccatttccaaacatcaaaattccctcagaaggcacaccaaatatttgaatctgacacccaaaacaaaacccaactcagaaaatcaatcccctgctggtgccaaagagcactttaaaatctccgtggcctgaggttgagaagcttctaagagaaaggcagtttgacaagtgaaatggtccccactcctgtaagaacgagacagacgtccttgttctgtgcaaccagagagacatgttctgacagcgtgtagaatcctcggcccatcctgggatgaccactgggagagaaaggaggctccagagacctaggaccccatcccaggactacccaccaggtgtcctgtggtacattccttaaccactccaagactcagtctttctatctgtaaattgaagatagaaatacctatgcgggttattctggggaatacatgtcagtgaacatggaaggctcaggggttcaagatttgggggtacccagaggtacagggatgggagaggctgtcactgtgaagggagcacactgggaagttttgggggtgatggaatgatccgtacactgacagaggaggtggccacctgaatctatatgtaacacagtacaccaaaaaagaaaagtccattttactttatgataatttaaaattaaattttaaaaagaaagctccagaatcggttttgtaactattagttcatcccctgtcacctgccatggccttgaatcaccctcacaagacacagtcctagtcctggcactacccagggaatgcccttggttttctgaatcccagttaggactattagagggaacagacaaaaacaaaggaagtgaaatgccctcttaccacttccagagatgagagttaacactgagtaactgtcaccaaacactcatcatctctcgtttctttgtgttacacacacagaagccgttcaagacaaatgcagctcggtagtccgaggtccagttttccagctgcctgcaaaagccacccacttaccagcctcgtgatgtagagtgacaaacaaaaaaggtatttaaaatgtgcagaagcaggtgtttccaagggagcctcacccatttttacttcctgttctaggtatttaaatagtggctgtggcagagttcttagagataacaggaattaaaagaaaaaaatgcccttccttcaacacactgtttccacactgtttccaagcagcagaaaagtggattaactgttttctgcttctcaggttttctggccttctatcaactaagattaaaaaataagtccagctgggtctacatttatgaaggtcaacttaaactaatgtggaaagagctgccaggtgcttttatgtggtgtggagggttatctgccatgaatttagctgtttgctttctctgagaagtggaacatcatgtcaggaaagataagagaggttctcagccgaggctcatctggccttcgtctcttgggattcggctggatgaaaaccctttctgccatttattaagctttttcttcaccgctccacgcacaaagaatccttaaacctggtcgggcacagtggctatgcacgtaatcccagcactttgagaggccaaggcaggaggatcacttgaggccaggagttcaagaccagcctgggcaacatagcaagaccgtcctctctcaaaaaaaaaaaaattcatttttaatattttttgttcattttttagttattatatttactcatgaacccaaactaagacaaaacttttttaaattagcctggtgcagaggcatgtgcctgtagtcccagctattcagaaggctaagatgggtggattgcttgagcccaggagctcgaggctgcaatgagccatgattgcgccattgtactccagcctgggtgacaaagcgagactccatctcaaaaaaaaaaaaaaaaaaaaaaaaagaatccttaaactagtaatatttacacatatccaggcatatcttagatatctgtcacccaatgccagggagctattattagtttgggtgatgtttggctgcaaacactttttcatgaggaatttgaaattctaaggtaaccctccaagaggcagtagtcatggctcacccgcaaagccagttgcattgagtggaactttcttaatgagaccatgtctgatgacagcttagctgaacccctatgtctccttgaggcttcactccccttcctagtcccatattcctcactttcaaaatctaaagaaaagtcgatgagtaactgcatccaaaaattaggtaatcccgcatgaacactaggacaaaacaaacccagaatgcagaaattattgtcacataaaatgatcagtgttaccacagagttcatcagaagatggggccttgggatgttgagccttggactgcacatcacaccagctaacctttgtcccgtgtaccctgtgtcgatagccctattcttcacaggaagctggagacccaacatgctgacatgtttcatagcacacagagattcccgctgtgcaccatgatggggcccaacaccatctcggagtaaagcagagagaggactatgacaaagtgattgcccacccccacctcccctccctggcaggcaccactgaccttgatcaccaggtacaaaaacaaatcagcttggaagaagagctgccagacgctaacacacagctaagctcagcactgagaagaagtcattttaaaagctcttccattccctgcccatcccttctgagcctgacaccctacatcctgcttcctgaatctagcttcatgagtgaacccattgtctggcacctccttcttccagaagcctagggttacaacacaccccattccttctgcccagaacatcagcccttaggctgatggagaccgagcaggagagacagggaacaacaggcagagaagctcacagatgtgcaaggagcaggctcttcttgggggaagggacaggttgctcattaccatccaaccaaacggaatcagaggctctggaccccaagaagtaaagatagatttgtgcttttgtggcagtaaggatcctttgatttaaaaataaacaatcacgccatctccttcacaaagccagcagagtcctgctccgatggctctgcctctcggctctgtgtgggctccctggtgaatgaaaagtctgtgtaggcaaatcggaaggccaaaacaaaggagcaaaatgaacaatctcctgtcttcacagccaggtgcacccactggttctgaatctggattctcgaagcaaaatctgcatgaaaggctgactctatcattggcaagtgaaagttgtgcttctttagcaaaaggaagggggggcctttataaaactgcccccctaaacataggggccacctgagcaggttcacaagtcagcctccatgtaagtgaagaacagcgtaaagcccttaacaaagggcttatgttcaagttaaacttaaggaaaaagcactgagacctgcacaaaggatgccctgaaatcacagagaaaggcgggccggtcgggaggaaaactcaaagactgaagcatatgaagaaaagaccatcaggctgtctgaacagccctgcataacacagcaatgttattttggctacaagcaaagctgaatcgtgtcactagaaaggatgccatgttcccctgtgttcagcttcgataatggtctcacagataattaattaatgccataagggagcccttccgaccagaaaggaacaggcagagtgggtgatgggagggcaggaaactaaataaatcaggggaaaagagaggaagcagtgagacttccactaccacagggtgctgccaacagctgttctggaaataagtcagcatcgtggagtgcggctcaaggccacgagaataaactcagagacagcagttatcgaccctgggtttcatcaagagctccttcactgtcaacatgagaaaggccccttgctcaagacaaggcatcctatataaaaagaattggtctttaggtcttgttaacatcaacctctagttctaacctacaaggctgtttgacgtaacagaggagcaaaaacttggatctccttgaaccacatgtgttctggaggcctcaacgtgaagttgaatgttaataggtaaataaataaatagattacaaatggcacagctgggccggatttaaggccgctctgtgcatctttaatcgagcctcattatttggaacaatgtagttggcgtgaccattgccaaacaagatccagacaggagagaaagaaaaatagcagcacctgcccggcacaggtaagaaagcttctccttgcattctccgtggattgtgttctgacaaaatggcagcaacactgagtgaggatggtacaaggtggaggggacataggtagctgacacatggccacattctgccccaaggtggctcctgcaatgggaagaccacatatacatctcactctttgtctataccactggggcagtttccaattacctgagaatgtaggtgatgcctttcacctggagtcctcgaaacaatttcaacgatgtctgcatccttaatgttttcccacaaaataagtgtgtccataagtctctttatgacacagccttctgttaccagtgacaccgtgatcagagccgagggaaacatggcaccagttttaattatatgagtcaactttgctggtagccaaaataacactgctgcattgggcattatcattcagtttagcagctttcctctcttcatgcacttccatctttgggttttcctttgctgcctctctcagctaccccccacctttctgactttctctgtgattttggaagaatgctgtgaactagccattgcaatggcaaggaaagcagtcaaggaccagcctccagctcacaccataatgacctaccttccctgggacactccacgcccatgtgtgcttcatgtgtaggtgaagggcggcacctggcctcagagcaaacaactctcccataaggtgactggccaggtcaagccagctggaggaaggaatacaaccccagcaagaggccactggtgcacagctgggccttctttcctgatagggggcaaggcaccaggaggaggcagagtgagcaaggcccccaagcctcccatgcaggactcccccgtgctccagcatggaagggtgagggcttcacctgggccctgggggcacagtgactgggctacatcccagaggtgcgggaccagcacagacactccctcccaggactccaaggcaggtgagcaaggacctcctttcccagcgcctgtgttccttctaacagagacaagcaggttagggagtgtgaggaaacctcaaggcaagggaggaattcaggggactctggcttgagggaggggagcgtcaactcaggagtccagggagactgtgtcaagactcctggttctctgcagtttttgtttgtttgggattttgacgataaagcactactggagaccagaagggcctagaggccgagaggaaggtgccggagcccagctgcactgaggtgggtgcaggcggcgctgggcaacggcgaaggacccccctccatccccgcctgcgtttgcttctgcaccccgtggacaccgattatcctaacctgtcatgtgtaattctggccccgaagccgcctggaaacattggctttatggtaaatcttcttaataaacaagattagcaggaaaggaggtgccggggactggaggttttatgggtttaaaacaggggcgtccgcctgggaaagcagcggcttccactccctcgctgccgtgaagctgccgccctccctttcctcccgcggctgccacggaggaaaaatgtcctctgatttcggcggcgctgcccgcgggggggtgcgggggacgcaggtagaagcgggtgcagcgggacatccgaggcccggcccctcgcggcacacgcggcggaacacgagcggggggcgcacccacgccggaccagggccgcgcgctccagggccaggggagtgccgagtggcggggctcggggcgtgaggcccaggagccggggtagaggcaggaggcggcgccggggaggaaactgaggcaggggcgcgagacctgctccgagcccccagtgaggacagagaggcgcgcgacccgtggccgggggcttgagacccagagcctgggggtgtcgcgctggaaccccgagacccccggagcccccgacccgctcgccaaggcgcgctccccactcactcactgaggcacccctccccacccgccccgtcactcaccgagacgcccctcccctaaaccccccactcattcattgaggcgccccttcccccacgccccgcattcattgaggcgcccctccccccacgcccccctctcattcattgaggcgtccctcccccagaacctctcagaggcgcccctcccccaacgcccccactcatttattgaggcgccttccctgcatgccccctcactcagaggcgcccctccccgcaaccccctcactgaggcgccgcccctcccccccgaacccctcacagaggcgcctctccccccgacccctcagggtggcgcctctccccacccagaccccctcacggaggcgcccctctcacaacgcccccaactaattcattgaggcgcccctcccccggcgccccccactcacccagacgccccgggagctgccggccgcgggggacggacgaaggggcggcaggcaggacgcgtggcggcagcagcagcagtagcagcagcagcagcgggagcggcggccccatccccgcggcctggccggcggcgctcagtccatggccgcgcgggaggcggcgggaggcggccgagtccgggcccagggaggcgcgcgccgccggctcctcccgccgcgcctctcgcgctctt

SEQ ID NO: 246 - DNA, 1048733 bp, Homo sapiens; identical to SEQ ID NO: 245
  source 1..1048733: mol_type = genomic DNA

SEQ ID NO: 247 - DNA, 1048733 bp, Homo sapiens; identical to SEQ ID NO: 245
  source 1..1048733: mol_type = genomic DNA

SEQ ID NO: 248 - DNA, 96 bp, Homo sapiens
  source 1..96: mol_type = genomic DNA
acaggcgcttcctccagacacaccacggcacacttcaacctgttccttacaagactacattgagcgtgctggtgttaaatgcgtgcaggcttccgt

SEQ ID NO: 249 - DNA, 33711 bp, Homo sapiens
  source 1..33711: mol_type = genomic DNA
tccagttaatttttgtatttttttgtaaagacggcatttcacgatgttggtcaggctggtcttgaacttctgacctcaagtgatccacccgcctcagcctcccaaagtgctgggattacaggcatgagccactacacctggctaagaatttactttgtatacatgttaaaaaaaaaaaaaacctaatatgtattaactcctaacacctaagaggaaacctctggtaaaaagagtctttcactccaaggacacggcagagcctgtgccatcttctaagtagatgaactttccagagtccaccaagaggtcctgaatcttctctcttgcatgtctctcttccatcctctccaaggcatccagcagggtgtggatcgaggcgttccgtccagttttgttgacccatttcatcagcattgcatacaaggcatcccctgggcctgctgtaccagctctgaccacatcgatctcatttttcgtgaggtccagctgcctcatgagctggtcccaggagtcaaagggcacgatgtttgcaaacttgtcaaagaacagcatcagagctgggtggagaaagccacagagacagccagatgagttgggactcagttcagaaggggcagaggatcccacatcaggcccagaacccaaggagagaacctggagagccccctgcatgggcaaacctgttgctccattgcccacccacctcccatccacagagagcccacccacactgcctggcctctgtggcccccaaggcgctgacgggcgtcaaggtcaccagagaatctgccctcagagagggctgagaacccacctggggaggatggattgaccctacggaggcagaaagcaaagtgggtgagagcccgagggagggagggagagtggctgcagcgggagctcagaggatgcgggctgcctgggctgcgcttgtcatgggagcatgtcccagggtggccacttctgcatctgtggaaagtgcagggtctggggcaggggacctctgccctccctgaggctggggcagagctaggtgggggcaagcaggccctgaccaagaagcaaacctgaagacagagcaaacctgcccagatctcaggactaccagggattgaatgaaatgagatgtgtgtgcaaagcactgcacaccaccatccacagggatagaaggggccaggagtaccaagctatgttttctaacagcctcatttaaagaacataaaaagaaaaaagtgacattcattttaatgtgtggtactgaatatgtgtaaaatataatttaatatgcaatgagtatacaaaaactgaaactgacccaattgtcccatagaaaggtttttttgataaacagaaattgacccttctggtccttaacgactggaaacttaacatttgttttatctgagttacttcctcaggaaagacctgcaagcatctcaaaaaaagtagcaaagaactgaaactcaccagatcactacatccagaccatgatgggatgtgggacccctcattcatcttgattgtttccttgccccattctagctcctactttcttacacattgttacatttcttgcctcctatataaacccttagttttagttggtcagggagatacagttgagactgagctcccatctcttccactgcagcaccctattaaagccttcttggcaatactcatcatctcagtgactggctttctgtgcagcgagcagcgggacctagaccaaacccctgaggttttggtaacaggttttggttccctggctgggaaagtgttgctcatggctctgctgccatgggccaggagactcagaagccctcccaagcagttgccccgctaactttggctggaggtgagtttcagtctctctcaggtcccactgcagccggccccaaccacattcctgattacttccgaagaactgcctttgaaatttgacatttgcatccagacaggtgattgtcctttgtgggcccagacagcaggatctgctcttctcagtttgagaaatttttaaaggaatttccatttgcaggttgaacaggcccaagtgactgtgagagggaagcactctgcctttcagtctggacactcttggaggcttgtttgtaattgtgtgttgtttcagggcaagtgagtgtcttttgtgggtaccaggcagcacgactggctcctctcaatttgagaaatttgaaagcaatttttgttggcaggttgatcaaacctaaccaatggagagaggaagcaccctgcctgtttcagtctggacactcttggagcttgtttgttgctgcagcagttgtattatgttttggtgattatttctatgtgtttgctagagtcatgggaaattggaattcagtaaacttggtattcttttgtaatactgtttggctccaatattgcttggaaactgaagtttgctgctgaatgagaaagtaggatggagttcctgtatccaggcttttatgttgctgttctaagcagcattgggcctgattagttggttctaggtggtgttctctgcgatgctgtttggagtctgcagaggtttggcctttaaaaatcaaactgccatggaaactgctttacctaaaatttgggttcacaaccttcactgaattatctattggagctaacaaatttcagccatgtgaacatatttgtagactggtgagtttgtattactgtctcatggagagagttcaaaggtaaaagctattggatctttgtgtgtgcatataggtctagatgtgtttatgtgtatgtacatttattattaagttacatgttgtgtctaccaaattgacttataagtaaaagagtactcataaataaagtaaataattccaagcaattttcaagttcatgtgacttaagtaaatccttactaaacaagtcagctttaaaattattggtaaaataagaaaacagaagtgtcttcagaattgtcagcatacatttttgtctgggcttatatttgtctttgctagatattttgagatatcagtttggcacaaaaacttaagactacaagcccaaccaaaacaaaatgatctttgagtcaagcttttgataagtaagattaaattaatgttgttggtttaatgaaaacagctgagtcttctgacttattggtgaaaatatctatatatttaactttgaagctcttaggtgagcacctgatgttcactggctattaaaaaaatggctgacaaagaaattaactaactttaaatgatggtgtctaatatctcaattttcagaagcaatctggataaacttaaaaatgaaagaattgagtaaatgtaaatgggatgttttaagtaaatttttcatataattaaaaattgttgtcattggattacagagaaaacttccagtgcagtaactgaaagaccaatgtgtggccaggcgcattggctcatgtctgtaatcccagcactttgggaggccaaggcaggcgaatgtctatcacttgaggccaggagtttgagaccagactggccaacgtggcaaaaccctgtctctactaaaaatacaaaaagtacccagatgtggtggtgcacacctgtggtcccagctactcaggaggctgaggcgtgagaattgctagaacccaggaggtggaggttgcagtgagatgagattgcaccactgcactccagcgtgggtgacagagtgagactctgtctcaaaacaaaaaaagaagaaagactgatgtgttcataaagattgtgattgttaaccaaacatgaagctgggcaggagctgattgagtggactgaactaatagaggactgaaataattcgtatggcttttgttggtttgaaatattgctgattcttttggttttgttttccagtctggagaacttttttcttctttgctatttatagcctttaagtatactttaagtatattgagtatacttttgtaaacagaatttgaggcatatttctctctctgcctaatttctctagaatttttaaattatttgtgactattaattcatggcaatgtgtttgcttacatatggttaataacaacgttttcttttacaatggaacacagttggataaaatggttattttctcagggctttgattgcaatggcctcgtgagaggttccagcaaagccaacttaggagagcctatgtggacagtgatttttgctgcactttgtgtgggtaatcaggccacgtatatggaactaaacttattttgcaggtacattggtcctgctataatttgtctttggtggaagtggggccgagagagagagattgtgtttcagaagaaacacaatcttttagtattaaattaacctttgattcctgggtggccatgaggtcacccatggtatgtgaagcttcccatgatgcccctcctcaaccatgaagcagccagaaagatccaggaccagactctctgtgactgtgggattgataaatagaaagggagaactgaaatcaacccaatatgtccatcaaaaggtttttttgttgttgttgttgttttgataaacatagaaattgacccttctgttcttaaagctcaaatcttacatttgttttatctgagttcctttttcaggaaatgaccttcaggcctctcaaagtatcaaagaactgaaacttacaaatcactacatccaatgggatgctggacccctcattcatcttgattgcttccttacccctccctagttcctgttttcttacacattgttacttttttgtttttttgagacagagtcttgctctgtcacccaggctggagtgcagtagcgctatcttggctcactgcaagctctgcctcccgggttcatgccattctcctgcctcagcctcccgaatagctgggactacaggcgcccgccaatacgcctggctaatttttttttgtatttttagtacagaaggggtttcaccatgttagccaggatggtctcgatctcctgaccttgtgattcgcccgcctcggcctcccaaagtactgggattacaggcataagccaccgtgcccggcccacattgttacattttatccctactatataaacccctagttttagtccatcaggggacatgaattggagactgagctcccatctccttgcctacagcactcaatgaaagtattcttccttgtcaatactaattgtctcagtgattggccctctgtgcagtgagcaccaagacctagacccaacacctggtgtttcggtaacaaaataatgagtggaatattttccattctttcttgcattaagtctttggaatcagtatgtagtttatacaacagctctgcaaattgggcttaggcacagataaagagctattagcccactgaagtcagtggtgccatgcaggacagggcagcccctcagggctgttgttctcctgaacaacaaaggagaagagaggaggtggagaagaggatagacagagtggctagtgtcattaatagggtgcagaaaggatgaggtagagtgggaagaagagatgggagaagacaatttagggtcttgatggtctatagcataggacccccagtttctggcatggaatgctctggaagagcactctcagcaatggggacaccagttaggacaccgtccctattcccaccatttctgctgcatctccaggagcaaaacacttactctcagtggggtcagcaccatttgctggaaccagcagcctcctcctctgagacccttcagcttctgccggtccctgtaacacacagtggggaatgccttggtctgagtcaggggtcctgcagtctagtactgactctgaccatcagccagcccggaaacctgcagcacatcactttcccccttgggtcaccatggagatggtgaaaaacctctggtcccacatagctcacagccactccccattgctggcattaccacctcagctccacccggtcagatcagtggcaacattagattcttataggagtgcaaaccctattgtgaactgtgcacgtcagggatctgggttgcatactccttatgagaatcttatgcctgattatctgtcaccgtctcccatcaccctcagataggaccatctcgttgcaggaaaacaagctcagggctcccactgactctacattatgataagttgtataattatttcattatatattataatgtgataagaatagaaataaagtacacaataaacgtaatgtgcttgaatcatccccaaaccatcttcacctcccagtccatagaaaaattgtcttccacaaaactggtccctggtgccaaaaggttggggaccattcgttaataatataatgtcttttgtatacacatacactgatgcatagatttggacaaagaatcacaagaaatgatatctcatagttacttgaggaaaaagacccagggcactgcagagtggaggatgctctctttacttactgagtaccttttgatagtttaaattttctcattttaaatatataaactatttgttcatgtcaaagcaccttatcaagctggagattattgacctttttaatgtttgccttcttttttttttaattacatttttggttagaataaatgggtactaatgcaagaaaggaactgaatggaacagtctaggtggaaggagatcattgtctagatgagcatttaacctgtgattaaggagggacccaaagcagagggaaatgggagaatcggcagctcaaaggggttggaaaaaccagacagtgactagaacaattcagggagtgcctcgctttgcactgaaacacaaaacaagttccatttagattataaagttatatgcaaaaatcacatcattgaaaaaaatatctccataagaagttagaggagttcgtcttgtgttggcaaaaggtctttctacagtagtgagcaatgaaaaggtaaaagtatctacagatttcactggttaaaaattaaagcttctacacctgaaaatattagaacaaaaaggggcaagaagaaattaggaatctactgtctgaatgtgagaaaaagcatgagtaggagagcaggccttctcataaagactctgagagacaagacactgatcttacgcaaaaacagtgaaaacaaagaaatgttcgtttaaaacaatgttttcctaaatagcaaaaaaaagaaaaaaaaagaaaagaaaaagcccttcaatgtcaaatcaaaatacatgaactggtacaaaccaacactagggggctgtgtgcatgtgtgtacctgtatgtgtgggtacgtgcatgtgtgtgtgcatgtgtgtacatgcatgtgtgtgcatgtgcgtgtatgtgcgtgtacacagtaagcagcactgttacaggctgacttggaaattgtgcttcttcttggaatcctccatacaaccatatgcagaaatttgggcagagatttagatccaaatatgtttaatgcaataataatttcagagtaaatttaaaatccctgctgttatgagcaagggctccctaacttctgtaggagcacacagtggagaccgtgcagccttattcagtcatcaacaaaccctgtgacccccactctattcctctggagctccagtttctgaggacatggcaaggacaggacagggactaagaagcagacatttggaagagtgcctgtccccttgtgagggtggctgctttttcccacgcagccccgtcccctgcagtcccatctccctcaggctccacttcccctttgaccaggagagccgaggcatggccttcaccccctgcctacaaggtcttggaggggcctgtccccaactcaccagcagacactgtgcctcccctggggactgtacagtgacacctgtcaaatctgccggctcctggctttccatttgctgctcagagacgaaagtggacagcgagtctgcgttgctcagaatctcgttgtgagcattgtcctcagccccaggccctcgtaggagacccaagcgccagaaacacaccttaggaaggcaaagagccaactcagaagcccacacccagggctccccacggggtccgtagggcacggctggacctgctgccaccaccccctcccagtgaggtcactccaggaagtccatgctcagcacatccaggacctgctgctggggccaggccctggtgctgggcttgggggctcaccccatccccagggtacaggctgtggggtaagggtctcacctgggctgtaggaagcacagggctacagaatggcccaccagcctgtatgatgctcaaaagggcctgtgtcccccatagtcaatgcacagcatccaggccacttcagagactcagggcagccatgagagcacggggacccacccacctggactacactgtgggcaagaagcagttcctgagcccctgatgcccccagctcctggagaaatcaactcaccctgtccatgcacttggggtcccctccacaacctagaagagaagacggttcccttagtggccagggaggggcccatgcagcactccttcttagagggcagtgttgggcaggggtgggctgggggctgggacactggacaaagatccccgggcctggggatccacatgaggccctgctaactcgggagatccttcaggagcggggagcataaagggaagtaggctaaaaacaaacaagtggaacatcactgttttctgctctgtgttttgctctgaacaaagctacataaatcccacaaccacttctcgtctcgactcttgtcatccagttgaggagctgactgccccctgcctggatgggcctgaccagtggaggaactggccctgccttcccagacttggctgggagatgaggggacccccagccttgggagagggacggatgacaccagggccctagggttgcacaggatgggaggatggggggtgatcacaaggaggaagatagagcccggccagagacactaggacttggggcaggggtgagcgtttctgtctgtgggaacagaagaaggcagggcagagagtgcccagagcccttgccctcagccagcacctacctgagccgatgcaacaacagacaatcagcacagccaccaacagcaacggaacaaccaaagtcacaaccaaaatcacccatatattatgtccattgcctgagaaaagacaggaaaagacaggagtctcgggctgctggtccctgtctcctctgcagctggggcttccccagtgggctttgtacctgattctttgtggacacactcgatgtcactccagggcgtacaatccttgaccttgaccatccctctggggcacctgggtacacacagggagggaggggggggactcttgatggaaagctggccaggtgggatgaaagaggagccactctccctgcccaatgtccctgagaaggcgtcaggggaaggatagtctcctcgtatctgcagggggtccccctatgctcccttgtttaggctggggaagggtctgagcatgcacactttacccccttggcctccctgctctggggtcagagctgcagttccaggagccttctgtgctgggcacacactaatcttccctgggctgcaggggaggcctgcgttaggaggaatcacactccaggggaagatcacaagcccgtgtggccacaagctgagccccttcctccagttaacccacagtacaagtgagccctcgcccccacctgtctgctggttcctctcaatcacagcaaacactggaggaccagagaagagcaattactctttgcttccaaaaccaaaataggaaaaagacaggacttattgagaaatcaggggccaggggtgaggctggctgggtgggctcaggtcctcatgggaacttgaaggagctccacccatggccttattatgatttttgcgggctgtgggcatttctgtcttcttgaattaaaagcaaatattaaaaattacattttatgactcaatttgtttaaatataaatataaccccagctggattctataccattattttcttatgatttcaagataaaatatttcatgtacctctgttgtgggccctaagtcatggcctcctgtgcctagtgaacaagtcagcctggccaaggggactagtgctggggaggggtgagaaggggccactgcaggggacaggggtggggacaggcagatggaccaggaggggcaggttgcaggctcaggagacgccacaggctcagggacacctatgggggtggaggcaccatggggtcagggctgatagatacgggtacaaggagactcgggtctttttagggttccttgcttctgtgggttctttgaggctgctgggagccccttggctgttgtctcaccctctgctgcacttccggcacatctcagcagaattgtcattccggaaagttcctggtttgcactgacatgctgtgttcctggtcgtggtgcagggacttctctcttcttcatctgatgacagagtacaaggttttgggaatgtgtttccctgacgtgtcccttgacctttcctcaccaccccaactccctccccctcagctcagctcaactcagtttgccaaggagttctgagggccagattctgcaccagcacactcgggctcacacaggacacccacccttcagctgtcaccaacacttggagtcatacaaaaggaccatgattcattatttattacatcagattagggaaaaagcaccatttagatcgcatggtcagtagcaaaggaggcacatggtatgtgagagagtctgcaagaagaggagcccttgggtgacttcccaaaaacccagcctgctgaggaagagggaggcgcctgagaaactgaaggctgagtgagcctgagaacctgccaggagcacacagcccagggggagcgtggccccagagcagacccgtaccaccgctgaaactcagccctgtccactcagccaggccttctttgtgctgtaatgatgcccctaccctcttggagctgatagtttgcactaccaggtggcatgcattataaaaatgatttctttctgtttcattttatggacctaagacataaccatggaacagggtatgatgaagaccaagttgggctggaacttggttccctgactcacattggctaccactcccacctcactgcccctcactccacctctggacaagaggtccacacattctgtacctgatttacaagctgtacatgggaggcaagcaaacaaattgttggaagcattggtgtaacccacaccctctgtgcaccggttacaggctccaggatgttctgatctatgagatcctgggaagggagagaaaagccaatgaatgaattgccacagagttcccagaggatcgtggcggtggctaggaaactcttcttttggccatcagtagaccccagacagagaaatcccatcttcttggcttggtcttgtcgtcaattctgcatctatacacacctctgactggcgctgctgacagaaatacaatacaaaccacatgcaaaattcaaattctatgagagccatattaaaatagtaaaaagagaatgaggtcaaattaattttaacaatgtactttttggacctaaaatatccaaaacattagcatttcaacatgtaaacaagataaaacattgagatattttcttttattttgaatactaagtgttcgaaacccagagtgtatttttcactcactgcacatctcaattcaaagtggctgtgttttaagtgattaatggccacataggcctagagaccagggcaatgccacctgcatccctggaaactcacaaaaagtcctaatccctgccctcagtgagctcttggtcagtagaaggtacaaacaggcgcagaaacaatacagcgatgaggggaaggcttcagatacagcccatgccacctgccatgggaggaaaatggaaggaaaaagggtcctccctatacagagtcaaagaatgatccacagaaagaaggcctacctcatgctgccctggattgcagagggtctccaggcactgaggtgacagcctgcaggagctgtcgccagcgggagcccatgtctggaggctcgaccttcacctccagggcttcgccccttcaggtgacctcactctcccctttcagtgcccatttatttatccctctcctctgattcatatttactgatattgaaagatactcttagaaaacccaaactgtggaaaaaaaacttccttgataatgtgttacgatgacgacactaccaattataaaaatgtggttattgagtaatagtgctggggcaactaaggttactactgaaaaataataaaggcttttttttttttttgagatggagtctcgctctctcaccaggctggagttcagtggcgtgatcttggctcactgtaacctccgcctcctgggttcaagcgattctcctgcctcagcctcccgagtagctgggactacaggagcgtgccaccacgcctggctaattttttgtatttttagtagagacggggtttcactaggtttcaccaggatggtctcgatctcctgacctcatgatccacctgcctcggcctcccaaagtgctgggattacaggagtgagccaccgtgccactgtgaaggaaaaacttccttgctgatgtgttatgatgatgacactatcgatgataaaaatatgattattcagtaatggcgctggggcaactaaggttactgctgaaaaataataaagcttcttgcttatgctctccctataaggaaatagagactaggtctatcaaggtgtcaactgtaaagtatgaaatcacacaagtactgcatgagaaatttttcttacaagtttggagagagaaaggaccttctcagtctcacgagaaactaaaaagttgcataaagttaactatatgaaaattaggaagaaaactgcatggaagaaatcttgactaagatgaaaacaaagtaggagaaaatacttgcaatgaaaaccacactgcaaagcatagtttccttaacctataggaattcataccaaaaaaatctagaaagaacatcaacaagaaagtagtagacttgaacaacactattaacaactagactggacagatgtctataaaacactctactcaatcaaaacaagatacacattcttttaaagtgcacatagaacattctccaaaataaaccatatgcttggccataagataaacctcaatacacttaaaaggatagagataatacaaaatacactctcctaccacaatggaataaaattagaaatcaatagcaggaagaaactggggaacatcacagctatataaaaattaaatagcacactcctaaataaccaactggtctaaaaagaaatcaaaagagaaatcagaaaataagacgaatgaaaatgaagacacaacataccaaaacctatgggatacagctaacgtagctgaagtttacagagaaattgtctattaaggaagaagaaatatccttcctaaatgtctattaaggaagaagaaatatctcaatctataacctaataatccactctaagacactcgaaaaagaagagcaaactatagataaagcaagcagaaggaagaaaataatacagattagagcagaaattaatgagacggagaacagaaaaacaacagagtaaattaatgaactcaaaatctagttctttaaatagatcgatatattggcacaactaattgtgttaaaaaattagcacagggaaaaaataagactcaaattatagtcacgcactgcatgatgacgtttcggtcaacaatgaaccacatatgtgacggtggtcccataatattataatggaggaggaaaattcctatcgcttagtaatgtcataagtcaatgcgttactcaggtgtttgtggtaatgctgatgtaaacaaacctacttcactgccagttaaaagtatagcacatataatgaagttctatatataatatttgataatgataataaatgacttactgatttatgtatttttgatactatacattgtaatgttattttagagtgtactcctacttacaaataaaaaaggtaactataaaacagcctcatgcagttttccagaagaaggcattgttatcagaggacataggagttgacagctccatgtgtgtctgcccctgaagatcctccaacgcgacaagatgtggaggtgaaagacagtgatgttgatgaacctgtccttgtgtagacctaggttaatgtctgtgtttctttttttttttttttttgagaaggagtcacactccgtcacccaggctggagtgcagtggcgcaatctcagctcactacaacctctgcctctcaggttcaagcgattatcctgcctcagcctcagcctcccgagtagctgggactacaggtgcctgccaccatgcccagctaattttttgtatttttagtagagacagggtttcactgtgttagccaggatggtctcgatctcctgacctcgtgatccgcctgccttggcctcccaaagtgctgggattacaggtgtgagccactgcgcccggccaatgtctgtgtttctatcttagtttttaacaaaaaaatttttaagtaaaaaaaagtttaagttaaaaatacaaaaatgtttatagaatacgaatataaagaaagaacattttttgtacagctgtacagtttttgttttttaagctaagtgttaaaacgagtgaaaaagttttaaaaattaaaaagtttataaagtaaaatagttacacgaagttaatattgaaggaaggaaaaaaaaatttacagatttggtgtagcctaaatgtacagtgtttataaagtccatagtagtgtacaggaatgtcccaggccttcacattcactcaccactcactgactcacccagacaagatccagtcctgcaagctccattcatggtaagtgccctagacaactacatcatcttttttaaccttttataccatatttttattgggccttttctatgttcacatgtttaggaactcaaatacttatcattgtgttacaattgtctactagtacaggtttgtaatctaagagcaataggctatatcacatagcctagggatgcagtaggctatatcatctaggtttgtggaggtacactctatgatgtttgcacaatgatgcacttgtcagaatgagttcccatcattaactgaggcatgactgtattagaatcagaaatgagagagagcacattactacagattatatagaaataaaaaaattataaaagaatactatgaaacctgtacaacaaaaaattaggtaccttggatgaaaggggcaaattcctagaaagacacaaactactgaaactgaatcaagatgaaagagacaatgtgaatagacatatagcaagtaaagattttgacttagttatcaaaactactcctaaagaaaagtcgttttcacaagatggcactgaaagcaaagaaggaagctcctgcccctcctaaagctgaagcgatgcaaaggttttgaaggccaagaaggcagtgtagaaaggtgtccactgccatgaaaaaaagaatatccatacatcacccaccttccggtggcccaagatactgagactctggagagcacccccaggagaaacaagcttgaccactatgctatcatcaagcttccactgaccactgagtatgccatgaagaagatagaagacgacaacaacacacttgtgttcattgtagatgttaaaaccaacaagcaccagatcaaacaggttgtgaagaagctctatgatgtttatgtggccaaggttcaacaccctgattaggcctgatggagagaagaaggcatatgttcgactggctcctgattaccatgtcttggatgttgccaacaaaattgggatcatctaaactgaatccagctggctaattctaaatacatgtatatgttttcaccagaaaaacaaagttgaggcccagatgcctttaccactgaatgataccaaccatttcaagaagaattaataccaattattcagaaaccctttttaaagacagcagaggaaggagcactttccaattcattgtataaggacaatattactgatatgatttggctgtgtccccacacaaatctcatcttgaattcccgtaagttgtgggagggatccaatgggaggtaattgaatcatgtggggcaggtctttcccttgcagttctcatgataatgagtaagtctcataagatctgatggttattataagggggagttttcctgcacaagctctctttgcttgctgccatccatgtaagacatgacttgctcctccttgccttccatcattattgtaagacttccccagccacgtagaactgtaagttcaattaaacctctttctttgtaaattgcccagtcttgggaatgtcttcatcagcagcacgaaaaaaaaaaaaaaaaactaatacagtaaattggtaccagtagagtggggagctgctgaaaagatacctgaaaatatggaagcaactttggaactgcataacaggcagaggttggaacagtttggagggctcagacgaagataggaaaatgtgggaaagtgtggaacttcctagagacttgttgaatggctttgaccaaaagcctaatagtgatatggacaataaagtccaggctgagatgatctcagatggagatgaggaacttattgggaactggagcaaaggtgactcttgttatattttagcaaagaaagcaaagagagtggtggcattttgtcccttccctagagatctgtggagctttgaactgggaagaggtgatttagggtatgtggcagaagaaatttctaggcagcaatgcattcaaggggtgacttgagtgctgtaaaaggcattcagtttttttgtttatttgtttgtttctttgtttttaaccaatgttgcattcctaggataaaacttacttggtcctggtatataattctttttttgttttgttttgttttttgtttttgagacagagtcttgctctgttgcccaggctggagtgcagtggcatgatctcggctcactgcaagtccgcctcctgggttcacaccattctcctgcctcagcctcctgagtagctgggactacaggcacccaccaccatgcctggctaatttttttgtatttttagtagagacggggtttcaccgtgttcgccaggatggtctcaatctcctgacctcatgatccacctgccttggcctcccaaagtgctgggattacacgcatgagccaccgcgcctggccggcattcagttttataagggaaccagagcattaaagtttggaaaatctgcaacctgacaatgtgctagaaaagaaaacccattttctgaggagaaattaaagatggctgcataaatttgcataagtaatgaggagctgagtgttaatccccaagacaatggggaaaatgtctccagggcatgttagaggtcatcatggcagcccctcccatcacaggcccgaaggcctaggagaaaatagtttcctggtaggagtccagggtcttgtgctgtgtggagtctagggacttggtgccctacattccagccactccagctgtgactaaaaggggccaaggtacagcttgggctgttgcttcagaggtggaagccccaagccttggcagctcccacatggtgttaagcctgcaggtgcacagaagtcaagaattgaggtttgggaacctccacgtagatttcagaagatgtatgaaaacgcctggatgcccaggcaaaagtttgctgtaggggcagggccctcatggagaacctctgctagggcagtgtggaagggaaatgtggcatcagagcccccacacggagtccctactggggcactgcctagtggagctgtgaaaagagggccattgtccttcagaccccagaatggtagaactgctgataacttatacaccgtgcacctagaaaagctgcagacactcaacaccggcacgtgaaaccagccaggaggggcgctataccttgcaatgccacaggggcggagctgcccaagactatgggaacccgcctcttgcatcagtgtgacctggatgtaagacaaggagtcaaacgagatcattttggagctttaagatctgactgccctgctggatttcaaacatgcatggggcctgtagccctttgttttcgacaatgtcacccatttggaatggatgtatttatccaatgcctgtacccccattatatctaggaagtaactaacttgcttttgattttataggctcataggcagaagggacttgctttgtctcacatgagactttggacggtgaacttccgagctaatgctgaaatgagttaagactttgggggactgttgggaaggcatgattggttttgaaatgtgaggacatgagatgtgggaggggccaggggtgatagggtttggatacattctcactcaaatttcatgttgaattcccacatgttgtgggagggacctggtgggagatatctgaatcacaggggcaggtctttcccatgctgttctcattatagtgagtaagtctcatgatatctgatggttattataaggtggagttttcctgtacaagctctttgcttgctgccatccaagtaagatgtgacttgctcttccttgtcttctgccatgattgtgaggcttctgcagccacatggaactgttaagtccaattaaacctctttcttttgtaaattgccagctttgggtatgtctttatcagcaccatataaacggactaatacaattagcttaatatgaagaccagaaaaggacctcataaagaaagaaaactacagactaacgattcttatgaatattgttgcaaaaatttgcaacaaaatactagcaagttgaatccacaagcatacaaaaagaattataggctgggcacggtggctcacgactgtaatcccagcactttggaaggctgaggcaggcagatcacaaggtcaggagatctagaccatcctggttaacacggtgaaaccccgtctctactaaaaaatacaaaaaattagctgggcgtggtggcaggcgcctgtagtccctgctacttggaaggctgaggcaggagaatggtgtgaacccgggaggcagagcttgcagtgagccgagatcgcgccactgcactccagcctgggcaacagagtgagactccatctcaaaaacaaaaaacaaaacaaaacaaaaaagaattatataccaggaccaaataagttttatcctaggaatgaaaggttggttcaacatcccaaaataaattgatgtaacaaattatatcaatagaatgaaaaccaaaagtcacatgattatctcaaaaacacagagaaagcattttactaactccaacaccctttcatgataaaaatcacaaaataatctaggaataaaagtgaacttcctcaacctgataaagaatatctacaaaaacccacagctaacattatatttaatggtgaacaactgaaagatgttctccaaaaaagatatctgttttcactacttttattcaatatggtactggaggctctagccaggacaattaggtaagaaaaagaaataaaaagcatccagattggaaaagaaaaggtaaaactttctctatttgcaaattatattttcttatatagaggaaatcctaaggaagccattataaaaacattaagaataacaaacaagttctgcaaggttatagaatacaagatcaatgtacaaaaatcaattatatttgtatacactcacaatgaatcctaaaatgaaattaagaaaaggttttatccacaatagcataaaaaagtattaaatatctaggaataagtttaacaaaatcaacccaaaatttatagtctgcaaactacgaaacattattttaaaaattagagatgatttaaataaatcaaaaaaactcatgctttgggatcaaaagacttctcattgttaagatgccaggaacctctaaactgagcaacaggtgcaacacaatccctgtgagaaactcagctgattttagaaattggcaagctgatcctaaaattaatatggaatttcaaaaagcccagcataaacaaaataattctggaaaaggaaaacaaaaaagaaagattcatacttcctgatgtcaaaactcactacaagactgtgtggcactggaaagaggacagatatagatcaatggaaaagaattgagagtccaaaaatacacccatacctttatggtcaattggtttttgacaaggatgccaaggccatttaatgggaaaaatcatcatttcaacgaatggcaactggatagccacatgcaaaagaatgcagttggacgcttatctgatgccatttacaaaaattaactgaaaatgcatcaagagttaaagtacaaaactcttaggagaaaacatggggataaagcttcataaccttggatttggcaaaggatcaataagtatctgttgaatagaagaaccagaaactgtaggaaacagaaaacttgaagaacatggaaaaggaatgttattgatgaattttgagataatttttgtatatagtatagggtaaggaaaagagaggtgtaaaggattagagatcagtcttagaatgtacctggtggacacaactctcccaaagggctatgttcccattgctgtgtgccaattgattgatcatgaagtttgatggttgcagctgagctaggtacgacctgtggggacaaagcagggactggcatgagtggcttccagatctcacccattacaagatcaatctcacattccattcccccaagcctccaaaattagacagaacttgcatctttctcccagttctaaaactcaaccatttgtttgtgctcatctttgtctctttgtccccatgcccccagcctgtggcaactaccattctactgtctgtttctatgaatttaactactctacatacttcatataaatggagacatacagtattttatggttttcttgaggctgtcatatttcaattagcataaaatcatcacgatccatccattcggtaccatgcattggaatttcattcctttccattgtgtgtatatgtattacgtttatccattcatctgtcaatgggcacttggtttgtgttcacattttagctattgtgaataaagctgctatgaacacgggtgtacaaaatctctttatgccctttctttcaattcttttggatatataccccaaggtaaaattgctgttttcttacaagagttgtataattcttatagatcttacatttggaggccacatatgaaaagccaacagctaccatcctactcaatagtgaaagactaaaggttttttctccaagatcaggaacaagacatggaggcctcctttcatcacttctatattatcagggtaatgcggggcccacacgaagagttagaaagtgttccctccaactcagtttcttggaagaatttgagaattcatgttagttctttaaatgtttggtagacgtcatcattgaagccaactggtcctgggcttttctttgctgggaagttttggattatggattctatctccttactatagttctgttcaaaatctctatttcttcatgattgaatattggtaggtagtgtgtttttagtaatttaccagttttatcaatgtgctctagtttgttgacatgcaattatttatagtattttttataatcctttggatttctgtaaagttgttttaaatgtcccctctttcatttctggttttggttatttaagttttctgtcttttttcttagtccatctaagtaaaggtttgtacattttatagatctctcttaagggtcaactttcagtttctttgagtttctctgcagtttttctattctctatttctgttatctctgatctattttttgctggtttgggcttagtttgctcctctttttttttttttttttttttttttttttgagacagagtctcgctctgttgcccaggctggagtgcagtggtgcgatcttggctcactgcaagctccgcttcccaggttcatgccattctcctgcctcagcctcccgagtagctgggactacaggcgcccgccaccatgcccagctacgttttttgtatttttattagagacagagtttcactgtgttaggatggtctctatctcctgacctcgtgatccgtccacctcggcctcccaaagtgttgggattacaagcgtgagccaccacgcccagctgtttgctcttcattttctacttcattatgtaaaaggtagattgttcatttatttcttcttttaatgtggtgagcatttacagctatcattttccattataacactgctttcatatcctgtaacttatggtatattgttttcatttgtctcaagatattttcttttgaaacatttttctaatttccataggtttgagggtacagctgctttttgttgttgttgttgttacatggataagttctttagtggtgagttctgagattttagtgtgcctgtcatctgtctcaagatattttctttcttttttgaggggggtggggcctcccacaatctgcccaccttggcctcccaaagtgctgggattataggcgtgagctacagagctcagcctcccaagacattttctaatttcccttttcatttatttttttacccattggttgttttaaaatgtgttgtttaggccgggcgcagtggctcatgcctgtaatcccagcactttgggaggccgaggcaggcagatcacgaagtcaggagatcgagaccatcctggctaacacggtgaaaacccgtctctattaaaaaatacaaaaaattaaccgggcgtggtggcgggtgcctgtagtcccagctacacgggaggctgaggcaggagaatggcgtgaacctgagagacggagcttgcagtgagccgagattgtgccactgcactccagcctggacgacagagccagactgtctcaaaaaaaaaaaacagcaaaaaagtgttgtttaattttcacatatttgtggattctccagttttccttctgctattgatttataatttccttttattgtgattggaaaagatagtttgttttatttcaatttttaaaattgtattaagacttgttttgtggcctaacatatagtgtgtcctggagaatgtttcatgtacccttgagaaaaatggatattctcctgtgattgggcagtgttcacatacacacagacatacacacgcttttactaatgagggttaggtgatgtgtaaattttttaaaaagcaggatactgaatcaaatattaaataatgaacttcaggtttaaaaaggcactttacaaactgtcccccaaaacagcctgccaatgtcccatgaaatactagagtcagaaaaagatgaaagagcagtatagttattcaggacaggatttctgtgcaataaattacattataaagacaagtgaaaaccattggggtctgaggattagctggtagtaatgtactgatgcttactgtctgatattgaggattgtattgtggttatacgggagaatgtccttatttgttggaaatatccactcaagtgtataagggtgatgtgcgttctgtgggtagcttgctctcaggtggttcaaagtaaagggtatagtataatttttgcatcttttctgtaattgggagattttttaaattagaaagttaaattagaaaaggaagagcaggggggccgggcgccgtggctcacgcctgtaatcccagcactttgggaggccaaagtgggcgaccacctgaggtcaggagttcaagaccagcctggccaacatggtgaaaccccgtctctactaaaaatatgctgggcgtggtggtgggcacctgtaatcccagctactccagaggctgaggcaggagaatcacttgaacccaggaggcggaggttccagtgagctgagattgcaccactgcaccccggcctgcatgacagagcgagactccgactcaaaaaatagcataactaaataaataaataaataaataaacaaacaaaacaaacaatgaattccaattcatagacagctttaggaatatttaaattatctttatttcttgtggctattttgctaagtagtgttttttaagaaatttgtctatttaatccaagttgtcaaattgattggcataaagttattcataagatcccactattttccttttaatggctgtagagtttgtaataacatcccatcattaattcttgatattggtatttcatgctgttgttctttttttcttttaaagtttggtttattacttttttttttttttcctgagatggagttttactcttgttgcccaggctggagtgcagtggcgtgatctcggctcactgcaacctcggtctcctgggttcaagcgattctcctgcctcagcctccggagtagctgggattacaggcatgtgccaccacgcctggctaattttgtatttttagtagagatggggtttctccatgttggtccggctggtctcaaactccagacctcaggtgaatcgcctgcctcggcctcccaaagtgctgggattacagggatgagccatctcgtccggccagtttattacttttattaattttgttgatcatttctgagaaccaactcttagcttgttgattccttttattgtttgaattctatttcattgatttcagtcttattatttccttgtcatgttgttactacctttgagtttaatttatacttattttacgggtaagtaatgcacacctctgagtcattgattttgataccattcttcttttaatccttaagaactttactgagatatactttatatatgatgtaattctttcctttaaatatatttatagaagtgtataaccatcaataaaatcaatttttgaagattttcatcatcatccccaaaagaaactccaggccaggcacggtggctcacgcctgtaatcccagcactttgggaggccgaggtgggtggatcacgaggtcaggagttcaagaccagcctgtgcaacatggtgaaaccctatctgtactaaaaatacaaaaatgagccgggcgtgctggcaggtgcctatagtcccagctactcgggaggctgagacaggagaatcacttgaacccgggaggcagaggttgcagtgaaccgggatcacgccactgcattccagcctaggcgacagagcaagaagccaattcaaaaaaaaaaaaaagaaatattttgaattctctttgatttcattcgtgaactatgagttatttataagtatgttgcttaatattcacatttttggagtccttctagatattgttattgcttaacactttaatttcattgagatcagagaacatattttatattattttgttttaaatgtatttagatttgttttatagttcacaatgtggtctatcttggtgaagtaccatgttcatagaagagaaggaatctcccatagatgttgcatatatgctctataaatgtcagttaagtcaaggtggttgacaatgttcagatctgttattttactgttttcatctgatcgttctatcagttgctgagaagggggtgacatgatctccctttaatccttttgagcgttgcttcatttattttaaagctctactattagacatatacacatttatgattattatgccttctgatgaattcattttttttttcttttttgagacggagtcttgctctgttgccaggctggagtgcagtggcacaatctctgctcactgcaacctccgaatccctggttcaagtgattctcctgcctcagccctccccagtagctgagattacaggcaaatgccaccacacccagctaatttttgtatttttagtagagatggggtttcaccatgttggtcaggatggtctcgatctccttgacctcgtgatctgcccacctcagcctcccgaagtgctgggattacaggggtgagccactgcgcccggcctgaattcacttctaacactaaaaatagtaccttaaaaaaaaatctctactaatagcaagtgaaaacctgacaacgagctcctggtgactctggacctggacagtgctcagccttctgttcagctgttcttcccacctctcacatgaaacatgtctatgaaaggctgaggacgtcacatctgcattggtgcgggcttcctagaacccatgttactcattcatccaaggagggcatgtcggcgcctggtagaaacgctgtgcaaggaatcgtggggtatcaagaaaaaggcacgaccctccctttccttaggacagttccagttcccagggagatgaggcacagccatcaataacccgagtcacgaggggctgcccaggcagaggtgacaaatgccactggtggcagggacaccggtagacatagagggaaaggtccacatagagggaaaagtccacacaggcaggttcctaggcagatacgaagtcaaggcagtcggggagggcagtcaaaacaagtgatgctgggacacaactctgaggtttgtgggcgtctgattaagggagatggaaggtgaggtcagagaagtgaggttctcagttcacagatttgggctcatgggggtgtgaggttgtgtgtgtgtttgtgtgtgtgagagagagagagggagagagagaaagagagcaagagagagaggtcttgttccaggtcttctcctccatagactctcctgaccctgccctgcctcttcctgagatgagtcattcaccagggggtttccttgccttgttcctctcggattagcattgtgttaggctgtttcagaggtaagtttgatattcacactgatttcctctctcaggcatacacaccctaaaaaaatgccttattgatcttaaaatgagcaactcagaattgttctgaggttggctgtggtcgaaaatctgcttcctttgagtctttcgtggcttttttatttctttgttcttttggtataaaaagacccctgggttaagaagcaagccatctgtcttgtagtctcgggccagcctcatggtctgggggaagccacttcttctctaaacatgtctatcattctggaaataagaggtggctttacatgacttctcaggtacccccagcagtgacccagcgctgggtgaatgcaggcctcatgaaaaagcaccaaatactcccctgggaaaggtcagcagaacccagtgacccaatcactgctgctgccccgagggttgctcatcctcctgcccagcccctctactgaacaaatgttctgagtctcatgctgtttgtctaaaacaaagacaatgagggttcctgtacagtctggttgtatgaggattaagtgtgttcatttacatatgaagtgctaagaacagagcttggcacacgcaagtactgtatttcagcacatgctgttgttagtacaatcattcccctcaatgttgattttaatgaaaccacatcctctaagccaccaataccatgacctggggccttgcaactgctggagtcaagtagggagggatggcatccctggagccggcacagcctctctggaggtggggggtgggggaggtggcccccatgcttcctgatagttatttaggtccctagtgacacctcctccaccagactgtgggcttcagggagcaggactgacacagggctcatttgtcctcccaccaccaccaggcgcagacattctcagagtaaagtgctcatcacctacttcctgggtgagtgactttccctccaagcccatgaggtgagcccagtggtggcctcagctcaccgcctcaggtcacaggttccaggctacagcacagggatgggaccccgaagagtcctgtggactctgctaaggaaccctaggagctcccagaggccaagtgcagggcagagatgtggagaagcagctgctcagaggactttagccctgcagaagccaaaacacggctgctattatacagaaggggagaccaaaaatgctacagacatggctccggcagattatttttgccaccatcgaagtgctgaaaccacactgttaaggagaaaatcttaaaagcagccagagaacaaagatctcctccccacagacaagccaggtgagaggcgcagcctaagccctgaaaaaccacacaggaagaggcagcggcagaggccccaccccagccggtgctgctcccctctcctcttcatcaggactgtccccgctccctccacccagtgctgagaccaacagcagacatgggggcgagggtgtgatgcacttaacatgacctaagccacacaaatatattaccaacaaactccaatgacttaactttgagattctcttcatctaagtttttaaagtggtcattcctagtttctctcattcctaccagtgctctggacagacttgcctgtggccaggtgcacacacgttccccctctgagctgcacacactttccctctctgagctttggtcctctcctctgtaaaatgtgatgattcacatcccctcctggccacaggcgagtgtctgaggtgccgagtgcaccctgctcttccctacaaagcagaccctttctcctttccccattatcacagatacctgcctgggaatccggaagaggcccttcccagtccaacaggcagctgctattatcaagcaggccaggtcccaaatgctggggacttcctcctcctaaatctcattttctccccagacaaaatgagagcaacaatccccacatccctgggttaggaaaataccctgaatgaagatgtgcagtctctggctgggctggcccaatctctatgccaggtccttccacctcacctctctctttagcaaagtagaaattgagaaattctgaaggctctgaagcttagacactcaggctatcaaagagcccagagattggaggctgaagactgccagggttggccgtgctcctcttcagctgtgactctgctgtggccccagctccttcctataaactaggcagatataaaatctgcagcggccctttataaaccacagtggtctgtgttggcagatgtgtgctgccgtgtaggaggacaaatcacatgctcagggctggtgtcagtcactcatgactctggatccccagggcacctgtcctaatgaacttgaaagagaactgaaggcactggcatttttccagactaagtgacaccaactgcccaacagcacaggctcagggcatggcactgtccccatctccgacctggaagctaaagccttgctgccctgtcactcctggatacaggacagaggaccagaactgggactgttgcctctcagtaggggctgggtgagcagccatctgcagccacatggatggagacctttcctgctcactcttcaaactgcaaccagtgccgggtgcccaccagaaggacaactggaaggaaacgtggcaggtaagccaggctgtggccctgcagtgacatctttgtcctaacttgaagtctggctcctctgttcctccacggcccctccccatggcgctccaccccattccttagaaccttctgccccaagctcagagagccagtatggaggtgcaggtgggagcaggtgcagcctctgctgggtagaggacaggtgctctggggatccagagtcctgagtgactgacaccagccctgagcatgtgatttgtcctcccacacgacagcacacatctgccaacacagaccactgtggtttacacagggccgctgcagacttttatatccacctagtttataggaaggagctggggccacagcagagtcacagagctgaagaggagcacggccaaccctggctgtcttcagcctccaatctctgggctctgatagcctgagtgtctaagcttcagagccatcagaatttctcatttcctactttgataaagagagagacgagacgaggtggaaggacctggcacagagattgggccagtccagcattgacagagccaggacctggggtgagaaactgagctcagctccaggctcatctgatgtcatcctgacagtctgaggacagagacattatctccattcacaggcatggcgggtggcaggaactggccccagccgaccacagtttcctaagtgcagaggtgcgactgcagtcttccctgctccctccccaacggtctaatctggagtctctaggtcatctactcccagtctcaaaaaattcctggatccttgaaaatctctaataacactgaaacaaaaaatacaacattgaggtctatcattttttacctcttagagtagcaaagaatgaaagttccatgtagtaagggtgcagggacacgggcacgcttgtgtattcttttttttttttcttgaaacggagtctcgctcagtcgcccaggctggagtgcagtggcgagatctcggctcactgcaagctctgcctcccgggttcacgccattctcctgcctcagcctcccgagtagctgggactacaggcgcccgccaccgtgcctggctaatttttttcaatttttagtagagacggggtttcaccgtgttagccaggatggtctggatctcctgacctcgtgatccacctgtctcggcctcccaaagtgctgggattacaggcgttagccaccgcacccggccacacttttgtattcttggtgtgagagtaaaactggcacaatcttctcccgaagtacaatttagcaatatccaaacaaaattctacattgatgagctcatgtacctaaaaattcctcttctaaagggctgcccgatacttcagggaacattgacatatggacatatgacacatacaagggttctcactacaatgctgctggaattagaaaaaacaaaagcaggacataatgttaacaattgcccatgggatggaagattaaaattaactgtggttcacgccatgtgtttcacccatgcactaaatattatgatgctgttaaaaagaatgagatacttgcatgtactgatagaaaacatccaatgcgatttgttcttcagtcagaattttaaaagttaaggtgcctataaatgcacaggaagaaggctgagggatggtgggatgagagggtcctgtgggatggcagaaggccttggtgtctgctacgggtcctttgtccctgccagggctcacgttgaaatctgaaccgtaatgtagctggtggggcctgttggggtttggggtggatccctcatgaaaggcttggtgccataaccgccccctcccacattcccccaggagttgtcaatcttagttccccatgacacctggttgttagaatgaacctggcccctccccgtctcccttccggatctcatccccctcctcctgccatcctccccaccccttcccctgatgggcagaatccagctgtccttccccttcaccaccagtggaagtttcctgaggcctcaccagaggcagatgctggtggcatgcttcttgtacagcctgcagaaccatgtgccaaataagcctcttttaaaattatccagcgtcaagttttcttttttattttttttcttttccgaaacggagtctccctctgtcgcccaggctggagtgcagtggcgtggtctcggctcactggaagctccgcctcccaggttcacgccattctcccgcctcagcctcccgagtagctgggactacaggcggccaccaccacgcctggctaattttttgtatttttaatagagacggggtttcaccgtgttggccaggatcgtctcgatctcctgacctcgtgatccgcccgcctcggcctcccagagtgctgggattacaggcgtgagccaccgcgcctggcctcaagtattcttttatagccacaccaacggactgtgacatttccaaaaccaccaaattcagatgtttcaccttgtctatacaggtgagccctacatccacctggaatcgcactagcctgtcaaaaagaaagccatttaataagcgtattaaaaataagagtcaaacgtgggttccacctaacataaactgacgtttaaaacataaattctgtaattatttggagatttcaaaatgctattggattcctggattttgtttagtttgttaaacaaaaacacgtaaaatttcctgacacttgtaagactggtttatccttcaggtacttagctttcgttttgtttttccttaacatagaaggaatctggatgagaacaattggtagagccttaatgaacttgaaagagaactgaaggcattggcatttttccagactgagtgattgctttcacaggaaacgctgcctcctgaaggaagggcgtgccccgctcctggctgcctgcctcgtggtggtcaattcgctgccctgtacctgttgatgcgcaagaaagtggctggaaggaaactgctgccggtgtgctcagtggactcgaaacggaagacaacgagcagaggagagaaagttactttttcctgccgggctgcgtgtttaaccaatttgtctaagaaaagaaggatggagggccgggcgcggtggctcacgcctgtaatcccagcactttgggaggccgaggcgggcggatttggctaacacagtgaaaccccgtgactactaaaaatacaaaaaattagccgggcgtggtggcaggagcctgtactcccagctactcgggaggctgaggcaggagaatcgcttgaaccaggaaggcggagcttgcagtgagccgagatcgcgccactacactccagcctgggcgacagagagagactccgtttcaaaaaaaaaaaaaaaaaaaaaaagaagagaagaaaagaaggacgggggtggggagggaatcagggagtggggagaatggcgctccccttcacgcagctggtgtggctgggagttggcttggaagtttacacacttgagctctatcgattccgaaacttcccgatacatcgtgaggtgtgggcaggagggagacgcgccaggcagcagccaacggggtggagtccccgggcccagcctcctgcgggagggggctctgctgcctccaggcccgggtcgctcctgcctggccccggggaccccgttcttcctccgactccgacgacgggctcctcctgcccggacatgccccgccacaagtgacccgggccaggcacccccgccgcgtccccctctctctctgccccctcccggtgccaggcgcgcttttccccaggcaggaccgcggtggggactcacctgcagcaggaccccgacgacgacaaacttgaaggtcttgtggacccggagccgagggctggcttcccgcgccggcctgggtcctggggcgcgccctgcccgggcccgggcactgggtccgtgctgtcccatggaggtagggagcgctcctcggcccccgcctcgtggttcaatcctccccgcggaagagccccacactttgctgggtgtggccgcggctgcctctgtcccactcgctgcgctcccgggattcggagtcactgccaggaacgcacctagatgtactctagctggtggtggcgccatcctgccaggtcaatccaagaagcagcgtgcttggctatgacaagacagaacttcgcattcggagttcagggcacccctgaccccgcccccttttcggggcacctgc

SEQ ID NO: 250 - DNA, 81437 bp, Homo sapiens
  source 1..81437: mol_type = genomic DNA
agtccagatgatagttaagaaagcagtaagaatacagagagtccacaatgagatgaaaatgcactgccagttgaaacatcctcctacactggagctttataaatattttaaagacaaggattggattagatttgacattagaaatgtaccataatacagaaggcaatggacacctaaagaacagaatgaaaaccttcttaggaaatgaagcttgacacttcacccaccaggccaccacaagaatgttgcattttcattattatggtaagtacactggtaacttcttttctaacctcgtatgcataatgtaaacatcaagactgacaatttggggctagcaactcaattggaaaatcactgttctctattgtaaaattcctaattatgtttccctagaaattgcaaagtgcacatgtacttgcatttaatgtttggtccatgggctgaatgctttgtgcattacttttctggttgttgttgttgttgttgttgttgttgttgttgttgttgttttgagacagagtctcactctgttgccaggctggagtgcagtggcatgatctcggctcactgcaacctctgcctcccaggttcaagcaattcttctgccacagccttccaagtaactgggattacaggcgctcaccaccacaccctgctaatttttgtacttttagtagagacggggtttcaccatgttggccaggctggcctcaaactcctgacctcaagtgatccacctgctttgacctcccaaaatgctgggattacaggcatgagccaccttgcccagcctgtgcattacttttgaggacacatttgacaatggcacagtcaagaacaccacataaagtagtattggcagattatgaaatagcaattgttttggaagacagcaaaacctgaagtattttcagacatgtacattatgaagtattataccttctttaactatgtgcaagttaaaatcagtcataactgaaaatcaaaagggcaataatgaacatacttcatccagaagaggtatccacaaaacttctgaaagaggtcttagtatatccagggatggagatattattacaatgtattatccaaatgatggaagttttctcttgctgatagaatgcatccacctactaacatcagtaagtacaggtttaacaatttaccagaaatgtactggaggaaatatgaatatgcttccagatttattctacctaaaggatctggctctattttacaaggtcatctattttacaaggtactgtagatgcattttgatgaaaaaaattaccctgctattgattttgaggtctggtattatgatagagcaaaaactatccaaaagagatttaattcaagtcattgcaaaatcttggaaaatgtgtgagaaatcttacacatggaaaggaggaagtaaagatggtagcttaaacatgtgttccactgtgaacaattctctgcaaacccacccccaaaagtcaaggaggctgacaggctgaagaaagaggctgtcaaatctagtttctcagaaaaagaaaaattaatagggacttaagaacagaagccatatatctgccctgagatgagctggtggatcctcacactgttacccccagacccagggcttatataccacagggaaagacaattgcagtaatttgcttaacggcaggatttacggcaagtacatgctcttaagagtagattaagtagtaaccttagaggcattcctagaactggagttaatcagaagtcaacacagtggattagcatccaagatggagttgctttagcctccacaaagagaaaatgaagataaatttggtccatgctaattagggggtgttccatttgtttgaaactgaaatctataatttccaaagaagaaaataaacgtggaagtcgtccttcctttttggtatgcatagacaatctggcagtgttaggcccctaaggccttatcacctcctccttctgtgggtcaaactttacagtgagaggaaagacatcttttaaaagaagaataatcatgactagtttaatcatgactagttcatcttccctgcaatagatacccatatttaacatacctattgtacaaagaatatgattgcacagctacaactttgggacaaactccttttctgccgctttcaatgatcgtcttccaaaatcagaacagcttttgaattttattttgtgaaaaatgtcgtttgagtgacacagtaaactctgtggagctctgtggatacagttgaatgatggctcccagtttatcatgcaggtgggattatattccaacagttatgtttcacagaaaggcaaaataaccaggtacggaaaaaatgaaaaatttgcagcttacatcaaacagaaattgcagtgtctttcatctctttaaagttttctaatcaaaattctagttttcatcaattaaaactttatttaggtagatacatttaataagtaactttttgttggcttaaagggaatgaactttatgtaatgtaactgtctatttcaggaagcttttctatgagaatttaaaactacaccaaaatatcttcttttttttttttttgagacaaggtgtcacattgtctctcaggctggagtgcagtggtgtgatcctagctcactgtagccttgaattcctgggctcaactgatcctgctacctcaaccccccacgtagctaggactacaggcctgcaccaccacatctggctaattttttatatttttgtagagaaatggtctggctacgttgcccaggctggtcccaaactcctggcctcaggtgatcctcctgcgtcaacctcccaaagtgttgggattacaggtgtgagcaaacctgccatctcaaaacatgtgtattttaatgagacaacaaagatcaagggaactttagtccttacaatgtaatgatcaaaaaagtgaaatagataatcaacataacattgcttgtagaccatgcaaacaatcttattgcatttgtatatttgtaatgaactgttttataataacaaaatgtaaaatgtgtattttatttgtccttttattgttttcctacttcttagacatgttaagaactatggaaaaagatatgggagtttgtgaaaatttaaataattcatatttatattacaagaaacagatattagaatatgtttgttttatatttcttttgtagcagaattttctagccaggcattgtggcttacacctgtaattccagcactttgggaggctgaggtgggacaatcacttaagcccaagagtttgaaatcagtgagggcaacatagtgagactctatctctacaaaaaattctctatctatatctatataaaggaattttgtgaggaaaactatatattttgtatataaatgaattttatcaggaaatatatctgtaaatgaattttataaaatatagcatcactttatccttgatttatttcatttaataattattttaaagtaatatactaataaactcattttaaaaactgctatgaccataaaactattagagataacataagagaaaatctaggtgaccttgggtttggagataactttttatatataacaccaaaggcgcaatcaatgaaaaaaaatgacaagctctatatcacatatcaatattaaaatgtgatctgtgaaaggcatcgtcaagagaacaaaaagacaagccacagactgggagaaaatatttgcaaaagacatatgtgataaaagacaattatcaaaatatacaaataattcttaaaactcaaaaataagaaaatgaacaactcagttaaataatgggcaaaagatctcaacagaaaccccatcaaagaagaaacacagtggcaagcatatgaaaatatgatctacatcatatgccattaggaaattgcaaattaaaacaatgagataccactacatttctacattggtgaaaattccaagtactgacagcactctcagtgctggtgaggatatggtgcagtagaaatccacactcatgccgggcacagtggctcatgcctgtaatcccagcactttgggaggctgaggcgggtggatcaccaggtcaggagtttgagatcagcctgaccaacatggtgaaaccccggctctactaaaaatacaaaaattagcccggtgtggtggcgggcgcctgctactcgggagtctgaggcaggagaatcgcttgaacccaggaggtggaggttgcagtgagccgagatggcgccactgcactctagcctgggcgacagagcaagactccatctcaaaaaaaaaaaaaaaaaaaagaggccaggagtggtggctcacacctgtaatcccagcactttgggagactgaggtaggcggatcacttgaggtcaggagttggagaccagccttgccaacatgacaaaaccctgtctctactaaaaccacaaaaattagccaggagtattggcacatgcctgtagtcccagttactcgggaggctgagacaggagaatttcttgaacccgggaggcggaggctgcagtgagccgatatcgcaccactgtactccagcctgaacgacagggcgagactctgtctcaaaaaaaaaaaaaaaaaaaaaaaaaaggaaagaaagaaagaaagaaaaaagaaaattccgtgattgcagtctttacgtatttatttgttattaagtacagtaaaataaagaaggatagatgtcatggaaaatgtcacgaaaataaaagagttaaaaaaaaaaaaaagtaggctgcaatgccagatgcctgaaaagttaatcaacgaaaggacttaaatgtccccattgaatttaggaacaaagaagtaattaatgaactgggcaaaaacactcaatgtaccagcgttatcgatttagaaactgaaactaagtatatctgatgttgcttttaggaaacaagtaaatgaggtcctaaaaagttaaactgtgaccatattttctttcctttttctaatttctccttgggccatttccaaaaagccctaataccccgactgatagaaatggataccttgctgtgcactggtactactgtgattcatggaaagctgatcatgcaacccaagacgccaaaattcccagccttactgttacgaaagaaagtttctaagcacaattgtctctagccaacttcctcttagtaagaaagaggccaggcagggcttcatgcagggtacagccctgagtttcttactgcgtggtaagtttctggggctgggagtaaagcagcgtgaccgaaagcagtacaaagttctaccggacacgcagatcccggtcctacaaatatgaggtccataatgagactgagatatcattcatccaacaaatatttattgaataccaaacattgggcttacggctaaaggaaaatacaaagttgtgttggatatgggttctgttttcaaggagcttataatctaataggaaagatgaggttactacattagtagcaatcagaccagatagaactggaagtgtgatgtaaatgaggtacagattgattgtagaattttgcagaaagaaaacaattctgaagaaatgttcatggaagtattagcagttgagatgtatcttaaaagataagtggggttcctgttggaaacattcaaaactctctcttctagctattttaaaatacgcaatatattattaactatggtcaccttactgtgctatagaacactagaacttattcctactatctaactataattttgtacccactaaccaacctctccctgtccctcctccccctattcatcccaccctctggtaaccactgttctactctctgcttcccaaaacaaagaaatgatcactgtttcggtgatggagatgtcaattaccctgatttgatcattacacattgcatacatgtatagaaatatcacatgcaactcttaagtatataccattcttatgtaccaaatacaaataaaattgaaaaaaaaaaaaaactttggctgggcgcggtaggtcatgccagcactttgggaggctgaggcaggcggatcacctgaggtcaggagttccagaccagcctggccaacatggtgaaacccaatctcttctaaaaaatacaaaaattagcttggtgtggtggcaggggcccgtaatcccagctactcaggaggctgaggcaggagaaatgcttgaacctggaaggcagaggctacagtgagccgagatcatgccactgcacttcagcctgggtgacaaagcaagactccatctcaaaaaaaaaaaaaaaaaagcctcctgagtaactgggactacaggcatgcgacaatactcccggctctctttttaaaaatgagaagtagaagtagtggtgactgtcaagaaagtattttggaaaaatactatgaataaccagaccaaagaaaccaaataccagttgtttcaggagcagtaaatcatttttgagggcttgagcaaaggtcttgctagaaaggtgcttaggggtcagattttggacataatgccaggccaagaaaatttgcactttatttcattaacaatgaggagctcttgaaagttttattggcaggacctaagatagttacagacccacaagtaacatgggtctagaccttgggaacaagaaaagtcaagatcgagtatgcagacttgggaaccgagtataactaatggttaagattaaataaaaatacataagaacactgagatagagaaatggctcattaatgctgcaaatgtctgcatgtttagggatgaaatagaaaaagaagtcagaaaaatacagttcaaacaataggaaagaaaaccagaaatgcatgattctaagaaatgaatgggtggacatggtggctcacatctgtaatcccagcactttgggaggccgaggcagaaggatagctacagcccaggagttcaagaccacccagagcaacacagcaaaaccccatctctacaaaaaacaaaaataaaaattagccaagcatggtggtacacacctgtagtcccagctactcactcaacaggctgaggcagaaggatcacttgagcccaggaggtgaaggatacagtaagctatgattgcaccattgcactccagcctggctgagagaatgagagcttgtttccaaaaataaaaaataagaaagaatttttagaatgagaggaaaacaacatgaaacatgagaaaaataacattccctgttatatggtaggtgcttcgcttatagtttctcattaattcatcatgtaatgtctctgggataaacattatggatttcctgcagaaacagaagctcagaattttatgccaggtgttgaaaggccatgtagctaatagatgatagaacacagactcacactctggtagtcctgagttaacagtagaaaagtcctgggctgggcgtggtggttcacgcctgtaatcccagcattttgggaggttgaggcaggcagatcaccagaggtcaggagtttgagaccagcctggccaacatgactaaagcctgtctctaccaaaaccacaattacccagcgtggtggcgggcacttatagtaccaactactcaggaggctgaggcagaagaattgcttgaacctgggaggtagaggtttcagtgaggcaagatcaagccacggcactccagcctgggtgacagaatgagactctgtataacaaacaaacaaacaaaatcagtaagaaagtcccagactaagaggcatcaaatcaggattctactccaactctgatgccagcttccaggaatacacttgataagttgtttcattcccataaatcttgggtgattcgtgtttaatgagagcattgaactgaatcatttattctatgactcagttctaatatttcacaattctatggttgtataatattacaggaaattcttgagaaggtgcagagggaatggatgaaaaaaaccacatgactaacataaaaaataatggggccatcttttcatttgagattgaaggaaagaacgagaggacaattaaacatgcagagtctgagaacttgcatttaggaggcataagatgctgaactgcaaaattggttagatattgggctgaagagaattgagaattttttaataataaaaactcttggcagggcgcagtggctcacgcctgtaatcccagcagtttgggaggctgaggtgggtggatcacttgaggtcaggagtttgagaccagcgtgactaacgtggggaaaccccgtctttaagaaaaatgcaaaaaatattagctgggtgtggtggtacaagcctgtaatcccagctacttgagaggcttaggcaggaggatcacgtgagcccaggaggtggaggttgcagtaagccgagattgtgccactgtactccagtctggatgacagagggacactatctcaaaaaacaaacaaacactcttaagaaattaggtgtagaaagaatgttcctcaataccataaaggccatatgtaagaaacctatagctggccgggcgcggtggctcaagcctgtaatcccagcactctaggaggccgaggcgggcagatcgcgaggtcaggagatcgagaccatcctggctaacacagtgaaaccccgtctctactaaaaatacaaaaaattagccgggcgaggtggctggtgcctgtagtcccagctactcgggaggctgaggcaggagaatggcgtgaaccccggggggcggagcctgcagtgagctgagatcgcgccactgcactccagcctgggcgacagcgagactccatctcaaaaaaaaaaaaaaaaaaaaaaaggaaacctatagctaacatcatactgaatggtgaacagttgaatgctttcgtctaagaactggaacaagacaagcacgccaactctcaccactcttactcaacatagtactttaagtcctagccagagcaatcaaacaggggaagtggataattgagaatggctcgagaggtgctgtggctcagtcctgttgtcctggcacagaaggagctgaggccaggcgttcaagaatggctcctagatgtctcataaggaaccataaatcaaacaactttcaaaactgaaacctgcgtgagaacggttgcattagttaatctgggagcttcctgcttttttttagctttcatatttatcttagagaaagggaggaaggagagatgtgtatggatacataagcattcaaatacatttgtgtataatcttatgaccagaattcaggtccaatgaacaaaaaggtagggtcttcggaatttccccagtgagatctatgacctgaatattattacgcaaggatccactttgggattacaggcgtgaaccactacacccagcccaggactttcctgctgttaactcaggactaccacaatgtgagtctctgttctgtaatgcccaaccttgtttttactaaccccgcttttagactccccgttttcctttaatcacctagccttgtttccacctgaattgactctcccttagctaagagagccagacagactccatcttggctctttcactggcagccccttcctcaaggacttagcttgtgcaagctgactcccagcacatccaggaatgcaattaactggtaagatactgtggcaagctatatccgcaattcacaggaattcgtctgattgataacgcccaaagccccgagtctatcaccttgtaatagtcttaaagcccctgcacctggaactgtttactttcctgtaaccatttatccttttaactttttgcctaatttatttctgtaaaattgttttaactggacccccctcccctttctaaaccaaagtataaaagaaaatctagtcccttctttggggctgagagaattttgagcgatagccgtctctcggtcgctggctaataaaggattcttaatttgtctgaaagtgtggcgtttttccaactcgttcaggtacaacagttctagcatctattagctatgtggcctttcaacacctggcataaaattctgaacaatggcttggaaattaagataccttagctctagtccttgctctgctaataattaatagagtgaaactggacagggttattcacatgtgtgtgcctcagtttactgttaactgaagaatgacaaagttcataaatttgaaaaggagaggtttcttatatggggttgcaacctgcagggtggccatgctacagtctgggaagcattgcctctggctggaagccagaaacaggcactttcagggtcagaagaataagacagagatttatgctgaatggggtgaccaaatatacatattcaataggctataggaggagttatgaatatttatgaaaggagaaatgtgtacatgtgcaatttggcttcatgccccttcatgggacctacattcaaaaaatggcagccttagcatgatctgagggaggatctttcagccctctgaggtcaaaagtgaaggagaggacaggaaaccctcactgtgtgttctccgtaggggccagaaccactgcatgtttggtgaacctggctggttgttatgttgaaactgcaaaagggagggataacagtcaggtgcttgtttgataccaggggtagaggagactttcaaaagggctggtttctgtttagcccttagggaagaatgtctaaagagaattacctacaagggtataacgaggagtgtctgacattccatctagtaatgaactagaactcagttttcaagttaactctgggaccctcttagccaagaagaggtccattcagttggttgaagagcttaggatttcatttatatctctcatcactaatctgcaaaagctggtagtgaaaccgcctttgcaaaattatgactgagacagcgaaagagatctaacttaatcgattccgtcttgcttctaacctccaagctgtccttattcattcccgggcataggctgaactaactccgggagaagcttagtttatagtttttagtttaaaacaaagatagtaacagccctttcccaaagcagacctccttcttgccttggaactagactgcctttagtgggactaacattagccacaagattagaaactgtggcttaggagtcatacagctggaggctacaagattctgactctccctaaactgctcctaagatcagtccttgagatattttgcagaccctgtacttgatggatcaggtggcaccacccagattgataaagtggctcatctgatcttgtggcccccacccaggaactgactcagcacaagaagagagctttgactctctatgatttcatctctgacccgtcagcactcctggctcgctggcctccctcaggccaccaagttgtccttaaaaactctgctcccactgggcggtggctcatgcctgtaatcccagcactttgggaggccaaggcaggcggatcacaaggtcaggagattgagaccatctggctaacatggtaaaccctgtctctactaaaagtacaaaaaattagctgggcatggtggcacgcacctgtagtcccagctactcgggaggctgaggcaggagaatcacttgaacctgggaggcagaggttacagtgagccgagatcatgccactgcactccagcctgggcaacagagtgagagacttcatctcaaaaaaataaatagataaataacctccgctccctgaatgaatgctcccggagactgatttgaatcataataaaactccagtctcccgcacagcctgctcttcatgaattactctttctctattgcaaatcccctgtcttgataaattggctctgtctagacagtgggcaaggtgacctcactgggcagttacagtagtacccacttcataagtgaaatcacttatcttagtggtagggtcccaaaagttgtttggtaggagagggttgaggctgggagaggtggctcatgcctgtaatcccagcactttgggaggccaaggtgggtggatctcctgaggtcaggagttccagaccagcctggtcaacatggtgaaaccccatctctactaaaaatacaaaaaattggcgtggtggtgggtgcctacaatcccaattacttgggagactgaggcaggataatcgctcgaacctgggaggcagaggttgcagtgagcagagatcgcgccactgcactcaagcctaaccaacaggggcaaaactctaggactagagctaaggtatcaaaaaaaaaaaaaaaaaaaaaaaagaagtagagtgtttaattaaataatttgttcttgctgtaaaatgtaaagtagatattcctcttcaaagactttcctccccgtctaattaggaataaatagtaacttctcttagaagcaaaatttattcaaagacctgtgctaacattcttaaatatctgctagccacaataaggaaatcaatgtactttatgttcttagctcccacaatttagcctaaatattttccctggcatgtttatactggtctaagcaagcattaggtcatagcctgttcctcttccttatttaaaagtgtttttacctttctcagcgttccacaagttacttcctccttcctttgttctcctctacctgtgcctcttttaaaaagttctaagttgctagccaattgggacaaatacagaatgtaaggtcccattccagccaacggaaactggacacagcagtagggtggatgtgtcaggttataaatgaccctgtctcctttgtttggtgtactctagtggcaaaactgctggcaagtgtaccttttctgcaggaagtaaaaatggccttactaaataaattaaatttatgttcaagtgctatttcttttttttttttttttcgagatggaatttcacttttgttgcccagcctggagtgcaatggcgcgatctcggctcactgcaacctccacctcccaggttcaagcaattctcctgcctcagcctcccgagtagctgggattacaggcatgcgccaccacgctcggctaattttgtatttttagtagagatggggtttctccatgatgaggctggtctcaaactcctgacctcaggtgatccgcctgccttggccttccaaagtgccttggccttccaaagtggcgtgagccactgcgcccagcctcgagtgctatttctttacggcacggaagaacaaacatttcaaacaatgctattaccaagtttgttagtatttattatctcatttgctaaacctaaaaaatatatatccttctttaacgtgatcgaatatttcaaaaagttattgtgttgtttcttaaaataaatcaatcataatcctagactatgttgctcaaactacatacaacaccttctgagcttctggcaggcccttcctcccctccctgctcaccacagatcactggaataattgtctgcatgtaacttctaattttgaagtggttgtggtttatcaaacctggaacatggcacttccaagtacatgagctaaggtcacagtaagactcaagccccttcaacagaatacctggaatttctctgttaaagattttctcctttacctgactacatgtttgtaatgcagatccctccaggagcgcttacttataaactgtcctggatcactaacgcgacattttgatgtaaattagtttatcttgacgtgctaatggtagaaaaaaagagaacatgaggaaacttgggtgctttcagggctggtaggaaggattaaatctttgcggcaatttctgagaaggggaaggaaaccttgctaacaattttgatagtttactccatttggctggagtaactctgatccatttgtcaaattcacgatggagcaggtacctgttagggtacaggtttgataaaccacaaccacaggtctatttcatttctccttttccaaagtggaacaaatttgtctctggggttaaaactgcttttctcatattggtgtgtaagagaaaatgagggaatttctttgagtttgtttggtttgtctgtttgtttaagcagcattttttaaataatttactcagccctgtctcagagaaagtccatgatgatctggaattcaacctcagggaaaagttctctcctgtgcctgagacactgcgcaactaactggaaccgaaggatggaacctgggtgtttaatttattaggaacaattgattcttcagtgacactttccatgcagatacttcaaacaaaataatggagccccacagaccgaatgtgaagacagcagtgccattgtctttggaaagctatcacatatctgaagagtatggctttcttcttccagattctctggtaaggatagagccttggtaaggataggtcagaatatgtttcttgagatgttggttggtttgttttttaaaaatgtatgtgattattaagagaccaatataaatatcaagttgtttacctgagaaagatgctacaaagagcatagattatcattactatcaaaagagaagtgacagataccacagagaacaggtcaaatggaacattttttgtttcagtttcttttgactagattgtcaggccagagaaattataagcaaacctgtagttatcaagaaaaagcatgaacttaaatataaataaagaacaaatatagagcctcagcacctggaacatggcacttccaagtacatgagctaaggtcacagtaagactcaagccccttcaacagagtacctggaatttctctgttaaagattttctcctttgcatgactacatgtttgtaatgcagatccccccaggagcgcttacttataaactgtcctggatcactattgcgacattttgatgtaaattagtttatcttgacttgctaatggtagaaaaaaagagaacatgaggaaacttgggtgctttcagggctggtaggaaggattaaatctttgtggcaatttctgagaaggggaaggaaaccttgctaacaaacaatacctctttcttaattctacttagggctcaaattgtaatgcaaatctttttcatcatttagcccttataaacactgtttttctcatctggtgtggtccaaggcctagaacattaaaactatcaaagcttttacagaccatcaggtgtcatccccctctttctacatctgagctagctgaaatccagaggaaatgacttgctgaaagtcatgagtggcaaaagcagaactagttctgcttataactcttgacttttagttattattattattaattattattattacatcctaaatgagggccaaggccactcagttaaaaatcgtggggtccaggccaggtgcagtggctcacgcctataatcccagcacttttgggaggccaaggcaggtggatcacttgaggttcaggagttcaagaccaggttgatcaacatggtgaaaccccgtctctactaaaaatacaaaaattggccaggcgtggtggcacatgcctgtagttccagctattggggaggctgaggcaggagaatccttgaacccaggagggggaggttgcaatgagtggagatcatgctgttgggaatgaagtttttggtgtcacagaaaaagaatgaacatgggaacaaatgatctctcagcaaaaggacctttactttctgcagaaagggtgctactcaatagctgtccagccacgagagcacaccaaacaaaggagacagagttatttataacctgacgcatctaccctactgctgtgtccagcttccattggctggaataggacctcacattttacactttacccaatcggctattagtttaaaacttttttaattggataagggaacagaacaaagaaagaaaagcaagttgcccagggatagttaaggaaacatctccatataaggaatggcatgcactatgggctggggcttttctagttctgtccagacatgccggagcaagctacgacagctgatttggacagccactaatagtggctagcaatcttatagtaagaaattgtgactttttataatctttgaagaactttcccatttctgacagtgccactgcactccagcctgggcaacaagagcgaaactcgtctcaaaacaaaacaaaacaaaacaaaacaaaacaaaacagctctctactcttggaagcagcagagtttttatcttcatttatatcactccggtaacactcagaagtagacaagcctcagggtaggtattcagtaaaagcccactgaattccacactattctttaatcatagttaaatggcaaattaggctggagggtgggggtggaacctctccaaaattactgcaatgactgcaacatcggaccccaagattttttttttttttttctgagatagaatctctttctatcgcccaggctggagtgcagtggcactgtgagaaatgggaatggaccggactgtttcctctgacactgccactaggttgaccaagtgtccctatttgttaggtactggatggacgcctgacatgcaagactctcagtgctaaatcaggaaagtgctgggacaattcggatgagtcggtcacgctaagttgcacttaatagctcttgtgactttgactgaattacaaacatcccctgaccctcaattttcacatttactggatggagatctggtgccacctccactagattgctatggagaatgaatgtgaaagcattttcataaatccagtgtaaggaccagaagccagtcttctgaccttgagccagtgcttgttaaaaactccactctatacatctaacccaattcaggaatatcctgcctagttccaaaggaagaaaagaccaaattgctcttattgggattaaatgcgtacactgagctgaggaaaaacagtattacaaatgagctaaacatgacgtagatccacagttgtagaattcccctctttgttctttcctctttcataactacggaaacagatgagaaacatttacggcatcaggttcttgtgatgctccctgcctgatatgctatggttttgttaatggaatgtccattcctgagcttatgcagaaaaaagtcccttgggaaagtggttttactgtgttatgttcattttccccatagttctcaaaatgtacttccttgtttcagttttaattttctttcattggtgtgaccattttcaactgctccctttctgggaagaggtagcagacggacattttcatcaaaatctgccccaggttgcttcacagataaggagggacccagccactaaaatcaccaggcagagtgttgcaagagtagatagagaatcacaattggctgccctgctcaaggggacaccagatcttactttcgtttagttgaaaggcaagcgtcagagtcgggaggctgtaccttcatgtccagtggcctcacagaagttccttcagtatctcttttagatgaaactcttttagaagttccttcagtatctcttttggtttctcactatagatagttacttgaacatgtctgaagaaaacgtggtcaagacagtgaataaaaaaaattctggttttgggaagcagtctgacttagtttcaaatattctatcccactgtttctgtcaatgttcaaacctttccaagctccaacatttattgtggaaaatgtgtgcctcaccaactcatgcaaataaatgtttcatgtgccctacgtgtgtagagggggcatggatgtgtgtttttggagggagggctaatttttctttagacatggagaatacgaggaaattagcttggcatcaagaaggttacagcaggagacaagagtgaagagaactgagagagcccggaaatgaggctctggagttcagatttttttttttttgagatggcgtcttgtaccccaggttggagtgcaatggcaaaatctcagctcactgcaacctccgcctcccgggttcaagcgattctcctgcctcagcctcctgagtagctgggattacaggcatgagccaccatgcctggctaattctgtagttttagtacagatggggtttctccatgttggtcaggctggtctcaaactcccaacctcaggtgatccaccctccttggcctcccaaagttcaaggattacagccatgaaccactgcgcctggcctaatttttgtatttttagtagagacagggtttcaccatgttggtcaggctggtcttgaactcctgacctcgtgatctgcccacctcagcctcatgaagtgctgggattacaggcatgagccacagggccaggcctggagttcagatttaacacatcctgtaaatgacatgatgcatctgatatttgaagagttttcctcaaagaatgttacatgcaaggtggtttagagttgttgtttccggctatatagcaaaagtacttggggagttttaaaaaatactgatgccgaagctccacctagaatagttcattcagaatctctagcataattgacctcagtacttgaaatatgattattataaatgttagtcaactgcttttttaggctctatgactgatagaaatctttcacttttatatcatctccagttaatgagtcccataaattgaaatctagtgtttaaatttttacttcatatttatttttactgattgttttattattattatttttgagacagagtccgctttgtcgcccaggctagagtgcagtgacgccatctcggctccctgcaacctccgcctcctgggttcaaacgattctcctgcctcagcctcctgagtagctgggattacaggagcccaccaccaaccacacccagctaatttttgtatttttagtagacggggtttcgccatgttggccaggctggtctcgaacccctgacctcaagtgatccacccgcctcggccctctgtctcaaaacaaaaacaaaaacaataacaaaacttttctcttctacccgagatgtttaagtttaaatcacaccatttgtacaaaaattccctgtcttgtccttaaaaataatttgtaatcactagctagttttgagatcgattgccatctaaccgaatgccatttgttctctctctctagtttcaacttaataaccctttctgcattttctattctttcaaaatttttccggccattttattgtttctatttagtgaaaatttattcactggtttctatgcctaagggcatttaggaagttgcttaggatacagacgtgataaaaagaccagtgtaaaaactctccactcctagacattatattctagtcctcatctcctgtcatttaagtcctcagtgattctatgcacttttgcttttggtttgggcagatgctctgagtttaatgtttctctgagatgaggaccccctattcaactcacaaatcccataaggaggcctctgtgcctttgctggtgccccagacagggtgctgatgcttacttatcttcaagattgtgaagtcagatttaatagtatagtcgtttgccagagctgctgtaacagtagccacaaacagttgggcttaaaataccacaaacaggagggcttaaatcacagaagttgattttctcacagttcttgaggcaggaagtccaagatcaaggtgtcgtggagttggtttcttctgatgtcttgctccttggcttgtagatggcctccttattattgtgtcctcacatggtcttttctccactatgcacaaattccctatgtctctctctcttttttttttttttttttttttttgagacagagttgcactctgtcacccaggctggagtgcagtggtgcaatctcggctcactgcaacctttgcctcccgggttcaagcaattctcctgcctcagtctcctgaatagctggtattacaggtgcgcaccacaaagcccagctaattttttgtatttttagtagagatagggtttcgctattttggtcaggttggttttgaactcctggcctcaagtgatccgcgcacctcggcctctcaaagtgctaggattacaggcataagctactgtgcccagtctccccctgtctctttgtgtccaaatttcctcttctttagggacaccaatcagattaaattggacccaccctaaaggcctcatttcaatgtacctccttcaagggcctatctccaaatacagttatatttttaggtactagggctagggcttcagcataggaatttgggggagacacaatttagcacatagcagaaaatataaggccaggaaaaaatattctggcatgctagatggactcattaacaaatattaaccaatataaaccaattaacaaatatttctttaatatttgccttttttttttttttttttttgaaacagagtttcactcttgttgcctaggctggagtgcagtggcacgttcttggctcactgaaacctctgcctcctgggttcaagtgattctcctgcctcatcctcccaagtagctgggattacaggtgcgggccatcacacccggcttattttttgtatttttagtagagatggggtttcactatgttggccaggctggtctcgaacttctgacctcaggtgatccacctgccttggcatctgaaaatgctggggttacaggttgcctggtgatttttaagaggaatgactgagctctcatgccaggtggggggaggggacagagaaagttgaatactctgacgatagccatgatccatagctctgaagcttagactcgaatctacccatcccgcaaggaagaaaacaaagaaataaaaaagaagaaaagaaatctcccaatgtcaggtcccaccctctttagaagtaatttcagcaaaactttgttgctattttggcatgtcctctactgtagtagcttgtcaaaatactgtccccaaacgttttctatatttctagattttactgtttaatgtataataataatgttctaacattaaaacgtaaccatagcaatgctccgactcacttgatctttaaatatattgttgaactcaattttgtgacatcttcagaattgtctttttgtattcataaatagcaacagtggatagttgccttggttagtgttattatttcaaggattaatctttaggttacgttttcttcataagatgcattagatgacttttttttttttttttttgagacagagtcttgctctgttgctcagactggagtgcagtggtgcagtctcagctcactgcaatctccacctcctggctcaagagagtctctcgactcagcctcctgagtagctgggattacaggcacgcaccaccatgcctggctaatttttgtatcctttttagtaaagacgggatttccccatgttggccaggctgatctccaactcctgacctcaagtgatccatctggcttggcctcccaaagtgctgggattacaggcatgagccaccacacgcagccaattagatgccttctcatgcttttctgtgttctgaaacagatcatctatccgttgatatagcatagctcttcagactacagacattttaggctataagttttgaattacattttctattccctttatgcttcttgttctagttaggttttttatttctaaataaaaatatgaatttttgcaatttcccaaatgcgaactcaactgaaattttcaagtgtattagcaaaatttattcatagcagcctcttacatttcattaagaattgattttttcttattccctgttgaagtttgtttataaaatatagtaatagtaataactatatagaaagtgttcactttgtagtaggccctgtgttaactttaactacactttttaaatctaagcctcatagtagtcttggatggatgcggtggctcacgcctgtaaccccagcactttgggaggctgaggcgggtggatcacgatgtcaggagttcaagaccagcctggccaacatggtgacactgtctctactaaaaagacaaaaatcagccggacgtggtggtatacacctgtagtcccagctatttgggatgctgagtcaggagaattgcttgaacccaggtggtggaggttgcagtgaaccgagctcacacaagtgcactctagcctggatgacagagtgagactccatctcaaaaaaaaaaaaaaaaaaaaaaagagatcaataaataaaataaataaataatcctcacaatagtcttcaccatttgcaaatgatccatttgacaataaatgaattcagcactatcatggaaatatatttccaaggtgaccagttttctccatttccaccccacttcaatccaccttcatgtagccctaggactattgtctcctccccttgtttccttatttccattcctgttcagctgtaacacattctgttcatagcagtcaagtgatgcttacaaatggaaatcaggctagaggtggtagttcacacctataattccagcattttgggaggctgaggcaggaggatcacatgaggccaggagtttgagaccagcctgggcaacatagcgagaccccatctctacaaaaataaaaaagaattagctgtgcatgatcctatgtgcctgtgttccagctacttgggaggctgaggtgggaagattgcttgacccagggagtttgaggctgcaataagctatatttgtaccactacactccagtgtgggtgacagagtgagatcctgtctctaaaaaacgtaaaatgaaaataaaaccttgatagtttgctctttaaaactcttcctacagggcccctgtgatgctcacctgtctctagaagggcatgtaatagctctttctccttcactttactttgatgcaatgtcagaacagcttctttccatcaaaacttaaacctttgatttcatttaaaatcatctgcttcaaattctaatctttctgatagtttaggttctaatttttctgatgttaatattgtcacccaagtttcctgttcatatttacctggtttattttatttttatttttatttatgtatttgagatggagtctagctctgtcacccaggctggagtgcagtggtgcgatctcagctcactgcaaccttcgcctcctgggttcacgccattctcccgcctcagcctcccgagtagctgggattacagggacccgccaccatgcccggctcattttttgtatttctactagagacgtggtttcaccgtgttagccaggatggtcttgatctcctgacctcgtgatctgcccgcatcggcctcctagagtgctgggattacaggcgcgagccaccgcgcccagactttattttattttttgagacggagtcttgctctcttccccaggctggagtgcagtggcttgatctcagctcactgcaacctctgcctcccaggttcaggcgattctcccgcctctgcctcccaggttcaggcgattctcccgcctcagcctcccgaacagctggggttacagatgcctgctaccacacccagctaatttttttctttttttggagacagtctcactctgtcgcccaggctggagtgcactggcgtgatctcagctcactgcaacctccgcctcctgggttcaagcgattctcctgcatcaacctcctaagtagctgggattacagacgtctgccaccacatcaaactaatttttgtatttttagtagctgagattataggctcgtgtcaccacgcctggctaatttttgtatttttagtagagacggggtttcaccatgatggccaggctcgtcttgaacctctgacctcaagtgatctgcccatctcagcctcccaaagtgctgggattacaggtgtgagccactgggcctggcacctggtttatttttgtgcatgcttttatttttaattttcctatgctactttcttagccaaaatttatacttaatctaatcaagcattaatctaacaaagagtttagtgttcatataaaatacagttttacaaatctgtttttctttaaattataaatttgttaagaaaattatccaaagaatgatccagaaacaaaagaatggctgtgtgtcttttcaatatcatcctggagcattgtctcaaccatctcactttacggtgactaaaacatctagaggttttccctttgttttctgtacttcttagtattgattaatactgttgtgctacttcagtctgaagttccatgttaatctgtagattttttttttttttttgagacagtgtctcgctctgtcgcccaggctggagtgcagtggtgcgattggctcactgcaagctctgcctcccaggttcaggccattctcctgccttagcctcccgagtagctgggactacaggtgcccgccaccacgctgggctaattttttctattttttttttttaggagagacggggtttcaccgtgttagccaggatggtcttgatctcctgacttcgtgatctgcctaccttggcctcccaaagtgctgggattacaggcgtgagccactgtgcccggctgttaatttgtagatttttatacagaaaagcagcaaaatatttctgttgagtagaaaatataactcattatgtgtctaacctagcaattttatgtcaacactattttctcaaacctctataaactttggctgggcacagtgggtcacacctgtaatcttagcactttgagaggctgaggcaggtggatcaccttaggtcaggagttcaagacaaggctggccaacatggcaaaaccccatctctactaaagatacaaaaaattagccaggcatggtgacatgcccctgtaatcccagctactctggaggctgaggcaggagaatctcttgaactcaggaggtggagccaagatcatgccactgcattccagcctgagcaatagggtgaaactgtgcctcaaaatgaataaataaaataaataaataagtcagagattgtgaataggatgttggatatacccaagttatgaattaattaggagcttgaacccaggaggcagaggttgcagtgagctgagatcgcaccactgcactttagactgagcgatagagtgaaactgtgtctcaatcaatcaatcaatcagagattgtgagtaggatgttggatgtacccaagttatgaattaattaggagcttgaacccaggtttgtctcagatcctcagggactgaagacttccaagtgaattatgggtaatgtataggtctatactactccaaatttacagttttcagacttccctgggttctcatggaccttccatgtcatttctatgtttaggttgaggtccctggtcttttctcctctgtaattaatttcacacccacccctatctcaactcacacaacttgatcttcactcccatctgctaagaaattgagtccataaaaagtgaactcctttaaactctagatcttctactgctgcaaggacagacattccattctggctctctctctcctcctttgcttcttccagtcctttgctccttctgcattctgttactctcctctctcctttgtcttcaatctctccctcttgcaatagccaactataaactgctcaagcttctcattcttaaaagatctctctgaaatgcaaattccctactgccttatggctctccttcaaaagtaatctacattttctctattttctaattcctcaacacactaacgtttgaaccctgcttctatgaccctgacctaaatttctattaaatgtacatagataaactaatatatatttgtgacttcctaatattgttttgttttttaaagaggtcaatcttactttaactctgtaatgatgcggttgaccttctgatgattctctacttctgtgaaatcctctactgtcttgactttttaattaatttatttttttttgagacggagtctcgctctgttgcccaggatggagtgcagtggcacaatctcggctcactgcaagctccacctcccgggttcatgccattctcctgcctcagcctcccgagtagctgggactacaggtgcccgccaacacgcccagctaatttttttgtatttttagtagagacggggtttcaccgtgttagccaggatggtcttgatctcctgacctcgtgatctgcctgcattggcctcccaaagagttgggattataggcgtgagccaccgcacctggccctactgtcttgacttttatagggtcattctattcaagctcattgagcgtctgtcactatgtttttgatctgtattgctggaatcagttcctctatctgccttgtgaatattctccattgtgctaatctaggcttctcctttcatttttcatattccctcacatggctttatacactcttgtggttttaaccacaatatagggtttttactgtagttatgctttcaaattgtatacttctttttttttttttttttttgaaatggagtgttactctgttactccagtctggagtgcagtggtacgatcttggctcactgcaactttcgcctcccaggttcaagcgattctcctacatcagcctcccgagtagctgggattacaggcatgtgccaacacgcctgcctaattttttatttttagtagagacaggatttcaccatgttggtcaagcccgtcacaaactcctgaccttaggtgatccgccctcctcggcctccccaagtgctgaaattacaggtatgagccatcgtgcccagccccaattgtatgtttctaatatgacttttctcctgaactttaaactgtgtatccaacttctcagcacagtcatatcttttgattccacaggtaatttaatgtcaatatatttaaaaatgaatttaccacctttatccccactctttgactttcacctgcatttctgtttcaattcttgtttccatccattcatttgctcacctaattcataaacatggaaatcatcctcaattcctcttcttcttagcccaaaaattcaattgtgcaggttatgcactgagaaaaagagcctcaggttagggggataaatcagagattggtgaactttttctgaagggccaaatactaactgctttaagcttgcttaccatatggtttatgttgcaactaccaactctcctgctgtaatgtaaaagcaaccatagatagcatgtaaacaaatgagacaggctgggtgccaatgaaaattcacgaaaattaatgtagtttactgtcccttgggtgagagttgggggtcactgaaattcggactatgtcttacttggctaaaccacaggcctagagtgggccataaatggagctattgggctagtgattttcttgccttaagcccccagccccaaatttaataatcacatcattttaatttcattttccaagtgtatctttaatatatggcttctcctttccaaattcactgtcattacctaagtttagtccttgaacaatattttaaaggcttccttatctgactttatatcttaaagtcctacaaatttatcttcctaaaattcaaatcaaaccatgtcaccaacttacagaaagggaaaattcatatattctacacacagcacatttcatgtaactttctaggctcatctttcatcatccttttgatgcaggattttctgctcctcagctcagcgaaatccaggatcttgtctcatgaccaggaagaattaggcaggtggacatagtgaagggtgaggatgacggaatttattaagcaaaaggggagttctctgcaaagagaggggtttcaccagcagtctcccacctcacaatggagcaccaggactttcacacacaaactgaaaaggctaggctcctccccagcataaggcatgaattcctggtggttccaccagttttcctactatgcatgtgggtgtgcccaagcaaaccataggtagtatcagaaaaggcaacatttgattggttaaaaggcattattcacccaagcaaaccataggtagtatcagaaaaggcaacatttgattggttaaaaggcattattcagaaagaatcaatcgggaaagggtgagccaataggggaagttctccctctgggtcacgggtttcatctgggaccaggagtctggcctttcagcctttagactgttttaggcttgaaggtgggtttcacagggacccttccctatctgcctaggcatctgtctgcctcctgcctctatcactttctcttgagttttatattttagcaacactgagtcatctttgtcccaggaagcacctacatctgtttatctgctgtcccctctacctttactaccttcccttcttcacatttatacccagaaaagtcacttcccctccaaaaattgggatcaactgtcatatttttatgaatatttcactttaattcctcacaacagctgacagaattaactacttcctcttctttgcaagttatttggctcacacagatatcagtaattaaacatattttactgcattggcatatatctgactaatgtgtttttctcccgtactaggcaatatgctccttagtcatctgtgtatctgaggtgagcacagggcctaactagcatatggtgcattctcaatgttcgttcaactgcattgacttgaattcccctgaagactgaaatgtgaaaatagctactctcggaagcccctttccagagaggtctaaaatatttacatgtttctattttaaatgcagaaagaacttccagatcattataggccttggatggaaattgccaacaaacttcctcaattgattgatgctcaccagcttcaagctcatgtggacaaggtattcttctcttcaccccctcatcacattctgttttcatcatcataccacttttctttcttagccttgtggaagtgtgtcaattgtcctgggaaactgttcattaccattgaacttatcagcaaagctatatcttccttcctgaaaaacagaatgaccccttcgtaatctgatacatgtgttttcctaaggttttcagagccagcacaaaacaatgcctgacacatgccaataactcaccaaatgtttgtttaaagaagaatctgggtgggaatgataaactaactaatggacaaggtatcgcctaagaaggtcagcttggaaattctcaggttcctcattccatgtacgtactcaaggctctgttgttactgagggggtctaacttgattttgtcctaggtgttatagaatagttaaatggagggaatttctgaattataaaattggccatgggttctacaaaacatccaataagcctgtaaattccacacaagtgttgattaggctgatacaaaggtaattgcagtttttgccattacttttaatgacaaaaaccacaaacacttttgtaccaacctaatagctatgtaaccctgaaaaagttactcaactctgtaatcccatttccttatttataaaatgagagaaactctggtctcacagtattgttatgggaagtaaatcactttcaaagtggcccttttgtagttcttgtcctataatagcattcagtatacattcattacttctctgtagtctcttctccatctgtcctaatctatcagtttggagtaccacataattgcggaagtccatgaaaagttttccgctctccaaaatttccctttgctgatggataatatttaatgtctagaattacaaattctttttaaaatactcattgaatgtttgctttgtgcaaagcactagaaccttgtaaaagatgagtaagggactggcttcaatgtctgtgaagatagcaaactaaacagagtaatttctttgcctgatagataaaatgttgtgttgacatgaccaaagaaatccaaaaataagaaaaaaactatctgtaaacacagaaaaatagagaaaagttccaatgatggaataaaaatttaaaggatttttttgaacgtattaagcaaatcatgtataaaatccagaaataagtttacaggacccatgtcaaggatttaaccaaagcagagggagatccccatgagtccccttttcccatctcagaatagcagagaagagaagcaagggaagcctggaacagttggcaagagggcaggttagaattcagtttgtgaattatgaggtcgtctgccgtaggcatttaccaggctttatttgatttaactgccataaaggaagagaaggacttgttaaattggggctcctcttagcacagcattgaaaccagtccctattccttcttggccttttggctaaaattgagtgtgaaatctatcacctaacatttgtactgggtttaggctgggtgtggtggctcacgcctgtaatcctagcactttgggaggccaaggctggcggattgcctgagctcaggagttcgagaccagcctgagaaacatggtgaaaccatgtctctactaaaaatagaaaaaattagcagggtatggtggcacatgcctgtagtcccagctatttgggaggctggggcagaagaatcacttgaacccaggagacagaggttgcagttagctgagatcacaccactgaactctagcctgggccacagagtgagactctgtctcaaaaaacaaaacaaaacaaacaaacaaatatatatatattaaaatacaaatttttactgggtttaatagtgtcttcctagaagtcatgttcatgcataatctgtgaaagtggtcttatttggaaatagggtgtgtacagatgtattcgagttaagctgaggtgatactggattaaattgtatatgatgagtgtccttataagaagaggaaaaattaaacacaggaacatagactcaagggaaaacatcacgtgaagatggaggtagaattggaatgatgcattgacaagccaagatgtgccaaggattgctggcagtcaccaggagttaggagacaggcatggaacagaatggaacaaattctccctcagaggctccagaagaaaccaaccctattgataccttaatttgggacttctatgacttctatcttccataactgtggcagagtacatttctgctattttaagtcatgatgtttgtggtcattagttatggcagcgcataaaactaacacaacactcttggtctctatcgcttcttttttttttttttttttttgagacagagtctcactctgtctcccaggctggaatgcagtggtgcaatcttggctcactgcaacctccagctcccaggttcaagcaattctcctgcctcagcctcctgagtagctgggactacaggcacccgccaccatgcccatgtaatttttgtatttgtagtagagacggggtttcaccatattggccaggctggtctcgaactcctaaccttgtgatccaccagcctcagcctcccaaagccctgggattacaggcctgagccaccatgcacggcctctatccctactcttaattgcctggaaaatacctaacaaatgaaggccagtttttagactttaccaccaaaggctgaaattgaaacaggaattgtttgtgagaagcaaacacaatagtttcgagagactgaatcagttagcaatttcctgtgagaggcaaatgtaatagtttctagaaccacagatggagctataacaaaaacatgtgttctctggatcctttacttgctacagacaacacaataagtgaatttacagctttgatcttacagtgcacctaagccaaccaccttgtcttagaatgtctcaacatacctatctgtatcttgaaacaaaatatattaattgccttagacccattcactcacatttcctaggaagacatgatcagagggagctatgcaagaagaaatccagcagaactctggaaatacaataagaaaatccatattagacactaatcttaataaaactaaccttcgttcatgaatttgaatagacaaaattaccaaataatatggaaaaaatgggcaactcaaaaagaagagggtagcccacttggcattcaggaccaatggcctccaataaataagatgatattagtgctttaaatattttatttagtgtatccagtatattgccttcctaaattaagtgaaagctgatatataaaaagaactattagaaataaaaaaccacacacatcccagaactcctcaatataaacctaacaaattcagtaaaacattgattgcaaaaaatatatatagtgacttagggacttccttgataaatttcataaagcataaagaaaaatcaaagagtgcaaaccatcagaaaaatacaaatatataaaaaagagaaatacaggtgatccaaattccttttaatggaatcccataagcagatgggtggaggaaaagtaaaacttccaacatataagcacaaaatttttagaccttaagaaatatttgagttttttatatcagaaagacagtgttggggtgagggttggggggcacatgtaaatactcagataaaattgtgaattttctagggtaaagaaatctgcatattcatagaaaacaaaaatgaaaaatagtttatttacagagtaaatacatacgactgtttacctgtaatgctaaatattaaaagacagtttcttttcttttttttgagacagagtttcactcttgttgcccaggctggagtgcagtggtgctatatcgactcactgcaacctctgcctctgggttcaagcaattgtcctgcctcagcttcccgagtagctgggattacaggcacccgccaccacacccagctaatttttgtatttttattagagacggggtttcaccatgttggccaggctggtctcaaactcctgacctcaggtgatccacccgccttggcctcccaaagtgctgggattacaggcgtgagccaccgtgctggcctaaaagacaatttcatacctatttgtatggctaattttttaaaaatctggccatatcaaaatactgaagaggacgtatagcaatagagactttcattcattgctggttgaaatgcaaaatggtacagccagtttgaaaactagcttggcagattcttataaaatgaaacatagatttaccatgcaactcagcaatggcattcctaagcatttatccaagtaaatggaaaatgtatgttcccagaaaaaaaatccatatatgaatgtttataacagctttattcataatcaccaaaaaaaaaaaaaaatctggaagaaaacaggatatccttcaaccggggaatgaataaaccaaattataataattgtaaattgtgggatggatagtggaatagtattcagcgatacaaatgattgagcaattaatttgtgcaatgacagggatgaaccttaaatacatttacctaaatgaaagatgtcaggcctatattgtatgattcttttcaaatgactttttagaaagggcaaaactagaaggattaaatatagctttatggttactagagacaggtaaggagtgggtagttgactgcaaaggtaatatataggggaatgtttagcatgatgaaactgttttatatggcactcaggtgatggatatatggctctaggcactgaaaaacccatggaattgtatgtcacaaagaatggactttcatgtatgcaaattttaaaaaataaaccagaaaattgggagaatactaggatggaatgcagactgtgataaataaaactaactggactctcagcaaactaacacaggaacagaacaccaaacaccgcatgttcttacttataagtgggagttgaacaatgagaacacaaggacacagagaggggaacatcacacaccggggcctgttgtggggtggggggctaggggagggagagcattaggacaaatacctaaagcatgaggggcttaaaacctagatgatgggttgacaggcgcagcaaaccaccatggcacatgtatacatatgtaacaaaccagcacattctgcacatgtatcccagaacttaaagcaaatttttaaaaaagtaaaaaaaaaaaaaacaaacaacaacacctaactggactacaaatgcactatataacttcgatgaagagagtggggagtagggaaaggaacggacttaaattactccagaaaatagtgttgtgttgtgactagaatctataaggcttacggtaaatgaaactttacaggatcactatactctaattggtaaatcagtttttcatggggtgcgggtgaacagttgtgaaactgctttacatgtagtcatacctttgcattttgcagatatttcaatttttacaaattgaagattcgtagcaaccttgcatcaagcaagtctgtcaaccccatttttccaatagtgtgtacgcatttggtgtctgtgtgtcatattttgataattataacaatagttaaaactttttctttactattacatctgttacagtgatctgtgatcagtgatctttaatgttactatcataatcgttttgaaggtgccataaactgtgcccctataagtcctgaaacttaattgataaatgtatgtgttctgactgctccactgaccagccattgccccatctctctccccctcctcaggcctcctgatttcctgagacataataatattgaaattaggccaattaataatcctacaatggcctctaagtgttcaagtgaaaggagttgcatgtctctcactttaaaaatctaaaactagaggctggtcatggtggctcaggcctctaatcccagcactttgggaagccaaggcggggagatcacctgagttcaggacttcgagaccagcctggccaacatggcgaaactctgtcttgactaaaaatgcaaaaattagccaggcatggtggtgcacacctgtaatcctagctactcaggagactgaggcagaacaatcgtttgaaccctggaaatggaggttgcagtgagcctagattgtgcgattgcactccagccagggcaacaagagtaaaactccttctcaaaaaaaaaaaaaaaaatatctaaagctagaaatgattaagcttggtgagaaagtcatgtcaaaaccagataggcttaaagctgggcctcttttgccaaacagccaagctgggagtgcaaaggaaaagcttttgaagaaaattaaaagtgctactccagtgaacatacgaatgataagaaagcaaaagagccttattgctggtatagaggaagtttgagtattttggatagaagatcaaaccagccacaacttcccttaaaccaaagcctaattcaaagaaaggccctaattctcttcaattctacaaagtctgagagggctgaagaagctgtagtaaaaaagttttaaaccagcagaatctggttcatgaagtatgaggctagaagccatctccacaacataaaagtgcaaggtgaagcagcaagtgctgatggagaagctgcagctaattatccagaagatccagctaaaatcatcaatgaaggtggctacatttattttttatttttgttatttattaatttatttattttgagacaaagtcttgctctgtcccccaggctggagtgtggtggcatgatgttggctcactgcaacctccacctcctaggttcaagcaattctcctgcctcagccttcccagtacctgggattacaggcatctgccacaacgcctgactaatttttgtatctttggtagagacggggtttcaccacattggccaggctggtcttgaactcctgacctcaggtgatccacccgccttggcctcccaaagagctggattacaggcatgagccaccacgcctggccagtggctacatttaaaaataggtgttcaatgcagacaaaaccatcttttattggaagaagattccaaccaggactttttttttttttttttttttgagacagagtctcactctgtcgccaggctggagtgcagtgatgcgatctcagctcactgcaatctctgcctcccgggttcaagtgtttcccctgcctcagcctcctgagtagctgggactacaggcacgtgccaccatgcccagctaatttttgcagttttagtagagacggggtttcaccatgttggccaagatggtctctatctctgacctcgtgatccaccccccttggcctcccaaagtgctgggattacaggtgtgagccactgcgcccggcccaggactttcatagttagaaaaaagtcaatgcctagcttgaaaggacaggctgactctcttgttaggggctagtgcagctggtgactttaagttgaagccagtgctcatttaccattcctgaaatcttagggcccttaccagctatgctaaatctactctgcctgtgctctgtaaacggacaataaggcctggatgatggcatatctatttacagcatgctttactgaatactttaagctcactgttgcgacctactgctcagaaaaaaatattcctttcaaaatattactgcttattaacaatgcctctggtcacccaagagctctactggagatatacaggaaataaatgttgttttcatgtctgctaacacatttgttctgcaacctatggatcaaggggtcattttggctttcaagtcttattatttaagaactatactttgtaaggctattcctgacacagataatgatccctctgaagaatctgggcaaagtcaaatggaaacctggaaaggattcactattctagatactattaaaagcattcatgattcatggaggacgtcaaaataaaaacattaataggagtttgcaagaagtcaaccctcatggatgactttgaggggttcaagacttgagcagaggaagtcactggagatgtcgcagaaatagtatgagaactaaaattagaagtggaatctgattttataactgagttgctgcaatcttacgattgaacttttcttttcttttttttttgagacagagtttcgttcttattgcccaagctggagtgcagtggcgcaatcttggctcactgcaggctctgcctccctggttcaagcaagtctcctgcctcagcctcccgagttcctaggattataggtgcctgccaccatgcccacctaattttttgtatttttagtagagatggggtttttccatgttggccaggctggtctcaaactcctggcatcaggtgatccacccaccttggcctcccaaagtgctgggattacaggcgtgggccaacaccccggctgcatgattgaactttaagagataagttgcttcttatggagcaaagaaagtagttgcacaacacagaatttactcgtggtgaaaatactgtgtttgagctgctgttgaaatgttgctgaacattgttgaaatgataaaaaaaaattagaatgttccataaacatagttgataaagcatcagcagggtttgagaggattaactgcaattttaaaagaagttctactgggtgccgagcgtggtggctcacgccagcactttgggaagccgaggcaggcggatcacttgaggttgagtttgagaccagcttggccaacatgatgaaataccactacctctactaaaaatacaaaaattagctggtcatggtggcaggctcctgtgatcccagctacttgggaggctgaagcaggagaattgctttaacctgggaggcagaggttgcagtgagtcaagatctcgccactgcactccagcccgggtaacagagcaagactccatctcaaaaaaaaaaaaaaaaaaaaaaaaaagttctactggggaaaaaatgctaacaaacagattgcatgcatgcaatggataaatctcttgtgaaaggaagagtcaattgatgtggcaaaccgccttgttttcttaagccaccccaaccttcagcaaccaacatcctgaacagtaagtagccatcagcatcaaagcagggctctccaccagcaaagagattatgactcactgaaggctcagatgatcattagcatattttagcaataaagtactttataattaaggtataaagtactttataatgtacattgtttttctagacataatgctattgcacactttatagtgtgaacataacttttacatgcactgggaagccaagaaatgtgtgtgatttgctttattgggatagtcactttattgtggtggtctggaattgagccctgactatctccagggtatgcctgtacatactggggttgaacaataagtaaatagatgatggatgatgtttcactgtgagtgagggaagttatagatcagcaaggggtaggagggaaagctagaattaataagtgccactggattagagttggagacatcagtatgaagtcatgttttgtttaatatttataaatatataagaatgtataatactacttacatatgcctatataatgagttatatgtatttatatatacacacacatgcttcctagatctatccactgcaaggatctagaattagtgacatcccagtagcaatgagcaaacccactgcccagataaatacccttctccaataacaggagcctggtcttcttgaagaaacagctgataatttcctttccttaggaaaggaaactgtaagtatgtaagaaatactgtgaaacaatgaaatcagtaaattttatggtcattataatcattgacaatgtgactgtgaaataagaaaataatttataaaatattataatagcattctaattgtgcattgtgtgtaggtatatatacttgtgaccaagttgtgttaaaatgatacagctaaactccatatttctttttaacaaaactggggacatagtggagtgagagctgtaaaacgaaaatcatgggttttcttgtgtttcgttttcttcttttttttttttctgagatggagtcttgctctgtctcctaggctggggtgtagtggcacaatctcggctcactgcaacctccacttcccgggttcaagcgattctcctgcctcagcctcccgagtagttggtattacaggctcctgccaccacgcccagctaattttttatatttttggtagagactgggtttcaccaaaatcaggctggtcttgaattcctgacctcaagtgatccacctgccttggcctctcaaagtgctgggattacaggtgtgagccactgtgcccagccaaaataatgtttgtattggtgtgctatgccagattataaaacaaatgaaccagaaaaataatatacagttaacagcaaagtaagatttttcctatcagttttcatgacatgttataaaaccatagaaattctgaccagatggcatcagggcagcaataaacaagggaaccaaaaacttaatagaggacctacatacagacccatgtgtgtatggaatacatactaaacatatgacagggtgaaatgttgggaacacgatggtaaaaacatgaatagtaatccatacatagagttggcacatagcaaaatgattaactggctctgctcttttcaccacaaacaaaaataaattcattcaagatggatacaaacttaaatgtcaaaatcaaaaatgtttcatctgttggaagaaaatgtaggagagtatctttatgtactgggataaaggaagaattttctagggcccggcacggtggctcacgcctgtaatcccagcactttgggaggccgaggtgggtggatcacctgagatcaggagtttgagatcatcctggccaacatggtgaaactccatctctactgaaaatacacaaaattggctgggcactgtggctcacacctgaaatcccagtactttgggaggcccatgtgggcagatcgatcacaaagtcaagagatctagaccatcctggccaatatggtgaaaactcatctctactaaaaatacaaaaattagctgggcgtggtggcacgcacctgtagtcccatctacttgggaggctgaggcaggagaatagcttgaacccgggaggcagaggttgcagtgaactgagattgcacgacggcactccagcctggtgacctggtgacagagcgagactccgtctaaaaacaaaacaaaacaaaacaaaagcacaaaattagctgggtgtggtggcatgagcctgtaatctcagctacttgggaggctgaggcaggagaatcacttgaacccaggaggcagaggttgcagtgagccgagatcgtgccatcatgccactgtactccagcctgggaaacagagaaagactccgtctcaaaaaaaaaataaagatttttctaatatggcacaacattggagtttttttttttgttttttttttttgtgacggagtctcactctgtcgcccaggctggagtgcattggcgtgatcttggctcactgaaagctccacctcctgggttcacgccattcaacattggagtatttttatgacatacttgatatccttaaaacaggacctctgttcatcaaaacaggccaaaagacaatgaaagccaagctacaaactgagagaagatattgtcacacatataaatgaaaagaagatttgtatcctgaatatacaaaatcttgtaaattgattggaaaaacaaccaaataaaaaacaatgttcaacagacattttgtggaatagaagacacaagttcccaatatatcatctgaaaaatgcaagctatcattaatagtcaagaaaatgaaagttaaaaccataatgggatagcattttataaccatacaactgaaaaatgcttaaagtctggcatgaacaggtattggcaggaatataaaacacctgaatcttttattcactgtgggtacaacctctctcaaaaactgcttgtcattatctggcaatgttgaaaatataaatcctattaagaacttccttcttgtctatataaataccttagagcttcctaggcctgtgtaccctgaaaggtatgaaagtatcgtttatcatagcaaaaaaacataaaataactgtgaaaataaataaactgcagatgcatccagtaatgatgaatgtcaaagccataatggtgatgagaaaaggaaatcatagaatatcctgtattcagtataattctattatgttaagttcaaaagcattcaaactaaataaccaatatattttgagatggtgtctcactttgtcctccaggatggagtgcagtgggaccatcctggctcactgaaacctccacctcccaggttcaggctattcccctgcctctgcctcccaagtagctgggactacaggtgtgcaccaccacacctggctaatttttgtatttttatagagatgggatttcaccatgttggccgcttgtctcaaactcctgacctcaagtgatctgcccgtctcagcctcccaaaatgctgagattacaggtgtgagtcactgtgcctggccaataatatattgttcagtgatcatacatatatgaattttgaaggatatataaatagcgaggaaataacaaatacaaaattcaacaaatagatactctcaaggagcaagcaggatattacaatcaatgagaggtacacagagggttgcaaaaattttggtcaagttctatttcttaagctgagtgatgagtaaataagtgtttacttatgtctactctttaggttgtaaatagatattacatgtgtttatattcacggtgtacaaattcatgaaatgcttctaataaataggaagttataagatgcatttcaaagtgttcagcagaaaatagtgcaaacatgttgccctgaatcatgttgcagattctaaagaaatgttcacaatggttccgagaagctcctcaaactgcatttttgcttttagagggaaaatcacatatttggccctcccaaactgaggccagagactgtcaaaatgttagctgagtagcattaagaaaagggctgaaggtagagtacctttccattttgatggaaacccacaaattagtatttctgtttttagtccgatattatttctattaattcatagacttttaatacacctgtcatcagggacaaataattttgtgctcatgtcctcaaagtcatttacaattcagaacaaattgacttagaaataaaatgtgattaatattttttatttatttgtgagaaaagtattaataattttctaataatgtatctttcaaatgtgtctagacgtaataaaaataattatataacactcaaaataaattattaaacaacaatgaactaaaaaaaattttagaacatttatatgaaagattaagatccataatacaaaatgtattctatgaaatcagtaagatgaatgattgatggggaaagatgggcaaataatataagtagttaagacagtgaaagatatttgaattgatgataaacaggcaaaaatgctcaatctcaagaataaaacaaaaatgccaatgaaaacaatgaactacctggtttcggctaagagagtgtcaataaatttaaaatgtacttaataaataactgctgttataatgctcacctggttcttgttaaaaagcaacatctcaaggctgggcataagtaagcctagcactttgggaggccaaggcgggaggattgttccaacccagaagtttgagtttgagactaacctgggcaacatagtgagacccccatccctacaaacaattttaaaattagccagatgcagtggcacatgcctgtagtcccaggtactcaggaggctgaggcaggaggattgcttgagcccagaagttcaaagctgcagtgagctatgattgctgtactgcactccagccagggtaacagagcaagatcctgtttctaaaacaaaacaaaacgaaacaaaacaagtaacatctcaacagtactccctccttccagctgtgcctcccctgcaagcctagggcacattctagttgtgattctgaaagccaattttatttttatttttaatttttgtgggcacatagtcggtgtatacatttatggggtacatgagatgttttgatacaggcatgcaacatgtaataatcacatcagagtaaacggagtgtttgtcacctcaagcatttatcctttctttgtgttacaaacaatccaattacactttcagttatttttaaatgtacaatgttattgtagcctcctgttgtgctatcaaacactagctcttattcattctatctagctgtattttagaacccctggggatggtgaatgagagctcatttttgggaggaagaagtgcgcagtctggccatggggaggacagcgggtgaaggaccagcctgaggataccccaacctcaacccgggcctgcgctggaggagccccagctctgtgcccacgtggcggtgcctggagattaaaaggacaacaaaaacaccccctgccgccctcctttctggcgcttcggacccgggaggggaccacccgggaagatccagatcagtctgtgtctagagctggggagtgggctggggcgaggggaagaggcgagcagaggggacgcgcctggtagccgaattcagaggccgctgctgtcaggcagggcagccccgggcagcgcggagaaactgctgatacttgtttaccaagtgttgctttcaaccatgataccgcctttacgcgtcacagtgatgctgtgtcttccccattatggcaacagggctataggcatggagggcgggggtggagggggtgtgaaaagccccaggcagcgtcaggggttgtgctcctgctcctgtttgatagagagaggaacacccaccgcacagggctgttgcagggtcagcgatagcaagcaggccacagtgtttggataagacaggcttgtaaaagttgccatgcaagactcctaggaaataagtccgctcagtcctgggagttaagtatcctacaacattccagccaagcagtggcttcagggatggagacgggaggctgccacagccatggggacaaactgtgggctcgggtgggcggttaggttcttcctgagcaaagtcgtgtggaccacctcctatactacagggtcctgggtctggggataaatgggtgtgtgtgcgggctctttgtaccttcattaaaatataacccattgccttccacccaaaggtcccttcacatcccaggtccccggcccccgttacctcccctgtcccggttcccatccctcctctgacggcatttggactttcatgaacagatgcccctgctgagctgccagttcctgaagggtcaccgggagcagcgcctggcccacctggtcctgagcttcctcaccatgggttatgtctggcaggaaggagaggcgcagcctgcagaggtgagggccagagagcagcttctcctgttacccggcaggttacctgcgcctggagtaacgtgctccctgcttggtgctaccctgttttcctggaaaatgggtactttcttcttctcgatgggcatcagtttaagcaacgatgaagggctcatttattatttattattattatttttttattttattttgagccagtctcactctgtcactcaggctggagggcagtggggtgatcttggctcactgcaacctccccttccaggttcaagcaattctcctgcctcagcctttcttgtagctgagactacaggcacccaccaccacacctggctaatttttgtatttttagtagagatgggtttcaccatgttgcccaggctggtctcgaactcttgacctcaggtaatctgcctgcctgggcttcccacagtgctgggattataggcgtgagccactgcgttcagcctgaagggccatttaaatgaaggatttttttattttaatttttctgactaagagctaatttgttttttaaactggtagctatttcttccttttataagcttttgaatgtttgtttgtttgtttttggcactctcttccaagaatgtttgaagacctgcatttgaaggcagattgcctttttgctttaaaacagggttgcaccatgttgcccaggctggagtgcagtggtgcaatcatagctcactgcagcctcaactcctcccaggctcaagcaaccctcccacctcagcctcctgagaagctggggctaccagcatgtaccgccacacccagctaatgttaaaaattttttgtagagatgagggtcttgctgttttgcccaggctgatcttaaactcctggcctcaagtgatcctcctgcctttgcctcctgtgctgggattacaggcgtgagccaccatgccgggcctgaagacagactctgagaattcataaaaacctcacagcattttgtactcttatgtatataaattatctaggttgctcttcataatcctgtaaagtaacaagagccataccggcccattttacaactgaaaagcacagacacttatttccttaatcaaggtcagacagcaaattagtggaaaagccaaggccagaacccaggtcttctgattttactagtgcagccttctttccccaggggacacattgacatttacaacactcatctttattttttttttaatactgctttctatccagccaattattagtctgtcttttaataattcatccaaatctcttctgaatcattgcataactttgtacagtttccacccacagtgtcttttacttttatttttggaagtaactgtttttaaaagttactgttatttttaaaagtgtgccttccccagaaatcagggagttacccatgtcctagaactccacggtgaagagaacagcctgtgcccatcgtgtttgcctgattgatcctacctcttgtctctcggggaaacacaggagactcagggaagaggaaaagtgtagagtcattgcagccttgttatttgtcaatgcatctcttttctttttctttttctttttttgatacagagtttcactcttgtcgcccaggctagagtgcagtggcgtgatctcggctcactgcaacctcggcttcctgggtccaagggattctcctgactcagtctcctgagtagctgggattacaggcacctgccgccacggccagctaattttttttgtatttttagtagagacgggtttcaccacgttggccaggctgatctcgaactcctgacctcaggtgatccacccacctgagcctcccaaagtgctgtgattacaggcatgggccccagcacccggccagtgcattgcattttttttttttttttcgagacggagtctcactctgtcacccaggctggagtgcagtggcacgatcttggctcactgcaagctccgcctcccaggttcacgccagtctcctatctcagcctcccaagtaactgggactacaggcgcccaccacaacgcctggctaatttttatatttttagtaaagacggcgtttcaccatgttagccaggatggtctcgatctcttgacctcgtgatctgcccgccttcgcctcccaaagtgctgggattacaggcgtgagccaccgtgcccggcgtgcatttttaaaagtgtgtctgatgctgaaaagtttgaagtctaggcacgtcccagtgggtcctctttataccatcccctctgcaaaccattatcctaaattggggtttgggggagagaagagtgacagtggaaagaagtctccacctcccagctgtgccctggtagttccaggggacccggaggctccccacacccaccaccccgcctcagatcacctttcactttctttgtttctcctcccttgacttttcagctcagaaagtacctggctctccaatgccttctgaggaaagtttacccgaggttcacattgcaagactcattaaagctctttagtgttttccacccgagaaaaaattcaagggaaaaatgaagacaaaagcagggcattcttaatggatattttatcttaaggagaaatgaaaatggagatggaagagggggcacaaggatggggtttgaatctagactcgttcagcctttacctccgatagagaacctcatacagcttttctggacttctggctgataaagagccgtggagggttccttggataaaaaaggttgaagggggtctgtcctgtggtggcttacttgaaggtattactgggtttgacttatggagtaagagacggagtcagtttccccacaggctgaggcagtctgtcctcatgcttttctagggcactgtggtctcccaggctcatacctaggtgcacacacaggtttctgcatctagctttgtatctctatgagtcggtcaatcaataaatctatctatcatctgtctactgatctatcatctatctatctagctagctatcatctctctatcatctatctatgtatctatcatctctctctatatatgtgtgtatatatatatatatatgtatatatatatttctatccttccatctacttacctatctatcaaaatttttttccgttgataatattctcgggccccagtttatgtttaattgttttggtaatgcctttctttgcacagtcagtttacagaggttattttatattctatatgtatgtgtggtccagcgttgtaattttcacatatattgcaccgtgtactcataagcagtatttccactgggtcattaacagaaagatatgtgtgcggcatatgaatgtgcatcactcaggtaattcaagcttggttcccagatcatttctgtaccacaggattgccgaaataaaagacaaccatggttatttcctctgctgcaagctttctagaatatgctatttgtctggatttatatctgaaaggtcctgccaaggaatcttgcccttccatttgtcgaagtctccaggaacttggggctccctcctatcctggtccactcagacttggtgctgacgaactggaccaaaaaagatccagacgggtaaggaaggaagagaatgctttgaatttccataactttcccccaggaaacacccaggcttttttttataattagggaagttcatatttatggtctgccgtatggttccaaagaaggggtgagcttgaccaaaaattcaaatatcacaggccccagaagtttcctcttaatccattctgaacacattggctcagaccattttgtcttgtttgtttccacatgacgtgtgaatttctcaacctgaccttcaagctcctgcaaaatcagcttttatttgttctttctcttcaaactgtttattccctaagatgccctccattcatatcaggttaaaaccagttggctttgataagtaatcattatataatgatcagaagagaatgattatggatgaattcagagcagatgctccaggtgggttggattgagaatttgattaataattccatctattccaccaaagtcacatcattcctttgacagttgggctgggaataggggcatttgtctacagaaggaatagcatgagattttaacaaacaagaaattcaacaaacagaattagacagatgatctgagatgttaaattttcctttcaccttaatttttgcagccaaatttatttcagctctagatgaaagagacagcactttcttttgtggctgactacaacagctgaagattcactgaggtttgatatgaggaagaacttcctcagccatgggattgccagaggcgatgatgggaatctacttaaaagggttacatatttagtagacagcctagattttaagactaatttatgtgccccggccgggcccggtggctcacccctgtaatcccggcactttgggaggctgaggcaggtggatcatctgaggtcaggagttgaagaccagcctggccaacatggtgaaaccccgtctctactaaaaatacaaaaaaattagccgggcatggtggcacatacctgtaatgccagctgctcgggaggctgaggcaggagaattgcttgaacgaaggaagtagaggttgcagtgagcgaaatcatgccattgcactccagcctaggtgacaaactctgtctcaaaagaaaaaaaaattatgtgccccattggaagaagtgagattcggccatctcatctctctcgggagctctgagccctggagttttatgttttctgcaattatgaattgtgatccttgattaattatgctttaataataaaatgggtgactactgaaagctgctgaatctgggtaagaatttggatgaaaaaaataatatatgtgcgtaatttattctgttcaaggtactgaatattgaataagctggatttattactcaaagagaaagacagaataagagaaggttgaagggaaaaatgactgtactagaatggtagtcaaaaatgcaacaacaggcaggtgcagcggctcatgcctataatcccagcacattgggaggcccaggtgggcaggtcacctgagatcaggagtttgagaccagcgtggccaacatggccaaaccccctctctactaaaaatacaaaaattagccaggtgtggcagtgggtgcctgcaatcccagctactcaggaggctgaggcaggagaatcacttgaacctgggaggcagaggttgcagtaagctgagactgcaccactgcactccagcctgggtgacagagtgagatcctatctcaaaaacaaacaaaacaaaacaaaacaataacaaaaaagctattaatagcttcctagggagtaagagtgaagggctagtttaattccagagatgcggacacagtcctgggtctcaccaattattctgcttggtaattaccttttgaagccttttaatatgcctaacacagagctaagtgctatgaagaaatgaaagaaatagaagcaaagtactccccatgtggttaaataacaagacactacatgacaaatgtcaaagagtgactcaaacaatatgtcctttagaatttcagagaaatgacatcaatgcaggctttacaagtcagtaaaaatcttggtgatgaggcagaacttgatgtaaggcaaatcctaaaagttgagtaggaatcaactagctagaataaaatgtggggttgtggtaaatacaaaaatgtaagatgagtgaaataacttatttatttatttatttattttcagagacggagtctccctctgtctcccaggctggagtgcagtggcatgatctcggctcactgcaacctctgcctcctgggtttgagcaattctcctgcctcagcctcctgagtagctgggattgcaggcacctaccaccacacccgactaatttttgtatttttagagagatggggttttaccacgttggccagtctggtatcgaatcctcgacctcataatccacctgcctcagccttccaaagtgctaggattacaggcatgagccactgtgcccagcctaataatatattaagatggccacaggccaaatattctggggctggaatgtgagtggaaatgtcgctcaccctttatcacatagcaccccatagtccagccacaacttgcagaattcaaagtaagtgtggatgtgtgtgtgcctgcagtgccttgcacacaagtgtgcatgcctgtggacatgtgaccctagaagttattaatatatctggtttacaaactgaattgttcttttattttttttctctcttggtggtcatcaataactgaaattgggctagattcctggaaattgggtaagttctcagaaatcatttacgcactttagaatccaggccaaatttaaaatcttacaataaaacaaagaacaaagcatgctaaattatatgtataatataatatcaaccatataaaatgcataaaaaatatactagaaggaaatgtgcctaaaattcacagtctaaaatttaacagtgattgcctcttccttgtatagataagggatttttttttactgtattttccagtctgtacataataaaacaagtaatgtgcaatgcaaacaaaacaaaatgaaactttatcaaatttcagtaactccttgaagtttaattttttttttgagactgagtcttagtctgttgcccaggttggagtgcagtggtgtgatctcggctcactgcaacctctgcctctgggttcaagggattctcctgcctcagcctcccgagtacctgagattacaggcacccaccaccacacctggctaatttttgtatttttagttgagacagcgtttcactatattggccaggcaggtcttgaactcctgacctcaggtgatccacccgccttggcctcccaaagtgctgggattgcaggcgtgagccactgcacccagttgaagtttaatagtgtgaaaaaaatatttctcatctcactatatcttctatgggaggccagattgcagattgtctacagaaaaatcccttcaaaagaccttgttattacatagactggagctcatggggcaggtctggtccacacatccttaggctccgcttctcctggaaaacaaaaatagcctctgatccagtgttgcctctcccatcaccaaacctcagcttctatcgccaaactcatcaaataagagtgtccagtagaaaaactgggcagatgggggcacagaaggtgaagacatcatttcccaagctaatgttgctgctggaacaatgtaagtcttgactttgtcttggtttggtttggtttgacattggtttgtttttcatctttgtctcatgcttaaaatgtgaagggcaaatatgatccttagagttaaggttttaggttttgtagatgttttactccatttaaatgacagcagatcatttagaaatgattcctctgtaacagccttccagatcccattcgattgtacagcattgagatagatagatagatagatagatagatagatagatagatagatagacggaatttggccctgtgttcccacccatatctcatgtcaaattgtaacccccacatgtcaggagagggatccagtgggaggtgacaggatcatggggttggatttccccaatgctattctcatgatagtgagttctcacaatatctcattattattattattattattattattgcaacagagtctcactctatctcccaggctggagtgcagtggtgtcatctcggctctctgcaacctcttgcctcagtctcttgcgtagctgggattacaggcatgccccgccatgcccagctaatttttgtatttttagtagagacggagtttcaccatgttggccaggctgatctcgaactcctgacctcaggtaatctgcctacctcgctctcccaaagtgctggaattacaggcgtgagccactgtgcctggccagttctcacaagatctgatggtttaaaagtgtggcacttcccccacctcctgccgccatgtaagatgcttgcttacccttccaccatgattgaaaagtttcatgaggcctcctagccatgcttcctggtaagcctaaggatctctgagtcaattacacctcgtttctttataaattacccagtctcaggtatttctttatagcagtgtaagaatgaactaatacacacataaacagattagaggcagcactggcctgagttgtgaaactcttcccagcctggtcctgcgattagctggctatatgaccttggacaagctgctttgcttctctgggccatggtttcatacctgcaaaaaaaagagcatggacttggctgttgcctgggtctctctagccctgtggagaatcagctacatctcttactaggaacttctcattcagccagttattccactgcggagatggtccaggaccattagggccatgctagacattgggaggctgcctgtcaggtgaacatgaaattgaacttatctgttctctttcctccctgaatgttgctgaaggtagatgcccatcctcagggctgtcttacggagaggagaaagttgtgcagtgattccaccctgcagttatctaactcggcagggaactctgggcagtgagtactcacggtacagtctccacacctctaatcatgtgctcctctccttcccaaggaacctggagaccatcatctcatttcctgggggagagagcctgcatggttttatactggtgactgctttggtagagaaagaagcagtgcctgggataaaggtatcttctcacttgatagcaccttttctttttaaatgagcttgagctttacttcccactcagtgcctttcctgcagtggatttctcaacacaaatgaacatagaccttgtcctgcttagttcaagtctgagagaagagatctaagctctaggccaccatatttgctcccttttctcaattcctataaaactcggaatggaccttttgtccattcaacaaacaggcattggtttgggcaatgggaaattggatcgaacaagacagacattttcccagccctgacagaagcttatgatggatacagtggatgaagatggattaacgtggattacaggtgtgagccactgcaccgggcctcaaactggaaattcttcaggagtcagacaggtatcaggaaggctggatagaagacaaaagacagtgatgcagcttgtgatcaactacagcgttaatgccttgcctaaaaatatttcagttagatttctgccttcgctctgtcgctcaggccagagtgcaatggcgtggttttagctcactgcaatctccacctcccaggttcaagcaattctcctccctcagcctcctaagtagtgcacgccaccacgcctggctaatttttgtatttttagtagagacagggtttcaccatgttggtcaggctggcctcgaactcctgacctcgtgatctgcttgcctcagcctcccaaagtgctgggattacaggtgtgagccaccctgcccagccaacactacctcccttgataagcatatgttgagcacctactggtcctcaatagggtgacccatttctgctatattatagcgctttctttctctctcagtagttaaactccatggttactttagttctcatccatgtgtttagtccattagaagatacagagtcaaatatcggccttccaagtgtagttcagatgaagtagagactcaaggaagacaaggaagtcttcccagcagaggggattctagagctgggggctctgtagaatctgtctgtgtattagtccattttcacactgttataaacatactacctgagactgggtaatttataaaggaaagaagtttaattgactcatagttctgcatggatggggaggcctcaggaaacttacagccatggaggaaagtgaaggggaagcaagaacctcttcacgaggcagcaggagagagagcaaaggggggagctgccaaacacttttatacaatcagattttgtgaaaactctccctcgtatcatgagaacagtatgggagagcccacccccataattcaatcacctcccaccaggtccctccatcagcctgtggggattaccatccaagatgagatttgggtggggacacagatttcaacacagatttaaatctgactttatatgagagcttcggagcaaggatgccccagttggagatgcagtagaactgatcataacgtgacaaatccgagagaagaagagtaaaataatagtactcaggcccttgggaggtgcaagaagtaacagccagatgaaattccagaaacacttacctaggggtctgtctgggaggtccccagggagcttctggctgtcaggccaaccccacagtggatctagcttaggacgttcccaggaagctctgacaaactgtccggtcctcccctgggttccaacagtatgaggcttactctgcctgcatggactttaagggagtgctaataagttgtgtacatgcatctcatccctaggctcttgttcaggccacgaatgctatcttgcagcccaaccaggaggccctgctccaagccctgcagcgactgagactgtctattcaggacatcaccaaaaccttaggacagatgcatggtaagatgcttccgaagctcctgaaggatcccccaggggtcctgggctctgcttaggggaagagggcctggggaccaggcatgtcctgaagggggtgataatacattcatccaccagatgacgctggtggactatctttgttttaggttaaacacatattatcttggagagctattgtcacagctttgtattctccctctcctttatattctcccgtgattaagatggtttcccttctgcagtggccagatatttcttaggcatgttgaggtcttgcctgaagcttgagaggaggggatgggatgcacagtaatgttggtcgcgcgtgccccatcctgcagtgttaggtactgcagagcaggttgtctacactctgtaatgccccttttattctaaccccctgtgttggttcctgagatgtctgaccttggttttaagccttgtctaatggatggcctgtattccctttctgtagctagggcaggctgatttgtcaaaggtaggaaagttgtcagaatcaaaatggagtcacttgtgttgaataaaaatttttaaaccttgacaaatagagctggggaaggctacaaagagagagctcccgtgtataaatgcctgataacaaaatcttttccaaaggactgaaaaaatcaccaccttgcacaaaggccatcacaaccttacatacacaaaaaaatacttacacaacgacatctgcccagcaactgcctttccaacattggccttgtgccaccctttttattgatgctcatagccaaggttaatgatctcaaaacagttacataattgtcctcatttttcctttaaaaacctttgtcttcctttatctttctgaatacccacatggtttattatggcacatgtattcccattgcaatgccctattccagaataaatatcagtttccattagggagcctctccctgttaatctgcttaacacaggcatggtcagttacggggcccaaccttcctggaccggttacatcttattctggttactgcattcagtttccaacatctgggaggctcttcaaattcttctctcagaggaatctgaagaatgtatgtgtttaggaggatgtgagagaggggtgtggtttcttaacaagagaatatcagagtctaagtatcattttccctgaatcttgcttccctgcaggaaagaaagattctgggaaaagagagtgtttacaagaagcaggactggagggagggagaaagacgctaggtactgccaagctttattatcttgtattaaaaaagtaaatataatttgtcatcccagcctctcagcactagtagaaatctatctgaagtcacaggattaggtattatccacttcctggttttatagtttatatttgtattttctctatttccttgaattttaattttaaagccctcatgatcacatcagtaggtcttctgccaaacagctcccttaagttgtatggtggctttgccaagctgaaatgagatgagatgtgttttagctttgccaagaaagcctgagtccatcacttaggatagcaaggctattagggagatagtgcaggtgtcttcagatcacatggatgagcaaaaggaagcaattttggaagattatgagaaaccttccaacaggtcccagtgtacatagcagtaagatggtgcatgcagtgtctaactgtcacaggctttcctagggctcactttcagactcacttctttttttttttttttttttttgtgagatggagtctcactctgtcactcaggctggagtgcagtggcacgatcttggctcactgcaagctctgcctcccgggttcaagcgattctcttgcctcagtctccctagtagctgggattataggcatgcaccaccatgcccagctaatttttgtatttttagtagagatggggtttcgccatgttggccaggctggtctcgaactcctgacctcaggtgatctgcctaccttggcctcccaaagtgctgggattacagccgtgagccactgcgcccagctcagactcactttttaggcccaggccaacctgctgtgttctcctgctcagcttctgcaggaggtctcatcgtctaaggaggtcccagggctaccgcccttgttttctcaaaaggcacattttcccacacagacataatttcgtttcagtgttttactcctagtcacattcatctatatggacaaatagctgaatggattggactgtgttttctaaagatggccccatgccatcctgcgcgctcctccacagcgtggcctgggcattcctttcgaccaggggtggactctgtgcccctacttgtgatgtacgtgttgccaatagaatgtagtataggggatagcacagacttctgaggcaagactagaagaggtgatgcaggtttaaccttgtgtcctgagccactaggtaaaaagtccacctaccctgagatcactctgctgtgcaaacgacacaggcaaaccacatcaaagagccatgtgggttctccagttggcttctgcccaggagtgaaggtgccctcagatggttctaggctcccatcccaacttatgtcctgtcttgaagtcttcccaactgaggcaccagccactgtggagcagagtcaagccattgccatcttgttctgcccagattccccatcaacagaatatagtggttttttcacacctctatgtttggagtggtttctatgcagcaatagtaaccacaagaaataaagttataaaaatagtaacaaacactagaaactgcaagatttaaggaatcacctgaatgctccagtcattgtctctggtttgtaatgataaactttcttctgcgtgataaatagagcttggctggactttttccctctgcttccattccccaaaatggagcgtaccaaacaattgcttctttcagagcccagctttagcaagagtcatgagctctaatcccttcatccataaatacttcctttccaggcacgtagagcccttcacactcagggctgagtagaaaatgcctgttgcagactgcagtggcgttttggagagccaccctcctggtacctgagtcactagtcctttgcccagcttttctcagttttgtaaagcgctcacttctgagtggaagacagaaccagcccggtctattttcataatctgcccccataaggcagaagtccacacggtactggaaacataaccatatctatgtcagtctgccactgcctgccgcctgtcaaccgtgcgtgtctgcatccagtccttctttggagctgctttccagcgactcagccagatctgagctttctgactcattggaaggttaaactattttcagactttcaagtgttgagattattaagacatgtgtttttttttttcttctttttttggcatgcttactgatcgcccctgttctctaggaagtaatgttcttcttggaaaaggtgaaggatatttttctccccaaaaagccatggaaatgtttgcctttatttacttccaaattaacagaatttccagcttttgcttgacccatcggcgcattggcagcgttaagaattttttcttttagcagtaatgaggagtcgaagggtttcttcctaaccatttagtgtatgcatttaaatcaggtttctttttgagtaaattggggctaagctgtagtgtgaacttctgctactgttcctttctcattagttcacttgatttcatggaaggaattttccatctcagcctgtgaacttattttgtctaaactcaattggaaagtaattaacactgagattcttctttaataaattctatatgataataaaatcatacaaacatctctttatttttctttttgacctagaaaagatgttcacaggccagacctggtggctgaagcctgtaatcccagcacactgagaggaagaggcgggtggatcacatgaggtcagtccgagggcagggtagccaacgtggtgaaaccccatctctagtaaaaacacaaaaattagctgggcatggtggcacatgcctgcaatcccagctactcaggaggctgaggcaggagaatcacttgaacctgggagatggaagttgcagtgagcctagatcctgccactgcactccagcctgggcgacagagtgagactctgtccccaaaaaaataaataaataaaagatgttcacaatatattgttaagtgaaaaaagcaggctacataacttgcataatatgagtgcattttaataaaaatatacatatttagcaaaataaaaggacaaatggtatttattaaaatatttacgttgattatttcaacacagaggatgatagttgattttgcttaatttcttccctccttcttttcaatttgaattttctataatgaagattgtttctttttctttctttcttttttttttttgagatggagtttcgctcttgttgcccaggctggggtgcgatggcgccatctcggttcaccacaacctctgcgtcccaggtttaagtgattcttctgcctcagcctccctagtagctgggattataggcgtgtgccaccacacccggctgattttgtatttttagtagagacgggctttctccatgttggtcaggctggtctcgaactcctgaccttaggtgatctgcccacctcagcctcccaaagtgctgggattacaggcatgagccaccgcgcctggactgattattttttaaatagggttagaaagtgaggaagttactaaactccgattagcccaaatatgccccagtgggtccttctggcagagtaaatgtctcggttcagcctgaatctgggaaattgttcctacggttcagcctgaatctgggaaattgttcctaccttataaactggagtatccttcagaaatgacatttactcaaacttccttttaggcagactgcataatagcaatttttaatattaaccatttaaaaaaaaccttcagattaattaacaccaaaagaataattgggaaaatacaactcctcactttaaaaaagaaacaaccaaagtaaatactaaaaaactatatgatgttatattatctaagcttagtttactgcaaagatcaagagcacactactagttgacggcctctattcacactgttcatagccctcgctcgcttctccagccattcactcactcatgcaaaaggtctgtacacacaatgatgcctgatggtataataggaaccttaacatttcaattaaaaggcaaaatgaggacacttaccatcagcctataaaattattcttattattcttcttcttcttctcctcctcctcctcctcttcttccttcttcttcttcttcttcttctccttctccttctccttctccttctccttctccttctccttctccttctccttcttcttcttcctcttcttcttcttcttcttcttcttttttttttgagatggagtcttgctctgttgcccaggctggagtgcagtggtgtgatctcggctcactgcaacctctgcctcccaggttcaagctattctcctgcctcagcctcccaagtaactgggattacaggtgcatgccaccacgcccggataattttttgtatttttactagggatggggtttcaccatgttggccaggctagtctctaactcctgacctcaagtgatccacctgcctcggcctcccaaagtgctgggtgtgggcggcaagccacccaggtgccaaggcaagagacagagggcacgagctgttccagtataatgaggaaaatatatagaataagaatagttatactagaaatagattatagatatgattacatatgaatatcattcttcattagtttgtagcactactctttattccagtattataataatctttgttctacaattataacctaggaaaaaccaggccatacagagataggagctaaagggacagggtgagaagtgaccagaagagtgtgagccttctgttatgcccggacagggccactagagggctccttggtctagcggtaacgcccgcgtctgggaagatgcctgtcacctaacggaccgtggtctagcggtagcgtcagtgcctagaaaaggcactctttttaaatatactttttatttttgtttaatcttccctgatttcctatagatctgagatatgtcatgcttattttcattgctatctaaaaatctcaataaactttatacctaagagtaaaaaaaaaaaaaaagaaaagaaaaggcgctcgttacttagccgaccgggaaagggagtctccctttccccgggggagttagagaagactctgctccaccacctcttgtggagggcctgacatgagtcaggcctgcctgcagtcatctggaggcctaaccgtctccctgtgatgctgtgcttcagcggtcacgctcctagtcctgaacacctggctccgccttttagatagcagtagcagaattagtgaaagtactaaaagtctttgaaatgcagaagtaatggcgtaagctgtcacgtctctctctccgcctcagctgccaaacagagaagggtcccctgtccagtggacacgtgacttgggtgaccttacctgtcattggagacgactcatactccttaccctgccccttgccttgtatctaataaataacagctcaatctggcatttggggccactactggtctccgcatcttggtggtagtggtcccccgggcccagccgtcttttattctatctctttgtcttgtgtctttatttctaccatctcttgtctccgcacacgaggagaaaaacccacagaccctgtagggctggcccctacagctgggaattacaggcatgagccaccgcatccagccagcctaaaattcttctgaaggataataatatagtacttgaagacacggtttgaaaaaaatcatactaaatgaaagggcaccattttacaagcactagaactacattaaacttaaatgaattccaacactcttaataatgtaactcaaaaacaagtctagtgttaacaaaagctccaataactaaaactacattaacaggcacaatgaacattgtaaacgccgctaattggcaccaagtttaatagggcagacaatattttcttctgcattcacacttactcagttacactgttgaaaaatgctgctgctcaagctatgaatgctttacaaaagaaatcattttaataaatacagtaaatgctaaaactctagctaaactattatgcaagatatacaaccaagacaaatacaaattcataatacaagcaacttgcattcaaaatgaactctaccactatattttattaaaagggcagactttatgaattaacccagctgcttcctgaattacaaaagtggcatgactcaatatgaaaataagaaactgtctacaaatttctgacagtaataaattgtaatatacaatacatgcaggagtcttacggaagaataaactctcctaggaaacaaaaatattttatacttttaaaatccaaagtaaaaaaaaaagaaatcattgccagatgcggtggctcatgcctgtaatccaagcactttgggaggccaaggcaggatcgcttgagcccaggagtttgagaccagcctgggcaacatagcaaaaccccatctctacaaaaaaatacaaaaattagatggtaatggtggtgagcgcctgtggttccagctacccaggaggctgaggtgggaggatgcacctcaaggctgcaatgagccaaggtcacaccattgtactgaagcctggggacagagtgagaccctgtctcaataagtaaataaataaatatcttttatgaaaaagattctctagtcagaattaacacctcaactagccaaacatcaggaagttacattacagctacttaatacacaaagggacacattttcaccagtcgttgtcttctgatatttctattccagaaacacacactctcacttccctacactccccatcccatcatttcttcagagcatggaaacagaatttgttgaacaccagaaatctcttgctatggtggtacataagtcataacatttgttgctgcccagcagcaggtatgaagccggctggtgactggctagcaaatgcctattctgtaagctcctcacttagcccatctgtagctctgacttctccaccaattcccttctctcctttcacagcctttctgagtttctgagggataatttcagaggttccatataactgtcaaagcctatggtagacatggcaaagtgaaaatcctctccactggccatttctgtttctcttgggggcatctttcacttgcctcaggtgttataaagctgatgaacacacgtacacgttgtttaacactttcttgggcatttcccatttgagatatggcatgtttcattatcctagtgacatgtgcaatcagaaaatgtatattttgttctctgcaactttcttttgaaaaatgtatatttgaacaaaatatacattttttgtatcttcatgaccattcatgctgtcctcactgtcatcatgaggctctatataacataatgactcctccagggcagtcttcggaaattcccagtgcagaagcacgtgtcatacagcagtccccattcatctccagtgcagctctggctggctcccatgtctgatcagctgtttggttggacagaaaatgactgcaagggaatcagttccagtgtgagctctgtttgcagaactcagactcccctccctcccatgttaatgctttttttcttcttcttttttttttttttttttttttgacagagtctcattctgtcacccaggctggagtgcaatgctatgatctcggctcactacaacctgtgcctccccggttcaagcaattctcgtgcctcaacttcccgagtagctgagattacaggtgcacaccaccacaccccactaatttttttgtatttttagtagagacggggttttgccatgttgccaaggctggtgtcaaactcctgagctcaggaaatccaccttcctcagcctcccaaagtgctaggattacaggcgtgagccaccatgcccagccccatgttaatgcttctaaagtttgccctcacttctttagaaattccttcagtacatcctttaagacttcctctagtgagtgtctgctggtggtaaactctcccctctaaaagttgctttatttctcctcaattcctgaaggatatttttgctagcagctatattcttttagatgttgaacatatcggtacaaaagcttctggtttccatggttgctattgagatgttagctgtcggtttatctttctcccctgactatgtgtacctgtttctctgtatctgtctactttttgggttgctcaatttattggccttgggcttcattctgctgctgctttttttttttttttttttttgagatggagtcttcctctgttgcccaggctggagtgcagtggtgcaatcttggctcaatgcaacctctgcctctcggttcaagcgattctcctgcctcagcctaccgagtagctgggattacaggcacctgccaacacgccaggctaatttttgtatttttagtagaaataggatttcactatgttggccaggctggtctcaaactcttgacttcaggtgatccacccacctcagtctcccaaagtgctaagattacaggcctgagccaccacgcctggccacaatttttaaactttttatttttacaggcacctgccaacatgcacaactaatttttgtatttttagtagaaacaggatttcactgtgttggccaggctggtctcaaactcttgacctcaggtcatccaccaccttggtctcccaaagtgctaggattacaggcgggagccaccatgcctggccaaaattgttaaactttttattttcttcctcaagaggatgagaagaaaggtcaattgtaagctttagaagtcttgcccaatagccaatctgagaatattctccgtaaacattcaccagaggcagccagtgaccatgggatacttttggtgagaggaattgattgctggggtcaggaatgggaggaaagcatacttctcattagataccttgttgaacttcgtaaattgtgtgccaaatgcatgtcttacctagacttcataaattaatttctttaaaaataatcaaagacaattttttaaagacttatttaatttaaggtgattataaaacatccagtatactttcactattaaaaaagtaagtattcctgtctgggcttggtggatcacacctgtaatcccagcactctgggaggctgaggtggtcggatcatgaggtcaagagattgagaccatcctggccaatatgatgaaaccatgtctctcctaaaaatacaaaaactagctgggcgtagtggcgtgcctgtagtcctagttactcaggaagctgaggcaggagaatcgcttgaacccaggaggcggaggttgcagtgaactgagatcgtgccactgcactccagtgtggcaacagagtgagactccatcttcaaaaaaaaaaaaaagtattcctaaacagcatattatcatgatatattattttgttttgtagggttttgaaccttgtctaaaaagaattaaaatgtataaatttcttcctgcaatttccctatttcactaagggtcattcacattggtcatatagacatagcacattttcaccactatatagcagcattttgtacaaatagactacaatttacttattctgcacttatttctgtttgtttgttttgctatgaaaagcaatgtcattacatatattcatgcccatagctacaagtttacatatttcaggttttctgtagggtggacaccagggagttgaattgttcaacaggactttacattcatctttagttttattggccaacaccaaattgttcttcacaatgtttgaactaagttgaaattccacctccccatcacatttagttttgtcaacttcatttcttcattcattaattcattcattcagtcttttgtttatttgtttattgccagtctgataggcgtatagtggtgcttcatcatggttttactttgcatttctctgattttctttttaaatttttaaaaaattatttttatgtagaaacaaggtctcgctacatggcccaggctggtcttgaactcctggcttcaaatgatcctcccacattggcctttcaaagtaccgagattgattataggcgtgtgccactgtggccagctgatttccctgatttctgatgagttaacaatctcttctttctctctctctctctctgtgtatacaggtactcaccattcgtgcctattttctgtaaaatatgtggctttcctcattttttttttttttttttttttttgaggcagagtctcgctctgttgcaggctagagtgcagtggtgcgatcttggctcaccacaacctccacttcctgggttcgagcaattctcctgcctcagccttcagagtagctgggactacaggcgtgcaccaccatgcccagctaatttttgtatttttagtagagattgggtttcactatgttggccagactggtctcaaactcctgactttgtgatctgcccacctcagcctcccaaagtgctgggattacaggagtgagccactgcgcccagccatctttcctcatttttatactaattaggcttttatcttacttgttttttttaatgttttttgtacactctgaaggctgatttttgttaattgtatgtgttgcattttttatggtttgtcttatgccttttgaaagtaaaagttcttaatttaaatatagccaacctgtaaatcatttgtgaaagtctgtggtttaagaggtcttgaataagaaattatcccatcatcataagtcataaatacttttttgttgttgttgagacagaatctcattttgttgtccaggctggagtgcagtgggttgatctcagctcactgcaacctctgcctcctgggttcagcaattctcctgcctcagcctcccaagtagctgtgataataagcatgtgccaccacaccagtctaatttttgtatttttagtggagacaggatttcatcatgttggccaggctggtctcaaactcctgacttcaagtgatccacctgtctcagcctcccaaagtgctgggattataggtgtgaaccaccatgcctggcccataaatacatttttatgtattttcttctaaagttgttttgtctttcactttttagtttttaattcacatataattactacttgctacttataattatctgtaagtagtatgagatgagaaataaattctatttccctcctatggataagcacaaacctgcagtattagcacagtcttatgtcagattttctaaaatgaatgggtgtgttttctaggctctctgttctgtttcattatctgtcttttcctgcaacgatatcatctgccttaaaaactctagccttgtggtattcctcattttcaagcagagcaaaccccgtcaccttgcttttctcctccagcatcgcttgtgctatcctggactaagaccttcatatagactgttagaatcatctagccaagttccattttaaaaatctatgttggagctgggcgcggtggctcacgcctgtaatcccagcactttgggaggctgaggagggcagatcacttgaggtcaggagttggagaccagcctgatgaaaccccgtctctactaaaaatacaaaaattagctggacgttgggcacttgaattctagctactcaggaggctgaggcaggagaatcgcttgaacctggcaggcggggggtgcagtgagccgcgatcatgccactgtactccagcctgggtgacagagtgaggctccatctccaaaaataaataaataaataaaataaaatatctatgttggaaattttgtacaaattttattaaatgtctacattaatttggagaaaaatgacttgattttgattatctattcaatatttctgtattatgaataaggcaaaaagagaggcagagaatagcataaaataataactaaaattcctgggtaaaccacctcaaatcatttcttcatatggctcaatattcttttgtgacatggcctgaaatatatccagacagagaactcttctcttcaatacatttcttcttttaggtattcatattgagttttcctgtccatgaacatggtataagagagtatatcccttcgggaggccaaggtgggtggatcacctgaggtcaggagtttgagacgagcctggccaacatggtaaagtcccatctctactaaaaacccaagaattatccaggtgtggtgacacatgcctgtagtcccagctactcaggatgctgaagcaggagaattgcttgaaccaaggaggcggaggttgcaatgagccaaggtcatgccattgcactccagcctgggtgaagagcgagactccatctcaaaaaaaaaaaaaaaaaaaaaaagaaaacgagaatatatcctttcatttactagtttttcttcaatttctttcaagataaagggcttacctatcttctgctttattcatagttacttgatatttttgtttctaataaatatggtgtctgtctatttacctgcctcttacctgttcatttccagtttcaaaaatgatgttgatatttgaatattaaccttaaatctagcaccttggtaaacactattattcattctaataattatcagtagattatatgtgttttttatttataaatcatattgtttgagtagcatgctttgcttcttcatttataaaatttacaacttttatttctttttaataatttttttcttattctcctggctaggacttctaacacagtattgagtggaagtgctgatccttgtttagtttcacatttgaaaaaagattgcttttactatttcactgttaagtataatatgcaccataggctttctgtggattccttttatccatttaagaacatctcttattcctaattagctgaagttttctgcatgtttgttttcatcatgagtggatttttttacatctattgaaatcattttacatagaagatatttcacacctattgaaatggtcatttcacttttccttctttaatatgttaagttgggcaaaatattaaagtatcacctgtcattctgcttcagcaaaaagtagtagtgtcttagcagtattggtgaaaagacagcatcaaataaaaaagatgtagaagtaggacccagtaaaaatctagcgcatggggcattgtcacatgtaagcagacagaatgtgacaccaccaaggagcatctgaagggctggaggctgaaggaagacatgagtcacccaggctcatggacacttcagagaaattagggagcaggaagaagaaataggatcaaagactacgtatgttggttggaaaaggaagctgatggtatggagatgttattatttaggtctcacataaaagatgtagataaataggtagataggtagatagatgatagatagagagatagatagataaatacatagatagatagatgataaatagatgttgttatttaggcctcacataaagatgtagacagattagacagacagatgatagatagatagatagatagatagatagatagatagatagacgatagatagatagatagataatctcagaaacagagacacagtgatctcagtaagataggcatatgccaggtgacagaattcagaggggtcccactacgtgaaaacaatagaacaaccttcgaaaagaaatttagtacaaataagagggcaggcttccttacatacaagttagtaaactggaagaatcagttatcctcaaacattggaatagatcaaaaatagttgtttatattaatgaaggtagctaaacatgaagctaagtgaacctgtctctgacctagtgtggcaatccctgggcaagggacacttgctccgctcttgtatccttcactgaatattcagactttcagttaagcatcggtgaatttagttttcatctcttgtgaaaaccttgagagaggtaattctctctgcttttcttcttttcccttccttcattttctcaaacattgcctgtttaaaatacgaaattttaaaagatggccttgttctcttttttgttgttattattaagtacagagaaaggaagaaccacaaatagcaaagggcaacatatggaatagtttagaagttccgggagcacccatgagggcaactgcagaagagaacattctatcccccgttgctgcagctttcattccaggtctccatgcatatcagatagggaaggaactccgggacagcagcagggcccatgcacatgtaaccaattgctttctttgcctgtagtaaagttcacattttgattgcttctccagattatgtagatccagacatattttatgcaggcatccggatctttctctctgggtaagtatagttcagttgttttcctgtgtgaagtctctgtagcattgactgaatgtataaggggacgaagagacagaagcttcctagcgtaagaaacataccaagtgactcttgctagggatccactctcaggtaaaagaagtgggataccatctgcacaacaaataacactgagggctaagtatttcagttaagagtgtttgttcctaggcagttcagatccatttatattcacttttcttagaatcctagctcaatgacagaagaagaaaaacacagtatgtcactcacacagttctatcacttacatctactttttcttcttgttattaaggcatgtagaaggctggggagtgtagtatagagttggatagcatcgaagctttcttctaaagttcctggaagagctacactgtggtttgaacgaatgtgtccctccaaaattcatatgttaaaacctaattgtgatggtgaggtattcgaaggtgggttctctgggaggtgattatgtctcctctgagaggagaagacaatcccctgagtggaactaatgcccttataaaggggctggagggagttcacttggccctttttgctccttttttcttccattccttgtcccttccactatgtgaggacacgggagttgaggcattaccttggacgtggagaccaggccctcaccagacactgaacttgccagcaccttgatcttggacttcccagcctccagaactgtgagaaatacatttctgttatgggtagtccccaactcaatacagtttgacttaccattttttgactttatgttggtgcaaaagcatacatattcagtagaaactactttgagtacccatacaaccattctgtttttcacatttggtacagtatttaataaattccataacatattcaacatgttgacataaataagctttgcgttaggtgattttgcccaactgtgggctaatgtaagtgttctgagcacatttaagggcagctaggctaagctaaggtgtttggtaggtcagatgtattaaatgcattttttgtcttatgatattttcaacttacattgggtttatcaggatgtaacccactgtgaattaaggaatatctgtatttacaaattacccagtctaatgtattttgttgtagcaacaggaacaaactaaaacactaccccaaaccatttttttcatattttctgagtactcttcttttgtcacatggcttgaaatttcttcacatagagaactctactattattttattttattttattttattttattttttgagacagagtcttgctcttttcacccaggctggagtgcagtggtgccatcttggctcacggcaacctctgcctcctggattcaaactactctcctgcctcagcctcccgagtagctgcgattacaggtggctgccaccaagcctggctaattcttgtatttttagtagagacggagtattgccatgttagtcaggctggtctcgaactcctgacctcaggtgatctgcccaccttggcctcccaaaatgttgggattacaggcttgagccaccacgtctggctgataactctacttttagatactctctttgcttaaacaaattagccattccttccttgacatgttttaatcagattgccttcctattaacttcggaaattaagagtttctgctatgtttttgtttaatttttaaacagtgaaaaatgaaaggtggaggcaatggctggatgaggtgaatatgtcaaatagatatcatctagtgggccatcttattaactaggagacacctgaagtgctatcaatagaaataatctgaagctgtgtctggatacagcaagagacatgcaaatgctaaaaatctactatattacattggtgcaaggacagagtagcaacacatactaagtattttctccagattgggtgtgtttgacgtgtgaagcacttcaaacagagtccagcctgggagggagtggggatggaatcctccttgtagagggtacagagtggaagcaagaaggtttccaagattgagagtaatgggtgtatggtttatgggggaaagggaaaacaaaaagaagggtgcagaaatggagctgggagtgtgttttagtatttaggctttctctgtatacctttgataggattagaaaaagaaaaatggaccatttttaaaaatttcatgctaccacatagcaggcttatactatagatgcagaaacagactgggatttaggaagcaccccaattctggaaaatccctttttgcttcacattgctctctaaatctgtatgttttcccttgttacgtaacaatttaccacaaatttagcagcttaaaacaatatgcattcattgtttcacaattctgtaagtcggaatcataggcaagctcaactgacttttccatttagggtcgcaaaaggccgaagtcaatttatctattgggctgggctcttaactgaagatctggggaagaattcccttcaaaactcatttaggttgttgtcagaattcagtgttttgtggttctagaactgagatctgtttccttgttggctgtcagacaggagctgctctcagcttcttgaggcatccagtattccttatcatgtgtttttttttttccatctcagcactggcactttttttttttttttttttgagacagagtcttgctttgtcacccaggctggggtgcagtggcacgatctcggctcaccacaacctccatctcccgggttcaagtgattctcctgcctcagcctcccgagtagctgggattacaggcacccgccaccagcccggctgatttttgtatttttcatagagatgtggtctcaccatgttggccaggctggtcttgaactcctgacctcaagtgatcctcccacttcagcctcccaaagtgctgagattacaggcatgagccatcatgcccagccagcactgacaattctaatccttctagcactttgattccttctcacctctccttctgcctctagccagagaaaactctctgattttaaaggtcttatgtgattagattcagcttacctaggtaattcaggataactccctatgtcaaggtcaactgattaataaccttaattacacctgcaaagtcccctttgccataatatatcatactgacagacatgctatagcataatactaatagttctaagaattatgataagaatcttggaaaaccatttttagaattatacctaccacagtatccttcaagggataaattgattctacttcttctctatgtcagaagcatctgatgaggatgaactatatattctgaaatccccatgattagatgtgtactagaaggtgattttactttcattaaaataaattcggagtcattgacacattttatctttgatttacataaatgcctccgctctgtttcttaccctcaaaatatttcccatgtagctaagtggccagtaccgaatcctacatgcattaataagtgtagatggacaaaaatatctggattactgagaattcccattagcattgtctagaaaaatgtaaatttgcttttttgttcttgatttatcctatttttgatttattatttatatttatttatttatttatttatttttagatggaggtctcgctttgtcgcccaggctggagcgcaatggcgcaatcttggctcactgcaacctctgcctcccaggttcaagctttcctcctgcctcagcctcccaagtagctgggactacaggcacctgccacagtgcccggctaatttttgtattttcagtagagacagggttttgccctgtgggccaggctgttcttgaactcctgacctcaggtgatctgcccaccttggtcccccaaagtgctgggattacaggcatgagccaccacacctggcctttttgcttactttttaaaaacatttttatttaggagaatggagatatttcatatgtagatgacacatattcattccctttagttcccacacacattcaatttcttgaggaagttagcctttgcaaaaaaaaaaaaatgatctcatttttttttccccactaaaacttctcattttcttggggttgctagaaagttgctacaagaaaggctaaaaataattgtgcctacagatatttgaaaggaaaatagttcctcttttttcacagtagcagcttggacctgagaatgtatgggagcaataattgggctgctcaaagaaacacaatttcccttcctcagactagaattaccaacctagagaacatgagtttttaaagtagatgtgcttcttttatctttttggacttgtatgctggtgttttctctgtcaccttcactgtggaaatcctcttgagggtgaggcactgaaagcagattgattaatgtctcttggccatttgagacattggatggctcttttaagttggccacgttctttcaagaactatgcttgggctacatattctggatatataatacatacttgtaggatgttatttttaaatcattcatttatcacatatttagtgagtgcctaccccatgtcagttctaggtgctggaaatagagcagtaaaaccaaccctcaacttggcccctctggagcttacatttcaatgcggtgggtggggggatggacaattaatacacaagtaaatctaataaaagcgtcatacaatatacattacaatggtaagcacaatgaagaaatggaaagctggatagagagtattagagactgtcgaatgtagtggccaaattttcctgtttattgtggtccaagagtgccacagccctctatgacatttgagcagacacctggaggaagtgagggagtgagccgccaagaaggaatggcaagtgcaataaccctgaggtgggagcgtgttggtcgtggtggaagagctgcaggaagccagcagggccgcaacactcaggggagaataagaaagagtgaggtgacagtagagaccggatcatgtagagctttgtcagcttcttttctgagtgagatggacaacacggacacgttttgaaaagaataacaatgtgatctgccttcagttgcaaatcatctctgtattgactgagtaggaaataaactccaagaataaagacggaaacagggaaaatatttaagaagcgatcattacaatccagggtggtggcttgtactagggtacaagggctaaaggtgttgagaaatggtcagattctggatatatactgaaatcaaagttgatggaaagatatgagtcaaagataatttgcaggttttggggtcctggttcactgaaagaacagagacatcatttactccaatgaggaagactataggaggaacaggtttagcaaagaagaaaggaaatcaggagatcagtttggggacacggtcatatcaagtaggcagttggatgtatgggtctggaatataggggagtggtctagctatcagtgtaaatagctttttacatttgtaaatagtcaggatataggcttttctttttctttttgtgagacacagtcttgctctttcgcccaaactggagtgcaatggcacaatctcagctcactgcaacctctgcctctgggttcaagcgatactcctgcctcagcctcccgagtagctgggactacaggtgtgcaccaccataccaggctaatttttgtgtttttaatggaaatggggtttcaccatgttgaccaggctggtgtcaaactcctgacctcaatcgatctccccgcctgggcctcccaaagtgctgggattacaggcatgagccaccccatccagctgggatatagttgttttctaaatctatgaggctagagaagaccatttgggaattgagagcagtgagcagtccacggactgaccctttgagagtgcaacatttagcagtactcaagatgggaaggagctagtgaaaaagccccaaatgactacataagaccatcaaccagattacaaagaaagacccgaacatgtgtgcccatatatcacccaacagcagttatgtctttcatgtttcttccccataaaatgttgttcatcaactttattagactagggtcttaacattggacaaatcacaaaacctctctggagcctattttatttttcaacagctgtaggaagcaaatacaaattggaaatctaaggctcagaaagatttgtacaaagttacacagtaatgaaaggggagccgggattcccactcactctaaagaatatgataaaatggctagtattcactgaatgcttaacatgttccaggccctgggcaggtattattttaattagttctcacaataatccaataagggagatactaatttactcagatgagaaagctgaggctcagagaggttaatgaactaagccaaggctcactgttaataaatagcaaaggtaaaattaaattccatatctgcttgagatagaggccttgctcctaatagctgcagcctgtcagggcctggcagcagtaacctctcctttcctcttcccaccattcccctgcactgctttctgtaccgcatctcttttcagagtgatgttgccccaattgcggaggccactgtgctgtttatccagtgaaagctgtagcacagccaacccaaagcgtccccagtgaaaacaacctggctccttacagcacttccagcctcagagcagtatttgaaaaatatcatgaacagcaaacacagcagtctgtctgtggcttttatatgtgtatatggtgtgtgtgtatgtcccttctcttgagcaaaataacttttagaattatagaaaaaaaatgtgcaacatcaatgtggatctgctgtttaaactcataacagagaaagtagcttgtttctggctataggaggaaaagacgatattccttagtaaaaatggaaatccacatatggggttcttgtaaaaatgaagatagaaaattgcaagtttggggatcaagttctggttctatcatcctttaacagtatgaccctggaaccttaattgctttgagtctttgttactttatctatgaaatgaagtatttaaaaaaactccaaaaatctgtcctgatgtacacacaagaggtcaaatgagaaaatgaatgtgaagatgctttataaactatacagcatggtaggtgcaaatgtgacatgaacttgttttggacacattataaagtcacccccacaaactgtgattgttcaagactatgcaaagtcagacacaggaaaataagtaaaacagatggaggcataaagagggggaactcagagaaaacagtgaagaacaggaatcaggaagacaaaggagaggaaaggtggggaggagaggagaaggaaagggggaagggaatggaggagaggagaacagctgcttcacagagcatggccggcagcccagtcccagcctttctgcatgtccctgacttcagcctctggcgaggcacaggcttactctgtgcttcctgctgttactcttcttatccatccttattatcaatacctgtggtcaacaaagtatttgataaaggcatcctcaaagtcaggtaacatctgtacgttatagattacaaagttgagtaatatccagaattggtagtttaacgtgatgacttcttaacaattatcactgtttcagggaagggcaaaggtgtgtgtgtgtgtgtgttcatctgtgtgtatctgtgtatgtaattgtgggtgtttgtgtatatttgtgaggctctttacttggcggagttaaaaagtatctgctcatcaaggttgagattagcaaaggaagtgaagatttttccagagcccctaaaatgtgccttttgaccaacactgaggacatctttataactgagtatgtgcaataaatatgtcttgggacctgtgccacaaattcctctctaaatagcctttacctctctggaataaccctttagatgaggaagaaaagggctgtgattttatagcttgttatgaagctggagtgaagatgatgcttcagtacttaccctacaaagatacccccaatccctcaccctaaaattaccattgaaatcatgttccctttctcattcactctcagtttccatgtcagaaaatataccattacctccctgcacccctttcatctctctcacttttctcttgcttagatggaaagacaacccagcaatgcctgcagggctgatgtatgaaggagtttcccaagagcccctgaaatactccggcgggagtgcagctcagagcacagtgcttcatgcctttgatgagttcttaggcattcgtcatagcaaggaaagtggtaagtcagacattttgttttcccttgagagtagagggaggaagaggagaggtgttttttttttttccaattgataaaaccaaatataaattaaaatgtcatgaagtttatacttctctaagtcagccaagaaactgcatgactgccaatgtttttgtgtcaagccaattaatattggaatatcagatgtcagcttgatcttgggttttacttccaaatcttaaaatgttgctctgtttccaactgttcactatcactttggtttggatctttagacactagcttcctttttctgaaatgggggagagatgtggagtttgaaggctatgagtctgggccagctggaaacaggtctgggatcttccaagaaagtccttccccacaaaatggtgcaacttctagccaaatctatttataccagcagagggatctatcaccctggaagcttgaaattgttcattttcttacctgccaggatcaagttaagtttttaacagttgcaaaaagacacttcatactatggagttttcaagttggattagaagaaaaagaatcaccagaacttagtgtcgtagattcaagtcacttctctaaaactgtcataatttttcacggattttggcatttggtgacattaatggttgatttacttaccatgcataatattaaacccataacgaatttcctataaatatctattgatttgatttttaaatcacttggcttcaagaggctattactaaaacagtgactcattctttatcttttttgccttcacgggctttatataactttctccttttcttgtgctccctccaaaacaaagcactgagaaaacaaaattcaccagagtattcagctagtcagttcaagggtttgtgttctacatttgaagatattccttatagcagctaccaacgggatactttgtttacatttgttgtgtagtaaatatttatatattggcaaacaaatctagttccaactctgtcatctgagatgttcttactttgtttcctcttctccatctcctgtcaactgttagaaatatacatttgagtacgtgaagtctgcaaacaaaagggccaaggtagatttgagttagaacaccagcaacagtttctggtgcattcttgtctgaaaaagcagagaagattgggcaccgtgggtcatgcctgtaatcccaaaattttggaagtctgaggcaggtggatcgcttgagcccaggagttcaagacaagcctgggcaacatagcaagaacccgtctctactaaaaggaatacaaaaaaatattagctgggtgtggtggcgcacacctgtagtttcagctactcagaagactgaggtgggaggatcacttgaactcaggggcagaggtggcagtaagctgagatcacaccactgcactccagcctgggcaacagagcaagatctcatctagagaaaaaaaaaataaaaaagaagaagaagcagacgagctctgctatatttccatgtggagctatgacgttatgctgtattgtttctttcaggtgactttctgtacagaatgagggattacatgcctccttcccataaggccttcatagaagacatccactcagcaccttccctgagggactacatcctgtcatctggacaggaccacttgctgacagcttataaccagtgtgtgcaggccctggcagagctgcggagctatcacatcaccatggtcaccaaatacctcatcacagctgcagccaaggcaaagcatgggaagccaaaccatctcccagggcctcctcaggctttaaaagacaggggcacaggtggaaccgcagttatgagctttcttaagagtgtcagggataagaccttggagtcaatccttcacccacgtggttaggaggctgccctctccccagcaatgcagagcccccatggagggcaggtgggcctggagaatgagggtcagggttctgcctgggatcatccaggaaggatctcagccctattcatgtttctgctctacagagcactatattctccttgttgagagctgttggcttcacaaaggagagttgatgtggccaagcctttccctccctacctgatcactgcttaacggcatgtataatggatacttcctcatgcagaacccccagaggagtgactgtatgccattctctttgccaagtaatagaaaaccaatctaaatgtcaaaaatcagataaaattgcctggggatacattacttgttgattttcttaaaaaacaaattcacttaacaattcattaagttcatactgagcactgcctccaagattaaaaccaggatttctgtggtcccagaccagccctcttctccctgaatgtgttgagttggtggcaggaggttggaaatgctccagtggagatgggaagatagaggatgctgacaataaggacttggaagtcactagtgtgaaaatgagcagttaatgatatgggaacggatgagactttccacgtggtacctagatttgcaaattctattgtaatgcctttatttttagaagaattattctctcttcttactctgaaaatctgtatttgtaaaatgaatgaatggatcctatataagtaaataagaaaactgggaataagtagtaaatcaatgtgtttagtgtgcaaataaatgtaaatgcttttattg

SEQ ID NO: 251 - DNA, 371041 bp, Homo sapiens
  source 1..371041: mol_type = genomic DNA
tatgctgggtggcacagtgaaatttatttgtctttatgatttacacataataattaaacacacaaaagaaaaaacactgtcaagatggccatatgtagcttaggaaatgactggtcccaatgcaatcatataaatgttcattcagcgtaaaaatgagtttctttttaatggttttaatcttttttttttcagtccccaaggcttgtaccactcagtacaaatgtttttgctactgggttatcatcaggaacatgatgtttaccaattcccaggaaatgaataaaatcaacagaaacatcctgtgacaacagagcacattttcatagaaatgaaattgatgagcttattacagtttgaatcagttcagctattagatctacacataaaacatgaaacaatattaacaaattacatttgtattaagtttttatttaaaaatatttatcacacttttttgtgcaagggttccattgatttctttggttttaaacacgatagatctattttacctaaatatatatagttctatttgtaccaaacatcaaaaatcaaaaaaacaaaatttcaaagggtaaaaatggaattattgcttcaatataaaaaaggcctagcccatttgagaactactgccattattgctttcctatttgaaaaactatcctggaaatcaaggaatgtaccccatagctccctgcagaaagtataaattggttgcacattatcatcatattaatatgaccctaccttcaccaaagctatcctgatcttgtccttaaaaaatgaaacaaagcaaaatagcataaataaataagtttacctaaggggatacaataaatagcctagtatactagataggaataaagaatattgtaacataaagcccttcagtgctgtacaatgcaacaatagctttggattttcaaggtttagagaccttgaaaatccatttcataacagttttattactggtatgcagctgacagaacaagagaatacacttcttttgttctcctcatcttagagtgaatgcacagcagatacaactgtcaattctgccttttgggaatttacctgggcatgtaccattgtcactttttgacctctgcctaattgtagggcaaaatcttaggattaaaaatatccaaatattccttcaattcctagtggtttcttggtctccagaatagttaaaaacagagaggaaattagactcaaaagttttgctgccttcttttctttgcatccatcgcatccagaatgggctgtcttttcgcagtgtatctctgacgaagttcttctatctcccgttccatcatggggtccagtgcttttaaccgcatctgtagttcttctaaacttagatttttcaactagatacagaaagaaagataccaatacaatgaaattatccacattatccacaatcaatacaatgaaattagactttaatgtctaatgagttttaacataaatatttcagcaaattctttacatcatctttgaagtatagttcaacaattaaaacaggaatttcttccttgaagaactcagaggtcatatcttgcaagaacctccagtaatctgcaatgaagcaatccgatcctctgcctttaataaagggcaaatgagaaaaatacgctgatggaatttgtaaaaaggtacaaagacaaatccaccactgccaacaaacagattttcagaatatgttccaggtatattcactctaactttttacatctttgccagctactgagtgctacaataatcatgaacacttgcagagatcactcaagaatgtgacaagactgaataaaggttaaattaaccattctatcctccattttactaaatgcttaataaagaagatgactgtggtagggggcgggaagtaaggctgaataggcctggtggggccccaaaagcaggaagccatgatcaattctggagtaggacagttatgtaagagtaatccagatttggttttcttttcttcttcttcttcttcttattttttttgacacaaggtctcaaacttctgggctcaagagatcctcctgccttgacctcctcagtagctgggatgtgccactgcacccagctcaggcttggttttaaaatgataaaacttgcaacttactttttgttttaagaagataattgcctttggttattttatgagtcaagctaggaaaaatactcattacttatagtcatccaaagtagcatttctcagcagatccttttactcgccatccctggccctatcgtgacttctgcttccaaaaaccaaattcactcttagctgaaaaagactctgaggatactgaaaagaatgagtcatagactctctgaaggaaattcaaaaaaggagttccaaaaatattttgagaaatgacagtgttatggagaagagtatgcaggcttccatgatgatgactttgaaggtgaatgccactcacttcggtgcataagaagttctggtatgtatattaataatcagccctgttattttgtagtcatatgtcatgaaagaacctagcttttaatattatgccataaaacatacatttatatatcatatgtagtattatacactttcttcattgatttttaatccaagtagtgatcttgcatctgttacatgctcagtgctgttcaaatcactgtggagatacagaataagacaaacagggaaactccaaactttgaactgtacacatcggtaatggccacattgaaaggccaatgtataccacacaaccacatttcccaagaaagacatgcccaactatgtctatgtaggatccagttccacttctgtgttcttcaacatcatctctatttcagcccatgttaatctttcccatttctaaatttctatgtaacactcataatttaaacaacacaatttagtatttgattctaaatcatgtactattttataattgatttttatgcatgagtttcatgtccctagatattccaaaaaatacttagactttagagactgtacatacaccaagaaactatcctactatactgcaaataacatgacgtaaacgtagatagataaatatgaataagaatatatgacccaaaggagtgggttactctaagatcagaagaactaacatattatataaagcaaacaattatcattactttaattctgaattaagatattcctgtaaatatcttgtactacttttactggggcaaactgccaataggtttataaatattgtattgcagtaatagactgaactcagaaaaagaagctacttagaagaaaaattttcttcctttaacagatttttatattatcaatgcgtaaaatttgtgaaaaacaggtctgtgatattagagaaacattatctaacattattaaggaattaggtgttcatgtaagtaaattaatgaagtacctaaatcttagttctttaagtgataaaactttgtctcaatatcacatacacacacatatacacacacacacacacacacatgtgcacacacacatgtatttacatatgctcttttttggttctatgtgacttttaggatttttttctaattttgtgaaaaatgatgttggtattttgataggaaatgcactgaatctgtagactgctttgggcagtaaggtctttttcataatattgattcttccaatccatgagcatgggatgtatttccatttgtgtcatgcatgatttctttcaacagtgttttgtagttctccctgtagggatcttttaccttcttggctaagtatattcctaggtaatttattgctattactattattattattaattattttacagctattgtaaaaggggttgagttcttgatttgattctcagcttggtcactgttggtatataatagtgctactgatttgtaccactgattttgtaacctaagactttactgatatggtttggctgtgtccccacccaaatctcatcatgaattgtaatcctcataatccccatgtgtctagggagacacctggtgggaggtgattggatcatgggggcagtttccctccatgctgttctagtgatagtgagtgagttctcacaatatctgatggttttataaggggcccttccttcttcaatctcactctgctctcccctctcaccacgtgagaaggtccaggcttgcttcaccttcaccttccaccatgattgtaaatttcctgaggcctccccagtcacatggaactgtgaatcaatacacctctttcctttgtaaattacccagtcttgggtatttctttatagtagtgtgaaaatggactaacacagttaactggcactgaggtagtggggcgctgctataaagatacttgaaatgtggaagcaactttggaactgggtaatgggcagaggttggaatagtttggagggctcagaagaagttaagaagatgtgggaaagtttggaacttcctagagacttgttgaatggttttggccaaaatgctgttagtgatatggacaatgaagccgtggctgaagtggtctcagacgaacatgagaaactcactggcaactggagcaaagatcactcttgctatgctttagcaaagggactggtggcattttgcccctgccctagagatctgtgaaactttgaacttgaaagagatgatagggtatctgggggaataaatttctaagcagcaaagtgttcaagatgtgacatgggtgctcttaaaagcattcagttttatggattcacaaatagatggtttgaaattggaacttatgtttaaaagggaagcagagcataaaagtttggaaaatttgcagcctgatgatgtgatggaaaagaaaaacctgttttctgggggagaaattcgagcctgcagcagaaatctgcgttaagtaataaggagccgagacaatggggaaaatgtctccagggcatgtcagagatcttgccagcagccccatttcatcacaggcatggaggcctaggaggaaaattagtttcatgggccaggcccaggggccctgctactctgtgcagccttgagacatggcaccctgcatcccagccatttcagttccagtcatggctaaaaggggccaaggtacagctcgggccatggcttcagctcaagccttggtggcttccacatggtgttgggcctgcgagtgcacagaagtcaagaattgaggcttgggaacctctacctagacttcagaggatgtaatggaaatgactggatgtccagtcagaagtttgctgcaggagcagagccctcaaagagaacttctggtagggcagtgtggaagggaaatgtggggttggagaccccataaagagtccccactggggtgctccctagtggagctgtgagaagacagccactctcctccagaacacagaatggtagatccattgacagcttgcaccatatgcctggaaaagctgcagacactcaataccagcctgtgaaagcagctgagaggagggctgtaacctgcaaagccacaggggtagtgctacccaagaccatgggagcccacctcttgcatcaatgtgacccggatgtgagacatggagtcaaaggagatcattttggaactttaaaatttaatggctaccctgctgggtttcagatttgcatggggcctttagcccctttgttttggccaatttctcccatttggaataagagcatttatccaatgcctgtacccccattgtgtcttggaagtcactaacttgcttttgattttataggctcttaggtggaagggacttgccttgtctcagattagactttggacttggacttttgggttaatgctggaatgagttaacacgttggggaactattgaaaaggcatgattgtattttgaaacgtaaggacatgagatttgggaggagccaggggcagaatgatatggtttggctgtgtccccactcaaatctcatcttgaagtgtaatctccataatcttggtttgtaatccccatgtgtctagagagagacctggtgggaggtgactggatcatgggggcagtttcctccatgctgttctcatgataatgagtgaattctcacaagatctgatgggtttatgaggggctctttctccttcactctctactctctcctgccaccatgtaagaaggtccaagcttgcttcaccttcaccatctgccatgattataagtttcctgaggcctccccaggcacgcagaactatgaatcaactcgatttttaaaaacatattgagacttgttttaggcctatcatatggtttatcttggagaatgtttaattttggataagaagaatgtatattctgcaattcttgggtagaatgttctgtaaatatttgttatgtccatttgttctacagtgaagtttaagtcctgtcttcattgactttctgcctcgatgatctgtctagtgctgccagtggagtggtgaagtcccccactattactgggttgcacctatctcttttcttagatttaagagtaattgttttatgaatctcagagctcaagagttaggtgcatatttatttaggactatatcttcttgttggattgatccttttatcattacataatgtcattctttgtcttttttttttactgatgttgctttaaattctgttttatctgaaataagaatagctacccctgctcacttttactttccatttgcatagaatatcttcttctacccctttgagtctatacaaatccttatgtgttgggtaagtctcttgaagacagcagatatgtggtttgtaattttttatcaattctgccaaccagtatcttttaagtggagcatttagaccatttacattcaacattaatactgaaatgtgaggtactgttccagtcatcacgttggttgttttctagatactctgttttcttcattgtgttattgtattacaggccttgtgagttttacgctttcaagaggttctattctggtgcatatctacctttcgtttcatgattcagaactccttttagcatttctcgtagggatgctctggtagtgacaaattctctcagcatttgcttgtctgaaaaagaatttatttctccttcatttatggaacagttttgctggatacaaaattcttagttaacggttttctgtttaaggaggttaaagataggaccccagtcccttctggcttgtaaggtttgtgctgagaaatctgctgttagtctgataggttttcctttacaggttacataacgcttttgtctcactgctcttggtgacatcttttttgcaacgaatctcctagaagttcttttttaattaaaacactttttttttttgtgggtgcataccgggtacctgaaatgttttgatactggcatgcaattgtgaaataagcacctcattgagaatggggtatccatcccctcaagcatttatcctttgaatacgatccaataacactcttcaagttattttaaaatgtacaattaagttattattaactatagtaaccctgttgtgctatcaaatagtaggtcttattcattctttttattttttattttttttgacagagtctactctgtcacgcaagctggagtgcagtggtgtgatctcggctcaccgcaactgatgagaaagcaaaaaatgtccatcaaaatatgaatggataaagaaaatatggtacatatacacaatggagtacattcgtgtgccatatctgtttctactcatgctgttttccttctctatcctatttcccattttatcatcttactcatccttcagtgagttagctgtgcatgggcctatcttgccagctagattgcaatcttgttgtgggagatagagtgttttactcatctccgaacctactatgctgtatttattttaaaaatatctgatttcagttttgtggttgtatgaggttgagtttacaggaaatctgacttctgcataagctacatatatcgctaggtcttcaggtgggctgtcagagaacttcaaagtactcactgacatatttattgagatttttctatggaccaagcatagtagaatgaattttcattcacatcttgaatagtttttcaaacttctttatgttgtttttcacctttctctcgtatctcctttggtagcttaataatcaaccttttgaattctttataaaaagatatttcaaagatttcatcttggtttagatcaattgctggagagctaatgtgatcttttcaggggtgttatagaaccctgttatgtcatattgccagaattgtttttctggttccttctcatttaggtagaaatatatggaatgcttcacgaatttgcatgtgagccttgcacaggggccatgctaatcttcactgtatcattccaattttagtatatgtgctgctgaagtgagcaccgtctcaattgttttgaacagaaaatctttataaagtgttccacagaatatactgccttctaagcagaggacatagaacctaaaacagtttccttgatatgagttatcattatttttattatggatggatgaatattgtttttagttaaattaaaaagtcaaaactactttttaatatgagtcaacactttgtttgtaaattgatatggtttggtacatgagtgacagcttaaataagaaattcattttgttagtgatagcccttgataattacatttcattcaggagatgaaagatcaatatacaaaactatgacatttctcagtatttctaaaaaaaaaaccaagtaaaagatacgcaaattaataactcagttactagctcttgtataaaacaggagcataaaaaactcagtgatatgagaagttagggtggaaaataagattaaatcaattcactgataattctgacatttcaaacctttaataattagaattatttctgaactctacaagaagtattgaaagtctgcttattactgatcagaaagagttgtcagtaaaattagaacttcctttaagtttacatatctagtctactataaaaacctaaaatatcacagtcaagtgataaaacttacttcataaaataattcatcttaaaatctctggggaaaaacactaagatttctatataattttgttttgtcaaaaatagtcgtaattacatgagcgatttttaagaagtcaaatctcaaatagcagaaacgggaatatgaaggttttgaatacatcaatgtaataacatttcaagacctaatgattctatgagttgctggaacaatcagtctgtcaaaataaatgagacactactacaatgaagcaaatggtcttacatgttaatgttaacacatttagtcaaacagtcaatcaagagaatcctaaggtttgctgtgtttactgggaaaacaaactcttcctagcaactgtttaaataaatcttgcagatgctacagaccttattagtggcctttgattaaaaaaatatgggttgctaatactgtatcctgactcatctattttcccatctgctagcaattctaacaatatgaactatcaacagaatggctaacaacaagaattttctatggcagttttgatgctgaattgcctatagcatttttaagatttaccagtgcatgtctcagactgttttgagtttcttgtggcctggagcaacatactcttttttcccttaatattccattttagctgaaatttttactgtgttgaacagaatcttgtttggttttagaaaacactgttgatggaggctgccacacatttaactaacaatgagaacaggaaacacaacaaagcactagtaaaaatccagtcaggtccactgattggtttagatatacataaacaggcaaggggccttttgcccataaggctgagccacagggataacaggtagtacttaaagttaaaaaaaaaaaaaaaaaaaaaaaagaaagaaagaaagaaaaaaaaagaaaagaaaacattcatatattaaggcattttcctgatttaattcctggcactgagaagcatacaaaaaaggagcattctagtcaatccaaactactatgaagcctgtttaaagaaaaccctacatatacatttaaaatatgcatttacaaaaataagatagtgataatttcaggcacttgataacactatagaagaaaagctgaattcctcactgtaaaaatgtgatcttaaaagctgcattaacatcaaatctactggcagaccccccttccccaaacagacattatttatcctgttctgagctgagaggcccaggtcttcagctgactgaataactaaaaatattctgggattacaattggaaactaccatgaatcattctgttttggctgtttaacttcagagcacctagaagaaacttaggattctagattttcattcccaaagaaaaggaagaatacggtttctcatgaatatcaatgaaggagtaggagaaagtgccaattactgattatttacaatgtgctgaatactatcctaaggtcctgtacactaagtcattgaagcctagcaatcaccttagggggcagatattaccaaccccgtttgacaggtgaggatgcttagagagatcaaatgatccaccctaggtctctcagctagaggtgcttatgtaggccctcaaaggcaacatctaacccacataaatttgaactgcagtctactgatagctgtttcatgggtttcccatgaactacaaaagcactacaaaatccaatgatcatgtgaaacagttttttcacaaattgtttataggttaaaaatagaaaaaattacttaaaaatcccaactttcctgtcagattgtacctggtgaagcattttacttataagctattcatgtattttagccatcactggccatatgaaataagtgcatatgtgttaattaagcatttttctatttaaccagctctttagccaaagaaacacatttctacatagccctttgggatagatttcctaatgttatcaataaatgtaacagagataccctgacaaaaccaataaaacatgtctccttcacattccagtgagactttgcctatgtctgttcagactgttccacagttggtttggtgctgtgtttaccttgaatctagtgcaggagttacaaactgatgagcattactataattatcttgtcttagagaaatctcggccacccatttaaaaaaggaatgatgaaattttcgttgcattcctcaatggcagctgagcacccatttcttatgtgcattttccgtttctggtaagtagctttgcttattaaaaatatcaggaaatacttaatttgggcacacttctgatatattgtaagcagctctaacattctaggcccaggacaacaaaatttaagtaactcaaaagcaaccagtaattaaatctttctggatctattaagggcagatgaaaaattgtattacctttgatttcttatctcagcgattctgattagcactttgaatagtttaaaacaccaatgaagccgtaaataagaggttaacaaattaagtgattaattttctttttatacttcaatttaagaaaaacattatatgagaaatatttgttatggaagatcacaaacattacaaaaacaacagtggttaaagtatatctgtaactagcttactgggtagtcaaacctctgtggagcaataatataaacttaaagtaatttaatttttctccaattacactctttcggctatgcaaagtcaaatttccttgacatatcccacagtaaatcttgggatgatttcactgatttctggtcacttttacttattaaaagtccagaccaaatataaacttcaatctcttattaagtgcaaattttgtcccttcccttagcatgagcttgcaccaatttacagtggggaaggatgatgtctatatctagaaccttctcgccgtctctttctaaggtctggttcctctagtgctgggagcaggaaggagaccggatgttattatgtaaatggtgacttgtcagtgaggtatgtttccctggtcttgctctggtttgtttgattactagtggtttgtgcacagaaagcgtgtgtatgtatttcctgatgttgtggttagtattatcctagtgcccaccccttttatagaggggctgcccaacatcttttctgagttagatattgtctcctctgacctgaaagccacctgggcagcattatgacttctgacctcctcttttggagtaaagagatcatggaagttctctacactctccagggactagtgggacccaaggaaggtaagggtcactactccaatggcccttagttatcccgcaggcctcggctctacctacagaagtctcctacctacaaaaatctttgggagagaagcagatatcagtgtctatgctaatataccttccaaacttccaggaactaaaggctctgcctttagtggcacaccagtgggtctacagattcagctagctcagtaagcaccttgctggggtaccaggtaaccgtatccctttcctgcaggcaccaccattctctgtgaatggatctctggaaggctccttatttgactttaggtaaggagagaactattttcttcccctcccaccaggttataaattccatttggatagggcctttgtctagtaaacagctacatctctagtgcctagaacactgcttgaaacatagtaggtgcttaatcaatatttattgaatgaatgaaaaatggtgggtctcttagtaatcgctggagggaggcggctggcttcagttgttggtggcatgctttagaatatcgggtacttaacacctgctgttttcagctgtggactctactaacaattttgtggtaacagaaagtcccttttgatgtcatagtacacatctattaactctatttaaaaaatgtgtgtgtgtgtgtgtgtgtgtgtgtggcatcaagttggtaaatttgcagttgaagtaaagcaaaaagagtatctgtgaagatgagggtattttttcagcatgtttaattaatattactacaggatagtttcatgctccactacatgtttattctgcatgtctgatgatacatttatttcaataataaggggctcatccttttcttagaataatggcttctctcaaaaaattctccaaaacaataataaataccatagttgactctttgaggaaacatgcatggagtgaagtgtgctggaagagcatcattcttactaatgtcacaattttctgcttcactgacatcacaatacttagtctaacaatttaaattatactatcttcatatcataaaaatgtaaatatttgtttcttgaaaatctataaagtagttttaaaatgaaagaggttagctaaaacccacaaatcatgcaatttagattgtaatagataatttttaatagtgaagcaacatctagaaataaacaagagtctcatattttagtttcgaagcatctaaatccacagttcatttaaaacagttcagaataagaatcgtggtctgttaactatttttaaaacaataaaactcaaaatatgccaaaatgtttctaaaacacttcaaaagaaaaaataaattcgatcatagttctgcattctcacttgccacatgggccttagaagataaaatgtaccaaaaaggaaacattttagcattctcaattttagaatggcatggtttgtggctgaaacaatatttaattttcccagctactgacagacaaatgtacaaattaaactaaaacacccatgaagagattcagatatttgtaaggacacaagaaaaaaggataggaggctcttatgaaaatgtttaaaaagcaaaattgattttgtctaccttaataataaataagctgtcttgtgcaaacttaaaagcaaaatcgtcgcctgaatgaaactgagattctattgttttttcattaatatttgttttaaaatatgctcacaaatgctatgaatttaaggtaaaagaaggtagagaatgagaataaatgaacataagtcctgctagttattaacttagatgtgtctcatgggggaagaatcaactttcaaatgtaaatgtttcaaatcttcaactttctgaattggggaaaggacaacagtgtttgtgggttatgtcagcattttagactgcgcaactaatatgcagaaatcacagaaaataaagatgagagccgggcatggtggctaacgcctgtaatcccagcactttgggaggctgaggcaggcggatcacgaggtcaagagatcgagaccatcctggacaacatggtgaaaccctgtctctactaaaaatacaaaaattagctgggcgaggtggcgggtgcctgtagtcccagctactcgggaggctgaggcagcagaatcgcttgaacctgggaggcgggggttgcagtgagctaggatcgtgccactgcacttcagcctggtgacagagtgagactccatctttaaaaaaaaaaagaaagaaaagaaagatgagaaagtaatatgccaccattacttccaaaaggctgagtaaacattgattacaaactaaaattttcacacttagatgattataatacacgaatggtccaaaaaggcttttctttgcgggggcgggggggcggtctgagaatggcgccaaattagatttttagaaactgtttttcggtatcaactaatttaatagagaacatggcatcaaaattttatctctaataataccttgcaaaatgagtgtgttcccaaatgttcctgcaagtcttcagcgctggggctggaccaagctgcacctcttgcaaaggcagcaaggctttggttttatcctcccttgagccagacacctgccttctgagtggcctcactactaatgtggacatggaagcagaggcagagaactgaggttgggggacagcacaaagaatggctgatcttactttacatctactgggaagccgggagactgtggtcatgagtggaaatttggggatcagaatttcagctctggtttgaataatatacattaatatggagtagttttgctagtaaatcttcacatttttattttacaagatgaaatttcagttcagtcttaaaaagtccattttaataaggataaaaggaaaaatgcatctttaattattgaccatatgaaagacatattgttggtttacctcctgtggaaaaagtaataacacagctatgtggctgctgaattcaatgtgctcttgaggaactttccaaaaaatattagtaactgactgacatacactgttattcaaggaagagcttatccactggataattattctgaaactggtttatattcacatacaatatatgtaactctcaatctgaaataaatgacccagcagacctagtgctgagctgctagtacctggtactaacagatcctagaattctccaaagcattcttagacaagaacaccgtgagtgaactttccattattagagtcagagtagcggtgcaataccagaaatgatcaactaattttgaaaaataccacatgcaaagaaattaccttcaaactgccaaaaacactgcaagctggtccacacaacactgcccatttctggatacccatgatttacctaagttcttctagcctattttcagttaggaatgcccatttgaatgaacctcctcctgctacagttctcttaaccacagtgcatgatcttgtgactctgtcaggtccaccctagccctgccaccgccaacccacagatctcttctaattaccccagttgtgagagacagtcatagtcttaatcattttcttttcacaggggtgttcactgcctcatctcacccgtactcagtacaaggccttttaagtaggccaccctcactctcacagttgtttctatagtcagaatagtcagctgtgctggaccaagctgtcaaaagaagggagagataactcttaaatactgaggaaattgcagattctgctagctattttttaatttttcaatgaccagaaactgtctttcattggtctttagtgagtgtcatccttaattatatcaactaattttaaagatgacatttttcctagacaattttgctagggtgacagcataagcttccccaacccttggtaaatctctgctctaagtataaaaaacaagacactgtttactgactcttaagaggtgtgggtttttaatcttgcagggtgaccaagtgttgaatatttggtaacaatttcgtaaaatcttttatatcccacttagaaattaactgatagaacacctgagggagagtggtaaaagtggaagcagtacaacagaataaaattaaatgatcctaaatcaactgcaatgtaccaaagccttctgaataggcaggtggcttctgaaaagggtaagggtgaatgaagttacagcttgactggctcagagagtttataggtttgtagaggatgagtggcttacagctcgatcactggctcctgaaaagttaggaagctgggccactatcagatcaatggtatcggaaactgagaaacatgaagtcactgagctctacagatatgaatagtggcatccactgaacccgctcataagggcaagatttcaacctctaagagagggctaagtcgctggctatacagtaccctctggtggccagatttgacactgcagatttttctgccttttaagaaaagaggcctggtttttttccttttcttttttttttttttttaatgcatagacttaccattgggttacgtcttgataaagccatcataaactaaaaatatctgcatttagtacagctaacctaccaaacatcatggcttaacctagcctaccttaaacatgctcagaataattaacattagccttcagttgggcaaaatcatctaacgcaaagcctattttataataaagtgttgaatatttcatgtaatttattgaatactgtactgaacgtgaaaaagagtggctatacgactactccaagtaccgtttctactgaatgtgtatcactttcatatcaccaaaaaactttaagtggaaccatcatatacctgggactgtctgtaattcaaaatctttctagacaaggaaggaatcaccagtagcactgctgggctatgggtaggtgggcaactacctactaggtgtaaatctgtcaaccaaaaaagtaaattatggtggctttaagggagaaaatgttcctctgaatgtgtttaaaatcccatgggtgtagctacttaaatgaagaaatctggtgagtacttagctatttaaaatttaattctttgcaggtacttactttacaagaagtattcttatatagagagattcatattgctataaatatgtacataatagctaacatgcgcttaccactggcagacactatgctgttatttaataggcaataatcctatgaattagtattattagtatcaccatttttcagaatttaagttttcagaggcaccaagagtttgaactttaagacatttagctaataaaaaaatgtggccaggatttgaatccaagggaactgaattttggagctggcactcttaaacactatacaatgcagttaaatatatgtagtttactgcccataataaatttttccaaaaaagagatggcttcttaaaaattttaaattagattcagattagtatagacacttgcaagtcaatgatgcttaaaaactaaactaaaaccctatgccagttgagtgtttatttcctggaatgtttactcacatacaccttatggtggagaggggagtttataattggccacagagcctgagacctaatatttttgaaatcataatatattttacagtacttcacaatttacaaagcatatttacatacattgtatcacatgaacctcaaaataatgctgtgaaatggggcagataattctgtaaacaggcattattcttaactttatagatgattaatgaggcttacaatgataagtcatttccttaaataacacaattctctcaaaatctaagatgttccaaatgactgaatgcattatgaattagcctatcataggctttatcatctgtcacataacatttaaaaaaagatttctcacaataaaccaaaataaaattttactttattttatttctgctttatctacaataaatattataattcaacagtaattactattgttgaactagcaaaacccacataacaaaataaaaatcagaacatgaaaagctatagtaaggagaatgagaacaagtatggatcataaaatccagaattaggagcgaaatggtccaaaaattatgagattaagatcaatgattacataaagcactcagcatttttgtaattacttaaatttgtaaagtgccttcaaaaatttgttactcttttataatccctaagagatcactgagagacaataatagcctttacacagcagatgaagaacattttgaaagtactatgaaattcagttattatttttgtttaaaagaaaacatcttgtgattctaaatcacaagagcccgaaattctttctgaatataagcaatgccatttacaaacattcctgctgcacccatcttctacaccccctgttgtaatgaattcgcatacctgcctccgattacaggctggattgccccaaagtagtcttctcagaaacctatctacacagttagcttctttctcttgtgcatcttcaaactctctttgtctttagcatcaacatgatatactttctgatatttcccatcttaaacttttattgttttttcttatctcaagaaaaccctgccttgactcacggccattcctccagttgtcacaattccatccctcttctcctttagaaagtcaaacttctcaaagtatggagaaaacaataaccatattttaaattggcaatcaaacttcaacttgctccatactggcttctgatcccctaatgctctccaaattcctcttgttaggtcgccaaagttaaatgaattctttttagtttctatcttatttggcccctccagctgtacttgatactttgtccacacctttccttcttgaaacctccctctcttggctcctacaacaccatgctctcttttctcctaaatttatggccatttctcaatctcctttattggcttcttctcaactactaaatgttagaactactcaggactctgggcttttactatatactccatttcctaggcagtctcatacatgccctgggctttaaataccatctatctgatagtatctctaatatagatctgtcttctgagttccagaacttagcaattctattagatgtctcctgggtattgcaatactcagtaagttcatatctgacagagaccttctaaactgtttatcttttaacctttcctatttcactaaatggctcttccaccatccaactagttgcaaatgctaagaacctaccatattcaaatgttgccatgccttgtggtgttcatactacttaccaagatatgtcaaatcgatgtcctcctcttcatctgctgtcatctccccagtcaaagccctcttatcttgagcacactgtttcaatagcttcctaactagtttccttctatctttgctcccctccaattcactctccatacagcagccagaattattgtttaaaaatgtatactgggtcatgtcctgcccctaagatacggaaatggctctttcttgcatatgaaatccaaatgcggccttgcctgaatctaatcctgcctaggtctgcagcttcagcttgtgctactctagccattactcctatgtttccatcatgactgattctctttcagtttctcagattcaccaagctctttgcatgtgaattgggagtaaaatcgtccaaaaattaagaggttaggattaaatgattacatgcctttcctttgcttagaatgttgttccacactccccactttggcttcaagactttgttaacacagttctgtctactgagagtgtcctttccctcatctctgcctgatgaagttctattcatctttaggactgatcttaaatgtcatcttcataaagtcttcctggtcaaattttccctgtaagcatactgagttacttttttctccatatacctaaagataattttgcatatgtctctgttataacatttatcaccgtactgcaatcattttttaaatttctgccacattagaactgtacaatatgagatacgtgaatataggactgggccttctttagatccccaaatttagcaggtgcctaacatcatccaatctgtcacccattaatattgctttaagaataagagccatcttacatggcaacaaccactagtgaagattgtatttattaacttgttagtgtttgtcatcacggtgacatacacatattcagaaaaatgagtcaatattaataattaaagacgttactgtgatgaagtttcctgaaatctgagctcatctgtatacccatatccaatgacttgaatgtctcaatcaattcattggctagcacaattctcaagccttattagggaccataatttctatggttgacatcttaatgctgagtaggagccggaagctttgtggactctcaggttcatgcacctgaaagtcctgtgcttaagtgtgtgcatgatcttgctcagaagcaccaagaacaggggtgagaagagagaatgtagaacatccattgttatacaagaggcagtgacaacagagatggcctatttaacttacttcaaaagcctttaattctcaagcaccaggaaaacaattttagagctgactacaatagatcttttgctagactgttctgaagactagttttttagaaagtaaaaccatattaccagaatattaatccacaataaggttgaatacaatttgttaaagaacagactccatgtactattacaaaaatgaggtctgacctgaaacaccatccatttgaaatatttaaaaataaaaatagacaactctcttaaggaggttttttaaagcatcatctgatatctacgctatgataaaagtcagcatcaagtttaaagaagtgaaacaaaacactgtcaccatgcccctatgagctaaaactttgagaattataaatggcggatttaacaatgataacctttccattcttttgccagacgcgaaacaaattatgctagttcctcctctagaatttcttgctttttctgcctatgaccttctcagctcacccacaagcagcaccattcattgactgaactgttatttgacagtttgtcataatcaaatacggtaagcagagtatcacgatgttctagttcactttaaagcaaactatttaggactataaattccatctaggccttagatacacttcaaggcaaaggtagggatactgggcagagaaaacaccaagatttgacttttactccaacatgtacctaagtgtagactggaagtttgtattcaaaacattgggggagaaaagtttaatgttacctgtgtattcaacatataatatcctctgttttatccagataattcatcaaaatcagaggcatgcaaggaaggtgagaatcaggctgtgatttgcttacagatatgaaatcttgggagcaactcagtccagtgaagagacttttattgccccacaaactctaatattgggcagacttgggtttttactggttaggtgatgaaaagtccaaggtaattatcaggactaattagaattacaaaggacactgacacggggtcactgtaataaagttatactttatatttaccagcagtcttagacggctatgggtaaatgttctggctctgcggccccctgaaaagcaggattttcattccaacagaaaaaggaaaaaaactgattccaggtggaaccaatgttgcttccccacccttttttcagttcagagttgacaatcatgttataaaatgaaaaaggcaaatgcatgaacagattttagtgttgcataaaacaaaacttaccacaaaactaatgtggctttgttaatgatatgaataatagattctgggtaaatggtaattattcataattaatttcatttcaaaaacagccatagccaaaattatttttacacagtcaactcaaaatgtttccaaattctctaacatctataaattaaatcactcttgatgatttccactacaaccatgcaaggcttaatacttttacaacaaaggaatttagaatatgtcaccccaaaatacattactctggcatactgactattttgagtaaaaggtacttgaaaaacagcaactgcaagaactctctgacctttcttcttcataaaagcaggaaatgaaattcccgtgtgaaagacagcctccctctaccagaaggaaagcatcattcttatcatcaaggacgggaagctgagaccgaggaaaatctgtacaaacaaaccttgttaagctaacccttatcttcctcgttacttctctgcccaattacctactctgcccaagctcctctgccttgtcacagtttcacaatttactactctttcgccaaaagagtagtaaattcagtatataagttttcaattctaactgcatctgtgggtcttcatttccttacaaaggctccttgccatgtaaaattcataagaaataaatttctatgtttttctcctgttgatctatctatgtcaatctaattcttaggcctagctgaaataccccaaaaactggtaaaggtacaatttcacctcacctacaacacatacatatcctttaaaaacatctttctcaaccccaactccctagcagccatggtgcaccctcaatgtccgtgtttgagaattaagggttcctgagcttttctcctctgcaaatcccactcatgggtccttcaccaaatgtccattagcaattcattcagccatttcctatctcagtctccaccagaaagggccacccctgcagctctgaaatgcttgaggggcttgggaagctgaaattctgtggtataaggtttcaatggctagcctcgcataatcatcacacttggcggggggggggggggtgggcgggggggggccctaatgaaggcaagggagagggaagggaaaggacacagagaaaagccttcaggagtctgtttcagggcatctcagtcttggcactaatgaacgtttggtggggtcaggggtaattcttggttgtgaggggctgtcctgtgctttgtaggatgtttagcagcatccccagcgtctattcacaagatgccagtagctttccccaagtttggacaacccaaataaatcacccctggttgagaaccagcagtctactctagagtcttgagcatagagaggtataggaagaaaattaaacagaggaaagaacctgaattcagacagacccctgggctatgtgtagaagaagcaagtggctcttggtcacatgctgctctttgtgaacatgactcaatgtagcggaaatttgagagtgagcacaaggacaagaggaatggaagtcaggaaatgagaggaatctgtaaggaagaattccaacccaaatactctgcccctcactcacaaggtgatccctatgtatctactgaagagtactcaaactctttttcttaaggcgctggtttataaaggccatcaggaagcagactgagatttgggggtggggtggaagaaggggagttgggaggtagagaagggtttcccctacctaaactaagcttgggcttaagatccatcgagttcgcctcccgagcagagcaaagaactgaaacatgcgagagggttgctgtgaagcattttagccaacttttccaagccagatgcctggagttctcactgaggaagctggcagaacctagaaaaatccttattactccctcaaatttgcagagggacttcagatgactaaaactagctgcaggaaagaaaaaagacattttcttttctgcctagccatttataaagttttttaacttgcagaaaatcactgaagttctttcagtttcggagcctctaaaataaagtggaaatactataaacacatgtcacagagatgttctgaagattacatgagaccacagatgttaaagggcctagcacaaaggtggcataggtggctccctaccctctgtctctccttcatttttagttttctttgggctcatgcaccacatgcccacatctgtgccaccagagctttctctatctgctcttatacactatatttacgagcttctgtcgttatcttgttctgcgattttcctctctccctatgttcctgatgaggtggcagtggtacttgctgctaaatacatctaagtcctttcatcactggtgacaagagttcatgtgagaggtagcagtggagaagatgcaggaaaaagaatgccatagtgaggatgacatacttcatcactgttttacccttggcagctctcactccacctgcatgaagacatgaaaaaatctctttctgcgtgatagtgcaggtgtgtagtttagcaggaaacttgacaggcagttaaaagacaaagaagcggccgggtgcggtggctcacacctgcaatcccagcactttgggaggccaaggtggggcggatcatgaggtcaggagttagagaccagcctggccaacatggtgaaaccctgtctctactaaaaatacaaaaattagctgggtgtggcagtgggtgcctgtaatcccagtgactcgggaggctgaggcagcagaattgcttgagtccgggaggtggaggttgccgtgagccaagatcctgccactgcactccagcctgggtgacagagcaacactccgtctcggggggggggggggggcgggaaaggtgaagaagcatatcaggagttcagcttttgctaggtcagagaaagttcttaacagactaactcttttgcagataataaactgtggacaaaacacaaaaaccaactactgaagtctctaaagaatgaacaaaaacacattcttccccctccacaagaaaacatttacaatgtctgggatgtaatccaaaattacttgacatatgaagaatctggaaaatgcaatccacccccaatggaaaagacaatcaacagaagccaaccttgatacgacccagatatcagaaataacaagactttaaagcagctataattactgctgaggtaagagaagacatgctcattatggatgaaaagaatgggaaatctcagcagagaaactagaaatataacaacaacaaaaacaaataggagctttaaaacttgaaaaattcaatatctgaaataaaaagcttactggataggcttaatagcagaatgaagatgacaaaaaattgattggaaaaaggtcagtgaaaattacccaatctgaagaggagagagaaaaaaatttaaaaagaaagtgtttcaggaccctctgaagtcccagaaggtggggaatgagagaaagtggtgggaaaaaacatcagcataaattatagctaaaaacagtcctaaatttggcaagagataaatttataaattcaagaagctcatgaactgtaaagaagattaaaaacaacatcaatcacaaaaataaatgcctaggttgatagaaaccaaaaataaaaaagttgtgaaaggagacagagagaaaaaaacatatacagggcaacaattggaatcatcggacttctctttagaaaatatgaagtccagaagacacctggaacaatattttaaactttctgagataggagaagcacacttcactttaaatataaaggcacagacaggttaaagtaaatggatgtaaaaagagcatgcaaacagtgaatgattatcgtactaatattggagggggaagcatatcacctgcctagctgccacagtatgatttcaaaaaaaacaagaacattcaccaagaacaaacaaaaaaacctcttcaaatagaccatggaactgaattcaaacttgtatctgataacagcgatgacaatatctctctataacaatcctgaccagcatatatcacaattactacagaggctactgacaagaaatccaaccttggtatgctgtacacgactgtcctcccaccctcccagtgaaatcaaacaaaattaataatagtctactacatcagagggactccatttgggggaaagtttcaggctatgctcttgcctcaaaattggtggggaaaacacatagacatatacatacacacaaagcaaatacagcaaaatgttcaaaattgttgaatctaagtagtaaatgttaagtgtttattgtactatttttcagctttttgaatatattaaaattttttatactgaaaaaagagaaaaattagccagaagagctttattcaaaataccttcccctctctttccttcacattttgatatattcttgttggggaggtgtatcaggatattaactgtatcttttgatacgaaaaaaagtcacatgattctggtatatttcaaccactgctagaaaatccacatggataaatgctagaatgagggctaggactttttctagtttgtccattactgcatctagtatattttcaaggaaaaaatgttcaatgaataaatgaaaaatagctaccctagatgtttaataaaaaagacatctgcacttgtatgtttactgtggcacaattcacagtcgcaaagatatggaattaacctaagtgctcatctacagatgagtggataaagaaaatgtgttatatctatatcatggaatactactcagccataaaaagtaacatcttttgtagcaacttggatggaactggaggccattatcctaagtgaagtaactcaggaaaggaaaaccaaatactgcatgtttttacttataagtgggagctaagctacggatatgcaaaggcatgcagagtggtataatggacattggagactcagaatggggatgtgggactgaaaaaatcacctactgggtacactattcgggtgatgggtacactagcagcccagcttcactattatacaacttgcccatgcaaccaaaaaccactagtatccctaaagctattgaaaaaaaaaaaaaaaacttagtaagcctcctagactttataatctcaagacacgactttttaacataaattctgaacattatctggaaaaactgttgactggaatacgtttgtttggtattttttcaaggatagaatgatgttttgataatcagacttctcctttacttgtcacttagtaaccttctatactaaaaaaatttagtcattgaagtgtaacatgtattcaactgaagctagttgaattctcacgtttctcacactccccttgagctggcatcaaagattaacttaaaaggtcatgaaggaattcaaattcaaggaattcaaatttccagcatgcccatcttgacactttgaaataaatataaacacatcctgatgtcacttcattacagcattcccttcccaaggagctctaaaaagaaaataacctgcaggtgaatttttgacatgcaagtcttgaagataaaacaatatagcattcttccagatcagttatatgctttaaaagcattatttctccctgaataaaaatgaatccaaaggctgtgattcctaagaacaactgaagttaaagctaaatgttctcaaaacaattttacatagctcattctaaatgttctttaccaacttttaaataagaatgacaaataagagacagtcaaatgtttttatggatcttctgaataaactacgtaaagataaaaaatacatgtaagtataaaatacaatttgtaaatgagggccgggattagcaatgccaggatggataaagacatgttttctcgcatttaggtaactttgtcccctatgagatgaccctcagaagttgtctcgacgtttgctcagcagtgatttgattcaatgaccaatattcaaacagcactcccttagagactctacgcatgacctctgactgcttggtgcctaactctccacatatgtcaaacagagggaagaataattgctagctacctcccagcaattctagaagatttaatgaggcagggagccagacctccatggtgagtcaattattccctgggtagaagttatgttatttgtgaggtgccgtatttctaaggataacagagtattgtacaagcattacaaataggtatttctcgattcctcaaagtgttgacattaaatctttcagaataatatactcacctagtaacaaatagtctaatattttataaaacagtttgaatttgatggaatgaaagcatacggattttataatgttgtttcttttctgattattagtgagagagaacaatcttttaggacaaatgggtttaaaggaatagacagataagggagaagctctctaactgaatccagacctattaaaatggcgaccaggtaccatgacctatgtatttcattgagctggggccaagtccagagtccactaatttcagcttgctcaagtcaaggctaggatgctgccgtgatagaaaagatatggaactgctgaagaaatgtaattcaattcttataaagaaatggggcccaatattaacttacatgattaatataacacacataaataaaggcagtaacaaacacttaattttggattagtgatgtcacaggatctttaaatagttcatacaggatggtcatgctctcataagttaaaatggagaaaattgattttttacaccagattagccacacaatattaatcatataaaatgtttccctgaaagtcttggcataaaaatgggccaatgtgctctgttttgcctttttccccaaagtaaatttagatgggggtgaggagggaaaactttagaaagcaatcacaaatttcaaaatcaataaattcaaattgtttttaaggcagtaaatacatagtcctgccaaatgctgcaggaaattgatgtacaatctgtctggcagttggaccatgtgaaaaaattttaaaaagaccttaaaataaccaagattctgaaggctcaacaaactttgttttagtaagacaattttcctggtccataaaaaagataaggaagtaaaaggtgggataaccaatttaacttagggtgtggtgaattatcttgggtatcttaaattggtacttaatttggtctgggctcagaagaaatggtttaccatggtgattaagaccagctgctaggtgtcatagatttaaattatacaacagaacacaggagtgtgtttgaacacagacgggtaggacagtctccaaaaagctaagagtgccacctctgttcagtgaaaattaagtcagttttttactaccctttaagagctgcctccactgatttggccttgaacatagactgaatgagaagatttagtttcccaacacatgtgccaccatgacttaaagacttaatactaagtctttaagtattaaagacttaatactaagtccactaagtagacttagactaaagtccactttagtctaagtcccacaatttttcagaaagaccaggaggccatttaaacaaagaaaataatttctttcctacaaaaatcaggggaaatactaacctttgtcattcaaaatagttttagtttgataccaaagtatccttattaacactttgagcagggacaccaacatattttattttattgttcacttagaagttataaaagtagtctacattaaatgaaaaaattcaaacaataccaatataaaaatgtactaaatagtgtaagttcacttttgactctgaacccccagctaccaaactcaccagggaaaactactgtgatttgttgaagtgaagggagcgaagagtccacattaaattagaatataacagtacaagtttatggactttttacatcaatatatgtactttcaatgtgactaaacgatttcaccatttactatgctttttctttttcaaagtaactataaagacaggtacctttggggaagaaaaaagaaaagaaaaaaagtaaatataaagaaaacactggaactagattttcaatggtgcagttaataaggattagaaaatactatatataatagaaaatataagatttaaaattttaagatcttcttgttatgacaaataatatctatatgcataatacacatatgtacatgtgtatacatacatatacacaaactacatattacagcatacaaaatactgagtaacacaatgaatatgatctttttggatattcttgaaaaaagtaaacttcatcatttgatttatctagaagaattttattggccgggtacggtggctcacgcctgtaatctcagcactttgggaggctgaggtgggccgatcacctgagatcaggagttcaagatcagcctagccaacatggtgaaaccccatctctactaaaaatacaaaaaattagccaggcgtggtggcacacacctataatcccagccacttgggaggctgaggcaggagaatcacttgaacccaggaggcagaggttgcagtgagccgagattgtgccattgcactccagcctgggcaaaatgagggaaactgcgtctcaaaaaaaaaaaatgtatttataaatctaatgctttagtggcagaccaggagacaacccacatacaagtggtcaatttgaattttatctagaaccattactgttgccctgaaagccagattcactttagtcagctaaattttatggagtgtgttttataaacaaagcattgtatgaagctctagaaaatagtcagcagaagacagtccttcttctcaaaggctttccaacacattatcaagaacatacacagtcacaagcaattacaatttgaaagtagcacacagataaagaaattaattaccactggtggggctggagaccgtttaacagaacagataggtttaagctgggtaagatttcaactagcaacacaggaatgaagggtgcttgaaaacagcacagaaaggcacaaggaaatagtacagacaattgtacaagtaaagacaaagaagtaggaggctgccatgtacatgtgaaggataatgaagtggcagggcaagactagagttcgggggcacagagaaggcaggaatagaagatgagcctggagaagtagatgggggcagattttggagcctattagctataaaccaaaaaatttagcatttatattacagaagtagggggccatgaaagtctcaaagtgaatgacatgatcagaataatgatgcatgagttaaaatggaaaagaacagttaggcagagtacgacccatgacaaagctccaaagaagaggtaatgttgcgtagattaaggacagtagcaatgaaaactggataaaggaaacagaccgaaagacacattctgaaggcaagttgacataaggaaaagatcttaggccccaggctaaagatttgaattctggctcctccaactatttgccttttggcgttgggcatgtttcttagctcctttaacatatagtttccttatctataaaacaggaataatgcacttgcctgtgtgtgggggaaaaaaaactgtgagaaaaatacagaaagttgtctagataattcatgtcaacacacttatttattcaacatcatataatgataaaaagaataaaacgtagccccaatctggttggggaaacagacatacaaacaactaaagtgacaatgatctgatgtaactggacctatattaggagtaagatccaacagaaacacagaggataaggtgtgtgtaaagccactaaagaccgtgtaaaagtgctgaaaaggttcaatgaagttccacagaggtgatgtgtgaaccaggctactcacaacttttaatgtttcttattttcacatcaaatcaccaggtccttcaccacataaattatagtacacaaccccctaggacccagtggtatcatttgaattctggagtgtgaaagtccaaaggaaatggtggaggaaaaaaggggaggtgaggggagaggaagaaagattagaggagtatgaatgaattttaggcaaataacttctcaggaaacaatacttgaaagaaagccagataatacttagattctcagtgtgatacaatattaaggcagcaaaactcaaatgaaagaatgtaatgagttccaggtgtcgtttagtagatttttttcagtaggtgaagttgagttgaggtggctactgtcagtgtcaatgccctgtctgaacaagttttaatttaacttcaagcaatacataggcttttgtttagactgtttgcatatatttgtctactgctgctaagaggcaaaataacctctttctcgagaaagtgagataaaactatgattgcaaaaatgtttattttttaatcttttcatgaatcaagtaattttatctaatttattcaacaaatatttattgaatagttactgtgcataaggcccagtggggaatatgagagaatataatatgatatagattttatcaccaagaaggtctgagtctcataagttcactataaagtagaaggtaataaattcaatgagaagtatacagataaagtgccacacagtataaaggaaggagattactttgagctgggaggataaggatttggcactggcactaggacagaggggactatgttgtgttactcatgcaacaaacatttactgagcacatacaatgtgcatgcacttacctaaatgcaatgagactttgaggtgatttagtccaattccttcacttaattcactagaaaatgaaaactcggaaacctaaatagctaattcaaggccaagatacaatttgaattgatatctccagtctgcaagtccaataatttctactacttaccctgtcacctccaaaactcagtctaaattttttgtcaggtacaatcattatttcaaaaggcattccattccacttataaattaatttgttataaaatgtgttttctaacatttagttaaaagttgccttcatttttaactaaaaatgaagtggctctagtggctccccctgtagttacacagaacaaatagaatcctgtggccatgtgatcatccttcacatatatgaagacaatcctcacgtcccccactctagtaggcactcagtaatcactatagttggggaataagctccggaattagatgggcctggatgtgaatctcagcttcaacattcacttggtgtgtgatcatgagccaagttacttaatttagataatctgtgtgtttatttagacaatgggaatgtttatgtccttcatgccttccattcaacgtaatggccaataactatgatcaagaattggcacaacttttggtgtaactgtcagaacactagagtttctctatacacattaagctggcactgaatcataagaggaaaagttgcaaaactgaaaaagatggcagcacctgtctttctctcccacttctcttcctctctggcataactagtctgtgagtgacagctgtgaaatactaaagactgggcgacatggcttttccagataacctgtgaagaatggtgaagcatggcttcatcaaatgacctgtgctaatagagctgctggcaaaagtgcagtcattttattgagataaaacattgaaaataattttcataaaataaggcacagatgctttaattagaaaaaaatgtccttgagggtgggattcagatgcagttttataacttgtacggtgccttaaatgcattaaaagatagacaatggtacaaggactattctccctagtggtaacaaaactgtttcctagttactagggtagggtagggaggaaatgaaaggaagaagagaaaatctagagtttattcttttcctgcttctaatgttataagccaatgctaatgtttagtagtcacaacctcgtctgctaggcactgcaactaatttcccgtatttgggtagaaaaaaatgcatcatgtctcaaagaatgaactactgacagaaatttagtgactgatactaaaggtagatacgtagctgcagggtatgagaaagaggagacacagtcctaaaaataacagcaaaactaagatgaaaatgcagagaagtggtatggtacattggtagctatcccctaatatctattctacctttcttccatagaaatatcgttttagccaggcatacagtcattcggaataaaagcaacactttcggtctctattgcaactacatgtagccctatgaccaagtactgacccgcattatatggacgtttctgggcacctttctcaaaagatggctggggcatgcccatttcacccctttctccaaccagctgcctgaagtggagatgcctccacctttgaccatgaaactgagagcctcaccctaggcatggtgagtggtgagctggaaggagtggggctctcgatgcagaaactgatttttccatttttgttaaacaatgctgtcaaaaaggccctaaaaactatcttttgcacatatctatttccttagattacattcctagaagtgagtgagaggatatgaaaacataatctgtcatggaactagagttaaaaaaaaaaagaatatgaaaacattctaaagctcccaacacatatggtgaaattgttcttctgaaagtttaaatttacatgttctctacatgccttcccagcccaatgtcaggagttaattttatcattaattggtaagagctctcttatattaagggtgtgaataccatgttataaatacctcttcccaattaatttacctttcaatttagttactatttttgttgttgtgcagtaacttaaaatctttatgtaataaacctttttaaaaagtggtttctgcccttactattatatagtaaaaagtcttcccacgtatcaagattatgtacatatccacctatattttttctattacctttttgctttcacttaacctttaatccacatgaaatttatttttccacacatttagccgattgtaccaacaccaagattccacacattcaataatagatgctattgaatataactattcctaataactgaaaattccacttttatttattctgatatcttgaattagtattattagactgttttaattattgtggctttagaaaaaaattttatactcacttatgcaattaattcacattatttcttttttttacaaaagtgtgtttggtttacacctctaagtgaactttagaaacacattgtcaggtttggcaaaaagaaaaaaacacctgaaattttaactggaattgtattaatgatcaatagagagcaattggggtagggaatgcataactttaaaacattaactctccccattattcccacaaatatgagatgtttccccatttcttaaactgtttttatgtcccttatgttctatagtttatttcttatagttagtcgtagagtttacttgcttaaacttgaggcaagtttccttagttacagatcttttatttatatttgtgctattataagtaggatctttaaacacatacttgtctgtgctggtatagaggaaacactaatttctgaatttattttgtaattgaccatcatcttactggtatgtttttaataatgctcataagtgttagttgattatcttgggttttctagttagataactgtattttcaatttcaaataatgatgacacttctcacttcctttgcaatatttaaacttcattttcttgtcttattgcattagacaaaactttcaaaacaatattaaataatagaggtaatagctgacactcttttttccacccctgactttacttcttaggacattttcctattttaacccataaaacagctgcatcgtatcagtctttcatctgtttttacactggtcccaacccccaatccctaactatactgtaagttccttgaaggcaaaaactgtgttttgctaattttttaaatcactgtagcatccagcacagtgtctggcacagagaaaataaatcattaaacggatggttctcaaaactggtgagtcactggaattacatgggagcctttgaaaaaaaccaactgcaagtttcacaaaccatttacaagtcagaaattccctgttcgtgggggtgcgaatctagacgtgtcaaaagcttcttagatgatttctgacggcccacaggtttgagaaccactagtctagtatttttatcactcccggagattctgtttcagagtcaggggcctgatttttagtaaatcttcctgagatgattcagatagaagcaggtttggaaactactgggttagacagtaattcaaagaagggatcagagttttatttttttcctttatgttgtctgtatatttttcacatacaaaagtggaaaagatagcaagatatataaagaaaaggccaatctctcctacctctatcttctaaaagtagccatttattactgtgtagtggcatccttccatccctcttttcttgcttacacaaaataaacacgagagagagagagagagagagagagagagagagagagacagagagagagagagaagtactctttctgtttttattaaaacaatcagacacttattttgtaatttggtagtatttaaaaaaatgttatttcaaataaatgatgatgaaaccaatatctgttctcttgtctatatagatttaaatttagcgatgagtataaaaacattttcatttcatttttaattctttagcaggtataggaacaatttgggaagattcacctaggaaattttttttttttttgcgggggtggggcagggacgaagtctcactctgtagcccaagttagagtgcagtggcacgatctcagctcactgcaacctccacctcccgggttcaagcaattctcctgcctcagcctcctgagtagctggaattacaagcgtgtgccactgcacccggctaatttttatagtagagatggggtttcaccatgttggccaggctggtcttgaacgcccaacctcatcacctaggaaattctaaaactatcagttaatatactaaaggatatgggttcataggtcaaacagcatcttaaaaaccaggaggacagtattaatacaggaaggctaaaaatggcatataaagccttcttttctatacttataataaagtaattaaaagctacaaaaagaaaaccttttatgttacttatgcttagctattactcattttttagataaaagatatttttaatacaaaagcaaaactaaggcacaactgatctccacttacatgctttaacaaaacataaaaggcagcactcaaatgtacaccagaaataaaaattctaaaatagaactactaataaaaggaatgtaaattactggctaagacagaaacatcatattttagaagactaagccatgattttggtgaaatcagtacatcattcgtttgttattattaaattttcataaagcatctccaaaaagctcaatgacacacactaataattgttaaataatgcaaatgaatacttctaaattctccagtactgtaaattagcagacagtgtgggagttgcagagaacaatgagagagagaagtaaaaacaaagcaagcagtaatatgatatcttaaattaagttgcaatttctgatttactccaaaaggatctttctgggcaggcaggatttaaagagttttaagaaatgatgtctttctgcctgtcaggagtgtgttagaagtatatttaattctgtgaagttggaataggaaagagaacatgggggagaactaagttaatctagaagaggtgtgaaattggagaaaggcctaaaaatcaaatgcaaatatgctgaagatagtaataattttaaaaaggaaatagtttaaagaaagggaacaacattcagtgtggtaaagaagtggtattaaaaatagtgttttgtatttttttttggcaggaatggaatggattttatggttagataaatcaagaagacctacaatggcagttaagatttgaaattgctagatatttggcaagagaactgataaaaagagaggggagtaattatcaggtgtcacccacaccctgaaggctgcacccactcttatcctctaattcctttgacccagagtaacacttctccctcttcctgtccagatgtggtttctctactagtgctctaggtcccatcccctcctctttccttaggaacttcattccattgactatcttcagtcaatcctccaattcctgccattagctctttcagcatataaaaatcatcaagtatgccaggcatggtggctcacacctgtaatcccagcactttgggaggccaaggcgggaggattgcctgagcccaggagtttgagaccggcctgggtaacatagtgagacccaactctacatttttttttttttaatttgccaggcatggtagtgtgcacctgtagtcccagctacttgggaggatgaggcaggagaattgcttgagcccaggaggtcgaagctgcagtgaactgtgtctgtgccactgcatttccatcctgggcaatagagcaagaccctgtctcaaaaaaaaaaaaaaaaatcatcaagcgtttcatatctaaaagcaatataaaataaaataaaaagtttctttaatcttatgttctcctttaactattatatctcttcttttcacaagcaacttctaggaagaagtctacttcttccctccttgattcacttcccgctctgaagcagtctggctttaggcgtcaccatctcatggaggctgcttcacttaaaagcaacattgatctccttaacaccttatccaatcttcgggttttagctctcctatgattcgatcttgctgaagctttttacacattcatttcctctttcttgaaatgttctcctccctcagtatctaagatgtcacattcctttctctgttgttgctccacagggacccatctcagtctaatattattctccctctatactgatgacttgaactataccaattaaaagatgactcacaatccagaaatctctagcccagatctctgtggaactccaattctggttatgtctaagaagcatctctttctgaatgtctgatggtacttatataaccaaaatgaattcatcatattccaccttaaaaagtcactattccttaaattgaatggatccaccaacccctcttctctccttcacctagttattcaggtaatctgggacttatctgagatcttccttttctcttacttcccagatctaatcactaaggactagagattctctcaaaactgtcccctaatatcaatttcattgcttttgttcatttctcatttggactatgtcatattgcaacaatccccttaatgatttctctacttccaatctcaattttttgcaattctgtttcaagaggtcagcttgctgtaatttttcaatggctttcagttatccataagcccaactcccaacctccttgtaaggtataaacgctgctgcctactctccagcctcatttctaccactttccaactcaatttcatgctctagcaacactgaacatgctttcttatggctagtccttctgtaaatactgcagcaccattttttccacttgtctatctggtacattcttactcattcttaggtatctgtttaaatgctaacttctctaacagcatcccttttctctcaggtgaactttggtgttccttatatattcctaactgtagttttgaagactcttccattaaacaatgatcttattgcattataattgtttgcatgggcatcttaacttcttaactggcttagattagggaattaaaatagacattggctgggcacagtggctcacacctgtaatcccagcactttgggaggctaaggtgggtggatcacttaagaccaggagttcaaggctgcagtgagctataatggtgccactgcacactagtctaggtgacagagtgagaccctgtctcaaaaaaaaaaaaaaaaaaaaaaaaaagagagagagagattatgaaaacatttactgggagacctaacccattttttgcttcaggaaaccaatcttaaacagtgccaagaaaggcaagccaaagacagtggatgaagacagtggtggtgatgctggaaaagcccaggcaaactgaagcacagctactgtggaagagagaacagcaggaaaaaactggagagacaccaggagcccaactgtgaagggactgctaagagaaggttcagctttgtgcttccagtcactgattcaaactttcttcatgaatccaaccactaaattaaacaccagctttctaaaagctgcacattctcatactataaaagaaaatatatttcaaataaaatactttccaggctttccagaagaaaaaatccatcccatgtcacccactgtgactaagcacggaggaaacagattaaattagggatattttgcccgtacatctccaggctgcatgaaatgaaaacaaatgagagtcaggactctcaaaagtttcacagttctaaccatcaacgcaatgtgccaagcaacatagtaaatgttcacgtttcaaacaggaggaatacattttaccttttctatctgggatagaagattagattctaatcttttttggttttccactcagatgagcaccttaagtgggatcatatttctatattacaggtacttttttttttcctgaaagtctgtgaatacttaattcaaaggccatggacagcaacctagaggagctctgaccatgaaaaatgttttataaatagttccatgtgcactgttcatctggagtctcactagagatggataatgaccttgtattttgtactcatttactctgaattagccaaaccttctgtttttaattacatacttaattcacctagcatggtctaattacataaaacaaaacatcatttaaacaaaaggtggccttgaacttaatctatcaaaacaccagttagtttttaaagtttttagttcttaacaaactgccaagacatgcaatagcaattttccaaatgtgatcatatgcttttatagcaacagatttactacataatcaaacatctgtatatacttttgtctcactattaatgcaaatatgcttaagttttgatagacttaaaaatcttaaagctgaagttcatactacacaataatttttaaatatccatagtcattttggccttgaaatgacaagttatcataaccatggctacttatttacaaaatggtccagaactttgtaaaaactcatgttcagaattttccttaattcttcacagtgtaaattagtagcccttctctgtgttatcatagcaccttatatattttcaatcacagtatttataatgctgaatagttattggtttaaagatctgacccccaactagattgcaaacttcatgaaagcagagtttatgccttttatctctatcttgccaacatggagcacagtgcctagcacagagcaggtcctcaatatatatttgctgaattaatgtattaaaatacaatgttgtaaaactatctcaatttatgaatatgatcttatatgtagaaaatcataaggaattcaccaaaaaattattagaactaataaacaagttccaaaaggttgcaggatacaagatcaatatataaatatcaattgtatttctatgcagcagcaatgagcaaacaaaaatgaaattaagaaaaccaattccatttacaatcaaaaccgttaaaatattttgtaataaatttaacaaaagaaatatacaacctatactctgaaaaccataatcctcaaattgatctacagaatctagagatccaatgcaatccctatggaatcccagctgacttctttgcagaaattgacaagctaaacctaaaattcatatggaaattaaaggaattcaaaatagtaaaagcatataatggaatcctattcggccttaaaaaaggaacaaaatttgtcacactacaatattgatgaaccttgaggatattatgctaagtagaataaaccagtcacaaaagataatactgtattactccatttatatgaggtatctaaaatggttaaattcatagaaacagaaagtataatggtggttgccaggggctgatgggaaaggggagctgttatttagtgggtttaaagtttcagatttgtaagatgaaaaagttctggagatctgtctcataacaatgtgaatatacttactatttaactgtacacttaaaaatgatgaaaatggcaaattttatggttttttttaaccaaaataaaaaaaatttttaaagccaaaacagtcttgaaaaagaacaaagttggtggacacacacttttcaacttcaaaacttactacggagctacagcaatcaagacagtgtggtagtggcatgaagatagacatatagatcagtggaacacaattgagggtccaaaaataaatcttcatatttagagtcaattgattttctagcagggtaccaagataactcaatgagggaaagaataatcttcaacaaatggtgttggaacaactgaatattgacatgcaacagaacaaagttacttctatctaacaccatatacaaatattaactcaaaatagatcaaagacctatatgtaacagctaaaactataagactcttggacgaacatgtaagtgtaaagctttgtgacctggagctacacaataattttcttagctatgataccaaaagcactagtaaaaaaaaagaaaaaaggaaactggactttatcaaaatttaaaaatgtgcttcaaaggacaccatcaagacagtgaaaatacagcccacagaatgggagaaaatagttgcaaataaaatatctgataaggaacttgtatgtagagtatatacagagctcttacaactcaataataaaaagactaataaccaatttaaaaatgagcaaagggtctgaatagacatttctccaaagacaatgtgcaaatggacaataagcacacaaaaagatgctcaacatcatcagctattaggtaaatgcaaatcaaaaccagaacgagataccacttcatactcactaggatgactataatcaagaagatagacaatagcaagtgttgcgaggatgtagagaaattggaaccctcatacactgctgacaggaatgtaaaatggtgcagtcactttgaaaaacaacctgacagttcctcaacagagcatttccatattattcagcaattcttctcctaggtatactcaagaaaaaggaaaacgatgtccacacaaaaacttgtacaaaattgttcacaacagcattattcataatagtgaaaggaataaagtgttatctgcacttcatccttacacggcctcatagtattccatattatgtatgaacacaccacattttgtttatctgttcatcaattgatggatatctgggttgtttctacctttttttttttaaaagctattatgaataatgctgcaaacttttctgtctttaaatcctgacatgaagatctgggctgaggcaggggtagaggggtagagaaaatgcctatcatcaagttcttccctatgtctatggcctagatggggtgggtgtcggatggtgctgaggcaggaagaggagaggagaactctcagtaagttgctaatgagaagagatcccagaagctagttcctgtgttccattctgcagtaacatgtcctctctaccatgagtgatacaataggagaatgggtgaacactcccactgtggtagatcctaagcaaagcatgacatggccctgccctccaagaaattttgtccataagataagtcactatttcatgttactgtaataatttttgtcattatctggagcaaaaaggaggatcttttgcaacaaaagagtttatgaacctaaattgctcttgtcaagatcaccaatgacctccttgttgctaaatatccaatagtaaattataagtcctcatctttcttgggcattaacaaaatctgaaccagctgatccctctttttagaacactttcttctcttggcttccagaatatcacactctactagttattttcctacttcgctgatttgttccttatctgtcccctttgctgattcctcgtcttctccccaatctctcaatgttagagtgccctggggatcagtccttaaaccatgcagtgagctgaataatggtcccttgagataccatgtcctaatccctagaatctctgaatgttacctcatatggcaaagactttgcaaatgtgattaaattaagtctcttatgatcctaagaatggggagataattctgaataacttggatgggccctaaatgcaatcataaatgttcttttaagagggcaggataggaattcaaacagaaaaagacaaccttggaagcagaatcagagggaaaagatgctacactgctggctttgaaaatggagaaaagggctatgaaccaaggaatgcaaggaatacagatctagatactaaaaagggcaagaaactctagattctcccttaacagtctccagagcaagtgtggccctgctgaaaccctgatttagccccataagacttagtttggatttctggtccacataactataaaagaataaatttctgttgttttaagccaccaagtaagtctgtcataatttgttatagcagccataggaaactaatacagattttggagcctggaagtggggtggtacaaaaacaaaaacctaaaactatgaaagtggctttggacttgacagtaggcagaggctagaaggagtgggaggtgcatgatagaaaatactcagattgcctaaaacagatttttggtagaaatttgaacattaaaggcactgctggtaacagctcagaagaaagtgaggagcatggtagagaaatcctaattcatcttggagaacacatatatcatcataagcagaatgttggtagaaatataaacacagtaaagatggtactggtgagggctcagaaggagatgagcaacattttattagaaactgtaggaaaggagatttgtcatatagtggcagaaagcttagctgatgtgtgtcctacaattatatacaatgatgaacttagatttagatgatttggatgagatcttggacttttgagctgattatatttaggtgagattttgggttgaaactgaaatgggttgaggcttctggagatactgggatggggtgaatattttgcatgtgagatagatgtaaatccttggagacaagagggcagactgtggtaagctcctcaagatattcatgccctgatgcctggaacctgaaaatgctacctcatatggcaaagactttgcaagtgtgattaacttaagcatcttgagatatggagattatcttggattatctcagtgggccctcaatacagtcacaagtgtccttagaagaggggaggcagagaggttttacacaaaagaaaaaggtcatgtgaccaaaaaaaaagaaaacaaaaagaaacagataagagagaaaagatgctatatcactggctttgaaaatggaaaaagaaggctggtgtggtggcttttacctgtaatcccagcactttgggaggccgaggcaggtggatcatccgaggtcaggggtttgagaccagcctggccaacttggtgaaaccccatctctactattttttttatactttaagttctagggtacatgtgcacaacgtgcaggtttgttacataggtatacatgtgccatgttggtttgctgctcccattaacttgtcatttacattaggtatttctcctaatgctatctctacccctgccccctaccccatgacaggcccccatgtgtgatgttccccgccctgtgtccaagtgttctcactgttcaattccaacctatggtggtttttgttgccactgcttttggtgctttagtcataacctatgagtgagaacatgtggtgtttgattttccgtccttgtgacagtttgctcagaatgatggtttccagcttcatccatgtccctacaaaggacatgaactcatcccttttttatggctgcatagtattccatggtgtatacgtgccacatctttgtaatccagtctatcagtgatggacgtttgggttggttccaagcttttgctattgtgaatagtgccacaataaacatacgtgtacatgtgtctttatagtagcatgatttataatcctttgggtatatatccagtaatgggatctctgggtcaaatggtatttctagttctagatccttgaggaatcgccacactgtcttccacaatggttgaactagtttacactcccagcaacagtgtaaaagcgttcctatttctctacatcctctccagcatctgttgtttcctgactttttaatgatcgccattctaaccggcatgagatggtatctcattgtggctttgatttgcgtttctctaatgaccagcaatgatgagtattttttcatgtgtctgctggctgcataaatgtcttcttttgagaagtgtctgttcatatcctttgcccactttttgatggttttttttttcttgtcaatttgtttaagttctttgcagattctgggtatcagccctttgtcagatgggtagattgtaaaaattttcttccactctgtagattgcctgttcactctgatagtattttcttttgctgtgcagaagctctttaatttaattagatcccatttgtctattttggtttttgttgccattgcttttggtgttttagtcataaagttcttgcccatgcctatgtcctgaatggtattgcctaggttttcttctagggtttttatggttttaggtctaacatttaagtctttaatccatcttgaattaacttttgtataaggtgtaaggaagggatccagtttcagctttctacatatggctagccagttttcctagcaccatttattaaatagggaatcctttcccgatttcttgttttcatcaggtttgccaaagatcagatggttgtagatgtgtgttgttatttctgaggcctctgttctgttccattggtctatttctctgttttggtactggtaccatgctgtttcagttactgtagccttgtagtatagtttgaagtcaggtagcgtgatgcctccagctttgttctttttgcttaggattgtattgcctatgcaggcttttttttggttccatatgaaccttaaggtagttttttccaattctgtgaagaaaggcattggtagcttgacggcgatggcattgaatctataaattactttgagcagtatggccattttcacaatattgatgcctcctatccatgagcaaggaatgttcttccatttgtttgtgtcctcttttatttcgttgagcagtggtttgtaattctccttgaaaaggtccttcatatcccttgtaagttggattcctaggtattttattctcttagtagcaattgtgaatgggagttcactcatgatttggctctctgtttgtctgttattggtgtataggaatgcttgtgatttttgcacattgattttgtatcctgagattttgctgaagttgcttatcagcttaaggagattttgggctgagacaatggggttttctaaatatacaatcatgtcgtctgcaaacagggacaatttgacttcctcttttcctacttgaataccctttatttctttctcttgcctgattgccctgaccagaacttccaacactatgttgaataggagtggtaagagagggcatccctgtcttgtgcaagttttcaaagggaatgcttccagtttttgcccattcagtatgatattggctgtaggtttgtcataaatagcttattattttgagatacgtcccatcaatacctagtttattgagagtttttagcatgaagcgctgttgaactttgtcaaacgccttttctgcatctattgagataatcatgtggtttttgtcattgattctgtttatatactggattacgtttattgatttgcatatgttgaaccagccttgcatcccagggatgaagctgacttgatcatggtggataagctttttgatgtgttgctggattcggtttcccagtattttattgagaattttcgcattgatgttcataaggaatattggtctaaaattctctttttttgtgtgtctctgccaggctttggtatcaggatgatgctggcctcataaaattagttacggagaattccctctttttctattgattacaatagtttcagaaggaatggtaccagctcttctttgtacctctggtagaattaggctgtgaatctgtctggtcctggactttttttggttggtaggctattaattattgcctcaatttcagagcgtgttattggtctattcagagattcaacttcttcctggttttttggtcttgggagcatgtatgtgtccagtaatttatccatttcttctagattttctagtttgtttgcgtagaggtgtttatagtattctctgatggtagtttgtatttctatgggatcggtggtgatatctcctttatcatttttttactgagtctatttgtttcttctttttcttctttactagtcttgctagcagtctattttattgatcttttcagaaaaaccagcttggggattcactgattttttgaagggttttttgtgtctctatctccttcagttctgctctcatcttagttatttcttgccttctgctagcttttgaatttgtttgctcttgcttctctagttcttttaattgtgatgttagggtgttgattttagatcgttcctgctttctcttgtgggcatttagtgctataaatttccctctacaaactgctttaaatgtgccccagagaatctggtacgttgtgtctttgttctcattggtttcaaagaacatctttatttctgccttcatttcgttatgtacccagtactcattcaggagcaggttgttccgtttctgtgtagttgtgcagttttgagtgagtttcttaatcctgagttctagtctgattgcactgtggtctgagagacagtttgttgtgatttctgttcttttacatttgctgaggaatggtttacttccaactatgtggtcaattttggaataagtgtgatgtggtgctgagaagaatgtatattctgttgatttgggatggagagttctgtagatgtctattaggtctgcttggtgcagagctgagttcaagtcctggatatcctgtcttgttgatctaatattgacagtggggtgctaaagtctcccattattactgtgtgggagtctaagtctctttgtaggtctctaaggacttgctttatgaatctaggtgcccctgcattgggtggtacatacatatttaggatagttagctcttcttgttgaattgatccctttaccattatgtaatggccttctttgtctcttttgatctttgttggtttaaagtctgttttatcagagactaggattgcaacccctgcttttttttgctttccatttgcttggtagatcttcctccatccttttattttgagcctatgtgtgtctctgcatgtgagatgggtctcctgaatacagcacattgatgggtcttgacgctttatccaatttgctagtctgtgtcttttaattggggcatttagcccatttacatttaaggttactattgttacgtgtgaatttgatcctgtcattatgatgttagctggtcattttgcccgttagttgatgcagtttcttcctagcattgacagtctttacaatttggcatgtttttgcagtggctggtaccagttgttcctttccatgtttagtgctttctttaggagctcttgtaaggcaggcctggtggtgacaaaatctctcagcatttgcttgtttgtaatggattttatttctccttcacttatgaagcttagtttggctagataggaaattctgggttgaaaattcatttctttaagaatgttgaatactggcccccactgtctactggcttgtagagtttctgcccagagttccactgttggtctgatgggcttccctttgtgggtaactcgatctttctctctggctgccctgaatattttttccttcatttcaaccttggtgaatctgacaattatgtgtcttggggttgctcctcttgaggaatatctttgtggtgttctctatatttcctgaatttgaatgttggtccaccttgctaggttggggaagttctcctggataatatcctgaaaagtgttttccaatttggttccattctccccatcactttcaggcacaccaatcaaatgtagatttggtcttttcacatagtcccatgtttcttggaggttttgttcatttatttttactcttttttctctaaccttgtcctctcactttatttcattaatttgatcttcagtcactgataccctttcttccacttgatcgaataggctattgaagcttgtgcatgtgtcacgtagttctcctgccatggttttcagttccatcaggtcatttaaggtcttctctacatgtttattctagttagccattagtctaatcttttttcaacgcttttagcttccttgcaatgggttcgaacatcctcctttagctcagagaagtttgttattaccaaccttctgaagcctacttctgtcagctcatcaaagtcattctctgtccagttttgttccattgctggtgaggagctgccatccttttggggagaagaggtgctcttgtttttaggattttcagctttctgctctggtttctccttatctttgtggtttttatctaccttttgtctttgatgctggtgacctaccgatggggttttggtgtagatgacctttatgttgatgttgatgctattcctttctgtttgttagttttccttctaagaatcaggtccctcagctgcaggtctgttggagtctgctggaggaccactccagactctgtttgcctgggtatcaccagtggaggctgcagaacagcaaatattgctgcctgatccttcctctagaagcttcatcccagaggggcatctggctgtgtgaggtgtcagttggcccctactgggaggtgtctcccagttaggctacacaggggtcagggacccacttgaggaggcagtctgtctgttctcagagctcgaacaccatgctgggagaaccactactctcttcagagctgtcagacaaggacgtttaagtctgcagaagtttctgctgccttttgttcagctatgccctgcccccagaggtggggtctatagagtcagcaggccttgcagagctgcagtgggctccacccagtttgagcttcccaggctgctttgtttacctactcaagcctcagcaatggcggatgcccctccccctgccaggttgctgccttgcaggttgatctcagactgctgcactagcagtgagcaaggctccgtgggcatgagacccgccaagccaggcatgggatataatctcctggtgtgccttctgctaagaccactggaaaatcacagtatttaggtggaggcatcccgtttttccaggtacagtctgtcacggcttcccttggctaggaaagggaaatcccctgaccccttgtgcttcctgggtgaggtgatgccctgccctgcttcagcttgccctccgtgggctgcacccactgtccaaccagtcccagtgagatgaaccaggtacctcaattggaaatgcagaaatcaccgtcttctgcgtcaatcacactgggagctgcagaccggagctgttcctatttggccatcttggaatggaatccatgtctctactaataataaaattagccaggtgaagtggcagatgcccataatcccagctacttgggaggctgaggcaagagaactgcttgaacccaggaggcagaggttgcagtgagctgagattgcaccacactgcactccagcctaggcgacagagcaagactccatcaaaagaaaaaaaaaagaaagaaaatggagaaagaaccaaagactcaacgaatgcagctccagatactgaaaagtaaaagagattctctgctagagtatttggagggattgtagccctgctgatagcatgatttagcctcataacacttagttcaaatttccccagagaaggtgtggccctgctacaactcaggtttagccccgttaagatttagtttggattcctggctccagaactgtaaaacaacacatttctactgttttaagccactcaatttgtggtaatttgttacagcagccatgggaaatgaatacagaccccttcccttctctacatatactcatttctttgttacagcagccatgggaaatgaatacagaccccttttcttctctatatatactcatttctttggagagtcctttgaagatcccattcagtctcatggttttaaataccatctatatactgattaccacaaattccagcctagaactctcccttgaactcccaatttggacacacaatcgtatatttggtatgcccacctggatgcagaagaacttcccagccaacaagttccacccacagtcttccccagttcagttataggcaacaccatcctggctgttcaaacaaaaaaccttggaattatcccggatctttcattctcatattcagtcagttatacaattttgttgcctatatattaaaaagttatcaggaacctgaccagttcttactgtctctggtgctctttgcccggatgactgcttctacccttgccccactcaatcaattctgaaatgtggtcagagtaaactttttaaagtcagtcagttagagatcaagttatttctctatggctacatatttcttttagaacaaatgcccaaatctttacaataccttcagaagcctaccatctggtgcaccctaccacttccctatcctgctctccaacttcatcttcttatgttctggccctcactcattcagctgcccaaaatcaatgtatcactttagtgttcccccaacacaccaaaggaagcttccacttcagagtctttgctggtccctctacttggaatgttcttccttcagatatccggatggctcactccctgcttggtcctttacctccttcaagtctttattcaattgtcactttctcaatgaagccttctccaaccattctactcaatattgcaagccctttaccccaacaccggcctcattaccttacgtggttcttttttctctccaaagtacttatcgtcttttagcaaactgtatactttactaatttattatggttattgactgttttctccattacagtatatgctttgtgaaggtagagatttttgtctggtttatttgttgctatatcatgaatatctagaacagtgccaggcatgtattacatataactgatttctagtatataggaagtagactgcactaccctagtatttaaggtcctgatgaatccattacaaatattttatttcagacttcaagtttttatctatactgcttcaggaaacactttatgttaactattatcataggtggcaaattcctaagttacagcaatattacagtcaccctgctgtaataatcacctatctactagaaaggtagaaggaatagttgtggctcatattgtatgattctacttacacaaaatgtcaagacaggcaaatccacagagacaagaagtagaccagtggctgcctaggactagaaaaagaaaagggtgttgggaggaaatgggaagtgactactagtgggtacagggtttctttttgggataatgatgaaaatattctgaaatggattatagtgccagctacaaaactgtatatgtactaaacaaccattgaattacatactttaaatgggtgagttatatggtgtgtgaattatatctcaataaagtttttattaaaaatttttatgtggctgtggctggttatgttttggattgcttaagaaataaaacaattttggggaaaattatgggaaaacaaatttaaaataaagttcttaacaatttaggactaacaattactatcacaatttgacagtaattaattaaagtaagcaaaattattaggattctaaaaactttcaaataaatattttaactgcatagccttgttctatttaatgacacaaaagatttaggaaaggtcaaggtaagaactaatgatgtattcttacataccttataaattgagtaaacaaaaactcagggaaactcatctaaaaaaataaaaaggttttcaaaactcgacccacatttgcccaatcaggtactaactagtctttccccaaccatctttttttttcatctgaaaagtttaatgatctaacctgctagagattcagcatatgatgaaagggagcttgcagaaggcaaaataattatacgaacaaaatatctttccttttcttaacttggacaaaatatatttagacagaattaaatggcagtttcttgggtggttctttaaagttttcctaggcactcttaagattggtataacaatataaattttattatatctttaagcatctcagaaattacacttataatttatgctcataattataaatagatgtgtctatgtaaaatgtacagtgtactcatttaaaaatctagattcacagcattaaaatacttaggctgttttatataaactacaaacaaaaatacaagttttacttagatgactattgtgcagattattaagagactggtaagtttaatgaaaacatcctaatggaattattttattaaggagaattactttgacatttaaatttttacttgaaagaatcctacctagtaatcgaatagctttttaagaacagtgtataaaataaactataccataaacttaagcctagagttcatcacagattaaaacttttaaactttaaactaatcataaattaaagtatacactgaggaataagacatatacagaaagagaagtactatggccaacagctttttaacaagactgtaaataaaccttattttaccaatattaaaggattcacctaccatattctattaaaaattctatttttctactcataagttacctcaataacaaagatgtgaaaatctaatacttttctaaaacttactaacattttatttaaagtataatatctaatgcttattgacatttattcaaatcacttctttttaaataaaaacaagttctctattttgaaattttgtaggactcaatatcaggtattttgttaaatggtaacttagaataaattcaaaagaaaggtttaaaaaagaaaagttctaagcttttaaatgatcctatcaatattggtgtccgggttacacacaactataaatcaaagcagaaactggcaaaataaaagaatgatgttgacatacattattctaatacgtaatggatttctgtaaagaagaattactagagacaatagatgccccttttgttatgctgctattaagtattattgaacagtcacatttagtttaatgcctaatccagaggcatgccacaaatatgcaagtcctatttttgtctatgtctgaagacggttatgtgtgttctttttctccttccaatttcctaatcagttttgcaaatagttacaaaatttttaccaggccaaacagccccctgctccctaccctcacccatatatttgccttcattttcagcccctgtaacatcagagggtttttttttaaaactgtaaataaatcctgactaattatgatttattcacagctgctctcaatgatattatgaactagtatccttttccactattaataatttctataaaatatttaaatgcagtttttttttacaactagaattctcatttgaacaaacaagaaaatgtcatactgaaggtaaatacatcaatttaaaaatttctcttataaataagtatgttttaagtttaataaagtagctagcacagctgggaacaggaaaaatgctgtttgcttcaattttgcaagcatttgatttgattggatggcaaaatcagcttgactgtgttagaccttaaagcctaacggtgacataaaataggtaaaataggataccctgtgagtaaggtgggtgaagtaattgataatacagagatattttgcaagtggctcccttgactgcattactttctaaagggaggtgaaaggcacatagaagtcactgaaaatacttttgttgaacaaacgaacattaaaaactaaaaaggagttttgttagtgtgttattctagaaaaaaatataaaattagaacattaaatattaatttatacttaaaccaagtaatcctaaatcggtctcaaaaaatatgaataataacatattctaacctcaatgtgtataccttattaatattttctcatgttctggaaaattaattaaaacaaaagtggttcttattaaataaatgaataaaatctattgagacaaatgcttattcatattttttgaatttgaatcacttcaaatggaatatctaataattcagtatttacatatcccataactttaaaaatataacaatgtaagatactgaatcttaaacatacaagtagctactacatgttttgcacacctataatttgcatctattaaggattaaaaatattaaatttctttttattctaaaattcaaaaaaagactatattttaaatatagtcatacctaagtattttagaacattttcgcttaaaggagagctaattgatgctaccctaaatacaagaagctaaatatattaagtacatcaatatgaaatggagtatgaactggtatgtttcctgaatgccttctcttacattgttactaattcattttataatttaccatgaattaaaataatagtttcctaaaaatgactcatggaaatatatgggtgtataaataccatccactttctcctggaaatgtattatcaatctgaacacagaacacagaacctgaagagagaagctcaagtgttttaaaaatatttcgcctctcctcagcagctgatttttccatgcttgttttaaatattaatataaaacaggttttccttaaattacaaaataaaggtaactttaaagaaatattcatttaagttagaggttatgtattaaattgttgccagtgatactgttttaatgttttagttacgaaacagaaactgaagtgaaaaaaatcccacttgcataattttttttttaaattttttaattattattacactttaagttttagggtacatgtgcacaatgtgcaggtttgttacatatgtatacatgtgtcatgttggtgtgctgcacccattaactcgtcatttaacattaggtatatctcctaatgctatccctccctcctccccccaccacacaacaggctccggattgtgatgttccccctcctgtgtccatgtgttctcattgttcaattcccacctatgagtgagaacattgcataatgttttaaaacaacctttagcttgtaatctagatgtaatttgtttttaactttcagaacaataaaacaataaatagagactatagtaattgattggtctgaattgttctaagttccttagtatgaattctgtttcacagttaagccttagactcaacttgtttaaggcaaatagacaaagtataaaatattactttggagatacaagataagtataatttttgaagaagtctcagtttagaattttagatgacataaagaattaatacataaacaatatgtgccacatgtgagcagtatgcacttaataaaatatttgtatgaagctaaaaatttcttaccaaaaagttagtaaaaatagacattattattattccttccttgaaaaaacctaaaactaaatctttaagtaaatgatctataagaattcttagtctggtccatgtgattacatggtcctatgtacccagggccactggaaattctgtaagcttagatagcatgaattctgaatgttagacattgctgttcaataaaaaataacttgtattaaaatttcgtattttcactttcatggttttatttccaagtctggttattttcactacaacctgattttccagatcagtggtgtctggtcaatttatctatgggtaaaataattaagtgttcatatgtctatacccaaatgctcctccagagcagcaatttgcttaagttggcagtgcctaccgcttggcatgcaacaaggctgtcacaaaaaaatgtttactgaataaatgatgaatgaaggaaaaaataaactaaaatatttctgtagagaaagaaacatgaaatgctctaaaatgtcagtcatgtcagtaatgtttatttttacagaagaatgctgactgaaagtgtttaactgtcccctgaattgtgagactaaggctcacaacaaagacaaaaataatgtacaagcaccacctatcttgaagacagccaccaaccaaatggggccaaatcgccaaccttgagtttactcagaggttgaatgagccccaccactcccaaatcatcacccagcctacataagagggcaagggtacatcaggagcactggggtgcagtttttgtcataggagcttcctcactcaagccaagttgcacagcaccaagatattacatcaaagacacgttgtggtttcctgcaagaagaggagactggcatctcactttccagctggactgaatactgaataaagaacctgcaaacttgccctggtgctgccagtggagtagaatttagcctgctgaagtgttcatagatgacctggcatatgtccctagaagttggggaaaatatattggcctagaaacttgtctacttcttatctagagatttctgaagatgggaggcttgggtagagcagcctgcagcagcagacctaatagggccacagaaatagtatacctgggtggggcgggggagaagtggagagtacctctcacatttcccctatctacccactaattctctgagaccctagaaaaagaacaccactgactcccatggctcatatgagagaaccaggactggggaagaagcaagggctgctggtcaaacacatcaatgccccatctagagagaggggaggagtttgaacttatgaaacagaaaggagatatagctacccatctctgaggaagagctcagtgataaaggaagccaagataaagctatcatcccaagaaaaccacatattccaaccacatgaacatcatattgtcagagacattttgcagcacttagaaccagattatgccagagtgagacccactatcttcagataaccacgttcactcagatgatgacctctgcctctcttgtccttcctccatgctgcctccttcccctctctctccaagaattagacctaggaggggagaaagcatgccaacagtcttaggccacttaggtggtcttctctaagatgtagggtggggaaggatcaagtgagacttaaatcaaatttgagattaaaatcttaaactacccagacttttactaaatgaaagtgaccaaaaagttgtagcatttgtccaaaggcatagttaagagtcagaaaagggagattagaaagagcatgcttcaaagtatgttttttaaaaaaagtaatttcagatatattgccaatgagttgtaactgtttaaaagttatttacaccctgtggtaggatgaatgctcaaaaaactgctaacaaaaaacttgatagctaaaactattctttaagttcaagcatagactgatacctgcccccacactccccctacctccccacaaaaaaaaaaaacagtgaaatcctactcatggtaaattctcaggtgacagctgtaatcggcctacatttaagcttggttcaatatatccatgggtagatagagccagcctctgctcactgttcctgccccactcaccttacatttgggataccctagaaatccatttttggtaatcatctctcttcaagggtctctctggttgatctcatatacttttttccatgccaaatagtcccaaattcatggttccattctgtactttcaactatctaatagatttatatgtcctccagacactgaaaactctatacatccataacatatcttgttagcttatcctccacacacacccagtctctaaaatctgttcttccctttttctattctttatctcaaacaatagcaaaaccatcaatctaattatctaaatcagaaaccttcttcttcaccctaatcctctatataaaactgatgatcagatccagatgattctaaatgatctaatctagatgatttcttgaatgtagactctcttctctaattccactatctttgccttaatccacttttaacaatttcaacagtctttaatccagttatcctaggtctccagggtctccagttcctctctatgcttcactttgacaccaaaaaacaagtttgataagagttttcccctcataaaaattttttattagctatccattactcataggattacggctaaacctagaagcctcagcttggcagttaaagcctttaccacctaggttactactgcatcatatccaatactagtctgttcagcagacatggttgcctttaggacctgttctctgacccagctgaaatgtgcaaaaaagcattctgtgttgctggctaagccaactcagtctgcaccccgcacctcggcctgctccatgtctgtattcctactttattcgaatgggcttcagttttgctactacccagagtttggattcagtgctatgatttatgcatctcctctttctcttgactgatggctttacttctggctcaggctaacctcttcactaaaggcttagtgatagtatcattgttaaatagtacaaagtaaactcttaagtcagatttcctgggttcaaatttttgctctaccacctacaagctatgagattttgaccactgaacttaatctctccaggcattagtttcttcagtttttttttttattcttgcagcttttatgaaagttttcttttttaaaattttattattattatactttaagttttagggtacatgtgcacaatgtgcaggtttgttacatatgtatacatgtgccatgtttaaaggataataatagtaccttctgtaaaggatctcctgcattgtcaggaaagtgctttaaaaagtactcactacatactaagatctcaatatgtgtcagctgctgtttttcccaatacttattagtttattagccaaaacaaaaggacaggacaccctctgagccataaaattatatatgtagataaacttcacacaccattttcaatataaagactggctacttagaaaaacaatttcagatgctgaagtttccaacttaaaacagcctcctatcatgagtcatagcaaaatgtggcatagttgcccaaattaatagaagcctaatagtttaaatatggcgtcaagaggaaaaaaaagtataaatgaccatagacaaggaagaaattcttacaggtgagagtaactgatatacaatatggaaagacaccacaggttgactaattctggaaaattctttaaaaaatgacaacaaaaaagatgaatttccacatatcgaaagagctgctactaaatgatgactactagacacccaagggttacagatacttaataatcttcttcagttatttgaagaatattttttctagaagaatatacctctaattttataataaaagatggaagatagaatttatttgcagacttgagctataattcactgttccacaaagcaaggggaaattatctgcactttatttctattgtgccttatacagatatgctaaggggaaagtattttaatgttcataatcaaaacaaaaatgattaaatggtcaaaaccaaaagcaacgcaatttcaggaattctgtactatcactgaagttctaatgaattagtatatttcttttcatcaaagaatataggcattaaaatgacaattttagatctttcattagcaaagataatccagaactcgctagtcgttccactggactagttagtacaagaatatggccgataattaactttttatatatttatatatttgtagccttggctattaggtagtttcatttgcattctcaaattaagatagagagttaaaaactaaactgaaggtctgtgagaatgaaacttgatactctaacccaggttactgagccttttataagatgccttaataattaataatactatactgcatatcaaatttcaacatgcaccattactgaattcatgaagaaaaaaaggtctgttgagaaccatgtaaatgtgtcttcaaaataaatcagtaaggtatcttttttccaaaatactttcatctgctatgagaaacaacattagtttgaatgcccctatcactcatttatctccttaaggtctgtctatcgttctggaaaggtgtttcaacaactgatgaacacaattacaaaacaagactactttggttttgaatcaagacaactagattctggatttttaaaaaaagtctattatttactgaaaagtcttccaacatgaagaaaccaacctaatgagggctttctatttttatgaatgagaggtactatggaaaaggctaccaacctaatggcaggaaggaggaaaaggtgtcagcattaattcaagtaggccaacaaatatgataggcccccaaacaatgatgtgcatacttctaactgtggaagatagacatgagaagtatgatggaagtcagttatagaaagatttctgatagtgaactactatgcatactcagaaaacctgaattaagtataaaattacaaaaataattttagatttaaagaaatttcatgacagttcaagtacaaaactattccatcatcaaaacacaacctgatatatgcattactagtttcctcaatcaatttttaaaacttttttgaaatcgaatgctttatttatttcaaaaggtaaacactgttgggctatcagtcttaaattagaagatcataaattacattgtccactctttgatcctaaattccactattggttaacatctcttttgatgtaatcaccccaatagtccccagtgcttactgactaaacatccaaaattgggttatgaatagaaagcccacatagtcaaaataacttccttagacatcaacattagccacaacatatgcttggagtacaatatcttgttttaaaatgtagagtagtcaatttttcaatgtaatcttctaaataaatgacattttaaaaagagcaaactactatgaggagagtttgtgcttcttggagctctttttgtaagtcatttttcttttgccatgtgctttaaacatcttaataaattataacatgttgacaagaaaccacatactgcacctgtgctttctatcttaattaatccaataagtacaggcctgctcacttaaatttgtaagggaaatgatgatataatgagttttaacttaaggtattaattacctaaataagcagaattagcttaatgtttcagtagactttgcctagacacaaccaccaaataaaaatttcagaaattatggaagccttaaacagcaccattaggaataagaaagtgaaacgctcattctacctcagatagccaagtggattaaattctactaaagaaaaaaattttaaaaaccagtgcagcagttcagagacactaaaatctttgttgcttttaccgaagaatcaattaaatctagtttagctgcccagtgactaaattattattttctacttgtacataaacacttttctttgaagcaggtcactttcctttcaaaacaaaggttatgactatcttaaatgcctcagcagacggatggtcaaaacctcataaaaattctacatggacctagacaatcacatgacacaactgtgcacacgccacaccatctgttggatatgactgccagcacagatttcgtgagctggcaaaggactgaaatagtcaagaattctgcaactatttcaaagtgcaggcttctcattaattttaatttcctgttggctctacaaggaatgactgagtagtgaaagcacaatatgccacatacacttgagttcatgccacatgtacacctgtaatcataaactcttatccaaagctatccactggaacatttgggattttgtgtgtttatttcttctttaccctagaagaaataaatctgaaatatctatagttgtcttttcatactttgttaatactcttgcaaacatctggaaatacttgacaataatcatttaattaatgcaaaggtaatcgatgacaatatgcttaaatacttcactcaactgaagtggtttcctcagtccacagaactaaggactgtagagaacaagcagttctttgactaaggagtacactacaaggaaaactatagccaatatctcttttaaaaccagaaacattacctgcatttaaacaaagcagataacatgctgctatactggtaaaacaaacaaacaaacaaacaaacaaaaaactggtagatgctgctggcttaagtttttaccttaagctgtctacagggtctgtgttgctgagggcttactaaaggggtggccctgctcctctttttcggggctactctagtttctttatcactccttcacagttgctggctatagaggagggtgaaaagaccctgagaaagaaacatttctccagaacaagtgaagattcctaaaatgtccatgggcagctccagcagcagggttggtactttctctgccaaccctttactgttttctgcattttgcaacagtgacttttgttttgtttccctgtaatcatactcacttgctaatgcaggcaacaaaggtaggactgcggaaaaactaggaaagccccaggcaactttatacttggggagcaaagttagtttttttcccttctctgccacaatttttgggactttttcttcagtgtggccctggaggattcttgtgtcccttagctcaaaagaacaccaccaactgaataaatatttaagaatcagagtaattaagaaatgttaacttactattcagtatgagtcacaaccaaaaatggttgatttacctaatttctcttatactagtaattactgtcaatccaatttctttcttttttaaaatttggaaccaatgtagtgggttaacagatggcttttgaagtttttgttcttattccaaaatctttacattacccaaaatatatctatttaaatatgatactgtaatttctgcaaaacattatctacatgctctctatttaacactaaacaatctggatgttaaggctgtttggaaataattctaacaaaaactgaaacattagactagtgctataataaacagacttgccttttacatttgttttagaaatcttcataagcacatcctaaacataacttttttccggtagggttaaaaataattcaattagcccaaatatattttatctcctatctttttatgataatccccaatttggtgacatcataaattcttttatcatctccttacattcaggaacataacataagaaaatccatagaaaatcccaaagacaaatgctaacgatttaaaaggaagtacacaaattctattgcatacaggctttaagacaaggaatgcttcctaccctgcacatctgtctagcaggtgcctttccgaataagttttgtcctttaggaatctgctctgagtacctcaaaagacaataaagtgttctctttcatttttttttcttagaacccattttcctcaaggcagaaggatgaagccttctctgtcctgaaaatatggtcaaaacaactttggcttattttaagcaacttctatcaaatagacttaggaattatataaaatacagttctcttctagaaggcggcctcgagatgcatcatgaagagggaagataaacacataaaccttagtatgctttatactttaatgagtcatattttttaacattctgtaactaatagatgagggaatgaataagaccagatttccctcattaacagctggtatctttgcttttagtccacttccccattttgtgagcaaagcagtccaccaaatcacttacgctgtgctccacctatgcttcttcttttaaccattctctctttgcccctcttacacccttttccttgtcttttgccatactcactactactcttggcaattatttgttcatcttctggcaatgcttcctttattcatctcttatttatttccatttccattccgctcagtggcgattacaaacattttccactttcctcaaagtgatgagagggttgagcagttccagttgacaggtgtaataaatgttgagaaaggaagaactgttctagtcactccgtccctcctgcaattccctttttaaggctatctgccctatataagtcaaaaataaataactctgcaaaaattggatccagtcatatgatctcttgatatccctttccaactgtgagaacatcttcctttattatttttttttggtactgtcaccatttatcatttggttcctcaccttaactaatcaaaatagtactcttcaatctagtatttcagctatttctgttaatctttcctcctcattcttgtttttcttttcaattttattcctatattattttaagcttgtgccacataaccgatttcccctaccctgagtctcttcctatcaatccttcatgctatcttcaatattaatattcttaagatacttttcatcatgtcatcctccaacttaaaaccttcagtggctttccactgtctattaaataaatattcagactctgtaaccttgcaagctttcaccctctgatctggatctacttttccattttatctctcgtatttttccagattaactaccacagacttgaaggtctctatttcattgccacccaacacagattatgctttcctactgctaagctttttattacacatcattccttgtagttcctgccttctctctttctgctatccatttatcaatgcttagacaaagtcctcttccacattataatttcatatacaactccagccttcatcaaatctccctcttattcaaaaccacatggcaatgtctgagttattgttctggattacaatttaccacttcattaactcataccttgtcctcttaataaatcagtataatttatttttacccacagtgcctagcacaatccaaagtaaaatatttgttaaattagcttaatgttttctaacaaattttggaatttccagatagaatgactacaaaatctatgaggggctaaaaatgtttccaaaagttactttcaggagttagccattggaaaaatagattcacaaaactaaaatgagtctaagacagacagtagaaggctacatgtcaaaaattgtgtgtatgtgaaaaatctgaaagtagagtactgcaatggtcattatcaaaatcattaatgaactctgatttcctaaattcaacattctaatttctgttgaattttaattaacaccctttctattagattgtctgcaaagtatactgtaataattccttccatctcatagcaccctttgccatgtaactttgctgttccttccatcatgaggtgaaatttatttccatatcttatgaattaggactagacttctgacatattttgacaacagactatgacaacagtgacactgtgcaaattctttcccctcttctcttatgcattttttatgcaaaaaaatgcataacacaaaattaaccattttcaagtgttcagttaagtggcattatttacattcacactctcatacaagcatcactaccatccacttctggaacgtttttcatcttgcaaaacggaaactctgtacccatcaaacaataactccctatttctcacccgtgagaaccaacattttattttccatctcgatgaatttgactattataggtaactcatataagtagaatcatatagcatttgtccttttgtgacctggcttatttcacttagcataatgtcttcagtgcttatccatgttgtagcatattgcacaatttctttcctaaggctgaacaatattccattttatgtattacaacatttttttaatccattcatccatcaatggacacttgggttgcttctacctttttgtcattgtgaataatgctgccatgaaaaagggtgtacaactacctctttgagaccctgctttcacttctttggtacatacccagaggtagaattgctggattatatgataatgctatgttagtttttttgaggaaccaccatactgcttcccatagtgactacaacatacttccaccagcaggtgcacaaggaaaggttccaatttctctacgtcttcagaaacacttgttattttatgtgtttgtgttttgataatagtcatttgaatgggtgtgtagtatcttattgtagttttgatatgcatttctctaatgattaatgataattattgaatcttttcatgtgtttattagccatgcttatcttctttggaggaatatctatttaagtcctttgccctttttttttttttttttgagacagagtctcgctctgtcacccaggctggagtgcaatggcacgatctcggctcactgcaacctccatctcctgggttcaagtgattctcctgcctcagcctcccaagtagctggaattacaagcatgcaccaccacaccccagctaattttgtatttttagtacaggtggggtttcgccttgttggtcaggctggtctcaaactcctgacctcaggtgatccacccgcctcagcctcccaaagtgctgggattacaggcatgagccaccatgcccagcccctttgcccatttctgaaatggactgtttgggttttttttttgttgctgttgagttgtaggagttcattatacattatgaatattaacctcttatcagatatatgatttacaaatgttttctctcattccattggttgccctccactctgttgatagtgtcttgtgatgcacacaagttttccattttgatgtagtccaatttatctattttttgttacttgtttttagtgtcatagcctagaaatcactgctaaatccaatgtcacgaagtttttctcatatgtatttcctactaattttttagttttatttcttactgtaagatctttggcccattttgaattaatttttgtatatggtgtaaagtaagactccaacttcattcttttgcatgtggatatccagttttcccagcacgatttgctgaaatgcctcttctttgcccccactgaatggtcttggcatccttgccgaaaatcatttgaccatagatgtgaaaagtttacttctcagctctctattccattggtctacatgtctgtctttctgacagtaccacactgttttgatttcagtagcttggtagtaagttttgaaatcaggaaacatgagatcttcaattttgtttttctttttcaagattgttttgactaattagggtcccttgagaatccatatgaattttaggatgagtttttttctagttttgtaaaaaatatcattaggattttgacagagatgacaatgactctgtagattgctttaggcaatattaacatcctaacaatattaaagcttataatctatgaatatgtcttttcatgtattgatatctaatttctttcacccatatttttgcagttttcagtgtacaagtcttttacctacttggttaagattattcctaagtatctcattctttttgatgctattatcaatggacactgtgcagatcctacgctgatgtcaagaggccttacaaccttgttttcaccttcttggaaggctactactgccacatacaaactccaggcttgcctgatgagatcatatgacctagccaatagttagcacaattgccaacacatttgggaagtaattttagagagagtgttcagccccattcaagtcagcagatgactgcagtcacttaagaaaccccaggtaagcccagcagaagaaacacttagataaacctagacaaactattaacctacaaaattgtggttttgatgaaagtaaaatagttgttattttaagccattaaattttggggtggtagaaagattaactgaagcaaagttaaatcattttatttgccatttcttaaccatgataatttattcattactttgtagctcatttcaaagtgtttctcagagcccattaagatgtattccatactactcagccataaaaaagaataaaatcttatcttttgaagcaacatggatggaactggtagctattatcttaagtgaaacaactcagaaacagcaaagtcaaatactgcatgttctcacgtataagtaggagctaaacaatgtgtacacacggacacagagtgcggaataatagactatggaaacttggaagggtgagaggggaagaagggagtcagggatgagaaattacctaaagggtacaatgcacattatttgggtaatggttatactaaaagtccagacttcaccatgatgcaatatatccatgtaaatttaaaaaacagcaatcgtacccttaaatttatgccaaaaaaaaaaaaaagatttattccaactgacacaagacaactctttgaggctaaatactctacattattcattatattcatgaataatttaaagcttaaatgtcagcattctaaataatttataattttaaaaaagtagataggttaaaatgaaatcttattaggactaaagatgtattgattttatttttctaactgcttactacaatattgaaaaaatattaagtagacattgcaatgatgtttgcaagctaacctgtgaattatactgctaatatttgctagcaattagtactaaatttattggggatagattttgaaactttattatctgattatttaaaaactcaatcacaatattgaggaaaaaagtacttaaaatatttataattgcaaagcatttagagtcatgttgtctaagcaaaatggtttattattacttaaaaattcttaaatttaaaaaatgtacatatttatatttatctaaaattgtatttacttatccatacgtttattaataaataaaactataaaggattataaagttattttgtttgggaaaaaaaatcttccagaacaatatgcaaaagtaacattattatttaaaatgtggttaagtaaaaatttactccataaaattttcactccattaaataactcattttgagaatttactctctcaagttctggaaacagttactttaaaatagttcatctgtattttatgtattctttaaaagaagtaagaagaaccagggtagaagaaataatgagaaaatgtaacaaaataggtgataaggcagttttatactgaagtttatatgctcctaggtacagaataggactattatttctgagaaaccaagtggaattaacacttactcaaatagaaaccaactcatatactttaaaaattgaagcaaattctcaaactctatgtcataaatacctttgcttcattaattttggcaactgagtttactgaatgtcagaagtatctcatatttgcattattgaaaacatcttttaaaatagttgtcattttagttttaaggagtcctgaatatttatttaaatttgagctatgatttatttaactataaaaaagtatttctctgcaagtacatttctataagcaagctacagtttcacaatttctctaaccatgtatatggctgtataatgaatattaacatatggtctataattgtatatacatacacacagttcatatacatatgaactatgcttctcaatttgatgataaaatatagaaggagaaaacataaattgaagaattaaaatgtacttacaaagtcaaagtctccatcttgaggaactttccagttatcaggaaaaacgtttttggacatagggaagggttcatgcatgttctgattacagttttcgtgactcttattcttgaagtcttgcttatcaaagtagtccatgaaagatggtctttgtacttgtggtgaggttgcatttccttaggtaaacaaagaacataaggaaggtataagttcttacatttaaggaagtattttctttgaagtatgatttttttatgaagccatataataaatttgcactggtcagattcaaggccaacataattaatttcataaagaacaaagtgaaataaaataagaattaaaaaatacccagaccaaataaaaattaagctgatgattaggcaaaggtctggaatgtttagattgtagaaacatttcagaagtttagtaaaatcattatcagaattttattaaaaatcatttcagctttatttcaaatttctcaaagaaagtaaattttaaaaactcaggtgtttttggtgggctttttttctttgcatttaagcctgcattgctattgttattgtacattttcagctgtaagaaattatgaggacttggctaggcatggtggcctgtaacctcagaactttgggaggctaaggtggaagggatgcttgagcccaggagttcaagaccagcctaagcaacatagtgaaactctgtctctataaaaaatacaaaaaattagccaggtgtggtggcacctatctgtagtcccagctactttggggacagaggcgggaggatcacttgagcctgggaggtcaaggctgcagtgagctatgattgtgccactgcactccagcctgggcaacagagcaagaccctgttcaaattaaaaaatatatatatatgaaatacataaactttaaaaaaattaaaaaaaatcataagaacttactcagtttcctcttatatttatcaaactgcttcctcagtctttctgattccctctgtccctggacttccatggcttcgcctgccacacttacatccatgtctcccaacactacttctctagcccagactttgcgcctaagttccataactaactttgctagctattagacaacttaatctgaggtgagttgccaattaatttaccagttctaaaactaaattcaagatctttcccttcaaacctacagctcccccgacatattctatctccactaaagtcaaccttatttactcaatccccaaaataataaagttgagaattaattcagactcctcccttcccaccatagcaaactgattattaggtcttttaattctacttctcagtacagttaactataaccccttttctctacttatcattgcaactgtcttagtttagcttctaatcacttcttgcttaggccattgtagcagcctccaaactagtctccttgcttccaatatcacagttttgattttaatttccatattgtcaaagtggtgacctttctaaatacaaaccaaaagatgtcattctgctcagaatctttcaatggctcttcattttttatactgaatgactaaataggaaataaatatttggaataactagatttttaatctggctatattggtcttgatcagtggttttcaaattggatccttaaagccccagggctccaaataaatgtcccagagaccaccaagaaggcatttcccatataattctccaaatagaaagtaagctactttcctttttcttttctttttttttgagatggagtttcgctcttgttgtgcaggctggagtgcaatggcacgaactcagctcattgcaacctccgcctcctgagttcaagcaattctcctgcctcagcctcccaagtagctgggattacaggcatgcgccaccatgcccggctaattttgtatttttagtagagatggggtttctccatgttggtcaggcagtaagctactttcttaagaattttttgtggggagtacacctccccacaagggaccctgatgggcaactgtaagttacaaaaagtatttttaaaacgtaaaattgaaatctttccttccgtaatttacactcatgttccaaataaattactctttcgtataattgtccctcaaatatctgaagacagaggtaatggctcctgtcttggctgtctatttttaatataaaacatccccagttcctttcataggatatatgtttcagattcatcatcaacttgtttacttgcctatggagacattctagtctactgttcctctaaaaagaaacataatattcataacagttatctgaccaacctagattgcatttgtaatagtcctagcacagttgaaaactacagttactactatgacaactaagtaacaatgttagttgggacgagctttaaggtcattttggtcaaaagaaagcatgttaagacttatttttagtctttaaaaatatgagggaagcctaaatcgatgcctactttatgtggcaaatcagagagtccggaattcttaatcaaacttcaaaaaacaaaagggggggggacggagattgaactgacaggtaaacgtcctatctcctctttcctttctccctacttttggatctctatgtgtgttatttgacagattggaagcctaggtgaggcggcttaggtgaggttataagagagagtggtaatggtgatatttattcatcaaaagaattctgtctcattgccttaaaataaaatggtttgccatatcaaaacagaggttttattgacttcaccttatgtgttttaaaaaaatttttataagataaaatttaccatcttacttctgggtatatatccggaactgaaagccaggtcttgaagagataactgtaaccccatgtctattgcagcattattcataacagctaaaacatggaagcaagccaagtgcccattagcaaaatgtgaggaaggaaattctgacacatgctacaacatggatgaaccttgaggacattatgctatgtgaaataagctagtaacaaaagaacaaaatactgtatgattccacttatgtcaggtatttagagtagtcaacatcatagagacagaaaacagaatggtggttgctagggactaagaggagtgggaaatggggagtcggcgtttaacaggtacagcagttgagttttacaagatgaaaagagttatggaaattgatggtggtgatggctgcacaactttatggaagtgcttaagattaatactattgaactagatacaggcatatttcgcagttattgcaggtttggttccagaccactgcaataatgagaatatcgcaataatgtaagtcacataaattttttggtttcccagtgcacataaaagttatgtttgtttgtttgccttcacaacgtcaattttcttaaaaatttctttttaacttttaaggtcaggggtacatgtgcagatttgttacataggtaaacttgtgtcatgggggtttgttttacagattatttcatcacccacgtattaagcctagtacccatttgttttttctgatcctctccctcctcccagcctccactctctgaaaagtcccagtgtgtgttgttccccagatgtggccatgtattctcatcatttagcttccacttgtaagtgagaacatgcggtatttggttttctaaaagttatgtttaggagtgacatcagaaagatggctgacaagagaggcctggtgctagtccactctcaacaaaaaaagaccgaggcaacagataaatagctaagatttgactggagtgtcagtgggagaaccctggagaataacgagagagtgcagaggcacctgtgctgcttagaagtccagtttggggtggctgtagtgtttcttaaataataccgcagtgaagtttgctgtatcagttaactcttcctttcacaaaatgtttctctgtagcatgagatgctgtttcgtaacattttacccacagcacagtgtctctcaaaattgtagtcaatcctctcaaactctaccactgctttatcaactgagtttatggaaaattctaagtcctttgttgtcatttcaacaatgttcacagcatcttcacaaggagtagattccatcgcaagaaaccactttctttgctcatccataagaagcaactcttcatctgttcaagtttaatcatgagattgcagcaatgcaggcacatcttcaggctgtacttccaagtctagttctttcgctattaccatcacacttgcagttacttcctccactgaagtctttaaccccttaaagtcatccatgagggttggaatggacttcttccaacctcctgttaatgctgatctttttacttcctcctatgaatcacaaatgttcttaataacatgaagaatgatgaatcctttccagaaggttttcaacttacttgatccagatccatcaaagcaatcattatttatggcagatattgccttataaaatgtatttcttaataataagacttgaaagtctaaaatactcatggatctatgggctacaaaatggatgttgtgttagcaggcatgaaaacaacattaatttccttgcatatttccatcagaccccttgggtgaccaggtgcattctcactgagcagtaacagtccaaagataatctttttttctcagcagtaggtctcaacagtgggcttaaaatattcagcaaaccatagtgcaaacaaatgtgctgccatccaggcttcattattccatttatagagcacaggcagagcagaatgagcataatttttaagggccctaggattttcaaaacagtaaatgaacattggcttcaacttagtcaccaccaccagcctgtcctttgaagctctgaagccaggcattgacttctcctctgtagctaggaaagtcttagatgacatcttccaatagaagacttgtttattctatattgaaattctgttgtttagggtagccaccttcatcaattatcttagctacatcttctggataacttgctgcagcttctccatcagtacttgctgcttcactttgtacttgtatggtctggagatagcttctttccttaaacgtcatgaaccaacctatgctagcttcaaacttttcttctgcagcttccttacctctttcagccttccagaattaaacagagttagagccttgctctgggttagactttggcttaaggaaatgttgtgactggtttaatcttctatccacaccactcaaactttctccatatcagaaagagaaaggctgtttcactttcttatcattcatgtgttcactggagtagaacttttaatttcctttaagaagtttttctttgcattcacaacttggctgtttggtgcaagaggcctagctttcacccagtctcagctttcaatatgccttcctcactaagtttaatcatttctagcttttgatttaaagtgagagatgtgtgactcttcctttcactttagcacatagaggccattgcagggttatcaatgggcctaatttcaatattgtgatgtctcagagaaaagggaggcctgaggagagagacagagacaaggtaatggcctgctggtggggcagtcagaacacatactacatttatcaattaaattcgccatcttatataggcgcagtttgttgtaccccaaaacaattacaatagtagcaccaaagaccactgatcacagatcagtgtaacagacataataatgatgaaaaggtttgaaatattgtgaaaagtaccaaactatgacacagaaatacaaagtgagcacataacattggaaaaacagtgccaatagacttgcttgacacaaggttgccacaaaccttcaatctgtaaaacacagaatgtctgtgaagcacaaaaaagcaaattgcaataatgaggtatgcttatgtttaaaaatggttaagatggtgaattttaggttatatgtattttaccacaataaaaaaaatttttttaattaccatcaaaaatgtgccattcagtagcatgaagtattgtgtgaccaatcttcaccttgcaaaatggagactcttgtacccaatgaacaacttgccattttcccctacctctagcaaccaccattttacttcctgtttttatgaatcttactactctggatatgtcatataagtataatccattaaagtggtatttttttgtttttctttgttttttttatgactggcttatttcatttaacataatgacctcaaggttcattcatgttgtggcatgtgtcagcatttccttccttttcaagaataaataacattcaactctatgtatatactacattttgcttatccatttgtctgtcaatgaacacttgggtttttctacttttgttgaataatgctcctatgaatattgttgaataatgctcctatgaacatgagtatagaaatacatcttagagatcctgctaattatgtggctttgtgttatttactcttttttaaataagtttttctctatgtgcagatctttagttgcaagtaatcttattttttaatatctatccagaggccttttttgctttctaatgggtgttttgatggttgagcctaatctctgattaaatgaatgattacaatacaatgtaaacatgtgaataatataattattggtaaaagtaatttttatttttaccctatgagtatgttgtatgtatgtatgtatggatggatgggtgggtggactgactgatttgattgcctgacagggtctctccttctgtctcccatgctggagtgcagtggcatgatctccgcccactgaaggcttgaccttctgggctcaagcgattttcccatctcagcctcctgagtagctaggactacaggcatgcaccgccacactcggttaatttttgtttactttttgtagagatgaggtcttactatgttgcccaggctggtttcaaactcctggactcaagcaatcctcccattttggcctcccaaagtgctggcatcacaggtgtgggccaccatacctcgctgagttatgtcttttaaatgtgtttccatctttacttttcattaaaccgtaagttccctaatgtagaattccaaatcctttacctaaataatttcacagataactctattaatttgtgtttttgactgtctacccagatgttgaatacctatgaacaacagcaggagccatggtttttcatcattacttttgaattagtagatgctatatgtatttcattactagcattggtgcactgctgataatgtatttgagaaagtattgtgactactacaattattattaggctggtgcaagtaataacagaatgatctatcccagtagagtcagaaagaacctgattttcagaatatacatgtattagtggaaaaatagaaaaagactctcaacacaactgtttatctaaggaccaatcctctaattacagctgttccagctttagatggctagaaaatgtgacaagacatctgggacccaaatggtacccactgtaaagatattgagacattctatgaaatttaagatagtataaaacaccaatatttgtggtaaacctttagaacttagaacactctcatatctcacattcaaagctcatgaaaaagaaactccttagagacagttcagcatgaaaacagccaaagctgcctttagatttcctgtcataacagactttacaagtatgttaaaaatgaacaaaatatatagaagagaaggtgtaatatttcaacgatcaataaatatgctaaaaataaagatatggtgtctatggtgttcatcttcaactttgttccctgaaatcaacaacaaaaatagaaattggttaatttgatgggttacattactgacatttagacaggacacatacattccattaacattttcagcagatttttagtacctttgatttgtctctaggcttcatcattacaagacgtatttctctatattcagaattgaaactcggttcccatggtaacctcttatactaaaatagagtctaggaatttaacctgttattctccatttctgccccattttgtaagtttaaaaaaattacaagtgtagctcaacttacacatattttttataaaccaattgagtaaatcaaaccataaagctgggagaagggggataatcccttaaagaaattctttgctcaatattctttttgtttctttttctttttaaagggaagattaattctgtaatagaattatatatttagttgtaagttctgttttcatcaagaagtcttaaaatgtgtcacacacataaatacatctgaaaactttaacattcagtattatataataagggttatcaagtttgtcaaggaaagtcagaatcagggaggagagaaaaaatggtttctttagaaactaactgctggaaaagtaagaaactcctaaaccaccattatcaactgcatttgataatgaaaagaaaggtttcactgaagcgtatttctagatagcattctttaaaaagtaaatttagtatttgtaggtgctttggtaagaacaaaacaaaaacaatagaaactacaaaaagcatgcattgtagcactactaatccagtgaagacaacagcactctgtgacctatgttcctccccagatcatcttcctctctccacaccaagccaggaccacattgctttcattaattttttttttttttttcatccagcactggcttcactgctgaggctctcgttatggtcttgttttctcctcaactgggagataagaaactcttcatcccagaatctttacaaactccccagtgctgtaataaacagtcagggttctcttgatataccactgactcttactttggacctctatctgagaaaattcacccaaaccattattggagtaaattaaaaactaatcttttcctaccagaaactaacatttatagagcacctattctaatatgacctacatattaagagtagcagcatacactgggaaggagaaggagaaaaataaaatctcagaagttgcttttttcactacaaagaacagagtgggggaaattttaatcttctataaaaaccttcaaaacagaaagatgggctgagcaggcatttcctttagaaatgaggagagtaagaaaaaggctgaaggaaagacaatgttcttttctgcaatgagtcagagaagaaacagtttgattagagagaagtggtagcaacagaaaggggagaagcagactactccttggtgttgactaaataaagaaaggaaattactaggaaatttcattccaggaatctactcttccaaccccaacagccttgtgcgtgctcctgacaacatcccaatcaggagcttctaactgaagtcacataagccaccaccaatgttgtagtgtctcaaagtgaaaaatttgcctccctaatatctataatccctagcttcctgactaggggtgagaaagtatctatctcattggaaaaagtggccatgtaatacaattctggctaatgacacataaaaataagggtttaggccaggtatggtggctcatacctctaatcccagcattttgggaggttgaggcaggaggattgcttgaggccaggagtttgaagctgcaataagctatgggctatgatcacaaacaccatattccagtctagatgacagagtgagacccttctcttaaaaaaaaatcaagtaaggttttctaggaaagttctgttttcttgatataggcacaatcctttctgttttttgctcttttctactgcctggaatacagacttgatggctagagatcctacatttactctgcaggcaggagaacaagcataataccctaaaagatggtgtcacagaaatgatttctaatgacatcatgaactcactctgccagtgccggatactctgcttttggatttctcatcaaatgagaaaagaaattaatcttattttgtttaaatcactgttatttgggtttattggtacatacagtcaaattcagtccttaactgatacatttctattcccaaatggaggatgtagggagaagcagaaggagcagcaatctgcagtttcactgcagaaacatcccaatttcaaacttgaagtccactattatacagagtagtttaaatatcactacgtctcagatacattatagttttaaaggtttttttacaggctgacctaaaaaacctatggcaaaatgccttttggcttccatactcaaaaattttaaaaataacccactcctaagataaaaataaacattcttacagagttaacaaaagttttaaaagcaacttaaataaaagaaggagtctattctgtcagatttttctttttggatgatttaataacaagatactattaaccaagatatgtttacacttaattttttattcaaatgtataatgtatgtgcttatacttctaaatattttccattgcttaatttaaaacctagtattaacatttagagtatctctttgtcatacacacaaaaaaagattaaaaaacaatttttaaaaaattttaaagaggaaaacaggttaggtttgttttaaaagttaatgggagggggcagctgcaattgcccagtaatgtttaactacacaatatgaaacacatgccacaatgcgcagctgagtctccagggagatacatgttcacagaagtgggacagagaggatgatgtttctgacttacaatttattaaaaaaaatactaggctcttcaatgagaaaataaagcaggaaatctcaagatagtaaccactgtcatatgtgatgtggttgctatggcaaatactttttttaagcacaaaaagaataatcatataaaattgacatcaatttctccagctgcagccgaattctgaccccagcttacaaaaacattttattttaacaataattttaacgttcagaattacctagttcctcaattttggccctaattccttcaactagttgctcatggaactaaaaacctattagcaataaagaataaagtaactatcattcattctctttgtggataagaaattttaaagaaaaaggttgcttttcatctccttcatgcatccccaaaacatttacaagtaaactaaattgtgagaaatataataccgtagaaaatacgtcagtccacccacaattattcattaagtttcctaatttgcacatcttctaaacaagtaaaaagtcctcataaaaatttaaatatataaagtaatttttaaaaatactttaacaaaataatttaatttttaacttcttagcatgattatgacaaagatattcaagtttagagaataaaataacaatcataactttagtaaagtatgtgtcaacatcaaaaagatttatgaagattacctaatttgttcttctaaaaatattttaagatgtgggtggttccacctcattaatggccttcgaaatgtgtcctttaatttgctgccaagagtatagtgaatacatataaaaaccaggatgttaacacagaagctactgacatcagttttttcctgaacttcaccatactgtattttaaaacaaagaaggataaacataacatggagaaggtccacagactattcataaaagattaaaaagcttagaaaataatacctgcacaaaggttaaagagactgaaattattcagccaagaaaagtcaagtctgagaaagaacttaataagtatccaagtatttatgaagggttctttgcacagaaaatagtgaccagctgttttcaatctccaatgaagtcagaatagaaggaaacaaaaattgaagcccaaagattttagttaaataaaaggaaggagttcctgtgcgagtaatgaatattgtaatggtcactgtatctatgaaaatgctttcttccaaggcctgtacaggaaagatattttcatttttacagggaagactaatatttacatccttgtgtgtgttttgtgctaataaaagaggtatcctacaaccaaaatgcatacaccagcaggtctgagctgggttatacttcgttaaacgtcccacggaccaagagcacacagaatagtagactatactcagtgcccacagggaactccaaaccactgcagccacaccttacctggattcctcgtacttttgtaaaggaaaatgaatgatttctaattgcccagaaatatgatgggtatttgcacccagctgcaagagggacctgtagtttactgctgtcacctttattgtcatatcccgggcaacattaacctcctaagttaaagaggaatggaacagtttttcataaaagaatggtaagtgagaaagtagttcccctacacattctcctacccttgccaattatttcttggcatctcaaattccatccttagtgatttactcctttggctcaaggctgtacgattctgggagaaaatgtatttcatgagcattaaacattattaggcattttattcctgtgtatctggtctctttccaaaacagattttgggggaaaaaagggaggaaggaaaggatatgagaaccgagagaaagatattactaagcaaagaatacggcatggaagtagatgctcagaacaaaacaaattgcctcatacttcacgattttgtctaggaacaatggatgaaccagggagtagagtcagtcttctcttcttggtatctctcctcaactgacactaatatctagtatcgtttccagagtaactcctaaaaagctaaagcagaacttcatttgctttctcttactaattaagtaaaactgcatatatgtgctgtccaaaataaactctgaaattttcaaaatcaacaaatactatatgcatatacaggtaagacatttttaaaatgtatatttagtaaatattatttaacccagtatttaagaaatgataaacatttatgaaaggttaatataagtaaataatatacaacctaaacataaccggttatttctccacccattcttttttgtttttctgagatagagtcttgctctgtcgcccaggctggagtgctgttgcgggatctcagctcactgcagcctctgcctcctgggttccagcgattctcctgcctcagcctcctgggtagctgggattacaggtgcatgccaccatgcccagctaatttttgtatttttagtagagacggggtttcaccgtgttggccaggctggtctcgaactcctgaccttaggtgatccccctgccttggcttcccaaagtgctgggattacaggcgtgagccactgcgcccggcctctccacccattcttaatacaacatggtctccacctacatcgccatccagctgcctctctgttcaatgtgctccagtgtatctccagccttcttaaatactccaggtaagttctaaacacaatactccaggtgagttctggctcctgagagcagagggaagctgtttatttccttgttctaaaaagtggttatctgtcctagctgcacctcagaagcacttgtagagtttttaaattttaaaaaacgtattttaaaagcagagatgcccaagccctgctctagtcttcagaccagcatctctgaagagcgactgttacaatacatacttgtgaggctggttatttggacccaaaagcagggtttatcttgtaaatcaagcccactgctccagcctgtggtgatcttttaggatcctcgttctatcctataacatatttttattttgttccacttcatgttatttgcaattctgatggaccttcaccttatagcttcatccaagtttctatgaaaaattttgagctagccagggctggaggccgaggtcctgtatcacaaaatgagaaatcttccggtaaacaatttattatttaacattgtagtcgactgaaatttagcaaccactgccgtgtgcccctggtgagcctttgtatcatagaggctagagagctgaacaccacatttctcagaattccttgcaactagagttctgggtaagtgcactctttcgcaactggggtggtgggggcggtggggggaagcaaacagaagctatatgcctgctagtttagttatttccttcttacaagccctgtcatagaggcttgattatttacagcagcattctagcatctagtcaccagtttcacaggtactgaggagtggttgcagtaatatttagtagctttctaatccctaaatagcagtgagggttgatttcaatctgtattactgaactcagcggcgccagcggtagcctctggattgctattcctcgttgtggcagtagtagttgttccttatatgctcacttttgtggtgttgtgggagtcactcttgaagcctatgctacacagccttctcctctaggctttccattgattttcttaacttctacatctttaatatggcttggctctatgcccccacctaaatctcacgttgaattttaattcccagtgctggaggggggactggtgggagatgattggatcacgggggtagtttctaacggtttagcaccatccccctagtgctgtctcgtggctgagttctcacaggatctggttgtttaaaagtgtatagccccacccgctttgctctttctcccgttcagccatgtaggacgtgccagcttccccgtccccttccaccatgattgcaggtttcctgaggcctccctagccatgcttcctgtacagcctgcagaaccataagcaaattataccccttttctttatatattacccagtctcacatagttctttatagcaatatgagaacacattaatacaatctctgacttaaattgctttgtgtgtggaatacctggagtagattctgtttcctccaataaactctcactgatataagcacatttgagtataactgttgcactctcataacaggaccaccagctaggtcacactacatagtgtctacaagggtatcatgaaagaccttgtcaaatactttcctaatatcctaagatacaatattcaaactctgcattttctctgaccttgaagtttagcaatgctgtcaaaaaaggaaattatattattctgatacgatttcttctcagtaatctatgctgacttataacgatcctgatctttcctaaaggactcttaaatgttctagaatcctgcccaagagggacattgagctcactggccccagagtagtgatgtgattctagtgtcaaccctgtgtctatatactggtttcatcacttacttgctaggaaatcttgaacagcattcccaagtctcagtttccttagtgctaaatggtagtgaaatgctattttataggatccttgtgaggagtaaataagataacatatacaaaatcctaagcacagtgtttggcctgtagtaggagctcaattagtaacagctataacctgagaaattcacctttttctccatttccaaaaataaaataaaataaaatgtaaatgtacttttatacttccatgacactctcctcattttctcaaagagatgtcaaatttcacaaacagtggaaaacagttctctcatctcaagtcgtatcaatagatattatcaaacacactctcggtcaggagatgccaagtgcgctgagtacttctctagcatttgctcatcttgccattcaaacccctcttattcatgttgatgctactcagttcattttggagatcatcattctctatagaagcccctttgactagcttactaaaaaaaagagagatggagcaaggtcttggaggaggcagggaaaggtggaggcaagaatttgccgtgggaagaacagagttgctcgatagctcagcatctctggtcccaggaagatatgatttttatcaccgcatgggaagcagggctgacaatgcccagggcttcccggatgctccctcttatcaagttgttggaaggataaattaatagggtggacagatgaatattatcctttattgattatcaactatatttaaaacactgctaggcatgttttgaatttacctaatacacacacctgcacatatacacacaacagagagacaaatatttatcactgaaactcagacagaattaagcaacacaattactaaatgatttggcttcacatcccatgctcttcactataccacatcatttgttcagaaaacatttcatgaactcttaccaagtgctaggtattgtattaggtatcaaaaatacagtgggaaataaacaaaagcacacgctcacaataaagcatgacagtgctgtaagagtgaaagcttggggtgagatgggagcctattagaggggcacttattcctaacctggggttgatagaggaagcaacctcttaactgagcctgagtgaatgaatatgatttagcaaaagaagcataaatcccacaggaggatttaggcattgcaagtggccaaaggtaaaaaagctctgtaagagctgagaagctggaagaaggatgaagagggaatagaaaggtaagtaggaaccagagcatatactgcttcttaactggtgttgagctttagcctataagcaattggtagtcactgggagggcataagcagaagagaaatgtgctgaaatctgtatggtggggagggaatgaagattggaggcagaggatcagtttagaagcctcacaagtgagaaactatgaggacttgcactaaagaaatgcaagcagagatcatgagaagagaatagggatatttagggggcagaactgatgagatgttacttccatgaagggtgaaggaagaaacggaaattaagaatgactcaatttttcaaccttattccaaagaccacatttaaaacacctatacagcttctctaggtacttgcatgataacatttcactttttttctgtaaagtagggagcaacgtcatctactgaaactgagatgggaggcaggaagaagagatctagtgaagatctaaactagccactctgtagaatgaggaattgctgaacagagaaacacaggcctccaggaaagttgagggcccaaatgggggagaaggtcttgatctggcagccctcatctgtgcagatggaagattatctccagcagcactcaatagccagggtaaagatgcagagaagatgaacactgagactggaccatatcaaagttttccaggagaggcagaaaagacaagacattagggcagtggagtttagaatataagagagtggcagaagcaatgaaatatagcctctaagaggagtttagaacataagagagtggcagaagcaatgaaataatgaaatatagcctctaagaggagtttagaacatacgagagtggcagaagcaacgaaataatgaaatatagcctctaagctggatatagaagtgaagggagggtgtgctaataaaaagaaagcagactaggaactagggtcagggaactagagggctctcatgatagcatttcccaaaatgtgtttctcagatgcttattacacaggatgttaatcactgatacgttcctcattaaaagcttttcatggtcaaataagtgaaggaaagtttgggtaatgtaatttttaaactgtttccttcctgtactatttgtatttaataagttaataatatatactgtagttctctaataatttatctctaggataaatatgcatttcccaaataattctgattactgtatattatttatctatatttatcagagaatttcactgaatgggtatcttaaggaacacattttcagagggtctgctctgtgaaatgagaagcagggatggtagaacacttgaaaagaaagtatcttaccaaggcaggaggtttacctgaaagttctcttagcttccagagctatgtatctttaattctactataacacacacacacacacacacacacacacacacacacacacacacacagcttgactctgactctactgtaattagtattcattcatgaaaccaatattccaagagcatgtactattatgtggcagaggagatttatacagcattcttaccaggacaaacttcgtgacttatctggagaaacaacagatacacacatgaaaaataaaaacctggctggaaaatatggctcttcctcagatacccataagacatagtttccctccagggcaactagtgctaccaatctagccacagctctgtaagatcagaaagttcctccataaaaacagagctaactgagtagatctgagctgaacaaactaaaaagccccagtctttctttgctgaagctactactctcccagagtcacccatgatgaaataatctctcctaccccatcagtttgatgacatagattcttgacctggtcctaatctactccaggataataaatcctaaattgattttcttgaatgacaaccaacctgcttttacccagtgtcaagcattcagaattccaactggcacagactagtatggataaaacataatccataaggaagaagtagagatccacatgtaaataatggctagtgccagactgtgaaggatcttggtgacacagctgaagcctggacattccatggggaatgaggaggccttagggatatctgaataggaagactgggagcgggagggtaaaagtaatgccatcattgctaaaaacaggtttagaaagttattcttgggacatgcccatagggtccacgtccattttttaaaaggcagatcaaattttaaaatactttttgtcatttttctccacttcccttcaaagggtctgtgggtaattttcctttctagaggtaaggaaaataggcccataatttctagcttcatggttaaaggtataaaagagtaagtgtaaacataatttaaactgacaaggatgttaaatcaggcaactcacttgaaactccaatggaaaaagagatgaaattctaaatcttcagtacacattgtagagattttagaaaaccaaaaataatatactgctatcatcttattagggaacaaaaatgctaaagacacattagcaaatgtggctttgactgatgtgacataagctgagacctcataccaactaatttaagaagttttaaagatttagatcacgagaaaaacaaaactacaataattatatggtttcagaaaaagtaagtcttccctcaataacttcttcacatactttactactgctatactacaatatgacaatccctaggggttatactaacatcacttgattagaattttggaaacactgaagtctcacattacagaatgatgtctaacttgtaaaaacaaaaaacacagaaagttggctcatgggatttaaaatttgctgaggtccataaaacaactgcagctataaaaaccacttatctgttcaacttcaaaattggttttcactaaaatctctgtgacaaaaagtcatacctatacaatcagttataacaaaattataacatgtattgatttttgtggatgtcaaatctaaaagtcactatacaaaatgtcagaaatctgtggtataaagtatgatgtcggaaacatcatcattagtctctcttccttgaaatataatacactgcaatctaaatgaattagattctataaagactcatttttcttaactattatatatatgctgatgttcaactatatgactgcatgaaaagttgttcatatagtttcataaggagctcagtaactccctaaagacacaaaaaagcactcaatgatctaattgatctgttaagaatcataaaatttgagttaaaaattatatcagcttatggaaaattgatattacatgttgatgaaaaatgtgttaactgttttaccacagagtctttgtgatccacttgtaccccaacactagctggttctggaggccataagaccatcctctgcagtggagtgaggcacgttatggatgcagaaaacttactctagtcagatgcccagctaggaatttcaggaaatccaagatgtaggctgctttccaggaaaaaggcacagaagacccaccaatggcaggagatagaaaattcatactccacccccaggattatggcaatatagcaatctattacattttgtgcttcatgatcctctctatccaaagtacatatgcaaccatagtgggctacacagaactagggaatgtgaagaaagcagcagtactgagccacgtgacttgaagttatgggtcagacctcatggcggagtagcaaaaagaaaagggtgggcaaaaaggaaatggaagtatctgagagaaaattctggtatccattttgcagtaccagcaaatcacttgaatatttacaattttctaggttctacaatgctagaagtcatgtaattctgctgttctgccatggagaggcaatactcttcagtggaaagcagcctagtgcttgcttagactttgacactaaccacacaggactagggtaggagcatgacaggaagaaaaaggtcagttggtgctaagagaaaattcatttttgcctataactgtgaaatcacaatgacctacgatgttaactgcagtatcttaaaaaactgtttttaaaaaagagaagtgctagtctgtgaaagcattcctattgtcatcactttgtaagcaacagaggtcagagagaatgtttgatcatcattttagccactgcagcacccccagcactgtgcctcacatatgataagcagcagtaaatattcatgcaactgaatcttctgtatgagcatccctgtctcttaatccttctttctagtgcttcttattttcccaccttatttcttcccatagctcgcactgctctttgtggtttaactgataatttggacaacataaaataatagtctgttgaatttactggaagataattttaggttcacttttttaattgggaaagtaaatgttaggaacactatctttttctctctaaaatactttgcaaattaagccgtgggttagcaaccttcaacagaaaaaagttccataactctaagttgaagatgtgttgttttctgctatattaaaatacaattttaaaaaggtgacttgtgccatactcttttttactgttacataaatctaagaaacaaaattttccacagttggctataaaaagtaacacagaactagcctggttcctataaaagtatcctttcgaattagaaaactaatatttaatgtaaaaaagccacatacttttcatagttccatcttcttcttcctcatcctcactgtttatcaccatggtccccaagtcggattccaacatcgtgctattatgttcaatcatggtctgggccccttcactcatcgtgcttgtggcccgcatggtgcccacactctccacactagtcttcaccatggtgtgggaatccagctcatcttcatcctgcaagcaaaatactgcaatgagggaagacttttctatgacagctggatttcttaattcttaacaagagaatgaatatattatagttttaatacttattaaaaatactattagtactgattttaatataaatacatacatacaaatgttattttaagagtgaaaattattcaaaataacctaaagctttaggtaattacagatcaagcaacagaaactgatgaagtagaaggctgctagttgcttttaaaataaggattaagataggtaaactatcagcaaatgcataacaaagaatatggtgacaaaacaactaaatatatatgagagcacctttaagacagaacacattgacactttgtattataatgggcataatgatgtctataaccttgtaaaacagccattagctttttcttttaaattatggcaaaatatacaaatacatatatataaaattcaccattttagcaatttttaagtgtataactctgtagcactaagtatatttacaatgttgtgcaaccaccaccattatatgtttacagaactcttcattccccctttccccagccctggcaacctctattgtacttacaagaggtatctagaataggcaaattcatgagtactactattcataccatagtactaattcataattactattatacttatgaatttgcctattctagatacctcatgtaagtggaatcatacaatatattttgctgagcctaatgcattcaagattcatgcatattgtggtagaaaaatttcattcctttttaaggctgaatgatattccattgtatgaatacaccacattttgtttccctatttatctgttgatggccatttggattgttgacacctttggctactgtgaatagtgctaatgtgaacactgacctacaagtatctgtttgaatccctattttcagtttggttgggtatctacctagaagtacaattgctggatcacatggtaacttcatatttaattttttaagtgcccaaactgttttccacagtggctataccattttacactcccaccagcaatgcacaggattccaacttctccacatccttggcaacacttgttattttccatttttaaaaaataatagccatcctaatgaacatgaagtgttatcacattgtagtttgatctgcatctccctaatgactactgatgttgagcaatcttttcgcacgcttattagccatttgtatatcttctttggagaaatatccatttacccattttaaaatgggttgtttggtttttctgttgttattacaaattctggatattaattccttaccagagatataatttgcaaatattttctcccattctgtgtgctttttacttcatttatagcgtcttttgatgtaagtttttaattttgatgaagtctgatttatcaattttttgcttttgttgacaaatctcagcttttaaatgtttcacagaagaatcaagtcagtaataaaagtacaaattaaaagtgctctttagaacattcaccaaagatatactggaatagggtcataaaaataaattaacaaatcctgtttgaaagaccaactgataatcacagtgctttgggaggtcagggcagaaggccaggagtttgagaccagcctaggcaatgcagcaagaccttgcctccacaaaaaatttaaaaattagctgaacacggtggtgtgcctgtagtcctagctacttgatgggctgaggctggaagactgcctgagctcaagagtttgaggctacagtgagctatgatggtgccactgctctccagccggggtgacagagcaagaccccatttcaaaaagaaagaaaggaccaaagaatctgctatttagaaaaacttgattacgcacggaaattcatttatatttattccatttttagtagaaacatataagcaaaatctagttctggcagaggtcaaaatgcaaatctgagaacatcaatgttgagtttcagcaacttgggttgtataatataacaacagttggacagctgtttgatacctttcctcttcctaaacctacatgctaagcttgggcattaggtctcaaagtcgtttgcacttctttcatgatcctttctcttttagaagacctcttcattctcatgccttcaactatctaataagttgaggagtctcaaatcctgaaatcttcctatgtctttacttattacgtaaatacttaaagatgtctaaaatttgacagtcccaaatcagatattatttcatttatctctccagtctctcctatctgtctccatccccaacaaccaccacaaagcatggtaatcttcacttgctacataaaacttcaatgtcttcttacatttattttctctttcattccctatatatgcatcagtcaactagttctttaaataattctctcttagctccatctcttcttttccattcccactgctactgggtataatcctcactacatcataggtggtttactgcagctaatgcttcctgactgaggactctcccatctaactttctagagtcagacagacattagttcaaatcctggctcaaatcacttatgaggcataggatccttgtctccaaagattgatgattaaataaaaaggtaagcaaaatgcctgcatgctacctggaacaaggtagtttcacaccttcctcaaagtacacggcattatactaacctttcttgaatactatttctatcattctaatgaagaatctacaatggctcccagttcctgccttcattaaagctaaacatttctgcctaaatttcaatgtcttctatggaccaatcctattttcccattgttcatataacctccaatacaggcaggctggactttaactgaatctctttgccataactccatatgatgctatgttcattaaagacttcctttgtgtacgtcttattctctatccagaaggtccttcccctctatccatttaactaaatcatacctagtttcagatcaagtatctactacttccatggctaattcagtctttgttaattattctcttttctaaacttccatagaatttacaaccggcattagacacttctgtattcaatttatgatctcatattgcaagcaattgttttgcaaaatcttttataaatgtaagtaccctatggacaagaatgtcttagagtacctctgaatccactaaagtgcttcattcagtattcaaaacacagtaagggtttgtgaaagttgtcagaatcaaaatgaagtcatttctgtttaaaacaacaaaaaaacaaacaaaaaccaaccctgacaaatggagcaagggaaagccataaagagatggtcctcatgcataaatgcctgatagcgaaagctatcacaaaagactgccagaaccactatcttgcacaaaggccattgcaatcttacatgaaaaatactgcgaggacatctacccagcaactgcctatccaaccacagactggcgcacaaggataagcacttcaaaacaattaggcagttctccccatttttcctttaaaaacctttgtcttcctttaccccccgaatatgcacattgttttgtatagcacctttactcgcactgccctattctaaaataaatgttactttcttttagagagtctttgctatttaggttgacacgttcaatacatattgactttttcatggaattataaaatcaaggacctttacagttagagagaaactaattcaaaccatcattttatatctgaaaacactgaggtccacagaaaataagagacttccctaaggtcacacacctacttaaaagtaggtctgggactaagaaacaagttcttttatttcttagcccattattctactatatacatgtacctgaattatgtttaaatttttctctactcaaatgcttaagttggagatgtaagctcacaatttttaaaagcttatatcaccaccttctattcccagagtcccatataaattattccatccattctagtccaagccaccatcttctcccacttggagcatgaaaatagcctactgactgttcttattgtttccatttttgccccttttagtctcactcacataggcagattgatcccttcagaagacaaatgacatgttactctcctgctaagaactctgcatttggcctcctatcacacttagaataagatccaaaacctttatcatgtccaaatgtgatctggcctatcccatctagtaatatctgccaatcccatctcctatcacattccttcttgctcaccaagctctaaccaagctgacctcctttgctgtttcttgagcattctaaacatgttcttccttttgagcctttaaattggctgatctctcagactggaatgctcatccataaatcagtttgataatttatttaactcaggtatctatttagctgtgacctcttcggtgaagctttttctgaccaccaatctaaactaaagcctccatcattttccattcttctgtattcttcacagtctatatctggcctttacgaccactagaatgtaagtctgatgaagacaagagactgttttaacctctgaatcctcattattaaaacacctagcatacagtaggtacttgataaatatttatttaatgaataaatcaatttatattttcacttattaatcatccaacaagcatttattgtacatcaagtagtacaccagacattggagatgaataagatagtttaattccatttcagtttttagggagtttgagatctaagggaaatctactaccatgtgaacaataagttacaggacaatctattaagtgctacaagaaaagtgttgacagtaaaatgggaataccaagagtagagcctctaactctgcctttagaaagtgaagaaggtctcacagaggaggctgaacttgagtcagctcttaaaagatgagtagactatatatttaacatacaacagatacatttgggtggagtgttttacaactttttacattagaactacactcagacacattccttctcagctcagacaccccaagattgaattaggtgtcatgcctctgtattcccatagtactctgtgcttatgctgattttacagtactgtaattgtctattcacttaccttgtctaaatcccccattagactctcaaatctataagggcagtaaccacatcttgtttacagttgtattcctgatgtctggtaaaaagcaatgttcttattatgtaatttattgaatgaatgttaaatgcctcattatgaggtaatgccaaaacacagaatgaaggacaattttatgaggttctagtaacatgttcttattataaaacatagaatagctattaaagatattatactttgggacaggaaataatgccattaactacaattattcagttgatcatttatttaataatgaaaaaacacttatcaatgagttagaagcactatgctaaggtctttttaattctctttcggctgggcatgggggctcacgcctttaatctcgacactttgggaggccgaggtggttggatcacctgatggcaggatttcaagaccagcctggccaacatagtgaaactccatctctactaaaaatacaaaaaattagccaggcatggtggcacgttcctgtaatcccagctacttagaaggctgatgcaggagaatcatttgaacccgggaggcagaggttgcagtgaaccaagatggcacctgggagacagagtgagactccatcccaaagggaaaaaaaaaaaaagtctcttattaaccctcagaggtgctattattcctcttaggcaaaggaacctgaggctcaaataggtttcataatttgtccaaggtcatacaacaaataagtagagaagcaagaattctaggcaggtctaattctaaagcctaagacctaccttctaattatgtaaggcttttaaactatctacagcatttctcaagccccatttaactcatactacaggtttgcaagaacatgtttcattttccgaagtaaagagatgaagatgattttctatcagttccttttttcaaatctgctggttgaatatcttattttgtcacggttgcaaccagtttattcccaaaacactaactctattttaacacgtgtgagtcatttttctcttatccttgtgagattcaatgctgtgaccattaaacttaacaagaaacataacatctgattggtataaaatagtccttagcctccctatattctacattagagttgaatctacaaagggacaataaagcctgaacctctggattcacacaattggcttagataaaattgtaaaaacattgaattaagtttggaagggattgatcttactgcatattatttttacttacgtagtcaatttgctaaagaatgctaatctaatttacaaattgacagtaaaaaatagcaataaaaatagcatgaacactcaattcactaatgagagggtgacacacaaatagaaattaataaagtacagatggaatgataactagttaaacgaaattagaaaactcacttataatttggtgatggtgttgaaaacttttaagccacagcttttactttttaaaattcttaacttattcttgatattttagattagtattataatttcatttgatactttttatatttttataatgaaacatttatgttttttcaaaattatatttcacttacatatactctgttattcctcacaaaagaaaagcagaagaaaaacatgttgatacttcatagaaaaaggtctgcagaacagatgcttccccactgtagaaagcagccaattccagtaaggaatacaatagcattttcaatcagtggccatcatgtgccaggaatgcaaaacacagtactgatgataatccagtttatgaatcataaaatccacatggaatacaaatatttgaaaacattattaggaaatcctactccactgctaagacatgcttatgctaaaacagcctgagaaataatcagagattttgcattatctactagtagatatttgtaatatctactaccttaaagcattttctaaatactcagtaattgactgaattaaggataaaaagtatttatcacttgtgagactaatttgtcattagtgtcacaaaagacaaatactttagaatataaaattgtttctatattctcaaaatgtttagaatataaaaatagaatatttctcagttaggatacctgtttagtgagacagttagactactccttaaacaggtgtcctaaacggaaaatattctaattttatttttcttcttaaaatgacattaaacacttctttattgcacatgcaatcacataacagcatagtatcagtatcagagcagtgatcttaatggctttcattcaactggacaattctaacgagtatgcattctgctatagcatgaaaaaaatattcttcagaaaaaaacgtgtaaaatatatacttgaaacaattatacaaaaagttgcattatagtggtctaaatatttttaaaacctcttaaaggtgctaattaaacagcaaacaataaatgtaacaaacatactacaaatacatagctgagttttcaagatagtaagggctcaaaacggagctatggtaataagccaaatctaacttgaaggcttctttagaggcatgtgatgatgggggtgggggattagtggttaaataaggtttatattttaacagataaaagggaaaagggaagtatttggattctttccaaagtagaaatgaaacctccacttaaaattgggaattttgaaagtctacatcctcagcaaaaggataggcaagaaacaatttacccagtggcaaaggagatgacaagtcttacctgagctaggtaaggtaggggacagggattgggaagcctccctaaggtaggggacagggattgggaagcctccctttagaatttataaccatggtttaggccttcaattttacatcactcacacgctctaggggaacctcaaactgagaagttaaccaaatatagccccagtaaggtagcaccccaggtgcctgatagaaacaaatacaaatccatattacagggacgcatactgaaccctcaactcacaccattctcagagataaaatctagccaaacgtgaactcactatcccaaagataaatacatgagtaaacaagccactgagaatgggtagaaagaacaaacaacagaattaagatgcccttgctccttagaattaatttagtccccttagaaagctggatcttggggtaaaattagggaagaatagacagtggcattctaaactgcagaaataaccgagaacaaaagtagaaatattccagctagaatggaaagcaatgagtaagtttgattgaattagggaatgtcctacagctcatggatgctttcaacactgggagcccagcataagttgcttggcaaaggagtgataggaaccttgggaactaaaagatgatttggagaagggaaagactggagaaagactagaatcagacggttattactagaatccagatttgaggataattaattagagcctgtactaaaaagggtcatatagtaacagaaatgacaagctgaatctgaaagaaatcaccaaagaggaattaacattttctagaaagtttctaggcagtcaaatataatggatcaacaataactccaatattcagaacctaaagagatcaaactgaatctaaagagaaagttgagagagattttaatttgaataaaataggtaacaccagttatttgtaatcaaaaaatgacttactatactttgtcacttgaccatatgatcaaggaaatgaaatctaattattcattttcccatcaagtaagaaatcaacaaggcatgtccaatgcaactgcaagatgagcacaaaactggggaaaactagggtaagaatctttcacttctttcctcatgcataacggaattcgggggctggtgactgcttgatgctaacatgttaacctaggtcgataaatatattttaatcactgagttagaaaggcaaaaatcaaagggtactatcgtacatttgcttgtatgtctcgaatcatgtaagattcctactaaactaaaaacactctttcctatagcaaggtgaaactactgatgtgaccaacagagcattaccttgaaactgtacttccaactctggtaaaggatagcagttatcccattgtccttgttattaatacacaaggttgtacctgtttgttgtttctgtgttccaagtgaaattgcccacagtagatcaactggtaactctgatccaactgagctaaaaattactgagaaaacatcaaaaatagtctctttcaaatagccgcccttaagtgccacttcaatgtctgacgggctgaaaaaagtaacaaattggtattcacccattaaaaactaagatttacagtatctgaaaatctataaaaagaattaattgtcttctcactgctgtaagtaggtggtctttccctttcactacgaaatcagcttaatagcttatacagctgctgtctttgacatacctgtctttagcaaacagaaacttcatggatcctaactttttgcacattcacaggcatgttttaaagttacatcaaagctttcaggatctccaaacgtcataaaagacttattcatcagtataacaagcctaattggtgaaaaggcatgtgggcaggacttcagaggctccatgatgcaagactgtacaagtttttggcattataggagaagtttccaaacaaaagattaccttacatctcctgtgcacaatactaatatacaatagagtaaattaaaagtaaaagcaaccttaaccgtgacatttcttttttctttcacagccaaaagcatgtcaaaggattgacaaatataaagaaacttataaaatcaaatattttaaaataagaatgacacctttaaaaactgttgtgttcttacaagcagtttataaaacatccacaagagggaaccaaagacaaaagactaaaattccactatttggagatttacacaaataggtttataaaataggttattacattaactaacataccatcaatagctttcagaaataggctaatggtttcttgatacatttttaagcagtgatatatttaaaaatactgtaaccactgtcatgttgatacctttatataagcaatgtttatgttcctcaaggacaacaaatgtctttcacattcagtaacctccacttgcatataatagcatgaactcaatgaacaggtggtgattccacaaaatttatagaagtatacaaaagtaaataatgaatattcatattaatttatcaaaacttcattctaaattgcttttatatgaaaagatttatgattgtatatatcttatgttcttagaacaaatacaactaagggctaaagggtctttaaaaagatttttttcttttcttcattctttctttctctcattccttttctcttccattatgatagtatttttaagagttagcagaaattttgttgttgttctttttggtttgttggtagtaaacagaaattttaatacataaattgtatttttattgtttaaattttaacaacagaaatatcacctacataaacttagatataattttgtaaaataattttagaaaatttccaaaacatacaattcaaaagaagactacttgaaacatgctaaagtaacaatattgattttaacatacagtttacatcactgaacttcctgataaaaatgaaattctggggcagaaaaatgtcagggcaacaaaaaacaatctcccccacaacccaaatatttttcacacatttgacttaagcattgctgaagaaatacttcatgtgcaagtatacaccttattaattattaaatgcaaatacattctgtgttgatgattttgtggctggcactatccttaatgatgagtaaaagtcaggcaaaacctgtttaaaacagttttatacacgtgtttcttgatttgataagtatttaccaattaaatatttatgtaataaatgtttgctgtgtgccaggcaagtgtgttaaggtataatcttttccttgagaaatgtatagtttaatggggagttacaaaatagacaaacacagtgagataaatattctcagagctaaacgcagtattccatggtgaacacagaggagcacttgccaaactgaagcctggaggagccccatgaaaggcttcctctttccagaggaggcaatggctaggatgtcaagacaaaagcagcaacctacacttttctttaaccactttttgagcaatccaatctatgctcatggtttaactaccaactgcggaaagcactgatttcctaatttgcctgagttctcccttgggattcagaccgctgtatccaactgcctgctacacaaaatgacttaaatgacctatggacatcgcaaattaaataactgctaaagtgatctcatcttacacagaaatacgccttggagagaatactgctggagaatacttcagccacagtgtaagtgcaaagtgaaaaaacaaaggctctgactatgctatcaagaagtttagttgtaaataatttgttgttttttcccttattttttaaatggtcaaaggataactatattttgaatgaggaaaaagggcccagaagaaagggataatgtagctgactaaagaaacaagcagagaaggggccttttgagggaagtaaaaagaaaaccaagagcaataaaacaattactgttcatgcatacctctatcacagtacttgctacattgcattatgatcagttatcagtttatttgtctcactcattagattgcaatcttcttataggcaattaccatgtcttatttttcttccatatccatatttataaatgggaaaaatatataacctctgaaccagggagacaaggaaacatagtgaggatacagaaacatattaaagttaaaagaaaactgaggtctagttagtacaataagaaaaaagttataaagattggaaagaaactatctatatttgcagatgacatcattgtctgtgtagaaaatttcacagaatctacaaaaaactcctagaactaataaaaattagtgtgtgtggcaacgtcacaggatacaagggcaatacacaaaagtcaattgctttcttacataccagcaataaatgactgaaatttgaaattaaaaaaaatttcaacagaaaaaaaacccacttaggtctaacatattaaaacatgtacaggatctgtatacactgatgcaaaaaataaaagatgatctaaataaattgagaaacaccccatgttcatgaatttgaagactcaatactgttaaaatgccatttcttcctaacttgatgtatagatttcattcaatcccaataagaattccaggaagttaatttagaaatgttgacaaaatgatcctttctatggaaatgcaaaaggcctagaacagccaaggcaatactgaatcagaaaaacaaaatttggccaggagaagaggctcacacctgtaatcccagcactttaggaggctgaagtgggtggattgcttgagcccaggagtttgagaccggcctgggcaacacagcaagacaccatctctataaaaaatacaaaaattagccacatgtggcagcatgcgcctacagtcccagctacttgggaggctgatgtgagaaaatcacttgagcccaggaggtcaaggctgcagtgagccgtgattgctgtcactgtactccaacctggttaacaaagcaagatgccgtgtccaaaaaagaaaagaaaaggaaaaagaaaattggaagattcagtgtccaatcttaaaacttctataacactacagtaatcaaaacagcacagtactggcaaaagaatacacacatatatcaatgatgtatcattgaaacagaataaagagctcagaaacagacctacacaaatatagtcaacagatttttgaaaatgacacaaaggcaactcattggagaaagaacagtcttttaatcaaatggtgctagaacaaccggatatccatacggaaaaaaaaaaaaaggacccagatatagaccttacagctttctcaaaaattaactcaaaatgcttcaaagacccatataacatgcaaaaccataaaacctatagaagaaaactcaggagaaaatctatgggaccttgagtttggtagtgaatttatagacaccaaaagcatgatccatggaaaaaagctggtatcatcataataaaactaaacacttcagctgggcatggtggctcatgcctggtaatcccagtacttcaggaggctgaggcaggaggattgtagtttgaggctacagtgagctatgatcatccactgcactcagcttgtgcgaaagaatgagaccctgtctctaaaaaaacaaaaggcaaaaactaaaaactagaaatctctgctctgtgaaagacactattaaagaatgaaaaggcaaatcaaaaatgggagaaaatatttgttaaatacttactttataaaggactcgtatccaaaatacacaaactcttaaaaattcacaataagaaaacagacaacacaatttaaaaatggggaaaaatattgaacatacactttgccaaagatatataaatggcaaataagcatataaaaagatgcccgacatcttcatcactaaggaattgcaaattaaaacgagataccactaaacaccttttagaatggttaaaatgcaaaaacaaacaaacaaaaaccctgaccatacaaactactggtgcgcagcaacagaaactctcattccttggttagtaggaatataaaatgatacaactttggaaaagagtttggcagtttcttactaagctgaacataccataagatccagcaactatgatcctagatacttactcaatgtacctgaaaacttatatccatacaaaagccagcatatgaatgtatacagcagctttatttattgataactgccccaaactaataagtaactattgaagatggccttcaataagttaatggataaatgaactgtcatgtatctctgcaatgtaatactattcagtgataaaatgggctattaagccacaaaaaaaaccatggatgactgttacaaaaaacgtagtgttaaatgaaaaaagccagtctgaaaaggctacataatatatgattccaattatatgatattctggaaaagccaaaactataaatggtaaacagatcagcggttgaaagggggttgggggagagttgattatgtgaagcacaatggattttttttaagggtgatgaaactgttctgtttgacagtacagtgtatcatgtgtatcgttttgatgcctaataccatgcgtttgtcaaaactttacatcataaagagtgaacctactgaggcaggaggatccctcgagaccaggagttctagaccagcctgagcaatatagtaagactcccatctccacaaaaaatgaaaaaaaaaaaaaaaaaaaaaaaaaaaagtcaggcctggtggtgcatgcctgtagtcccagctacttgggaggttgaggcaggaggatcgcttcagcccaaaagttcaagacagtgagctatgtttgtgccactgaactgtagcttgggtgaaagagagagacccagtctcaaaagcaacaacaacaacaataacaaaaagagtgaacccaatgtatgcaaaattaaaaaaaaaaatttaggaggtcaggggatcccagggtgaaatgtagaatgtggcaaaaaaaaaaaaagtaactgtattaaaaatatattgaaacaaattcactgaaggaggtgagaagaaaaggtactaacctaagtaactttggagtaagtgaactgtgaattctgttagactaaagacaaaagaaatgatacataagcagtgtaactgataatgttgttttccatgttttccacatgggttaagaattctgaaaccactatacatgtatactggagttgagaaacttagtaaatgaatgataggagccaggtttctcaccattggagttgtaggttataaacaagcaagaggacccatctagaataataatggattagagtcagacacaacagtataaattaatgtttagtttaatacagatacagatgtatacacatacatatatatacacacacacacgtgcctacatatatagttataaatgtgtatatacataggctagtatacacacatatatctccttgcctcataagctgagagggcacagaagcaacaacatcccacagtacaaaaaagtccccctggaatccaaacttgatttcctacagttttccagtaaaaggaagtaggctccttattctagtactggaacaggaaatatacaagatgagcctagaatatcttatagtgtcagagagtaaggaagagctaaaaacaaaacaaaaccgcacaatgatggggatatgtcatagggacaaaggagtcaaaacaaaaggttcccaatggccaaagctggaacaatttaagcaaaataaataaataaataaacatagtagtattggattataatccaaaatataaactaataaccatgagtcaatattgatgcgaatgactgaataaatggggagaagagacaaatctcctgtgtagaaaaaattctaaatactccatcctcaagaaagtggagaataaccccccacttcttaaatgtgagctgtgtactgtgacttccttccaaagagtacagtatgaaaagaaagaaagaataattttactgtaaagaaacatgacatgctacctcagtcatgtgatcctggttaacatcaacagtggtaagtcatgttgacagaataatttactcttgatgtgatgagacttatatttatctctgggtcttttcaaaaaccaataagcctcgtctcatcattagaaaaaaaaatcccaattgaaggacattctacaaaatgtctaaccattattacccaaaactctcaaggtcaccaaaaacaaggacattccgagaggctgcgacatcatgaaccctttctgtgcctggcttatatcatttaacgtcctccaggtaaatacgtgcttgccacaaatgacaaaatttcattcatttttatggtatatacataccatgtgaaattagccaagcacagaaagactaaagaagctgatctcatggaagtagagagtagaaatggtggtttccagaggtaggggaggcttgtagaggctaggggtggtagggagagattggtcaataaatacaaaattacagttaggaggaataagttctggtgttctgttgcatagtacagtgactgtggtcaacaatactgtatatttcaaaatggcagaagattttgaatgttcttaccacaaagaaatgataaatgcatgaggtgatggaaatgctaaatattctgatttgatttttacacaatgtatacatgtatcaaaatatcacactttaccctgtaaatatgtataatcgttatatatcaattttttttaaaaaagagaagcctaaggagacatgatgactaaatgtaatatggtaacttgatgggtcctaaaacacaaaaagaacattaggtaaaaactaagtaaatctgaaaagaataggcactttagtttcaaatctgtattaatattggttcattatttagacaaatgtatcatacgaatataagatattaataacagggaagactgaatgtgggtggtatatggaaactctctaaactatttttctatttcttctataaacctaaaactattcaaaaataaaaagttaacttaaaaaattgagaaaatcctttgctttttaatttgagcaaatatttattatctgttttatcacaaggcccaacactacaacccataagtcagtggttctcacccaggccacacattggaatctgttaggaaggtttttaaaaaaatcctgatgcctaggccctagcctacaaaaattaaatgagaaatttcccagaataaaaatcaagcattgttttttgtttgctttttccaaaagccaccactaccacaaagagaaagctcaaatgatatagcaatttattaaatattttacatactatatcgagtatcacaaatcccaaagaatcatgtttctattagaggtaataaagcatataaactctaagtgattaatgtctacaatttttatattgacaagaactctgtattccattacttcaccaaaaactttttgcagtttcttttcagagtatttttaaaatattttacaaatttcaatatgtatatgcttttaaaaaatgcacttaagtacattctattttcaaaatagcatcatttattcaataatatattttaaactttcatatggcagagacaattcccataaatttgctttatatcatacacaacactaccgtagaatgctccttggtaacaacaaaatgttgcattttgaagctttattgcatagaaagaccaattttgttaatacatactctttaaaggtggacttgccataagcaattcaagtgtttacagtaaatatgaacaaacagatatattatttaatcaactcatgctaaagatttgggaatatcttccactaatatccagaaaacgaattcttactatgtaatacagttgacccatctcaacacctaatttacatcacatactcagaaatgccaaaagaagatctttgtcatatttaacaacacttaaactaacacaaaaactttgatattggattaaccttctacagaaatctctgtttgcaatttgtttaattttagaaatctgtacaattacctcagcacctatcaaaacatgtcaatttgtcaagatacattctcatcagacaagctttttctataataggtataaaaatcaaattcataaggcactatttccaatcatgctccatacttttcttgaataaaaaatattttaaaagatttgtttataatagttacccagggcacaggtgtatgcactaaaattttaaaaaccaacatatcttgtaatggttatcatataccatttcctttttaaaagccacattataaattgatgaaaatggcaatttaattttaggcccctaatttttccccaactgcaataagccaaactagatagaagtaaattaaatttggaaatttttctttatattgttataacccatacattttctgaaaattatgttaagaatgcaggatccacacacaatagacccaagtatcaatacttgatgtgaaatataaatctctcccttaatgtagcagcgaatttcagttctgaaattctgaaatcagagaaaaaatttgatctacattatctaaaaagttagttttatgaaatttttcaatggtccaatgctaaacttgctctgtgtcattatttgctccaccactgcttaaggaccaatccagagtctggactggaaacagctacagtaaaagctgccagagaatacaggtcctctgggctgaaaataaatcagaagcaaaagttggcaatacagatctctcaccatgctgaaaagacctttcatccatgaaataatcaaaaaggagaaaaaagaatggagaaaaatttcactgaaaacaactgggacaccaaaatatccatctaaaactttccgccatatcctaaaagaaagtcagttccccagtaccaaaactaagtaggtaatggccaaatgaatccctcaaactaaagcaaaagaaaaaaagaaaagaaccagaaagtttcatgggccaaaggtaaccaagctaagctgtgaacacaaacaagaggttgcaatgcaacaaccttgacttaacagatacacatgttaagtcaagcacagtatcaattagataacaaggggtccaagcttgtactttcgttccataacctagacaaaattattgtaaaagacacagtggttaagaaaaagaaaaatatcatttatgtctattctttttgttgtgttgttgagacagggtctagctctgcagtggcgcaaagtcgactcaatgcaaccttagcctcctgggctcaagcaatccttccacctcagcctcctgagtagctgggactacaggtgagcaccaccatgcctggctaatttttgaatttttggtagagatggggttttgccatgttgctcaggctggtcttgaactcctgagcttaagctatccacctgccttggcctctgaaagtgctaggattacaggcatgagccaccgtgcctggaccatttacttctattctaatcaactataaatttggatatgatttgctttaattgtcctgattccttgtaatgctaccttacagaagttttcccttccctgcttgtcactttgacaacttgtctaaaacaaatcagaattgaacaaactatgattttttctttgaattgttctaatttatgggcactcaaggagtttgttaatcactgaaatatacggagggttttatagatttataaagagatcatattacaaactcaatatcaaaaattataattttaggccaggcacagtggctcacacctgtaatcccagcactttgggaggccgagacgggcaaatcacttgaggtcaggagttcaagacctgtctggccaacatggtgaaactctgtcactactaagagtacaaaaattacccaggcatggtggcaggcgcctataatcccagctactcgggagactgaggcaggaaaactgcttgaacccaggaggtggaggttgcagtgagctgagatcacaccactgcactccagcctgagcagcagagtgagactgtcttagatagatgatagatagatagatagatagatagatagatagatagatagatagatagactgatttaaaaaataaaataaaaattataattttagaacagtccaagaaattacaaatggcaggagctcccatcaaaatggagattagaacacacaggtttacacctatccctctcaaaaccctctcaaaactacaataaagccacagaaaaggataaaccccaaaagacaaacagcacaggaattgaatagataacagtatatgggagatgtcaaaaatgtggaagctagaaaaatgtttggaagttagaaaacagataaatatgtaagcagctaactcagcagaccaaaaataagacttaagcttgcaaagagaaaagtcacaagaagcatgtgaattcagagtagtgaaccctaacatcttttacagcaaaatttgctggtcaactagttccactcttacacacagagctgccagaggtaattttagtgcttctctcaaatataatccccgtacatttgaagaaagcccataaagtgaaatgtcagagatcaaaacaaacacaaaagaacagacacaaggcagggagcaaaagataactcaaaataataataatgaaataataacgtagaagagaaagctatcttagacattaaatatctgatatgaaaaaatagcaagtttggaagataaacttgaggcaatctcagaagaataaaaagagaaaaagagggaaaaggaaacagaaaagataattgaaagactaacctaaaaggttcaacaaccaaataaaaggagatccagagacagagaggagagacagtgaaaattaccaagaaatagcaaacatgaaatcacatagaactgaagggtgtttccagatttaaaaagtcaaaagacactccatacgatgaatggggaaaagatgtataccaaggcacattattaggaaagttttaaataacagggacaatgcaaagatccaaaaactcccacattcaaacattcaaagaatcaggtatctgaatggcatctatcttctcatcagcattattgctgagcaaggaaaaagagcaaggtcttcaaaattataaaagaaagttattttcaatccaaaattttacacccaatcaatcaatcaatcaattaagggtaaatgtacaataaagacacggtcagatatgcaatgactgaaaaaaactgctgctgtcaggaagctactgggagatatgatacataaaaataaggaagtaaaacaagaaagacagaagacagcatcagggataaagagattacagaagaaaaaaaagaggacattccacaggttgatgttgaaaggaagtcttaggatgacagctgctcaacactcctaaagaggaattagttccgattagtaaaggacagaagactattgaagggatgaatcaataaaaaaaaaaaagtacggcattaataaattgtgtttgaacatacacagaggagctcagagatccagcagagagtttgggaatatagcatttgggaacaaactagtgattagaaaactgtaaaaacaacaacagtaacaaaaacggagacaattattggttctgaaaatcacaaaaagaaataacatgtaatgataatatgatataagtgaacagtatttacacagttataactatataagaatttgttttaattgtgattacataggaaaaattagacataacaagtaatcaattcttttacaagttttcaatttgtggtaaataattttatctgaaatatttcttattaaataaaatttactttttaccatgtaaaggaatgagaataagtaaatgttctttactggttttcctcaaaaaaaaaaaatatgtgtgtgtgtgtgtgtgtgtatgtatatttatacacattttcaaatatatgtatacaaatatacatatctatacttatatttaggaaaaccagtaaagaacaaatacatattacatattaataaaaataaaaatattaaagaatataaaaatatatattgtaaaaatataaatatataataaatatataaatatatatatgttttttctttttagacagagagagagagagataaagagagtctcactttgtcacccaggctggggtgcagtggcatgatcatggctcactgcagcctcaactgcccaggctcaaaccatcctcccacctcaggctcccaaatagctgggactacaggcatgcatcaccaagcctagctaattttgtgttttttaatttttttttttgtagagacagggtttcactatgttgcccaggctggtcttgaacacctgggctcaagcaatcagcctgtcttggcctcccaaagtgctgggattacaggcgtgagccaccgtgcctggcccaaatatatttatttttaattttaaaactagatttaatatctaccaactcttccaaacatatttgaccagttaaaatttgttttaaaatgttttttaaaaaattgaatctatatcagttcacaccagatcagtaatgttattttggtggccacaaggtagggcaaaaccagtaagggcaaccagcaaaaaaaacccgaaaactaaacaaacagaacaataacaaaaacaaaaaacctggccaaaatgttacaacagcagtagtgatggtataagtagtggcattaataaaaacaaaagctaaactttattgagcatactatgtgcaaaacattgttctaggtgtgtatatatgtaattatatcctcataacaactctatttgcagatggtaaaactgaagtagagaggttaagtaacctgcccaaagacataaagttatttgggaacagaactagaattcacatccagatagtatgatctatttttagataatgcaacctcccttttaccaagtaagtacattacaggcttctggactgacttgggctaattctcctgctgttcttttctttacctaattcaaaaggttctcaaaaggtagacttttggccagaaacagtggctcaggcctgtaatcccagcactttgagaggccaaggcgggtggatcacttgaggtcaggagttcaagaccagcctggccaacatggctaaaccttgtctctactaaaaatacaaaaattagctgggcatggtggcacacgcctgtaaccctagctacctgggaggctgaggcaggagaatcgcttgaacccaggaggcagaggttgcagtaagccggggatcacgccactgcactccagcctgggcgagagagtgagactccatctcaaagaaaaaaagaaggtagacttttgaaggtccctattgaacaggggtaaggggaaagaggggaaggcgggggaagtttctgtctaagaaatgctcacctgaaactgtatcaccacctgaggggaatgggttattcaaagcaccctggcatttctccccacacccatgctgagaattaattgctttagtgaagcatgtttaaagagaacatgacattattcagacattaaggaccgcaacctgaacagctctgagttcagaccataagaggtcaccagaaagtcctcatttcttttccaaggatagaagctctaagacatagtctaagaccaattagacttcttttctttgagtcattaataagttaatatgaagtcaaataacacctttcttcagataaaagtaaaggacctgatacatgcataaaagtgaaaagatttcattcaagcttaacatcaaaaagtatcccattttttgctcaacatttcacttaaaattcttctacatccatttaactccttgtattttacttaacattgtgatccttaagaaacgtctgagctccagtgacaagcaattcttctaaactccttatcagtcttttaaagtgctttaaaaatagcatgtcaatgctacattctatgccttatcttataaattcaattaacatcattctgctttgaaaatcatcatccaatgtaccacatgtagaatatttgctttgctgttttacttaaaaacaagtactcttttactgtataaatatttaaaaactcattcaagtacctgtacaatattcaataagccataccagcaaacttacaaattagtattttaaaaatcatcaactaagttcaagaaatacataagaatgaatactgcttgttgtgtaactaccaaattaccaaactgcatgcttacattttgaatactagagttaaactagtactaactgcacaaatcctgtatgcctgctttttatatacacaacctagattaaactttgtgttcatttagtcaaaaatgaatgtaaattttataaaaaatattttacttttatgaaaaagagtatcacttcaatgaaataaattgtcctactgaacatcaagagatgtgtagtctatgataaattagctgatttaaaactgtatatgtaattcaatttaagccaattcacaaaagaatcccaaaggaataaatgatataaactatttaagattctgagccttcaatgtggataaactttcctgagaaattacatctactaattttaaaagttgctaaaaataaatggcaatgtaggatatacatttactgtagaaagacttcagattcattctgcctatctcgttcttttaagtgcttgtgagagtgtatgtgtgtacatattgtatattttctatgcagggcaacaacagataaaataacctcaaaatggaagctactgcctgaaaaaataatctgaagaaagcatgtgaatattgctcaatgtgtgactctccaaactttttacttttttcttataatttcagtaaaaaagactataagagttttacccagaaacactaagctttgccccagagaataaatgtttattcaggaaaaaaaaatcataaaaacctgacataatttttaagtgctcataatatttcccctcaccttgaatatggacaggaccaagtaacatatacctaaaacgacttggtatcattggatttgaaactaagcagtgggcagaagctagaagcactttgaagacagttttagtaagagcctgaagagtcattaaaaaactgtcagaagcctgacagcctttaagaaagtttcaggaaggtaagggaaatattagaaagctggagaaaaggagattcttatgtggtggcagaaaatttagaaactgttgtattagtccattctcacactgctatgaaggaatacctgggtaatttataaagaaaagaggtttaattgattcacagttccacatggctggggaggcctcagaaaatttacaatcatggcagaaagcacctcttcacagggcagcaggagagagaactgctgagcaaagtggggaaagccccttataaaaccatcagatctcctgagaactcattcactatcacaagaacggggtggttgttccctgattcagttacctcccaccaggtccctcccatgacgcgtgaggaataagggaactacaattcaagaggagatgtgggtggcaacacagccaaaccatatcattctgcccctgccccctcccaaatctcatgtcctcacatttcaaaacacaatcatgcctttccaacagtcccccaaagtcttagctcattccagcattaactcaaaagtacaagtccaaagtctcatctgagacaaggcaagtcctttacagcagcactccactacttggtaccaatttactgtattagtccattctcacgctgctataaatacctgagactggttaatttataaagaaaggagacttaattgactcacagtttcacatgaagcctgaggaggcttcaggaaaattataatcacggcacaaggcaactcttcaaagggcagcaggagagagaagcgccgagcaaagagggaaaagccccttataaaaccatcagacctcatgataactcactcattatcatgagaacagcatgtgagtaactgcccccatgattcaattacctcctaccaggtccctaccatgacacatggggattatgggaactataattaaagatgaaatttgggtagggccacagccaaaccatatcaactgttggctataggaaccagaaaagtaacaggaaaagtaaaaaatgtacctaatgaactgggtggtctagcaaagcatgtaagatgttgcctggtttcttcttgctgcttataatcaaacacaaaaggagagagataagcttaagaaacgacaattaaacaaaagagggactgagacttgtcgattttgtaaatctccagcctctatagacagcaaaccatgctacagttatgagacagcttgcaagcaaacctcaaatccaggcaatagtcaggaaattatggtctaaatatcaagctgaaaaggtgactgtaaaatcctttgttcagatttctgacagatccatgcagttcctcaacagggcttctaagaagcttaaaggcattgtccctgcacaatctcatcaagaggccaaaatcagggaaacaattatctcaacaaaatgtatgagtatagattattctaatggagtaagctgcaatgagatttataggagacccacaaagtgtttttggcagaaacactaccagcattgactgcatagcacagagatgcacgaaatgaaaagagggctttggactccaaaatttctaaccacaggaagcaggctgagaaaactatctagctcaacacacaggctaccttccatgaaaaaggaagaactcagtgggcagagcaaaaaactcagagaacacagaaaggagccatgaaaaactatcctgaggtaggaatagaacttagttttaatgaagaaacttctaacatttgcttggctggattccaaaactgctatggaatagtgactcgtgcacttcctgtcttcctttttttttaaacagaactacccataatgatataattttatgcctgacccaccattgtacattggctattcggggtggtgggggtgaggtaagaaacatctcttttgtttataggtcttcagattgaaaggaactggacccaaggaacattatctctatctgaatgtaatttagaagatgacattctagattttgagctgatattgtaaagaaataatacttggggtagatgggatagtgcgtgtattttgcatgggcaaggaatgtaaataaggtgcggccagaggatagtctgagccagttttaaaacataaccataaattctttggcaattctcccctcaaaaggtggagcctcattcctattgccttgagtgcaggccagacctagtgacttgtttttttttttttaattgaggtgaacttcatatacaaaaaattaaccattttaaagtatacaaatcagtggcacttagtacattcacaatgtgcaaccatctcctctatctagtatcacagcattttcatcacctcaaaagaaaacactgtacccattaaggagttgctctccatccttccttctttcccacaccctgcacaccacaactgggccctgtcctggtctctggtaaccaacaacaatttgcctataattcaattgtaagttgtaagagttctctatacagtttgcttttttttttttcttttaaacagatggggtctcattatgttgcccaggctagtcttgaattcctgggctcgggcgatccacccgtctcagcctcccaaagtgctggtattacaggcatgagccaccgcacccagcttctatacattttggatactagacccttatcagaagcataatttgtaaatattttctctcattctacaggctgtcttttcacttcttgataatttattctcttatgcacaaaaatgtttaattttgatgaagttcagtttatcttttttgttatttctgctttagtatcattctctaagaattcactgacaaatccaaagtcatgaagaataaccctatgtttttttataagagttttaaagttttagctcttacatgtagggtgttgatccagccaatcagatcttatactaaaaggctgctgtatttgataaaacataggggtctaacttcattcttttacatgtggctatccagctatcccagtaccatttgttgaagagattgttcttttcccattaaatggtcttagcaactctgttaaaaatcagttggccatagatttatgggtttatttccagactttctattctattcccttggtctacatacctatccttatgctagtactacactgatttgatcactgcagtttcatattaagttttgaaaacagaagtgtgagtcttctaacatggttcttcttttttgatatgttttggctatttggggccccctgcaattacatatgaatttgagaactgacttttcctcttctgcaaaaaatgacctgaaatttggaaatagatctttaaaatctgtgaattgatttgaggagtactgccatcttcacaatataatgtcttctaatctctgaacacaagatgtctttctattgatttaggtcttttagcaatgttttgtacttttcactgtacaagttttttaactccacggttaaatttatattttaggtatttcattcttttggatgctattataaatggcattgtttgcttaatttcctttttacatttttcattgctggtgcctagaaatacaactgagttttgtggttgatgctgtaccctgaaactttgccaaatttatttactagctctagcagatttagatggttgacagataacaaacaggaagttgctctagctcatggggggctgaaacaaaggtatctgcaccagtccctcagggaaccaccagacaggtcaaaatgaaaactacaattttttttcagaacaaggatcttattgtccccgtcctggcaccagtgagctacaccgggaatatgggttgctggccccatagctgctgctgagctagaaaataaaggatattaggtatataagcaaaaatgtcataatgctttcttatcaaaatctggcactcccctggatgctgttaagttttctatcagattccagagttatgcaaaagttgatttgtcagttttttccagtttaacatagttgcttctgtggaggtaactgattcttagagctccttgctccaccactcacttgcttttaaaaactgggccgggcgcagtggctcatgcctgtaatcccagcactttgggaggccgaggtgggtggaacacccaaagtcaggagttcaagactagcctgaccaatatgatgaaacctggtctctactaaaaatacaaaaattagccgggtatagtggcatgagtctgcagtcccagctactcaggaggctgaggcaggagaattgcttgaacccaggagatggaggttgcagtaagccaagatcatgccactgcaatccagcctgggcaacagaacgagactcggtctcaaaaacaaaataaaataaaaataaataaatagaatgtggcagaagtgacagtatttaactcctgagactacaacataaaagacagtgagaggtcctctttgttctctctcttggaccactcactctgagagcccctgaatgagccatcctggaagtgaatcctccagcccttgtcaagccttcagatgactgcagctctgatgaacacttagattgcaatctcataagaaaccctgagaatgaatcacgtaactaagaccctcctgaaatagcaatctacaaataccatgataataaatgtgtgttgttttaaggtgctatgttttgggggtacatgatatttaaagctgagactcaaaagaaaagaacctagccactccaagagttctaagaaaaagagtgtttcaagtaccgggtatagcacatgcaaaggccctgagtaaggaaagatcttaagcatgttaaaaaaaaaattaaaaatctgaaagactagtgtgacttaagctcagcgaaggaaagaaaaatagtgaagaaagagacccccaaaggggcagaaagaaaccaaaattactataacaaagtcttaaaaagtagtaaaaactgataatatatgataaagtgcctttgaaaccacaagaaacaactacaaaaatttaacatttagaaacattaactggagagaaatctgaaactaaatgtatctatcatcacacaggaatccagggtaggaaatatgaaaccccctgagagcaagaaccaagggtctttacatctcccatatcacctactcatctttgtagaattaatgcacaatgacaaacctgaaaaaaataccttttgaagacactatttaaaattctaagtaatgaattcattggtgaaagattttaagtctagaatacaggcttcaagtatctcctcactaggtagtccatgacaacggccaaataaataactcatgtagctgcatatctaaagaacatgattataaatcagctctacaaagatgcacatttctccttgtcctgggctaccatgtgataaaaggttttataattggtaaaaagagtaaaagaatttcaaaagaattcccaactggataaccagtctctgaaattaaaactgaatttaatttagcaaaataattccatttgtatacagaaactgtaagatttttaaaatgaacttttatgggagaacatactgttacgaaatacattttcaatcagtaaaacataaaataatacatgtgttttcagattttatgactatttgaataccaagggttattctcctctatatctttatccagaaaaaaatatataacttgaaacacaaaggcaaaaaataattagcaaggtatagaagcactagacactacaaaccaggtgcagtggctcacacctgtaatcccagcattatgggaagttgaggtgggtagattacttgaggtcaggagtttgagaccagcctggccaaaatggtgaaaccccatctctattaaaaatacaaaaattagccaggcatggtagtgtgcgcctgtagtcccagatactcatgaggctgaggcaggagaatcgcttgaacccgggaggtggaggttgcagtgagccaagatcgtgccactgtactcccgcccaggtaacacagtgagactctgtttcaaaaaaaaaagtattagacactacaaaatgtggtaaataaatacaattattttatttcgttatttaaatgtagtaacatcaatataaagtaaaaggaattaatagctagtttaatatgctaggcctttttatgtcccacctgcaactcctgctatggtacgttttatctacagcatagctggtgaccagttaaaagaaaattccagaagatatgacacaaaactgtataaattcaagacaatatttatttaacaaacccagagttagtatcaactagatactaggtactgtggaagttcatcctatcaacattacattccactaatcactaattcttaagacatcagaaaaagatagcaaacatataaggcaaaccaaatatattttgagattcaatgaaaaaacatatcttacttgtatagtaaaacagtaagtgcttttaatatattttaacagaattacagacaaataactcagaagaaaaaaatcaactttttgaagataattacaaaccgaattttcttcttcctcttccaattctcgttgctgttcctcatgtcttttagctttgatctccatagcttctgtgatcaggtctcttaatattgatacaggtttggcattcttgataaaaggatgctaaaaaagtaaaattcaatggtataaattcaaaagatttttccgaattatagctaacaaatgttaaaacaacatgtaaatgttaaccaggatcacaggcttcaatgattgttttttcatctagaattaaatgtataggttaagaaaagagagtatggccactgcctagaaataaagaatttgctttggggcttgtttaaaaaaaaaacttaaagcacacatgcaaaaatgcaaccctgttaataaaactataatatccttaaagatctaattgtccaaaggaagtgtacattaggagtaaaaaagattaagttaaaaataggattacagattatattacacatagaaataaacttattttggtactgagttacgtaatttaattaatcttaataagttgacagccaaaatcagtggccaaaaggagagcaactattttgttacttctttaacatattttctattttattgtatcttaagtaatttaaccaagacaaaaatattttttcagaaaatgaatgttgcctaatttctttactatatataaaataacttgtcactttttaaaaaatatcaccctgatctagctaaaatagctaagctctctatcattctgacaaagagaaggaaaactatcagaatagacctaggttttgaatttctttttattgagaaggagggacatgagagaaagtagagtgaaaggttataattttggatagataacctaaatttggggcagcaatcagtttcagtaattttcatagttacatgtcagtagatagcatcaggtaaaagtgacctgactgagtgagtgagttatttgtttatttgtttgtttgagacaggggcttgctctgttgcccagatgcgagcacaatggtgcaatcatggctcactatagtcttgacctcctgggctcaagtgatcctcccacctcagccttcctaagtgctgggaatagaggcatgagccactgcacccagccctgagttattttaataaacttcaagagaacacaaaaatatatttaaagacaaaaaaaattgtgctgaagaagaaatagatacttgaaagagggtttaaaatggcaaacatatcatttgggacaactataagaaagaactttttcagagtacagaaatactaaaatcaattgtaaagaaccaataaattattttagaacagttatagattaatcttaccaaacaaattaagtcctattaacatatctgtggtagagactcctggtcatacaccaaaaatagagttgtggttggaccgacaattgcccaactggatcctacgtttctcaacttaacccattcaggtggttatatgcgactaagtgaatgcgggagcaaatactgtgttccacttcctggcctgggctatggagggctccttgttactaatggataagggtgagaggtcaggttctcccagagtcctgtactggtactgtgggaagtagtctcattttagctgattggcgatgaaagtcctgacccttcaccagactgcctctgaccccactccaacagggaggttgttgggttcttattcctgcctggtaggagtataagtctaggctcccacatggtcttcactggcactccccacttagggagggaatactttctacactgccttgtggagatgaatgccttagcatgacagccttctctgacaccgcctgagaaggactggacagcctcaaaaggatagaagtctaggttctccatttagcctttgctggtgaccggggtaggccatagttttcttggtggtgtttggctagagtagaacggttatcatctgaaagttttcagtcttactaggctgtccatttctccgtccttctgcttgaaagagcaggtttttatttctagtttgtgtccaatgttgtttctgggttgttggcttctccactacccagtgtgggataaatgagggaaaaagaaaccccagggaactcacagctatgtctttccttgagtcccaccatctctagcagtctattgccttctttccaccttttagagtctttttatgcttgttttatatacttacaatgtccatggttttagctgtactttaatgaggaagtatagagaaaaatatggttactcaatctgtccagcggcagaaatgccttcttcaactcactttaagcacttgttttatctgaagtgtttttgtataaatcattaattttgaacactatcagtttagaaattgataattcagaacatgaacaaaatttaagaggaaatatttcagattttaaaagaataaacttttcaagcagtctcaatttttaaaatacatcatcaagaatgtgataggttgatctgcagtaatttctgtcttctcattactttaggtggtttaagaatcctcaccctctttaatttttattttagacacatttagaaataggaaaactttactgcctattagaatctggtacattcatctttttcttgttgaaatactttataaaacccttcatataatcagccccttgcctgacataaatatatatatatattttttagtttccgttttttgccattcatgcattttttaagttatatgtattcaaatcatccatttttcttttgctttattgcaccggaatgaatatataaatattctcctatattaacccctagttctttcctatttccattttttgttttagtttttttaacatttaagaccttaatctatctggaaattactttggtgtttctgtggtgaagatctaagttaatcctcccaacaccccctaaaggcaggcagttatctcagcaccatttttactttgtttttccctcactgattagaaatgctatcttcataatatgctagtttcctttgtatattatataccatttgtgggcatttaattctgcttcattattctatctcatactggcgttacatacttttctaagcatttaacaaaaagatgtaatttgtttattaaacataaaatttgatttttctattaaatcaatcactatataattcagatgatgtttattttttgcctatatggttactcagtgactgaaaacggaatatcaaaatatcccaatttatttatttagagcaacctcttatgtctttaatttgtaacatacaatgctatattaatatatcaagtttataactatatcttcctttatattatgttctttatcaatattaagtgactccatcctcatttactgatttctgctgtcaattttgcttttttgatcatgttattcatactatctttttatattttattaaaatttcattgcctgtttttaacttttttttttaaataaaaacagacaattgaaacatttttattaggttaatttcactttttacattactacaacaataacaaaaataccaataccattgaatacaattaagaagtttacttaaatcatattcctcaaaatttggtgtgtatcatcacatgtgttagaatcatgggagcgagggcagagggttacttctaaatattcaaattctcggcctcccctagacaaactgaatcagaatttctaagaatgttgccatagaatctgcattttagcatttctttccaagtgatttttatgcaaaccaaaattaaaaatactgcattgacattttccatcccagtcttctgaagattgaaagttaacagcagggttggggtgggctggggtgggacaaggtcatgggaaatagcagcccaggaagcatcagcactgtcatcctcactgtggtttggatgaagtaccttttcaataagctcttctgtatctcttgataaacagttacatggtaatgaaacttttcaaggttatttccttgagaatacagctaaggcagcttcttgcgtctttccaagcagaatattctgatattattattaatctttatcttgtcttgttctgaaaacaatttgagctatcttatgaaattcatagtctatattagtttaagaagtagatgagaaaataagctcaggaaaataaacctatgggtaagagagagagtgtatgtgtgtgtgtgtgtgtgtgtgtgtgtgtaagagagacagagagaagaaagagagagaaggtaacttagagattaataaatacttcttttaaaaataggagttatttgtattttagtttttaattcaacctaaaccttctctctgtagggtttcacaattttaaaaaagtatgtcttttaatttaacaaaatgcaaacatgtatctctgctagtggagaaggtagtgaaaatctttttttttttaaagtttttttttcttttattattatactttaagttttagggtacatgtgcacattgtgcaggttagttacatatctatacatgtgccatgctggtgcgctgcacccactaacttgtcatctagcattaggtatatctcctaatgctatccctcccccttccccccaccccacaacagtccccagagtgtgatgttccccttcctgtgtccatgtgatctcattgttcaattcccacctatgagtgagaatatacggtgtttggttttttgttcttgcgatagtttactgagaatgatgatttccaatttcatccatgttcctacaaaggacatgaactcatcattttttatggctgcatagtattccatggcatatatgtgccacattttcttaatccagtctatcatttttggacatgtgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttagctgcataaatgtcttcttttgagaagtgtctgttcatgtccttcgcccactttttgatggggttgtttttttcttgtaaatttgtttgagttcattgtagattctggatattagccctttgtcagatgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaaggccttgcccatgcctatgtcctgaatggtaatgcctaggttttcttctagggtttttatggttttaggtctaacgtttaagtctttaatccatcttgaattaatttttgtataaggtgtaaggaagggatccagtttcagccttctacatatgactagccaattttcccagcaccatttattaaatagggaatcctttccccattgcttgtttttctcaggtttgtcaaagatcagatagttgtagatatgcggcattatttctaagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggcctttttcacgatattgattcttcctacccatgagcatggaatgttcttccatttgtttgtatcctcttctattttcttgagcaggggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgaaactttgctgaagttgcttatcagcttaaggagattttgggctaagacaatggggttttctagatatacaatcatgtcatcagcagacagggacaatttgacttcctctttttctaattgaatacccttgatttacttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatatcccatcaatacctaatttattgagagtttttagcatgaagggtggttgaattttgtcaaaggccttttctgcatctaatgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattaggctgtgaatctgtctggtcctggactctttttggttggtaagctattgattattgccacaatttcagatcctgttattggtctattcagagattcaacttcttcctggtttagtcctgggagagtgtatgtgtcgaggaatttatccatttcttctagattttctagtttatttgcgtagaggtgtttgtagtattctcggatggtagtttgtatttctgtgggatcggtgttgatatcccctttatcattttttattgcatctatttgattcttctctctttttttctttattagtcttgctagcggtctatcaattttgttgatcctttcaaaaaaccagctcctggattcgttaattttttgaagggttttttgtgtctctgtttccttcagttctgctctgattttagttatttcttgccttctgctagcttttgaatgtgtttgctctggcttttctagttcttttaattgtgatgttagggtgtcaattttggatctttcctgctttctcttgtgggcatttagcgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagtggttttgagtgagattcttaatcctgagttctagtttgattgcattgtggtctgagagatagtttgttataatttctgttcttttacatttgctgaggagagatttacttcaaagtatgtggtcaattttggaataggagtggtgtggtgctgaaaaaaatgtatattctgttgatttgggatggagagttctgtagatgtctattagttccgcttggtgcagagctgagttcaattcctgggtatccttgttgactttctgtctcgttgatctgtctaatgttgacagtggggtgttaaagtctcccattattaatgtgtgggagtctaagtctctttgtaggtctctaaggacttgctttatgaatctgggtgctcctgtgttgggtgcatatatatttagtatagttagctcttcttgttgaattgatccctttaccattatgtaatggccttctttgtctcttttgatctttgttggtttaaagtctgttttatcagagactaggattgcaacccctgcctttttttgttttccatttgcttggtagattttcctccatccttgtatttttagcctatgtgtgtctctgcacgtgagatgggtttcctcaatacagcacactgatgggtcttgactctttatccaatttgccagtctgtgtgttttaattggagcatttggtccatttacatttaaagttaatattgttatgtgtgaatttgatcctgtcatgatgatgttagctggttattttgctcgttagttgatgcagtttcttcctagtctcgatggtctttacactttggcatgattttgcagcggctggtgccggttgttcctttccatttttagcgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacattttttccttcatttcaactttggtgaatctgacaattatgtgtcttggagttgctttctcgaggagtatctttatggcgttctctgtatttcctgaatctgaacgttggcctgccttgctagattggggaagttctcctggataatatcctgcagagtgttttccaacttggttccattctccccatcactttcaggtacaccaattagacgtagatttggtcttttcacatagtcccatatttcttggaggctttgctcatttccttttattcttttttctctaaacttcccttctcgcttcatttcactcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaagtcattctccatccagctttgttccgttgctggtgaggaactgcattcctttggaggaggagaggcactctgctttttagagtttccagtttttctgttctgttttttccccatctttgtggttttatctacttttggtctttgatgatggtgatgaacagatgggtttttggtgtggatgtcctttctgtttgttagttttccttctaacagacaggaccctcagttgcaggtctgttggagtaacctgccgtgtgaggtgtcagtgtgcccctgttggagggtgcctcccagttaggctgcccgggggtcaggggtcatgcacccacttaaggaggcagtctgccccttctcagatctccagctgcatactgggagaaccactgctctcttcaaagctgtcagacagggacatttaagtctgcagaggttactgctgtctttttgtttgtctgtgccctgcccccagaggtggagcctacagatgcaggcaggccttcttgagctgtggtgggctccacccagttcgagcttcctggctgctttgtctacttaagcaagcctgggcaatggcgggcgcccctcccccagcctagctgctgccttgcagtttgatctcagactgctgtgctagcaatcagcgagactccgtgggcataggaccctctgagccaggtgcgggatataatctcgtggtgcaccattttttaagcccgtcggaaaagtgcagtattagggtgggagtggcctgattttccaggtgccgtccgtcactcctttctttgactaggaaagggaaccccctgaccccttgcacttcccgagtgaggcaatgcctcgccctgcttcggctcgcacacggtgcacgcacccactgacctgcgcccactgtctggcactccctagtgagatgaaccgggtacctcagatggaaatgcagaaatcacctgtcttctgcggcgctcatgctgggagctgtagaccggagctgttcctattcggccatcttggctcctccgaaaatcttctcttgagaaaagtgaatggacaaataaagatttctcatttccgacaaaagaaaataaccagcattgatttgctatttctgttgttatgagtgcttccaggtggttgtctttggatctgctctgttcctgtgcacctcttcttggaatataaatttctgagcctcaatgtgccctgatgccgttcctttcttccaccgtaagagttaccgaaagctcggcgtccgtgatggggtagagggcttccgaggcgatcgggcagtgtcagtcttcagccgctaagccgagaagatctgggaaggagtcagagagccttgggccagagttccaggggctctgggagtggcggatttgaaattggtgagatgtatcttgggctggtcggtctgaggacctgaggtcctaggtggatctttctcaaggagcaaaaagcaggaggacgggggattgatctcccaagggaggccccccgatccaagtcacagcaccaaatttcatgcacgtccgtgtgaagagaccactaaacagctgtttttaacttttaacccaaattcttttaagtatgcctcatgtagaaacatgagttggattttatgtaagtttgtaagtttatctcatgtagaaagcatggagttgcatttatcttatgaactaagtgaaccatttagtacttaactaaatattatttaaaaaaattaaccacttatgttagtatataattatatgctaatgccattttatcacaattgttttacattatgtaaaacatacatgttttatcataatattctatcataaatgttttacatttgccatcttgttttttctgcattcttttttacgttgctttgcagttttaattttaccacctgctaatcttaaaatgcctttaaaaatatacagatagtccctgacttacaaaggttcaatttaggatttttcaactttacaatgctgcaaaagtgatatgcattcagtaggaaccatacttggaattctgatatttgatattttcccaggctagtaatatgtggtacaatactctcttctgatgctgagcatggaggtattaataagtcccagctcccagtgagctatgcgatcatgagggtaattaaccaatattctatagtgtactgtgttgtcagcattttttggatattgtgttttgtgttttcacattcaattgcgtctacaaaacactcaactacactaatgtatgtgttctgggcacgtttttggtaggctaggctaagctaggataggtgtattttaacacctttttgacttacaatattttaaaccttcattggggtttatcaggacctaactccattgtaagttaaggagcacttgtacttaaaaacttggcaatttgtctgataaaacttctcttctgactcaagaatactcaaataatatggtcttgctcttcatgtacccttttaactttattagccagttcctctttgttgatcaaaaccatgtctgcagcagttatgtagggaaagcatgagtacaaatgaaattggacataccgagattttgagattaagaatgttaagctctatagactaactgtagcataacactatagtgaattgacaatgaattgcataaaagcagggttgtggtaaattggacgaaccagataagtatattggcttttcttaaaaataactgcagcttagaagggtagtttatacattcccctgagaagataaagtataatgtagtttgaattttctatactttgttaaagaaatataattctactggtttctagtttctgtagtgttggtcttctctcacttctgttaatacataatcagtcactaaatccttctcattctttcatcagatttactattttctattttggcaactatttttttaaactcaggtccttaacaattcacacctgtattattacagtgcctcctcattctatttctatactttgttgcaatattatgttatcaaagacattcttttcttacattctcttgtttacatatgtaagtaaggtggctctcagacaaaattgaggcatctcatcctaggcatcagaatacccttcttgcttcactgttgtctgtatctaaactcagacaccacttctctaactggtgtttctattctggctaagcagatcttactgtgttctaaaatacatctcccatttttgtgtctttgttcatattgttcataccatttctcctccctaaaatgatctgcttcttctgtatgaggtatctgtgattaccatatccattcttctacttttacatttcttaatcatataggctgtgcatcatgaatgtaacttctacattgtattataattttttaacatttttgtctttcatttctcaaagaatataacttcagttttttgtgtgtttttggggtgtgtgtgtgacctttctactagtttgtcaaaaatgtttagagtaggacaggagtcttttctttcttattgctctacactcctctaggacactgtctttgtctttacagttgtttgaagttgtgttgtaagtacctctgttttccaacttgataaaaagggaagagatcatggaagactgctcactgacttactttatttatttatttatttatttatttatttatttatttatttattttgagacagagtctcactctgttgtccaggctggagtgcagtggtgcgatcttggctcattgtaatccctgtctcccgggttcaagtgattctcttgcctcagcctcccaaatagctgggactacagacgtgcaccaccatgtctggctaatttttgtatttttcgtatagacggggtttcactatgttggccaggctggtcttgaactcctgatctcaagtgatccacctgcctcggcctcccaaagtgctgggattacaggcgtgagccacggtgcctggccacttactgactttagaatctcggctgcccaccagcaggtataaggatcatcttcagatcaggaactccggtgctaatagactgaaactgaaccttgtcttttaacatctccagggttttaatttatctttaaaaactactaaaatttcaatttaataatctcaaaggatccttcccttctatgatttttaaaaatgtatacaataatctatctgtgtcatagaaaatcaatcactattttaaaaatccatcaggaatttctttttaaatattgtttctttgtttactggaaatgaatatggtataatctgtacacgtaagctatagatatatgtcaactaaaatttggtaatcagattgtccactgagagttaaactatgatttaaattaggggtccccaacctccagctgcagactggtacctgccttggcctgttatgaactgggctgcacagcaggaggtgagtgagcattacagcctgaactctgcctactgtcagatcagcagtggtattagattctaacaggagcacaaaccctattgtgacctgcacatgtgagggatccaagttgcatgctccttatgagaatctaactaatgcctaatgatctgaggcaggacagtttaatcctgaaacaatcccaactctgctcaccatccatggaaaaactgtcttccatgaaaccagtccctggtgccaaaaaggttggggacaactaatttaaatcataacagataagacatacaaaactccttgaagagacagaatggttcctaggcttcctgctaaataagactctaatgaggccaaagataattatcctacccccccaaaaaaaaatttaaatcagaagtttgttaggttaaatacacacatattaactttaatatgtacaagtactggatactaggagtccaaaggtagtaccctttggactactttaaaatacatatatatttcagcagggcgagatagctcacgcctataatcccaggaatttgggaggccaaagtgggcagattacttgagcccaggagttcgagactagcctgggtaacatggcgaatcctgtctctacgaaacagacaaaagttagctggatgtggtggcatgcatctgtagtcccagctactcaggaggctgaggtgggaggataggtggagcccaggaggtagaggtttcagtgagcgagatcatgccactgcactccagcgggggcaatacagtgagaccctatctcaaaaaatacatgggccgggcacggtggctcatgtctgtaatcccagcactttgggaggctgaggcaggcggatcacttgaggtcaggagtttgataccagcctgatcaacatggcgaaactctgtctctactaataatacaaaaattagccaggcatggtggcacacacctgtaatcccagctacttgggaggctaaggcacgagaatcacttgaaaccaagaggcagaggttgcagtgagccaggtgccactgcactctagcctgggtgacagagtgagataccatctcaaaaaaataaaaaataaaataaaatatatacacacacatataatatacatatataacacatacatatatatttcaaatgaatattgacaatatttcaaaataaatgttttaatcaatttttgtggaaaaataaaattttaccatcttaaccattactttttgaaaggtagtatttgcacataacccaaatcgcaaaagtctcataaacagttttcatcaaaaagcaagtctccatcccagtcctgccccatccatagttagttaccttttctggaggccagtttcttgcttatttttccagagatacttcattataagcattaagatatgtatatatgttgtgtgtacataggtgtatttttccagtaactctttttcttgtactttaaattgtttccaacttgttgacagacatttaggatctttccaatcttttacaatttcaatgttctacgaatatttttacacatgttatttcacacatggttaaatatttctgtagaataaattcctagaagtgcaactgttggatcaaagaatatatggatttttattttaaatagatattgctgtactggcatctatggagattgagtaccaagttacactttcataacaataaacattatacttaagagcctgttttccatacccctcaatacatccttttggaaaaatgggactttggaaagttacttttttttttttttccttttttctttttttgttcttttaacccaatggttcctttagagacagggaagtccctttttacaagaaccatgtttttcatccttttgtcacttaacaatagaaatcatttagcaaatatcaagttttgttaatgtgagacatacttattattagctgaaagttctaagactattctgttggggaaattaagattcacaaacacctattataaatattaaattatttctatttgcattaaattttaaggtagattttaaaatctactgacattctggatacaaagtctacttacaattattctatcaaaaaaaattgaaactctgaagctcttcatttagataatcctgtaactgatatttacaacgtgataatctcttcaaggagtccagggatcttgtacttacatattttatggtggagcaaaaagtcaaaggataaatgctgagtcaaggaacagaagaaaaaaaaaacatgagaaatagtaactatgaagacaaagattcctttctgaaaggagaatgctttggaaattttgttttaaaatgactctgggggaaatgaggggacgagaggggaggaaagaaaagaagggagcaaacaggaggggaggggaggtttacatctttagaaatcagttatgaaacacacagcaattctggccaatgtcagaaagctgaaaggtatgaagaaaatatccttcccttcgaggcacaagcactgacctgtaaaagttgtgttgcagtagctctctgctcaggattcttcaccaaacactttttaacaaaatcggtgaaatcatcggaccaaagttctggctttctgaatgttggtggtggatttgtgggaatcataaaaatagcctagtacaaatgaaatatccaaaagacagtaagaatcacactagcacaatcaaataaacaaatctctttatctgtctttttatcagactctaaatttgaaaaacaaatttaagctgttctaggatttctagtaacactgaaattcaggaagccagtccatctgctactaatgtaatcatttcccattaaatttcctctatttgaattgtagctcattgagcacatcattctttattttacctattacttttttttatcagtctctaaagaagactatatttctgacccactaaggactttccctaaacatatatattcccaaattttgctactacatgccagatttacttcttgtttcagttttatataagcattgctgcttaaaatgggtagtaggagtccaatttgcttttgcaatccagaatatttaagtaaaattactgctataatttgaaataatacttgacagagccaagacttttctctttttaaatatgagtcaaaatttcaaatgaaaaatttcaaaggtaatatactactttaatttattactaatgattgagtacttataatttagtggtaatgataatacattcagaaacctcaaaaatcaaaagccataaaaagagtccatctcatctctcgcctcctagatagtcaccctggcctgtttttgcttttaatctgagtatgtttatgacccaagaagtagattaaaaaaacaaaaacaaaaacctgaagacattctaaatatgaaatacaagtcagttagggggttaatgtagatgtcccaacatgagtaataaaatgttcaaactagaatagtatctacaggaatgaaatggaagaaatgaagcatgagatacttcaaaggaggaaccaagagtacatgctaataatattgttttggagaggtgaaaaaaggaagcatgaaaaattactccagaattcaagaaataagaaataggtaccttaaattgcaaggcactcaggtattttaataattgcctatatcattcttttgaatgccctcagaatatgcagccatttaatataatgcattatcattggtttcttacttggaaagtgatcaaatggactttctgtggacacagcagcaaagactcaatatccaagtctgttgattataggttaagagtcaatctttttaccagtatatgcatcttctttcaaaaaacgtaaattctttaatagattagaatattttatatacctcacgtcatgttatacatattacatctatgatagtctttcaaaagcagtgtagccagtattacaaaacaataaacatctttcaatcaaacaaatatttataaagcatttctgtgtgttcagaacaatgctataatttagaggtatcaaaacaaagggccacaggccaaatagtgccagtggacctacttcgttcagacaaaatcaatctcacattgccacaagatgaatctgctgtaattagactaatttaaactaggacatatgttcttccttttgcgtgagctctatctagcctggctcaattatctactttatgtgatggtccctttaaatatcagaccttataaacccggctattacagtttttaaaataggatacatatctcagacccccagagctcacagtcaacttgtgcagaaaaaaaaaaaaacacatatgaaacgaatagcaaacaactgagtgccagacaatgaaattctgcctgcaaataacctaattaatctcagacagctccacagttgaggcagaacctaataaggctttaaaaaatgagtaaaatggggttaaaagcagctgctggaaaaggcacacaaaaccacctgctacttccaactagagaataaaaataaatttgaactctcatctctgtgaaacagttcaaaggacttacataagcccctatatagactgacctcaaactgcaggtaaattatactagattgtctagataaatattgttcatctgcacttctgttgtaaactggtggataacacaatgatttatgtccttgaagccaatgctctcctttgaactttgaggcaatgagttgcagtcttatcttgagataatcttaacatataaggctcaccttagcagtagctattagaaacccaaggataaaaagcttaactctaactcttatttacccagtactctcataaagtgaacctaaaatgtcacattctaccctcaaatatgcattgaacaagcatgaacaccgagcatacagtccaaacaaataagtcttagcgtatgatctacaccaaaatgtctccaggaaaaccactatgccatttatttccattttttaaggttagctcatcaataatagattttcttgacagccttactgtactaatttaactaatttaacctaataatgaaccacagaggatcctcttaagaatctctaggttttatatgagttgattaggtattaggccccttctatagaaagttttggcaatcagtggctcactttagactaacaattcattcccttgccaccaaccaaatcacagggacacacattacagccatataatttatcttatctctaacaccattttgattgaagaatgttagtaaaataaatgacatgattatccttgtgtttgtttctacacaatgtgttgcttaactacataccaaacctctgattatgtttctaaaagaactactctgatcacaagcagtttaataacgcaagaaatctaggtgcttcaaaacaactaattatcttcatgcctgaaatgtcatgccttagactgcaagagtacccaggagatgtggaaagggctgaaaatgagaatcaacaatgactgaactttataatctcagtggaatgagtcaacacatgtctgactctacagcagctgagtctgtgaatgtatagaagtgatgggcatgccagaataacaaagaaattcatgctattatttaagaacctcagatatatgagcaaaaggttatcttcacaacaaataaatgagataaaggatgagaaaacactataaaactataaagaagtaaacaaatatagctgtttcctgatagcaaacataatacacaggtaacaagctaaataaaattttaaaataatttctggaaaggaaataaagtaattacactaatttataaaagacagtacaaataaaagcaaacagtacaatgtgatgaggccaatactggacatgagtcagaaaaactggcttgagttctaaatcactacctgactgtgtggctttagtatcattttgttttttttttccaagtaaggaggttgaactggatgtttatcaggtcccgtactgggtataaaaagaccctggcactctttaccacgtattaaaaaaccctggcactctaactgcctagcaattgaagggtaaaattatactaaacaagtattaaattgctagttaggaaagggatggagaagaggaaaaagagggaaggacaggaaaaggccttttagatgttaatataaaaatgtgaatctaggccaggtgcagtgactcatgcctgtaatcccaacactttgaggggctgaggcaggtggatcacctgaggccaggagttcgagaccagcctggccaatatggtgaaaccctgtctctcccaaaaaacaaaaattagccaggcatggtggcaggcacttgtaatcccagctactagggtggctgaggcagaattgcttgaacctgggagatggaggttacaacgagccaagatcacgccattgcactacagcctgggcaacaagagggaaactccatctaaaaaagaaaaaaaatgtgaatctaaatttttatcaccattccctcaaaagcaaatatgaaatatacagaaattttgaagagaatagtaaatctaaagtgaaactttctcctataataaagtttccacagtaagcacagagttaaagtattgggaacatgaactcacaattcactccagttccagtagcaatcattaatctggccaagaaaggccaatgtgccagcctggaaaccaaattaagggagagggtgcagctggtattctggaagtacaaagcaaataagagaaccagctctagatggcactgggtacataacagcaccattattagtaactatctgacctatttaactactctatgcctctgttcccatatcttaatatgggaatgttagggctgttctgaattttaaatagattaatacatgtaaaacacttagaatagtgcctggcacaattgtaaatgctcaataatgtgagctattattaacctaattttacgactgaggctcacaagagtaagctagcttattcaagatcacacagctagtaaagtgaatgtcaaaattagaacaagtttgattccttagcatatgctacctcacattaccactgcttccatcagatttctgctgcacataattttattttaagataaaggctctgttatatacattcagtctctagaaaaaagtggaaaagtatttgtaacaaagaagattatagttttactgtctctaacggtggaaaactgaagaaaaaaaaagtcaaacaattgagggtgctaagtaaactatatatgaataacataaagtaacatattgccataaaaactgacaaatgtgtgaattacaaaaccacaaagaaaagttcttaaaaagcaaaaatgagggagtaaaacagtaaagactgctttcacataaaaatgactagtatgcagcaataaaaactaaaagatggtatagaatcttaaaaatttaaactgtcaattcatagcagcaattatgtacaagattgtataagtgtctttaaaatttatttttactatgatggtttttaaatttttttttacttttaaaaattatacttgcagctaggcatagtggctcatgcctgtagtccctgagctgagaggctgaggaaggtggattgcttgagcccaggagctcaagacaagcctaggcaacacaatgagatcctgactctatttaaatatatatacatatatttaaaagtatttaaaaattatactcgcaattgcaaaagcttcatttgataccaccccttaagctgtcacctattccagtctgccccacaaccacctcttactcatgcactatttaaatcccaatacaatcaattgtaaatcttaaccatctttcaagactgaaatataatatccctttaatacaatccaacaatatcataaaacatggctgtagagaaaagcaaaagtgaacaaaagccaacacttaaagaactttatcacaaatttcactctctcagatagaagtcctatgatcagttcaactgacttttgtaagcacataaatgtatccatacctgcaatatattaacttcttcaagaaatttagagtctaatggaatataaaaatgtatatcagatcattttaataaaatagtgtaagtgctcaaatacatgtgagcaataggtattacaaaggatgacttagcccaaataggtatgtgagctaaatgggtatgggaagatgagatttcagctgagtcataaagaatgagtgagtcagtgaagcacagaaaggagaccagcatcttctcagttgtgaagtttgaaacctcatggagctgtgagagaaactgacttatttcagatgtagggcagggaaattacgaggtgagccaaaggcatcttgttgcccataaagaaagaaatcactcaaatactaactggatcacatcagaagttcagcacttgtagaacttagtatcagccataaaagagtctgatttaactgatctggggtgacgacaaggcacaatattttcttacatctcccaagcaattccaatatgtgagtaacatggagaaccactattctaaaatataaaatacaagacaagtgctatcactgtttaatatctcaacttcagaactttccatattttaatattgtactctgattagttataaactcattctaaatgccctggataacatgaaaactacctgaaggcaagacagtgtcttctattgtctgaatgtttgtgtctcttgcaaaattcttatgttcaaagcaaatcaccaacgtgatggtattagaaggtggggcctttgggaggcgattaggtcataagggctccacctttgtgaatggaattaatgccctcataaacaagtccccacagaaccatctaatcccttctgccaaataaggacacatagaaggtgccttctatgaggaacaagccctaactagacaccaaatctgctagcacctagatcttgaacttccaagcctccagaactgtgagcaatacatatcttttgtacataaattacccagtctaaggtattttgttatagcaacccaaacagactatacaatcacttaagttttatatgtcaactgcattaggcatagtacttctccatagtaaaacctaaatttatactgagagtgttgatataaagacatccagttaagtatggtaactgaacatactgatttacttcaactccttccccaaaatcctgctaaagtacagtaagaattttaaaaaggcttaacctccaaagagagaagggcaatagaaaataagagacagcaataaaattttggaaatagaaagtagatgaaagagtcataactgactcaaaagatctgagaaatcagtaagaagcacatcaattccctccaaataactaaaaaaaaaaaaaaagcctaagaacttggaagtaccaaatatatctaaagatagtggacacctgtaacaaggagcacacctggtaccaagatcttggcttctaaaatgccaatccccagtaaaagaaacctatgctccttgaggaaatgactaatttcaaaggtcaaaataggaaaatcacaaggttagctctgggtatcttgctaggccagaaggtaaggaaacactcaaagattaatggtattatgtcaaaaggacatataaataaccaaatttaggataatttgagcatcaaaataataatagtaataatgactataactgattataacaaattgaaaacaattagtctacagtgttttttttttttatttttgagatggagtctcgctgtcacccatccaggctggagtgcagtgacatgatctaggctcactgcaacttctacctcccaggttcaagcgattctcatgcctcagcctcccaagtagctgggattacaggtgcccgccaccatgcctggctatttttcacatttttagtagagacaaggtttcaccatactggccaggctaatctcaaactcctgacctcaaatgatctgcccaccttggcctcccaaagtgctgggattacaggtgtgagccaccgcacctggcctatgacaatatttttcaaagagtttaagaaaagctgttctttatagaaaaattctaaaaatacacagtaactgaaatacagtatcaacatattgcaccctcaatgtaatttaatgatcaattcaggcaaggaacaccaatggatacttgagtttggatatctgtcccctccaaatctcatgttgaaatgtggtcctcaatgctggaagcggggcctgggaaggaagggaagaaggaaaggaaggaagaaggaaaggaagaagggaagggaaggagggaaagatgatgtagagagatagaatgaataatgcccccaccccgcaagatgtctacgttctaatccccggacttgtgaatatgttactttacatggcaaaaaggattttgaagataagattaagttaaaagtcttgaggtggacagattatcctaaattatctaggcaggccaaatgtaatcagaagggtcctaaaaagtggaagagggagccaggagagtcagagggagatgtgagtttggaataatggtctgctttgaagcagtcttcaaataatgctgctttgaagataaaggaagagggccatgagccaaagaatgtgggcagcctttagaagcttgaaaaagcaaggaaacaaattctctctgagatactccaggataaaaaagcttccctgccaccacttcagatgtagcctagtgagatatgtgttagacactgtattttggaaagctccaaaataatctcctttgactccatgtcccacatccagggcacactgataaaaggcgtgggctcccaaagccttcagccactccatccctatggccctgcagggttcagcccctgaggctgctctcatgggctggcattgggtgcctatgggttttccaagtgcatagtgccagctattggtagctctatctggaggggtctggaggatggtggccctcttctcacagctccaccaggcagtactccagtgaagactctaaccccatatttccctcttgcattgccctagtagaggttctcatgaaagctacagccctacagcagacttctgcctggacattcaggcttttccatatctcctctaaaatctaggctggggttcccaagtctcaactgttgccttccttttagttatgaaaatggctgcagctggcttttgcaccctcaaataagtttttcttttctaccacatggctgggctacaaaattttcaacttttatgttctgcttcccctttaaatacaagtttgagttttacatcatttctttgctcatgcatatgggcacaggttgttagaagcagccaggtcacctcttgaacactttactgcttagaaatttcttctgccagataccctaaatcatcagtctcaagttcaaagatccacagatccccagggcaggggtaaaatgccactaggttctttgttaatgcataacaaaagtgacatttgctccagttcccagtaagttcctcatctccatccgagacctcatcagcatggatttcattgtccatatcactatcaacattttggtcacaatttaacaagtctctaagaagttccaaactttccctcattttcctgtcttcttatgagccctccatactcttccagcctctgcctgttacccactttcaaagctgcttccacattttcaggtatctttatagcaatgccctactccttggcactgattttctgtattggtctattctcacatttcaataaagaaatatctgagactgggtaatttataaagaaaagaagtttaactggctcatggttctgcaggctgtataggaagcatagcagcttctgtttcagggagacctcaggaaacttacaatcatggtggaaggtgaaggggaagcaagcacaccttttttttttttttttttttgaggcagagtttcactcttgtcacccaagctggagtgcagcggcatgatctcggctcactgcaacatccgcctgcccatttatggtgataacaacttcttcctctcttacttcctccctctctgtcttcgccctgcccccagctatccgtctatactagttttctatttctgctgtagtaagttatcacaaatgtagtggttcatacaacacaagtttattatcttacagctctttaggttagaagtacaatatggcttggctctgtgtccccgcttaaatctcctgtcaaattgtaatccccaatgttagcggtggggcctgatgggaggtgattggaccatgggggtggagttgtcatgaatggtttattatcatccccttggtgctgttctcatgatagtgagttatcataagatgtggttgttaaaagtgtgtagcaccttccccctttctctcttcctcctgctctagccatgaaagatatgtttgtggccgggtgcggtagctcatgcctgtaatcccagcgctttgagaggctgaggcagtcggatcacctgaggtcaggagtttgagaccagcttggccaacatggcaaaaccccatctctgctaaaaatacaaaaattagccaggtgtggtggtgggtgcctgtaatcccagctacttgggaggctgaggcaagagaactgcttgaagaagctgttatctccataaatgggcagtatcaggctagtatgatactgctgtagtgccatcagtatgtggtctccaccttccaatttacttcatggtttaagatgggtggttgaacattaccacacactgactccagaactcaaaaaaaaggggaagggaatggcaatatagagtattaatcagatctctttacccaggctccctggaagtccaacacaacatttctcttttgcagtgttctgaacacttttgaagctcttttccaagaggctgcaaaagcccatggaatttccagagatataaatgtctttgttatgctaaggagttgacacatgccaactgaagcccctagatagcttcaggatacaggatggtcagcagaaagaataagcatgtaattagcaggttagtatatttagctgcctgacctctggtgagtggatactaaagactgagctcaaacaaatggccaaaggtttaatcaatcattactacttaatgaaaccccagtaaaaactctgtacatctaggcttagcagagcctcctggttggcaaacacattcacatgtcctgattctacaaaaggaagtcacacaggctctgtgttccctctcagacaatcatatgggtctcttcatttgactggtcctcctgattagcatcctttataataaacctgtcattctaagtatagttctttcctgaattctgccagtcattctagcaagttatcaaacctgaggggatcaaaggaactgctgaatgtataaccatttagtcagaagtatgggtaacctagggacaaattaagtgtagctggtatctgaagagtggtcatgttggggatcatgcccttgaacttgtggggtctgagctaactctggatggttagcagtagaacagaaccacagtacactcaatttgtgttgaaatagaatactgtaattcaggtggtattcaaatgtattttcactgtttttcaaacatagcaaaatagtgaaattgataagcaactgatataagaagcactttttagacaaaggtgaaaaatactgtttctctaacagcttttctctacagttgtggttctcgaggtgttcatgaactccttcactgggccctttcagggatctaccaagtcaaatctttttttcataaaaacactaagccattcttttcctttttctctcaattgacatttgcactacaggtacaaaagcaatgacagataaaattgctggctccctagcaccaatgaagacagtggaacaaaactgtaatcattgtattcttcattgtcatgcattcacaatttttttgaatctgtgaattcacaaaaaagacacttttgattaagaaaatccttgatttaaaaaatactctttttagcaaatctttttagcatctttttagcattttgtagtgaaatgagaaatacgcataaactatacctgctacataatgaagtacaatggttgtctcaaggaaaattatctgtgattaaattgcatgttgaactacagcttttttcatgaatcatctttttcatttgaaagaaaaactgagagataaactttgattattcagatttggatactcaacagacattttctcaaaaatgaatcaactgaacctatgacatcatggaaacacagatggtttttgataacaattataaaatttaagctttcagttgaaaagtcaaattttcaaaagcttctatctgccaccatgaacttaacagtttcctagtatttagaaacttttctgatttttccaaatgacaaatacatgacattacccgttcacatatgaataaagatctattccaagtacaagatagagaaatagattttaatgtaacaaaatagaaaaactcactactatggtttcagattctaatactggaattaatctttagaaaattatcactgttgaattttggtgtagtatgaaaggaagaatatcataattaccagaaaacaaatgattagaatattgctccatcttaatcacatatcatatatgtgttaggccagatatttttcatacatttccattgaaataatgtgttacaacactcacaaataaaaaaaaaaattcaaccatcttctattaagctatccactcattatttttatgaaaatagtaattgattcatataaacaaaagctcttgggtcctcaattctttaaagtgaaaaggactgctcaggccaaaaagcctgaaaaccactattctatagtgaatgcaaaccagggaaactaacaggaatattttcttctgtttgatgcatgttcaccagcaacagtaccacaaacttgtttcattttatattatgtccttctaatttgtttacttttttacatatttgaaattttaacacagataaaatttggtatatagtttattttttctaagtaactgtattttaatatgcctgaaaaaataatgaagagacatggttcacaagacatcaaaagagcatccagaaaaatgaaattggtaatgtgtctccattctgtccaagaggatgccctggaccactaaaaaatatacctggtccttgcaatagataaattcaagtggtagacacggatgagcatagcttgatgcagtagtcaataagatcatccaactaatcaccttattctagtaaccattttcacctgacagccttctggtcaaaatttggattcccatgtaaaactgacttcagaagagaatatggtgatgaacatctgattacttgagggttaaatatctatttttaaagtaataaattggaattttgatttgtatatcagtgaacttggttaagtccatcctatgagacagttctatatttattacattggcagatcggtcttcgaataataaatgctgctctgtgatcttgtctgggtagccaactgatcttccttagaaaatacacaaccacaacccttccgcaagcattatgctcatactacatcactgattacctaaattcacaccctgacaaagaagagggctctgccaataacaaagcatattaagttatatatttcagaataacggaataagagtgaaactttactaagaatagtgaataaaataatattttaaatgttaaataagttttgagataaggccttttaatgtttaattttagaataattctaggcattttaacagcataataactcctcaaaaaaagaagtgtatggtttggatgtcactttaagccatgaaatttttatctcagctatttaaataaagtatctcatctgaaatatggtacaatgtatactttacactgcattagctataacaataaataatggatcataaacatttacatataaaaagaacaaaatgaaaggtaagactatgcggaaaaaatactagaacaaccactagaagtttacaaaaaataagaagacagtacaaaaacatcaataaaatagattgaaaaataaagctgatgaactaattgccttgaatgtatcagaaaacttaagggaagacaaaatattagaaatcagtggccaggcatggtggttccgcctgtaatcccagcactttgggaggctgacgcgggtggatcacgaggtcaggagatcgagaccatcctggctaacacagtgaaaccccgtctctactaaaaatacaaaaaattaactgggcgtggtggcgggcacctgtagtcccagctactcaggaggctgaggcaggagaatggcatgaatctgggaggtggagcttgcagtgagccgagatcagagatcgcaccaccgcactccagcctgggtgacacagtgagactccgtctcaaaaaaaaaaaaaaagaaataattgacatatatcagataaactaattgcatgtattatcaaaacaatttcagaagcatgataaaattaagaatctggaagaaaactttcatagtaacttatcttagtaataaaacagaaaatgaatcagagcttcaaaagcaagaaagaagaaccaatacccccatccaaaggaactatctggaatgtaccaaaatgtttcaaaacagaaaaaaaaaaaccatatgattacaaaatgagaaaaaaggaaataatgaacaaaagattcatgtaatgtaacttagtataatttgaccataagattagggaaataaattaatactagtcattagcagtttttgtatcatctggtaaaagagttccaaggacaagaagttcaacaccatgaagtactattagaagatcagaatattatatgcaatactgcctagcttcattttaccaaagtgcaacaataattcaattcaatccaaagtaaatcaatagcatccattgattttctttctattctattcccacctctgactcctaaaacagtgcggcacacacgtcttagctctatcccagtgcccccaccaccatatgccacccttgcaatagctgtgtcttgtccatcactagcctggtgcagtctgtcctaatgaggaaaagcagggaagatgcccgcataggctcaggaccatttaaatggggaatcctgggatcctgggtctgcagagcatgatctaggagggaaaactatgggctctagcacagagatgtagcatggcccatgcagggcataatctttgggcaaaggctccagttaccgggcctagtgcctataattgacatactatcctcaaaattatcatttagcataaaatcatcctgattcgagttaaaatattatgtcactttacaaccaaagtgcaaagactaagttgttatagaatctgtgaaagttaatcaagtaatcaaaacatagtaaaatataaaaatgctcattataaagaacacatcattcaaaatccagtcatatctaatagagactacaaaacttaagcagatgtttacacaaaggcctataaactcaaactgatacaaagaactgggttaaagctaaacaagcagaggtcagcacagagctcctgtgattgaatcacaataaaacaatacactagtcctaagatagcaagaatatgatgcaataagtgaggctctggtcccaaaacagtataatgcccagtacaaatcaatttcacaaaaatctataatagaagtcaatgtaaattaggattaagaaaatcaaaattaacaacaaaaaatatatgaagaacaaaaaagaaacaactgaaaatatgaaaagtttataattaaaaaaagacacacagacatatatacatacatcaaagtctacaatcagaaaaaaacaatagatctcagaaatttagtgtgaaatttaagagtaaatagtaagttttagaaagaaaagaaatctgtcaacacagcccctcattttcgtgcctagggaaaataaggcttaatctacagccttggccaaatatgattgccagataaataaacccttagattctaccataagttaattaaaatgataaaaaaaaattcatatattagtttctaactccaaatttctttaagaaaaccttatgattcacaagcaaccaaccaattccaaactctatgccagtggttcttaacactggctacatattagaatcacctgggaagcattctaaaattgcttattccctgaactcaacccaaagaatctggtgttgtctaggcctaggttggttggtttttaaaaaaatgtcctatatgagtgtaaggtgtatcaagggtcaaagatcactgcatgaatcaaacagtatggatccaaattcccactacatttagcacaagtttggggaataaaaacttaccatttttagagacagagttcataaatagaatgggagaaactaggaaaactaattcaggggccaactctaggcaacaacaatcaaactgttccccttgctaaataaataaatacatatatagtatataaaatatatataaatatacatataatagacatttatataaatatatatgtgtatgtatgtcactatattttatatttcatctaaaattccataaattagaaagtcattgctgtttaaaaactatgtgtaacttctgcttctaggaagatagagtagatgtacattttcctatttctctcgttaagtacaaccaaaaaccatggacattatgaataaacaagcatacgaagatccagactgggcacagtggctcatgcctataatcccagccacttgggaagccgagtggggaggactgcttgaaaccaggaattcaagaccagttcaagaccactgtttctaaacatatatatatatatacacacacacacatatgaattctatatatacatatatatcaattctatatatatatcaacccatatatatagagagattctaatatatatatatatatatgaaagatggagagaaggcagaacagctagggatcttggaacccaaggaacataactgatgacttccctggatcttctttgtcccttatatattccacacttggggccagataagccaacaaccagaaaaagctaacaggtacaaacaaaaaagctccgacaaaaccctgcccaaaagatgaagagaagaacaccatggaaagaagaaaactttaggcaaatttcactctatgtcagccaaacaccacagaaaaaactgtagtcccactctaaccatgtcagaaaggcttagtggacagcctaaagttctatcctcatgagactataacaaggtcccacaatactcctgacatggtgagaaaagaacaagtagggagccaagaatttcacccctctggaaagtaaaaggacagccccccctagcagtgtcagtagacagcaagtagaacctgtacttcctctccaaactggcagcaatgaggtgatcctcccactacccactgaggaggactagaaaaaagttaaattaagactttcactaaccagtggaaattaggtaagcaccaatacaatagagactacacacggagagctagaatcaccactctgactcagcaataatgaggagccactcctgctacttgagtagggcaacagagactgaaaggggaatctggacttcaacaaactctacctggcagtgatgagctcccttcccctcttaaagtaatgtcataaacattcacctaaaacagaaggtttaaataagatccagtctcagaatataatggggaaataggtcctgttttcaaccaaaaattactcatcagaccaagagtcaaaaaaatcacaaactgaccaaaaaaacaaaaaagataaaagtcaacaccaaaaaaagacatgtcagaagtatctgacaaatattttaagagtctttaaaaaaatgcttcaatgaacaatcatgaaaataactgaaacaatgtaaaaatagaaagcctcagctttaccagtaccttgtgataatttatgtacatatagaataatactaaaataaaccaccaaaaagttttgcatagaaatatcctcataaacactatagataaatcaaaagaaaactcttaaaaaaaatcaagtaacccacaggaagtaaaaaaaaagaaaacagaaattaaaaaaatgcaaaactttagccataacatattaataattacattaaatgtaaatcgcctaaatatgccaattaaaaggcaaaaactgaaaaggtagattttaaaatgcaactcaattatatgtagtatataagaaactaacttataatataaaaatacaggcatgttgaaagaaaaatgatggaagaaatataacatgcaaacaataatcaaaccaaagcagaagtggctatattaataacagataaaggagacttcagcaaagaaaattaccagagacagagagggacattacatagtgatgagacataattcaccaagaaaatataacaagcactaatgtatatgtaccaaccaacaagctataaaatatatgaagcaaaaactaaaacttgaaaggagaaatagataaattcaccattatcagtagaaatgtcaatatcctctaacaacaagagataaaacaaatagacagaaaatcagcaaggatacagaagaaatcaacaacaccatcaacaaaatttatagaataccccacctcaacaacagcagagtacttattactttcaagtaatcatggaccatataccaagagagaacatatactgaggcataaaacatacatcaacaaattttaaagaactgaacagagtagagtctccaagcacaatggaatcacattagaaatcaataacagagacataataggaaaatcaagcacttgaaaactaaagaacacgctttcaaataatctatgtgtcaaagaagatgtctcgatcgggggaggagccaagatggccgaataggaacagctccggtctacagctcccagcgagagcgatgcagaagatgggtgatttctgcatttccatctgaggtaccgggttcatctcactagggagtgccagacagtgggcgcaggccagtgggtgtgcgcaccgtgcgcgagccgaagcagggcgaggcattgcctcacctgggaagcgcaaggggtcagggagttccctttccgagtcaaagaaaggggtgatggatgcacctggaaaatcgggtcactctcacccgaatactgcgcttttcagaccggcttaaaaaacggcgcaccacgagactatatcccacacctggcttggagggtcctacacccacagaatctcgctgattgctagcacaaagcagtctgagatcaaactgcaaggcggcagctaggctgggggaggggagcccgccattgcccgggcttgcttaggtaaacaaagcagccaggaagctccaactgggtggagcccaccagagttcaaggaggcctgcctgcctctgtaagctccacgtctaggggcagggcacagacaaacaaaaagacagcagtaacctctgcagacttaaatgtccctgtctgacagctttgaagagagcagtggttctcccagcacgcagctggagatctgagaacgggcagactacctcctcaagtgggtccctgacccctgacccccgagcagcctaactgggaggcaccccctagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacacagagcgcctctcctcctccaaaggaacgcagttcctcaccagcaatggaacaaagctggatggagaatgactttgacgagctgagagaagaaggtttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctaattggtgtacctgaaagtgatggggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgaaagattttgtgaccaccaggcctgccctaaaagagctcctgaaggaagcgctaaacatggaaaggaacaaccagtaccagccgctgcaaaatcatgccaaaatgtaaagaccatcgagactaggaagaaactgcatcaactaacgagcaaaataaccagctaacatcatcatgacaggatcaaattcacacataacaatattaactttaaatgtaaatggactaaatgctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagacgttaaaccaacaaagatcaaaagagacaaagaaggccattacataatggtaaagggatcaattcaacaagaagagctaactatactaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaatttaactcatctccgcaccaagcggacctaatagacatctacagaactctccatcccaaatcaacagaatatacgtttttttcagcaccacaccacacctattccaaaattgaccacatagttggaagtaaagctctcctcagcaaatgtaaaagaacagaaattataacaaactatctctcagaccacagtgcaatcaaactagaattcaagattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaacaaagaaaaaaagagaggaaaatcaaatcgacacaataaaaaatgataaaggggatatcaccaccgatcccacagaaatacaaactaccatcagagaatactacaaacacctctatgcaaataaactagaaaatctagaagaaatggatacattccttgacacatacactctcccaagactaaaccaggaagaagttgaatctctgaatagaccaataacaggagctgaaattgtggcaataatcaatagtttaccaacgaaaaagagtccaggaccagatggattcacagccgaattctaccagaggtacaaggaggaactagtaccattccttctgaaactattccaatcaatagaaaaagagggaatcctccctaactcattttaggaggccagcatcattctgataccaaagccgggcagagacacaaccaaaaagaagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacagaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagatagggatgccctctctcactgctgctattcaacatagtgttggaagttctggccagggcaatcaggcaggagaaggaaataaagggtattcaattaggaaaagaggaagtcaaactgtccctgtttgcagacgacatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaatagaagaggatacaaacaaatggaagaacattccatgctcatgggtaggaagaatcaatatcgtgaaaaaggccatactgcccaaggtaatttacagattcaatgccatccccatcaagctaccaatgactttcttcacagaattggaaaaaactactttaaagttcatacggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaagtaacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggagtaaagatttaaacgttagtcctaaaaccataaaaaccctagaagaaaacctaggcattaccattcaggacataggcgtggggaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacaggtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtgaggggaggggggaggggtagcattgggagatatacctaatgctagatgacgagttagtgggtgcagcacaccagcatggcacatgtatacatatgtaactaacctgcacaatgtgcacatgtaccctaaaacttaaagtataataaaaaaaataaataaataaataaataaataaataaaaaggtcaacatcaaaaaaaaaaagaagatgtctcaagggaaattaaaaaaaatacactaaaccgaataaaaatgaaaatacaacaaatcctgttaaaatttgtaggacacatgctgctacttgaagagcctagacaaagaagaacaaaaataaatgcaagacaagaagaaagaaaataataaagagtagaaatcaatacaatttaaaatatgaaaaaagttaaaaatatcaatgtaacaaacagctattttaaaaaacacacacacaagaaattgacaaacctcttccaaaatgacaaaaaagacaaaaagagtagtaaagtttctaaatatatttttgttttttaagcaactgtaaatggtattgcatttttaacttcaatgtccatgaattcattgttaatgtacacagaaaaacaactgattttttttttttttttttttttgagacggagtctcgctctgtcgcccaggctggagtgcagtggcgggatctcggctcactgcaagctccgcttcccgggttcacgccattctcctgcctcagcctcccaagtagctgggactacaggcgcccgccactacgcccagctaattttttgtatttttagtagagaccgttagtatttttgtattcaccgttttagccgggatggtctcgatctcctgacctcgtgatccgcccgcctcggcctcccaaagtgctgggattacaggcatgagccaccgcgcccggccaacaactgatttttatatcttgcatcttgaaaccttgttgcgcttactcattaattctatgagtttattcattggtattttctatgtagaaaatcatatcatctacaaaaggagatggtttcatttctacctttccaatctgtatgccttttcctttcacttcttgcctttttgagctggcaagaactcccagtactgtgctgaatgagtagtgagagtgaacatcgttcctgttcccaacattaggggaaaacattcagtcttttaccattaattatgatgttagctgaaaggtttttataggtattcttcatcaaattgaagaagttatctttattcctattattctgagatcattcaataccgtaaatgggtgctgaattgcatcaaatttttttttctacattatgtgacttttcttctttagtctgttaatatggtgcattacattgattcagctgaatggtactctccccacccaacaacccagctgtctgtatgttcttaaggtggaagctcagagtgttgttttttttaacactatgaccctgaataaagcaacatatctatatagctagtcccagaatcactggtaattgcttacataagaagctccgtatggccagatgatacagattgtggacacatgagaaaaaccttcttgttgcaagtaaaatatatctgtggctgagaaaaaaagaccgtcaaatgaaaaattctacatacaaaaaaaaaaatcagacattgggcacggtggctaacgcctgtaatcccagtactttgggaggctgaggcaggcagatcacttgaggtcaggagttcaagaccagcttggccaacatggtaaaaccctgtctctactaaaaaaaaaaaaaaaaaaaaaaaattagctgagtgtggtggtgcatgcctgtgttcccagctattcgtgaggcaggagaatctcttgaacccaggaggcagatgttgcagtgagctgagattgcgccactgcactccagcctgggtgacagtatgagactccatctccaaaaaaaaaaaaattggatttttttggtttactttccctgattctattaatcactgaatacaataaaccaaatactaaataggattagttatgactcataaataaacataaggatgtatattacattgccattcattcattgtatgtaaatttcctacagctagactataatatacagcttcccaaagcaatctaaaagtaacaaactttaatgatatagcacaactgaagtttggtatagtaagtgcaaataagtattgcaatgacaattcatcatggtaaactcaagggtctgtaaaaaatcaaattatcgaggaccgagttcaagaagaactatattaatacatagatttctgtaacttggcagagaattccctacaattgctacatttaaagtaatcaacacatttctatatctcagaagaagacggaaattatgtgttcgcctatcctaatgtattaaacttttattacaatagttttagtatatttttagcttaacattaaggtagaaacattctatcaaactaagaaatagaaattgctctgaaattgcaaaaacctgtactatttcccattttaaaatcagaaggattacttctacagcatttaattgttacatcttacaataataaattacatgggactaatatgcataatagaacacaacggtagtagtaataatgattgagcagtagtatatttacataccgataaaagaaaacccatgtagaagaaactgaagaaaataaacgctagagtgaacaaatgatgagtaatgctccaaaatacaagaaaaagaaagaatgggatacagaatagaggttgagagattggacttgagcagagaaggaaccctcttcctccacatggaacatattgtgagggagggaagaataagatgagaaggaggagaaaaagaaacgaagaaaaaataaagggaaggaagaaaggaagaaagagagggggaaaaaagacataaaggaaggaaggaaaagtatagatattgactgttacggactgaattgtgtcctgtccccccaccaccaccactaccaaattttatgtcaaagccctaatgctccatgttactgtatttgcagattgggcctttaaagaggtattaaggttaaatgaggtcataaaggtggggctctaatccaatatgacttgtgtccttataagaagaagaagagacattaggaatgtgtacattcaaaaccaaaggccagggctgggcacagtagcttatgcctgtaatcccagcactttgggaggccaaggcaggcagatcactggagcccaggagtttgagaacagcctgggcaacgtagcgacagcccgtctctacaaaatatacaacaattagccaggcatggtggtgtgcacctgtagtcccagctactcaggaggctgaggtggaaggatcatttgagctcaggaggtcgcggctgcagtgagctgtgatcacaccatgacattccagactgggagacagagcaagaccctgcctcaaacaaaaacaaaaacccaaaggccatgtgagaacacacagagaaggcagccatctgcaagccagagggagacctcagaagaaaccagacctgccaacaccttgatcttggaagtccagactccagaactgtaagaaaataaactgttgttgtttaaatcacccagtctttagcattttgttatagcagcaggaacagactaatacattaagttagacggagggacagaaacagtgaactgctaatagtctccagtttttctttggaccagaaagcaagtctgacaaaaccaaggagagatggggtaaagaaattttgcaacagacccagaagagaatgaggtggtaggcgtaggggaacatgtgaaaggattgccaactgtccatttcagattagaaatcaatcttttgggggcatcagtcttcacagttacataattgcagttaagcagcctggttacgaggaacacagcaaaatgggaaaggtaaaaacctttgaggttttttaagtctgagtgataacctagctctatcagtgtagctgtgtcttgggttgttatctagagttataataatgatagttacatagagtgtgccaataataatatctactccttttagagttgttttagagttatgtaaaactttatcatagagttggtcagatagtagacaataaataatagctactatacttattactatgggattagtgtagtattggtacattgttaggaagatacagcaaaaaagagaaggaaaaaaaggaattaaaagaaagtggttcagccgggtgcggtagttcatgactgtaatcccagcactttgggagaccaaggcgggtgggatcacttgaggtcaggagttcgagactagcctgggcaacatggtgaaaccccatctctactaaaaatacaaaaaatgagccgggtatggtggcagatacctgtaatcccagctactcgggaagctgaggcaggagaatcacttgaacctgggaggtggaggttgcagtgagttgagatcgtgccactgcactcaagcctgggcaaaaagagtggaactctgtctcaaaaaagaaaaaaaaaagaaagtggttcaagtgacagagtagagtcttggctagatagaggagtaaagtgaatgcctgaggatactgacaagctggaaaacaggaggaaaaataagttaaatggcctgaggatgaagtccagttgaattttaaacccaagaaaatgagaaagatcgaaagattggtaattaaaataaaatcctccagagaagactgctgagtgtgaatcagcagctacttcttatatgtaacaccacagagaaacataacaaaaaaagaaagccagctaaatggtcgtggccttgtcattagctagcagtgtatcttgaaagaaggcgcttaaactgtgagccttactgctatttgaggattactgacaaattacctctggtttctcctttattccacttccactgtaccctctctccgacaacacacacatacacacatacacactcatcattatagtaaagatcaagaaaggcagtaaacaagagcaaagatctggaaagaaggcacattttcaaaactgacatttgtcttgtgcatcctcccacttcccttttccctctcccagtcccacctctacaagcccaaaaaccccagctctcactgctggctctgctcccagaaaaagcccaaagtgccatgtttctctttgacctttcttccctccctcccacctattaaaacttccactgagtctatctcagtttaacaagggaaaaggcaaactgattatgccttttcataatgatgccaggatgaacagtaactcatctgtgcttaaacctcccaagtgtgtttggcttaaaaattgaaacgaatctatttggcaaaatttcaggcagaatggaaaggggataatttggggcaaggagattttctttcttccctgttttaaagttgtgaggaagaaaaagaagtgtttgtcgtaactgacaacagacaaccaccacagaaaaaacatccacagcagctcagaatgctagactgctacacttaagggtactttttaggtgtacaggcctgcataggatgctgaagtggggggcttatgatagcaaacatgaggaagcaatctaccctactataaccctgaaaaaagtggttcagaaccatctaccacgtcatggtaatgactctcttttctcttccctttattacagaggctgcccctcaccctgccccccagatgctcccctgataaaaggaggtggggaaaaaggaggcagccataaaggcagcagcaggagtgaactctccatcttagttatttcctgttagaagtggggaaagaatctgcagcatagaagccttaacagaagcctgagtataaagcaagaaaatagctgtagatagaatcacatgaaaaagtgactatacaggaaaaggtgccattcaatgagaaaagggggaaaagtatcactgaagaaaagaaacactctcttcccaaaaaaggtagaaatacaatcaaatgtttcagagcagggatcagaaaacttcggcccacatgccaaatctaaccagtctcctgttttggtaaataaagttttatgggaacacagccacactcattcatttatgtgctgtctatatggctactttcacattataatggaagagctgaatgactgcagcagagaccatataacttgtaaagactaaaatatttactatctggccctttacagaaaaaaggccctgctttaggaggtcaggggtaagaaggggactgagatgaggccatcggatttgataataagtgatctctggcaaatatgaagaaataatttaaaagaagtttaaaagaaactaaatgtattctaataaagtagagacaatgaggataaggtattctttcaaacagcctctaggaacaaaggaagactacatgcaagtctgcatggggaaataagaaattttcttgatctcaccaatcttcctcctcttggagtcactctctttaatcaccaaccaaacagcttcccaaactagaaactgcagaattttggtaagtgattctagctccacactgctttctgtatcctcagttccaggtgcaatgcttagtatacaaaagataatgtttgttgagtaaaacaatttaagagtacagaatgtagagagaaaagattgagaagagagaaaaaaattctgtccccacttcatacctggaaaaacattccatgccacctctaatggctatgtggcttggactcaagtcttaagagtcatcataggccaggcgcagtggctcatgcttgtaatctcaacactttgggaggccaagcccagcagatcacttgaactcaggggttcaagaccagcctggccaacatggtaaaaccccgtctctactaaaaatataaaaattagccgggcacagcagtacatgcctataatcccagcactttgggagactgagacaggtgtatcacttgaggtcaggagttcaagatcagcctggccaacatggtgaaaccctgtctctactaaaaacataaaaattagccaagcgtggtggcatgtgcctgtaatcccagctacttgggaggctgagacaggaaaatcgcttgaacccaggaggcagaggttgcagtgagccgagatcgtgccactgcactaaaaaaagaaaaaagaaaaaaaaaaaaaaaaaggtctggttatttaaaagagcctgagactcctcccctttcttttgctcctgctatcaccatgtgacatactcatgcccccactgcctcaggaagtaaaagcttcctgaagcctcaccagaagccaagcagatgctggcatcatgcttgtatgacctgtagaactgtaggccaattaaacctcttttatttataaattacccagcttcaggtatttatttatagcaatgcaaaaacaagctaacacacacacagcaaagcctaagatttacatctatgtttactaccaaaaattttatagatttagctgttaaatttaggtctttggtgcattttgaattaacatttttacagggtatgaggttggagtctaatttcatttttgtacatgtgggtatctaattgtgccagcacactatgttgttttaacatcaaatgagaaaatatataagataatttgatactacaaatatttgtggttgttaaaattcaggtactaagcaaacagctcagtagaatactacaacaaacatgtaacctaattctcctgtctctagtttctcctttaatatctgttttatatctgtgtaaaacacagtccagtaatgcaacaactctacataaaactaaagatacctactgctgacagaattagaatttctggaaattctgagacagaacttgcccctgatttttccagtttatacaagctatccacaatccttcgctcatggcctccttcctctcttttcaattttccaggctcatctcttaccattgttcccaaccacttggtctggctacacaatgttactagacacatctgatgtgaagtactcttgaaagactctgtagattactcatgctagacttttggctttccttaacctgggggttccctgaagcagaaagaattttatttatccctatattcaagagtccaggagagtgcccaacacaaagcaggtgtttcataaacacttgctaagttaaaggaatacacaggcaggcatggtggctcacacctgtaatcccagcactttggaaggcagaggtgggaggatcacttgaggccaagagttagaaactagcctgggcaaaatagcgcaaccctatctctacaaaagtaaaattttaaaaatcagccagtcctagtggtatgtgcctatgttcccagctactcaggaggctgaggcagaagaacagcttgaggccaggagttcaagacagcagtgagctatgatcacaccactgcactctatcccaggcaatagaggaatatcctgtctccactcccctccacactccaaaaaaaaaaaaaaaaaaaaaaaggaatgtgcctataaatggaagacagtgacgaaggtaaaggaataaagtagacgaaggcaacaggtttggaaaacattaaatcatcttgtttggcaggaaaaattgtctatatagggggatgttgagagaagcctggaaacctggatgggacagcaagagtaaaggccaagtgaggaatttgtacagtgatagttttttagggtaacttgatggatttttagacacagattataccaattctcttttcccccaataagagatttgtgactttggctaaattatttgactcagaaaagactcaagtacttcatacacaaaattagactaatctctttagtatgataggctcagctggtaggcccatcaccctagacacagaagaaaaaaataatcatgctataataaggaagcttgacagtcatttacgagagtttaccaacttttgagcagtgaaatctactttccaaataaactcatacatggaaccctagtacagaaaccttttttaaacccacaataattgaaaggggcatgaaaaaaactggagaccccacacacccaccttccttcctctcacaaacattggttcatataatcaagtggacttcaaatcaaatatggggaaccctaaacactactttagaacatggtcaaaagtttactaatctagagggatccaggtaaagtcatacaaccaagattcccctttgtggctactgattcgaaaataaatgctagggaggaaacaaagataaaaactaaagatggaaaggaaggtcctactgtaattttcctgaccagaccaatggagggcataaactaggatggtagtattaaaaagacagaagccaagcaaatataacatacagaaactgttttcactttgttttccgtattcttgatgggaaccatgctgacccaggagagactgcccctcccaaggctagctacttcttagacagcaaactacccctccttgagtgcttttcgcatgcaaaccactcaatctaaaactacctcccatccatccccagtattcagctctcacagaactcttatattctgggactattagaatagtcccctgttctaataatcacgccagggccaggtatcaaacaacttgggggctgctcttatatgtgactatgccgacattattaaaaccagccaattctaagcctccttaccctgcctcgcctgttccttctcactaaaatcatgataaaggctctcccccatgatttccctagctatttctgcctcctaaacaaccctggtgcttccctatgagcactatgtggcgtggcatatatgccaccctgtctgatgtgccatgccctctccacttagaaactgtatcaatcttttcaatggcagttgtctcctgacgtgttagtttcaccatatttgaataataatataaaccacattttaaaaatagttcaggaccaagcaccaaacaaacagcacgtacttagagaataaaatgtgaagtattaagaatcagtattaaggctgggcatggtgggtcatgcctgtaatcccagcactttgggaggctaaggcgagaggactgcttgagcccacgtgttcgagaccagcctgggcaacacaatgagaccccatctccacaaaaaaattttaaaaattagcaggggtggtggcacacgcctgaagttgcagctacttgggaggccaaggtgggagaatcacttgagcctgggaggtcagggctactgtgaaccctaatggcaccagtgtactccagcctgggtgacagagaggaacagaagaagaaggagaaggagaaggagaaggagaaggaggagaaggaggagaaggagaagaaggaggagaaggaggagaaggaggagaaggaggagaagaaggagaagaaggataaggagaaggagaagaacaagaagaagaagaggaagaggaagaggaagaagaggaagaggaagaagaagaagaagaaagaaagaaacagtataaagatgagattttctagttatgagagatgccaaagcagaatgttttaagagataaacctgacatatagtaaacatttctttttttttattaaaacacattaactataaatatgtttaacatcatttcttatcttcatcattcaagatatctgagccaaaaacctaggccaaaaatcctgactctcatttacattccacatttagataatcagaaaatacaaatatccagaatctggccacatctcaacaactttacctttactaccctggttcaggccgccattatctcttacctggactactgaagaagtaacctcctcactattcacctggcttccattcttgtcctgctacaatcccttctcaatgaagaacgagccgtttaaatcacacatcagaccataccattcctctgctcaaaaccctgcaatggtttcctgtttcactcagggtaaaagctaaaggtcctgccgtggtttatgaaggctctaagtgatctggttccctgccatccctctgatctcatctcctacttctttcaccatcttatccagctccagccacttaaacctccttactgtttctaaaacatcaaacacagtcacacatcagtttactctgactagaacgttctttccccagaaatctgcattgctcatttacttagctccttcacatctctactataagtcaccttattagacaggcctttcttgaccatcctacatataatatcacaaacatatctgtcattctgtatccctcttatcctgctttttcttcatagctgttatcagtacctgatatgctatagttttcgtttttttgtgtgtttttttcccgagacagtgtctcactctgtctcccaggctagagggcagtggcacgacctcggctcactgcaacctccgcctcctgggttcaagcaattctcctgcctcagcctccaaagtagctgggactacaggcatacgccactatgcccacctactttttgtatttttaatagaaaatgcgtttcactatgttggtcaggctggtcttgaactcctgactttgggtgatccacccgcctcagcctcccaaagtgctgggattacaggcgtgggccactgtgcccagctttttgtgtgtaatttactgtctttccccactacaaataggtacctaagagattggaactttgtttcattcactgttatgtatgagtgcctaaaacagtgtctgagcaggcactcaataaatatgaaataaattaatataccaaagcctttctgagggatttacacttgtactgctcaaaaatccataaacctcgcaaagagacaaaactggatcactagtggtaatatataaaaatgtaaaaataaaaatgtagtcttctaagaaagatagaaggcttgacagtaaatgattaactaccaaaagaataaagtataaatgagagattggcgaccatgtgaactcacctcaagagaataatagatacctacaaatgaacatgtgaaaaactttataataaaactatataattaagcacagagaataagactatcttgccaagatttgctaacttggcaaacatccatattaaactcagcttccccaattccagatacaaatgaaattgtgaatttggcaattcactggagagaaagactgcattacaatctaggttcacattaaagttacctcattcttctcaacttagatctgacgcagaggaaaatttttaacagattctattggacatatgccatactatagtcagtaaagttcaacattaacattttagatgttaacctaaatgatttgttttcctaaaactaaactgcactaaaaaaatatgcattatgagtataaaatgaattattttaaataatattttgtcaaagaaaaagcaatttataacaccagtccttccctcgtattttgatttcattcatgtagtgcctcacccacagctgaacacatggtagcactcaagctgttcactgataagagagagaatattctttccttcaaggtttattaaatatagatatgtccacctcaaccttcccagttattaaaaaatgcaaatgaaaattatgtaccccaaatttgtatataaatgtattaatcatttatttaataattagtatgtcataaagcgtagtattagatactgaagacacaaaataaaaattacacatgctgctatcaataacttcataatgtggtagagaagtcatataaactataacagaagatgataacttgtatggtcttggggcacacaagatgcaaaggaagcccagaagaaaagttcccaagatagaatgtgtagaaaaaagatgggagaaaatgcaggcataaagtaacacttagaagaaggcagaggtaaacctaacactacctacaaatgatagtatggctaaaggaaaggaaatatcacatgaataaagatgtatgcagagcccaaggtcttacatgacacccttaaaaatttggctattaatggggaggatcttaagtaagacagtaatatgagttgtgtttcatttaagatgatcaatctagcagcatcatgaagtttactttagagaggagattgagactgcagattattaaatcagttggtactgatccagaagaaggtagaacgatggcggtggcgttggctttgccagctcaggactgagtgcaagtaacagagaatcagccagattctccagaggctcttcaggttctcctctgtctttcagtcagcagtctcagtccatttgcggaggaacattggtgttacagcagtggcgtttaataaggaacttgatcctgtacagaaactctttatgtacaaggttagagaatacaaatctaagtgacagacatctggaggatctgttgatactgatccagagtaccagcaagagccagagaagaagctttttaagctcaagcaagtgtatggtaaagcagacatgaatacattccctaacttcaaatttgaagatcccaaacttgaagtcatcaaaaaaccccaggcctgaagaaataaagtaaaattaacctggtaagttgtcaagggttagctgtacaactagctagaagtttcagaataaacatacattcacaactgtcaaatgttcttttaatctcgattccaaataaattagttggtgatgtggagtattaaaaaaatctggaaggaaaaataaagatgtggacgaaaagaaggggatattacttgagagatattaagaaagttacagagatgggaactggtgaataatgaaaacttgaatcagcacagtggcagtggagctggacaggaaggagggaaggaaacatcaacaggacctggtgactgattaaaggcagaagattgggccaggcacagtggcctgtaatgccagcactttgggaggccaaggcaggcggatcacttgagtccaggagtttgagaacagcctgggcaacatggtgaaaccctgtctctaaaagaaaaaatatatatatatacaaaaattaaccaggggtggtggtgcatgcctgtagtcccagctactcgggaggctgaggtgggaggatcacttgaacccaggaagcggaggttccagtgagcggagatcgtgccactgcactctagtctgggtgacagagtgagaccctgtctcaaaataaaataaaaaataaaggcggaagattggacagagggaggatactcttggttaatggcaccaccatctaaccagttgtttcaaatacatagttggttcaaatataaagggagaaacaagcctgatgaaaaaacagtgaaaacaacttggagatattggatttgaattatctcaaaatagtaaagaaaattatataagcagattactagaaatatgtctagaattcaagacagagataaaagctggaggaaagccagggaatggagacagcagtgttctctactgctgtcttaaccctttctttcagagccacatataaaagcagttcactggcacctctgcttcctgggtccaagtgattctcccacctcagcctcccaagtagctgggactacaggcatgcgtttttatactattttgagagaattcaaatgcaatatccccaggttattttcactgttttttcattctcccaaaggaaaactgtttgtctcctaaatcaaggagcacgtgagcctgtaaagttccatagcagagaggaaataagtgatgggtaggagaaaaaaaaacaagaagaaagaggcatacccttctataatactacagccagaaaagggtaaaatgaggccccaaagttcaggcatatgtatatggccatttaactaggactttttaagcaataagcatgctgtgcttaggctgtctcagcactattgttaaatgctttaattatgtaacttttgatacattcatgttatcatatgttgtaattattgttgttactattacattttctctatatagcacttattatgtatggggcaatgtactaagtagctttacaaaaattatttcttttaatcctcaccaaaaccctatgaggaagtatttctccattttatatatgagaaaactgagggatagaaaggttaaataacttgccctcaaatactcagcaaataaaggacagagttgaaaatggaacccaggcagtctagctccaaagtccatgatcttaatcatcaagttatactacctcttttcaggtggataaagaatacttttggttactaacttaatctgaagacaactattttctagtaggaaatatttctaattttacaatacatgtaggagaaaattgagtttactgatcagaaacttgctagactacattattaagtaaaaaaacacacagaattaaaatattatttaaaacatctgtacatttttaatctgtataaacatgtatatataacaatagttctcatctatataaatatgtacatataataattgttcttaaattttactatgcatcagaatttcttggtgggcttgttaaatgcagattgctgaacccctacttcaaaccccaatctttcccctattacttacgaaataaagtacaacttcttttcagcatggcttacctttggccatgaggcatcgtctaaccatctttcaataagtttttagtacattacctatttttttatgctttccctaatacaacccttcctaataaagccatacattccttctatgattccaaagcacctctaaaatagtaaaaaacagaacaatgataataatatcaattaactctgtggggcattcccaaggaaacatgaattacctcattcaatcctcataacaactcctcaggataaagattataattattctcactgtacatatgggaaaaaagtgagacatggagaggttaaattgggcatggtaatacaatcagcaagtagaaaagctaggattctaccactgcaattatactatataagcaattactagattgttcagtacttggatactatttagatactagatttttctaagtactaatgtaaataatttccttattcatttttacacttatttaactgacatttactgactgcctatcatatgccaggcattgtgttaggcacgaaagactatcatgttaaaatacaagggaagacccagtacctgctctcttgagacatggaatccagtggaaaaaccaaacattaaattaaaaatcagagaaatatttcaagaaatatgtgttaaagacaaaaagtacaaggcactccaagattataataggaagatctaagctgtttatagttattgtactggcagtgtcctattacaagagtataagttacacagaatttgcatttcaggatgccaaataattccatttcaaaatgacgctttcaaaatcaaattaattaattataagaccaaagtcatatagttaaaatttaaaacatattatttaaaatgaaatttaaatatgtcagctctttatttttccccttagcaaatggagctattacgcatctgacacagaatgtaataaatataaactatccaaaactaataaaatagcatttgaaaatgtccttgcaatattggtcatgataaaggtaaaataatatgccaagttcctgacaatcctagtagtgcataaagtacttccattttggacaatgctaactttcttatgattgaattagatccatgacttaatatacatcatttgtaagattttttttttttttttttacaaaaagcagacttctttcataataaatttcaaaatgaaaaccaatgtttttttacagaggaaaaatgcctaaaagtccaaatactgatcttacaaagagacatgaaaggtaaaatcaagtatgaaccaggcctggattcccacatcttcagtttctatttatcaaacagaaaaatctttccaactttctcctttcctgtataagaccaaaactatgcaatattctgtttgtattacaattacactaattcaatgcaggtcacttgctttttactgagtccagatgacattcagtaaactaaacatgggccaattagtttaaaaaaaagaggaagaaaagaaaaaaggaagaaacgagtgagttctgattgcctttgggtaggtcatacagtggctacagagcatcacagcctgaacttcattttggctaacaccaaccatacggctaacattaaggactagcattttttattcctttcagatttctcacatttggaaattccaatttaaataattttctggtgaaagtgaggacagcactcctgcataatatcagttttcccctaattcaactccaatgtcttattttggagctactaaaatggaatctgcacaatgtctaaaaaagtataataatcctttttaaccaatttttttatgtattacagttttaaatgagcaaatgaaactgataatttagctgacacaaacccacacaaaaaaagatggtctaaagctatgaagtttcaacatcaatgtttgtaatctcaaatcaacctgaaccaccatacaattaggtatatgacaaactaagtaatagaaatattcataactaaaagcaatattatttttaaatatcttattaggtgttggcacccaacattttcttataatctatcatgtaaagaaatctgttttactattccttttaaactctctactcatgctactttaggtgtgtttctagaaataaatactaaactctctgctaattttttttggctaagaaattttttgaaagttataatgtaactaagttaaaatgtacatataatcataatttgatatcaagactgctttcatacaaaaaacctacattaattaattccttaagtaaatttacactttatcaattgttggtattttaaaaagtactcaaaagaaactcttcattcaccattattacaaaaatggaagtctccaaatatgtaaactagcttgatttttaaatttgttacttatttagcctaatttttttaaacttgcctaaatttaactgaagaatattatgttcctgcaagtgttcatgaatacaaagatacagtaatgaagatggaaattatttactctaacaattctgactgcatgactgttaaatcacttacatacggccaaatgatctacaaggaagcagggaggtcctgaaattgtgtactcatatccattttcaactactgcacaggtgacacaaccaatcaaggcattactgaaacagaatgggaatagaaaggacttagtgaataaaagtgacttctttagacaaaaatgtagaggttagcttgtgaccaaggtggaagaaacagcagcaccattcctcccattgcttgttcatattaagagaaaactgagaccactaagaggcaaaggacagaggacagcaacaccagcaaagagacaggcagcagtggggtcagagcatgagaacagtattaagagttaaacatagagcacagagggggtggtttaaaatgtcagttttactcaattatttataggacagttcttggaaataatgttacaatgaaatgttggttatataaaaatcttatttaatgtagtaattactatttagacaagggcaaatatagtaaatattaagtaaaaattaacaataattaaaatgggcttatggtctgaaatagacatattatgggaaaggattactgttctaacaactacgcataaagctgtgaaaaggcaatagttatactagtctgtagaaacagtactctaaaagttacaataaggagatacacttttttttttttttttttgagcaaggtcttattctgtcacccacactggaacacagtggcatgatcacagctcactgcagtctcaacctcctgggctcaaccgatcctctcacctcaggttcctgagtagctgggactacaggcgcatgccaccacacccagctaattgtttttgtatgttttgtagagacagggttttgtcatgttgcccaggctggtatgaaattcctgggctcaagcaatccacccacctcagcctcccaaagtgctgggattataggcatgaggcaccatgcctggtccaatatggatattaatcctcctgaaatagatgggattttaaaatgcaatactcagtttcaatgttgaaatgtgctcttctttcactgaaaatgacatgacactgtgaaagctttcttctaacacaggaatttttagaccttcacacaagttttcataatgtttaatactttcaataagcttcatgactattaatgctttggggaaaacttactttttgtttctttatttgcttttcaaaaccaaaggcatatagtaataattcattatgcttttacaatcaggtttcatctgatgtcaatgttacctttcatatctttttaagtgtttttccatgttaacgtgaaggtgtgtttcttaacttcacatagcaagaaacaaagacacgcctttgttcaatttaaatattttggttcctggccaggcgcggtggctcacgcctgtaatcccagcactttggaaggcttaggcagatggatcacctgaggtcaggagttcaagactagcctggccaacatggtgaaaccccatctttactaaaaatacaaaaattagttgggagtggtggtgtatgcctgcaatcccagctgcttgagaggctgttatttgttatatgttattccatattccctattctattctattctattctactcattcagagacaggatctcaccccatcacccaggctggagtgcagtggcgcgatcacggctcactgcagtcttgacctcctggactcaagtgattctcccacctcagtctcccaagtagctgggactacaggcacaagccactatgccaggctaatttttgtactgtagacacggggtttcaccatgttgtccaggctggtctagaactcctgagctcaagtgatctgcctgccttggcctcccaaagtgctgggaatacaggcttgagcaactgtgcctgacctccatattcattttattcaaaagaattttatacacaaaattgtggcaaaacttcaaggaagaatatattcttttgtagttctgtaatctagtggaaaaatgtgatataaaaaaacataaaagttaatgatatactagtgaagggttcctaatattcaattaactttgattttattctcaatctattttatactaccattcttcttatgaaaatatcttcaacactttcattgtaccaataaacaacaatacaataattaacaatttgcatttattattaaagtattaaatttaaaactccaaagcacctacttgaaaggaacattccaatataatttaattattcttggtcatttgctcatgtttccttaaatataaatacagtatacctaacaaataataagcataattataaatattatcacattttacaattttttattctaataaagaaaacatatgctcaaataatggaatttaactataaaatctaatttttagctcattgaaaaaacataaaaaaggatgatcaaactatttaccagtcttaaatatttaagagtataatatgtttatactactatatttatatgttataaatacagactatatattaacacatttataactatagtaatatgtatttatatagtataaaaatatactactatatataatactggctttttaaatacatttcctaatttcctttatttactactttaactttgtagtttataatttacaaatttcccagcactatatcttccccacaagaagatttccctttctagtggctactaacatacaatgtttaaggattaattaatgatagattggttaatgaatctgcaaaatatttagctcttttatttccatttttctctcctgctaattgacttttgaccatgttagtgtttattaagctcaagatccaaattagctaaattcttgccctcccaaacaggaggcagtctaaagcaaaggtgttggttgactgcaagttctggtggaatttacctattaatcagttctacaccattttgtcaaatctgaaccaatatagtgccaaaagaacattcttaaatattaagacttttatctttggcatacaggattcattcatccaacaaatacatactgagtaactactatgggccaagcactgttctagtgcttaacatatattagtgaacaaaagaaataagaaattcctgccctcatgttgccaatttaccaaccctgtgctgtgctccacactaaaaatacaaaattgaagatactaccccttacttaaagaagatttaatctaatcaaaggcaagaaaaatgtcctcaatgcaacttatcatataatgctaaaatatgcatatgtaaatggtagcagaagcatatataaagtgccatgaagagtagaggggaagaagcctctgtgcagatgttactgagtacaacatcacaaggagtataattctctctgcctataacaatcaaacacaggcattccaacctgagaacagatatgcccaatacagctttatatctaactctatgttgtctttcttagaggtaaatcaaggtgctgctttacagaccttcataattaatgtccccttagcatcttcaagagttaatggaaaaggagggaaaattctaatcactacatgttgacactttttagtagccaagaaaagttctcaaagaatgacaatttaaaaaattaacttgtatacactttctaggttaaccgtgggcctcaataatccctaccattccaatacacaaatgtcacaagttctcattcatatgtgagagctcaaaccagtggatctcatgacatatggagtacacttgccatcaccagaggccaggaaggggagcggggagggaggagtgaaatggagggaaaagggaaataaatgtatttattggcactgagctgtacacttaacaatggtaaagatggttaatttttaaaatattttcaataataatattaataattatccttaccatccttatctcttattcacatgaagacattagttaccatttattaagtgcctccagcaggagaggcactgtgtacaccctttatataacattatttctaaggcttaaacctttagaagattagtatttttattacccagtttttcacatgtgaagactgagagtgggagagattgtataatttgcccaaggttgtacaccatttggcctggaatgtaaaagaaatccatacgaacacaaagtcaaggatcttttcactctacctgatagctgcccactcccataaagaatctaatattgagggatattaattcctcttctatgattatttttaaccatcctatatgtagataaatatgtaaactgatctaaaacagtttacatccttgttgaaaacaggatcacatatgattacctagcctgctaacccagacaggcagatggatggacaggcagatggaagaatgaacaaaatctcaagtataatgacatccaaactgtttaaatctactgcacagtgttcttataaatcttcaatggcaagtccatttgactgacactatttctaaaagaacaattaggctaggcacagtggcccatgtctgtaatctcagcattttgggagggcaaggcagaaagatcacttgagcccaggagtttgggaccagcttgagcaacatagtgagaccctcacctctacaaaaatatttaaaaattagctgggtgtggtggcacacacacctgtcgtctcagctactccagaggctgaggtggaaggatcacttgagcctgggagatcaaggctgcagtgagacatgattgctctccactgccctccagcctgggcgacagagagctcaaaaaataaaatacaataaatgaaagcacaattaaacaaaaaataaacttaccttgagatctttgtaacacctttattatccctattattacctcatcttctattaatgtccttctggctcactccagccacactggcctctggttaagaatcaaagagccaagcatgttcccatctcacacagactttgtactgtctgttccctccaatcaaggcagtcttaccccagatggctcactcccttgtgtgcttcagtctttagcttagatatctccttcttaacaaggcatccttgactaccatttaaaagtacaatcagaccttcatactccctaatcaccatccaatgatatattttatgtatgtgttatatttattatgtctaacccaaccagaatataaacacaatgaaggcaggaatttttgttttactcaaggctatatatcctgcccatagaaaagtggctgatgcacaacaaatatttgttgaatgaataaatgaactttgtgaccaggcacagtggctcatgtgtataatctcagcactctgggaggccaaaggaaggatagcttgtgcctagaagtttgagaccagcctgggcaacatactgagacttcacctctacaaaaaacttaaaaattagctgggtgtgatggcatgcacctgtagtcccagctactcaggtcaatgtgggctgaagtgggaaaatctcctgagctcagatatttgaggctgtagttactatgatcacaccactgcactccagcataggcaacagacaaagaccccaactcaacaataataataacaaccacaataataataatactaaatgaacttcattatttggaacctaaagaggaattgtataagttcaatttcatcactgataaataattcaattaaagacttcttttaaagccaagttttatattatttagcactactgaacttccccttcttataaaatgtttgcctccttactctggccaaaaatcttcttttcattgctctttagaagtttaacatgatgaaaatcagtgtttgactttaaaagtcaaagtatgaatgaaaccgaacttgtatagacacatcttttagctctcatttcaataaactgttattaaatccataatcttttgagagagcaactcacagattaaaaattaaaattaatattttatctgatgctttacggcatccattgtattgaatgcatttgtttaatatttctaagtctttagaaaagcttctgagaaaattgatttccttatgttgtttacagtctgtgaccaaatatttttaggacattcacatgaataaagggtcccaaatgcaacagaaattataatcacatcataacttaagctttaaattattcatgtcttttatgtttaacaaaaaaactattatccaaaactatttattatattaaaatatttttactcaacaatctttttctcctaaggtcaatgaaggcatatgactcctccccaattatataactttttattattttaattaaattaactgataccagcatgttttaatatcatccctacacatttagaagaagtaaataacctagagatcaaaatacacagtaaacccatacaaacagcagtttttcattgccatctctctatatataaacattgaatgcaattctatgaaagtatggctccacgtattcagatgaggaatatgtctgtttacatgtgtctctttcccggtccacattacagggggacctgtgtgtgcctccgtggttaagatttactgcatgttcacattaaagtctcatttccaacatttaaacatgcagccacaaagaccaattagaacagttattagtacaacccttggtgtaccaaagatttgggagttcataaagttgaaattgattgtttatggacaattacaggtaccaaaatgatttaaaacatttcaatttttgctctgctgaacgagactcatttaaacagcagaactagaagcagagacttaaatatcaacttgtaatcaaaaatcaccagtaatgtcttagcagcgtgttcatcctcctactcagtagagtccttaaacatacagggactccaatattagcttcaaaacattttcagaatgtctagcaaaaatatgtcaaacctggatctctgacttaaaggaacacacaaggcctaagaaataattgctgtctcaaatactgtggagttaataaggttttaaagtatataaagttgctataggctaaacggcacattttatattagacaccctttcttgctaaacactgtattatatattaaactgtagcaaaagtgaatgaatctatgaggaaaatcaaaatgaaattttcaagtactcacataatgacatacctctaaactgtgaggtactttatgacagagtgtgtgattcattcatcttttaattcctagtgcttgaatacaaagttgatattcagtaaacactgattgaatagaaaaatgagtaaatacaacttgaagaataactatgtaatgagatttctgattttacaaaacactttcactacttttctaattatatatatatacatatatagatatagatacagatatagatagatatagatacagatatagatatcgagtagagacagggttttgccatgttgctggtctagaattcctgagctcaagcaatccacccacctcgaactcccaaagtgttgggattacaggcgtgagctatcatgcccagtcgtgcttcaccacttttcaatgtcaacttcaagaaaatgaaaattgcacctttctgaacaaactttaagtctaccctaaactgctaagaatcaacactaagagcagatgacataatgtgtgggaaaataaaaagtcagccagccagctggacatcagtctcttctctgactgctatgactaaactcttcaaggttataacttttcaaatgctaccactgtaatgaactatttcattgctagtgttacctcctttccttggtcttcccctttctagacaagaattcctgttattatctcattcccttcttgactgcactttacacactggtttcaatttgtacttgacctagttcccagaaaacacccagttttccttttctcacttagtatcttaatatttgtaatattaataacccacttatctattcaattgtttaattgtattttatctattatctattcaattgtttatttctatttaattgtagtaactctattcagagctagcctatgcaaaagagaagacagcagtcttcagatgtgacttacttagtacagaaagatcccaaccctaatatatacaaacacatacacatgcaaacacacacacctgctataaaccaaaattagagatacatttctttgtgttaaactcctgcttcttgaggttcttattctccctctgtccctctcaattgttctgtcactctttacctcctgcttttttctgttttacagtaattctctccagctaacttcactcttctttcttctacatacaacatccaatgtgtccaaaaaaattctgtgggtttttgtttcaaaatatatccaaaacctgattaggtcttaccacctccactgttaccaacctaacacatgccacgatcatctctcacttggattactgcagaggcctcccaactggcctctttccttctatctttgcccaccccgcccccacaatctgttctcaacaaaacctaagtaatcctttaaaaatgtaaatcagatcttatcactctgctgctcaaggcctgccaggggtctgtctacaaggcactactgatctcacctacctccatcacctcccttacttcctgtctttctctgacattatctcctacttctttgtccctagatcactctgctcccttctgcctctccaaacacaaaagggctttccattgaccattccatctgcccaaaatgatctccccaggtatatgtgtggtttactcccacaatacctgcaagcctctactcaaatatcaccttcccaaggaggctctgaacaccatatttaaaatcacaaatttgtccaccaaaactccctgtatccttcttagtgtacactctagttttctttaatcatttccaaaacacttatggctttctcatattctatataaattacttattatatattgttttatatctattgcctccttctaggatgtaatctctgatatatcccaaatgcctagaaaggtatctggcagagtagacaccgaataaaaatttgaatacatgaaaatatactagactatcttaaaatacaataaatatatagtatgttctttttgtttgttttttgagacagggtctcattctgttactcaggctggactgcagtggcacgatctcggctcactgcaacctcagcctctcagggtccacaggcaggtgccaccacgcccagataatttctgtatttctttgtagagacacagtatgccatgtttccaaggctggtgttgaattccttgatacaagcaatcctcccacctaggcctcctgagtagctgggattgtaggcatgagccattgcacccagccttgatgtcattatctaatgtctcctccttaataaattgttaataacccttaataaattgtggctaacataccttttacaatacaactctagaccattaatgtgtcccataaatcctgtgtgcatcaggaggtatcttttttgcctcaatgccttttattaatgcactgtcagtattctacttgggctttattcaaatacaagcctataaaactactgaatctttttccatccctcctactttcccattcttgatttttcccctacctttctctacaactccaggtgaccagcaatgacaacctaatatgtatcactccataccttcttctccatccttaaataaccacgtacaaacatatgtagagatttaaaattctattttgtttctttgggaatgaagttgtccccatatatgctccttcacatcttatttttctcatctcatagcaaacagtggaatataactacattaattggtatacacagaactccattctttttaatggccgcatgttacaaggccaaaatgtatcaaatgtattcaacttttcccaccttgtttccagttttttaccactaataaaaatactgcaaaaagatccttgctttgaaaaatgcatatatccttacatatttatgcttttatttttatgagataaattctaggggtaaaactgccaaaactgctttccaagaaaagaagtaaatgtcacatttctaccacaaatgccttttgctctaatttgccaccaatattgagtggagccataacatttttaattttggatatatgatgatatctcagccaggcacagtggctcaagcctgtaatccctgtacttcgggaagccaaggcagatgaatcacttgagatcaggagttcaagccagtctggccaatatggtgaaaccccatctctactaaaaatacaaaaataagccggctgtggtggcacccacctgtagtcccagctactcgggaggctgaggcaggagaatcacttgaacctggaggcggaagttgcagtgagccaagattgtgccacagcactccagcctgggtgacagagcaagactccgtctcaaaaaaaaaaaaaaaattagcccgggcatggtggcgggcacctgtaatcccagctacttgggaggctgaggaaggaaaatcacttgaagccaggaggcagatgttgcagtgagccaagattgtgcactgcactccagcctgggcaacaagagcaagactctgtctcaaaaaaaaaaaaaaaaactcaatgttactttaatctgcatatcctaaagtactattaatcatcttcctatgtgtcattagtctattgggatttgcatttctgtcaactattcatctctctccctgttttttatactggattgtcttttgacactaatttgtagttttttttaatatcgtagatatcaaccatttatctgtaatttgaagtataaatatttttcccaacctaccgcttatctattgagtttgctgccaatgagatcccacatataagttacaaaaaaaatcattatatgattagatttatttttctttcatagctcctgcatttcctatgttggttagaaacttctcccaagtttctaattcatgcatatagtccagaattcatattcttccatgtaagtctctagtatacttagaatttatttaggtattgtaagagaccaaagattcaattttctttcagatgaacagataattccaaatgcatgattatcattttcccattgagctcaaattttcacatttatcatattaaattcccaacagactattgtaattacagtagctttagaatttattttaatatctggtaaagctattcatttctcacttttttctccataattttcttagtcaacaagtatgaacattatgttacccaattccaatgtaaaccataaaggaattttaactagaactgcaattaacttttaaacaatttttggtaaaagattattatgatatagtttttgcatggcaacacaatattataagaattgggaacatatttttaaagccagcatgctctttccttcatttcaattccagtgtaatgtctttcaattagatttttacgaatttcttcctacagaagtgtacttcttttgttaactttattcctaaggattttctagtttttgaaactacttttaattgattactttttccaatttttctttaataacattattatcagcactgagaaaggctaccaatttctgtgtattttatatacaactattcaccaaattatgttattaagtctgataatattttactggtaccttttggatatcataagcatacaatcatatcagcaaaataaaatgtatttttcctcttcttttctaatgttcatacagattatttcattttttacctcattcaacatgctagaacaaaactaaataacgataatgataataatgataatagaggacatacttgttattagaaataacattagcattccactgtttaaaatgtttacttttgaagaatggcccggagggcagccaagatgaccgaataggaacaactctggtctacagctctcagcgtgagcgacacagaagatgggtgatttctacatttccatctgaggtaccgggttcacctcactagggagtgccagacagtgggcgcaggacagggggtgcagcgcaccatgcgcgagccaaagcagggagaggtattgcctcactcgggaagcgcaaggggtcagggagtccctttcctagtcaaagaaaggggtgacagagggcacctggaaaagcgggtcactcccaccctaatactgtgcttttccgacgggcttaaaaaacagcgcaccaggagattatatcccgcccatggctcggagggtcctacgcccacggagtctcgctgattgctaggacagcagtctgagatcaaactgcaaggtggcagcgaggctgggggaggggcgcctgccattgcccaggcttgcttaggtaaacaaagcagccaggaagctccaactgggtagcacccaccacagctcaaggaggcctgcctgcctctgtaggctgcacctctggaggaagggcacagacaaacaaaaagacagcagtaacctctgcagacttaaatgtccctgtctgaacagctttgaagacagcagtggttctcccagcacgcagctggagatctgagaacgggcagactgcctcctcaagtgggtccctgacccctggccctggagccgcctaactgggaggcacccccaagtaggggcagactgacacctcacacggccgggtactcctctgagacaaaacttccagaggaacgatcagacagcagcattcgcggtcacgaaaatctgctgttctgcagccaccgctgctggtacccaggcaaaccgagtctggagtggacctctagcaaactccaacacacctgcagctgagggtcctgtctgtaggaaggaaaactaacaaacagaaaggacatccacaccaaaaacccatctctacatcaccatcatcaaagaccaaaagtagataaaaccacaaagatgggggaaaacagagcagaaaaactggaaactctaaaaagcagagtgcctatcctcctccaaaggaatgcagctcctcaccagcaacggaacaaagctggacggagaatgactttgacgagttgagagaagaaggcttcagacgatcaaactactctgagctacaggaggaaattcaaaccaaaggcaaagaagttgaaaactttcaaaaaaatttagacgaatgtataactagaataaccaatatagagaagtgcttaaaggagctgatggagctgaaagccaaggctcgagaactacgtgaagaatgcagaagcctcaggagctgatgtgatcaactggaagaaagggtatcagtgatggaagatgaaatgaagcgagaagggaagtttagagaaaaaagaatgaaaagaaatgaacaaagcctccaagaaatatgggactatgtgaaaagaccagatctacgtctgattggtgtacctgaaagtgacagggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcaagttacccacaaagggaagcccctcagaccaacagcggatctctcggcaaaactctacaagccagaagacagtgggggccaatattcaagattattaaagaaaagaattttcaaaccagaatttcatatccagccaaactaagcttcataagtgaaggagaaataaaatcctttacagaaaagcaaatgctgagagattttgtcaccaccaggcctgccctaaaagagctcctgaaggaagcactaaacatggaaaggaacaaccggtaccagccactacaaaatcatgccgaattgtaaagaccaccaatgctaggaagaaactgcatcaactaacgagcaaaataaccagctaacatcatcatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagattaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacactccactgtcaacattagacagatcaaccagacagaaagttaataagcatacccaggaactgaactcagctctgcaccaagcggaactaatagacatctacagaactctccaccccaaatcaacagaatatacatttctttcagcaccacaccacacctattccaaaactgaccacatagctggaagtaaagctctcctcagcaaatgtaaaagaacacaaattataacaaactgtctctcagaccacagtgcaatcaaactagaactcaggattaagacactcactcaaaaccgctcaactacatggaaactgaacaacctgctcctgaatgactactgggtacataacgaaatgaaggcagaaataaagacgtgctttgaaaccaatgagaacaaagacacaacataccagattctttgggacacattcaaagcagtgtgtagagggaaatttatagcactaaatacccaaaagagaaagcaggaaagatccaaaattgacaccctaatatcacaattaaaagaactagaaaagcaagagcaaacacattcaaaagctagcagaagggaagaaataactaaaatcagagcagaactgaaggaaatagagacacaaaaaacccttcaaaaaattaatgaattcaggagctggttttttgaaaggatcaacaaaattgatagaccactagcaagactaataaagaagaaaagagagaagaatcaaatagaagcaataaaaaatgataaaggggatatcacgaccgatcccacagaaatacaaactaccatcagagaatactataaacacctctgtgcaaataaactagaaaatctagaagaaatggataaattcctcgacacatacaccctcccaagactaaaccaggaagaagttgaatctctgaatagaacaataacaggctctgaaattgaggcaataattaatagcttaccaaccaaaaaaactccaggaccagaaggattcacagcctaattctaccagaggtacaaggaggaactggtaccattccttctgaaactattccaatcaatagaaaaagagggaatcctccctaactcattttatgaggccagcatcatcctgataccaaagcctgacagagacacaaccaaaaaagagaattttagaccaatatccttgatgaacattgatgcaaaaatcctcaataaaatactgacaaaccgcatccagcagcacatcaaaaagcttatccaccatgatcaagttggattcatccctgggatgcaaggctggttcgatatacagaaatcaataaatgtaatccagcacagaaacagaaccaaagacaaaaaccacatgattatctcaatagatgcagaaaaggcctttgacaaaattcaacaatccttcatgctaaaaactctcaataagttaggtattgatgggacgtatgtcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaatcaagggtattcaattaggaaaagaggaaggcaaattgtccctgtttgcagatgacatgattggatatctagaaaaccccattgtgttagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaaattaaaagggacgtgaaggacctcttcaaggagaactacaaaccactgctcaatgaaataaaagaggatacaaacaaatgcaagaacattccatgctcatgggtaggaagaatcaatatcgtgaaaatggccatactgcccaaggtagtttatagattcaatgccatccccatcaagctaccagtgactttcttcacagaattggaaaaaagtactttaaagttcatatggaaaaaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgacaaaaacaagcaatggggaaaggatcccctatttaataaacggtgctgggaaaactggctagcgacatgtagaaagctgaaactggatcccttccttacaccttatacaaaaattaattcaagatggattaaagacttacatgttagacctaaaaccagaaaaaccctagaagaaaacctaggcattaccattcaggacataggcatgggcaaggacttcatgtctaaaatgccaaaagcaatggcaacgaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctataatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagacaccatctcacaccagttagaatggcgatcattaaaaagtcaggaaacaacaggtgctggagaggatgtggagaaataggaacacttttgcactgttggtgggaatgtaaatgagttcaaccattgtggaagtcagtgtggcgattcctcagggatctagaactagaaataccattgacccagctatcccattactgggtatatacccaaaggactataaatcatgttgctataaagacacatgcacacgtatgtttattgtggcactattcacaatagcaaagacttggaaccaacctaaatgtccaacaatgatagactggattaagaaaatgtggcacatatacaccatggaatgatatgcagccataaaaaatgatgagttcatgtcctttgtagggacatggatgaaattggaaatcatcattctcagtaaactatcgcaaggacaaaaaaccaaacactgcatgttctcactcataggtgggaattgaacaatgagaacacatggacacaggaaggggaacatcacactctggggactgttgtggggtgggaggtggggggagggatagcattaggagatatacctaatgctaaatgacgagttaatgggtgcagcacaccagcatggcacgtgtatacatatgtaactaacctgcacattgtgcacatgtaccctaaaacttaaagtataataaaaaaaaaagtttccttttttatatactttatatttatgtactcaagaaaggctgttgaattttattcaattttttcagcatccattatcatcatctaattttccttcttcaatttgatacaccctacttgatattctttaatttatgcagaattattttcagttaaaggctattaattagtgcgtcctttttatttcaaaaattcttatttagtatgcttccagtcactctatcattatccattgggatttggtaatatatatagaaagatttattgtttataactgtttcttcttcataatctttcaaggcctcaattctgattcatttgctgtttggttatagttagttcaagtattttcctcaaatgaagcaaatgagagttatattctgtcaatctctgaatatctaaacatatctttactctgaaaggtggatgaaatactggttgagtcactcattcatttattatttaataagaattactctacgtaatacagatggatacaaaatgacaaaaaactccctgcctttaaagaatacatatattccagcagacaaagacagacaataagcacataaatgaatcaattaattaaatataaaatggttagaagagctaagaaaaaataaggcaaggaaaggaaaatcttctataatatatacataacagtcaagaccgacctctgattttgacaataatggccattcacccatatatagtgctttctaagtgccaggtactgtggtaagtactggacacacatcaaatcattcaatcacaaacaacccttcgagatagttactatgaaaataaaaatgctataactggtgaaactgaggcacaaacaagttgatttaccaaaggtaaaacagcaaataagtagtagaaccaagctgtccagctcttaaccattatgttttcttgcttctctgataatatgccatttcagtagataatgaaaggaaatgagggcaggagagagacccatagggttatatggaagaatagaattcctagcgaaaagaaaagccaccacaaatcttataaacgccatgaaaaatagatataaatacattaaaatatttgtattataatcttagactcaaccttaaaatatgtggctgaaacaattcctcacatgtatagagaaatgtttaggttatattaccttatcactcaagaattgatcagataaagtactcaggattaaaatgcaaaaaagcaaaaaaaagagtattaagagtatcttaatgtgatttcttaaaatttatttctaaaactaaatgctagaattatataaagtgaagaaacacagacacattctcaataaaaatggaaataaaactagaataacagtctacctaccacccctatgtaccaatactgtaatggatcctttacacacaatttctcatttagtccttacaataagcctgtgattccaataaatctattgtgtccatttaatatataaagaaagtaaaatttaggagaatcagtatattgccctaaagtcacataataggaaaagtgggaagaaataaaatacaaatttgtaaaacatcactgtataccttaaacatataaaatctttatatgtcagtatatctcaataaagctgctgaacatatgaatttgtatgatggcatgagcacagactattagatccaagaaaatcaattgtctatggtaaataagttcagcaaaattataggatatatggtaaatccaaaaaagtaattccctattgaagctggactgtgcggtagagaaaaaaaatgagctttggagcaaaatatgcttgattcaggtcaggcagagaaggctatggagttaactgaagagggagtgctgctgagattagtacctgcagggtcatgcttgcaataaccctagtggatgcaccagtgacaaagttgctcagcaacaacagcaaactaaagcaaacatatctgttcctagttctgagagatcaaaaggcaaccaacccaaactatgtaagaagttaagaaccttactccctttcagccctcattctcttctcttctcaatactactacttttacctcctgttaactacctcatttttctttctttccttgctctttgactctttcttgctgacgcttcccttctaggtctcttttttcctttcaatcaccccctattgaactgctttcttccctctcaccaccagtttggtttcaagaggattcttaaataacttcattacctccaaatacattttgatctcaaaggtcatagctcttcttccaatattagtaatttaagaattactaatgagacaaatccacaggttaacatgaaacaattccacatgtcacagagttaaaaaatgggtcaaacacactgacctgtttatgttaaaatattatatggctttagaaaaaaattatgccctaaatacaacatgcgctgcattaacaactgcattaacaacattttagtcctttagatatgcaaatacttattgtgttacaattgcctacagtattcagtacagtaacatgctgtaaaggtttgtaatctaggagcaataggctataccatataccctaggtgtacagacagctatattatctaggtttgtataagttcactctatgatattcttcacagatttctcagaatgtatttccatcattaagcaatgcatgactgtattaaaaattctttcatacaatttttcattatttttgcaaaattcaaggagtaatatatcacttatttaacaaatgttaacaggatatttcagaagattggtgtcaaaaagaaactcagttattgctttaatgtctctcagcaccaaatttcttttccatttggacttaataacaccttacatatacaaatgattcacaaaagacaagtcctctacagtttactatcatgagactcagaaaccagtatcacacaatgcttttaattcttatcatattactaaaattttatcagaaacagatgtcagcaatacaattttgatggaattacttaactttttttttttttactttcataacaaattaagcattgctcagttgaaaagttataatgtcacaagccttgaggcagcattaggtgctataatttgaaccgatgcagtgtagagtttgcatgctagtagaaaagaatttattagctacattgttgataattatttaactagcaaactccaagttttcttaaaaacacttccaatcaattaaatatctaagaaaactaataaaataactcaaagttttctagatgtataattaacatagcaatacataagttagcaatatagctgcaaaacaggtggaaaatataaccattaaaatgacttccatcctttcggtaggaagtagcttaaaaaaacaaataaaaataaaaacaaaaacaaaaaataaaatgacttccaaagaacaaaccaggcaaatggtttatgtccctaaataagctgaagcctagagataaagaaatttagtgggtaaaaaggaaagataatctatactaaaaacaaaaccaaaaaatgaacgaagacgatgaatggataaacaaaacgtggtataaacatataattgaatattatttagccttaaaaaggaagaaaatcacatgctaaatacagatgaagcttaaggacattatgctaagtgaaataagcccattgcaaaaagaaaaatactctatgattacacttacaggaagtatctaaagtagttaaattatcatagagacagaaagtagaatggtagttaccaagggctggagggaggaagcaatggggagtggttacttaatgggtaagagttgcagttgtgctagatgaaaaaatcctgcagatctgctgtacaacaatctgaatacatttaacgctactgaactgtgcactgaaaaacagttaagatggtaaatttttttaaccacaattaaaaataagagctttttaaaagaatgtaaagtaaaaatggaagatctgtgcacaatttttcttacgggcaaagaaatggtacatcttacaggtaaaacatgtatgttatgtgttacaactttagggaagccaaaggttttaatatctgatgccccatgaatgtgatatagcagctctctccatatcaattctgacaaacactatcaactttatttcttaaaactgtcccttagccatattcattcacccctctcccaccaatgttgtaggattccaagccaagactttctgctttgaagccctttaccaatgcaatcagtacccaacatacaactttccatccagtatttgtcagtcaagatatcacattaggttttcccttccctcttctcttcactttcccatcatcactgtagaagcctctgctacctgggacttcctctccctcctcaaaaatgaagaagaaattaagacattcccagataaacaaaaactgagagaattcactgctagcagacctgccctgcaaaaaacaaaaaggaagttcttcaggtagaaatgaaaggacactagatactaacttaaatccacacaatgaaatcaagagtacagcaaaggtaactacagaggtaaatgtaaaagacagtataaatgtatttttttcttttctttgtaactctttagagcactcctaccataagtataaattacaatttttaaaatgtcacgctacaattcaataggtaaatactgaacctgttttaagaagtacgttttatatttcacttctagaatagagataactaaaggaaatacagcctctttgaaaataaggaaatgcttcaaaacaaatctgtggtagatgaactatccctcacatgtcataggcatatagtactcttataacttgattatttagctcaatgaagttttaaaatactaaccacatcttattttacctcttttatatctctgggacctgtccctttttctctatcaccgcagctaataccttaatccagggtatcatcatttctcccctggattattggcagcctcctaatgggtattcctaatattagtcctgctccactttaatctgtttcctatactgatgccattagtgacataacaacaacaacaaaaatcagatcccaccattctgctcaaaattttcaagtggcctcccataatcttcggggaggaaaaatttaaattcccaaataatatacaggtcaggacatgaccactacctctgtctccagtattagaatcaccacatacataaataatctacacccacattctctgctacagcccttaagagttatttaggatcccagaataccacacatctacttttatacatgcttaccttctctgattagaaaaaccttactttgtctacccccatctctacttctttagtcttcaggactcagtgcctatacctaccacccaccctaactcccaataatgctgagttatatcatctcatagattctagtcacaattaccacagtacttaccaaaatgtactataaacacctgcttgctatgtatttatcccacagactgtaagcttcttaagcataaagattgtttccttactcctattttttgtccctagtatacgcaaaaaatgtctgccatggagtaagtgtttaatcaatgtttgaaaaaaatgaatgaaaggatgaagcaggttgtacattgagagacccatggagaagctgttcaatttttactatctataacaaagacaaacatcaaaattaataatctgataaaactgaaataccaaaattaatctttactttgtaatcagtaaaaataagtaaatcgatatactaatgtaattcttaatttttgtagttcattcttcaaaatattttattcaagcaagtgggatccagcaaaaaaatggagaccctccccaaaacttttacaaccagaaaatgagcttctttcaaattctgatgtggaattcccaagtaatcttgcagcaaattaaacaatatgatctatgatccatatgtaggccttgactattaaacttattttgtcttattaacagtattggagggatttttttaacaccatggattaaaaagtgaaaatgagttttttaaaagtaaagcttaaataacactctatctactgttttgcaaatgtgttatgaaggctttgaaaccacaaaatttccaacagacctaaaaatgtataatgtgctatatgtcaagctgtatttctttttttttttttaaactttaagttttagggtacatgtgcacaacgtgcaggtttgttacatatgtatacatgtgccacattgttgtgctgcacccattaactcgtcatttaacattaggtatatctcctaatgctatccctcacccctcccccaaccccacaacaggccccggtgtgtgatgttccccttcctgttaattcaagatggattaaagacttaaatgttagacctaaaaccataaaaaccctagaagaaaacctaggcaataccattcaggacataggcatgggcaaggacttcacgtctaaaacaccaaaagcaatggcaacaaaagccaaaattgataaatgggatctaattaaattaaagagcttctgcacagcaaaagaaactaccaccagagtgaagaggcaacctacagaacgggaaaaatttttgcaatctactcatctgacaaagggctaatatccagaatctacaatgaactcaaattcacaagaaaaaaacaaccccaacaaaaagtgggtgaaggatatgaacagacacttctcaaaagaagacatctatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctagagaggatgtggagaaataggaacacttttacagtgttggtgggactgaaaactaattcaaccactgtggaagtcagtgtggtgattcctcagggatctagaactagaaataccatttgacccagccatcccattgctgggtatatacccaaaagattataaatcatgctgctataaagacacatgcacacgtatgtttactgcagcactattcacaatagcaaagacttggaaccaacccaaatgtctaaaaatgatagagtggattaagaaaatgtggcacatatacaccatggaatactatgcagccataaaaaatgatgagttcatgtcctttgtagggacatggatgaagctggaaaccatcattctcagcaaactattgcaagaagaaaaaagcaaccaccacattttctcactcataggtgggaactgaacaatgagaacacaagttgtatttctaaggtaggagaaaggttacatagtctttaatactttctcctttacaacaaacttttccttatatataaaatacagcaaaaatagtaccttttgttcaaaggattgttgagaagactagaattcacgtaccacacttttgcctcatgcacaataaaaactttttacatgtttaggtgttattattactataattattatgacatatccaagtcccaaaaagttatcagcagtatactctgcaaaggaaaagaaaacacaccactcagataagtctatattcattaatgaatatatctacataccaaacctgcccccatttctttctactgattcccatctaattgaagaaagattttagtagtattctgctgtggattgactcttaaatcacttcactaataaagtcctatgaaaatttaaccaccaccaaaaaaaaggggatcagcacttaatcgcaatcctggattgcaatatgagtgatcagatgctaccccggtctgggtcttcatttcttcatctgtccaatggcaatcacagttcctatcggatctcatagggttaactatctgtgagaatttaaagattataatttatgtagaattgtttgctaagcttgaaaatacttcataaatacagactaataatactattgctgtacaatgccaaataataaatattctacgttttaagcagattgtctttgcttccttcagaaccaggtcttgactctttagcccaacttcgtttggtttggatatataaaacgacatcttataaggtgttcccttcaagggtactttatattactatgcataagaaatgctttccatattaactgaaaaggagatgaactaataagttcaccgaaagcataaatgactaagaggagagagaatgatctctggctttgagaattctcttagaagtactgcctataatcccagctacttgggaggctgaggcaggagaattgcttgaacccgggaggcggaggttgcagtgagccaagatcacaccattgcactccagcctgggcaacaagagcaaaactccgtctcaattaaaaaaaaaaaaagtatctaggtatagtaagtagtttaactaaaaacagtcttagaaacatggatcccaattcctaccctaaattccactaggacacaacattcttataattgtatgtactgttctttcttgccaaggtactcagcactaagaaggcaaattcccagaaagaatgaaaagtgtaagaatgtatgtgcactaactttaacttcctactgtgtgtcaaacactatctttacctactttctcatttaactctcaaaacaaacttgaaaggtattacatcttttttacagatgattacgttacgtaattcacagagatcgtattagagagaacaaaatgctgaaactaaaggtctgactacaaaggcagttctttctatttcaccacactattgatcctatgaagcagaagtcaaaattttaaaatgtcatcagagggttgtatccccattgaagtagctggttacataaaccaccaaggtttctttttgtttgtttgttttttgagatggggtcttgccctgctgcctaggctggagtgcagtggcacaatcatgactcactgtagcctcagtcttcccaggctcaagcaatcctcccacatcagcctccggagcagctgggactacaggtatgtgcaactgcgcccacctaattttattttttgtagagacaaggtctcactatgttgcccaaactggtctcaaactcctagactcaaggaatcctcctacctcagcctcccaaagtgctgtgattacaggcatgagccacaaccacacccagtacccatcctgattttttttttttttgagaccgagtcttgctctgtcgcccaggctggagtgcagtagcgcgatctcggctcactgcaagctccgcctcctgggttcacgccattctcctgcctcagcctccagagtagctgggactacatgtgcccgccaccacgcccggctaattttttgtatttttagtagagacagggtttcaccatgttagccaggatggtctcgatctcctgacctcgtgatccacctgcctcagcctgccaaagtgctgggattacaggcgtgagccaccgcacctggccccatcctgatttttaaggaaacttcaacacgagttcttccagtcccttttaaatgatggacactgtcaagaagtaaatttcacctaataactggtttatccagaaagaaaactgactcctcattcaaatggcattatattaaaccagaataatctccttaccttgacacaatggtttttgtaaatgtaaaaaaaaaaaaaaatcacacagaggtattctgattcatccaaggacattttctatattagcctagtaacatatagaataaagtaatatacaagaaaacttaggggtagacaggtatatattcagccacatgcttctcaataagaaaaatgatttatctactgtaagaaaaagtaaccttatagtaaaaaacagcagcagaatattacttgtaatagatgttaaatatttagtgtctctgttagttctatatacagttatacctaatcatgttaagtgtagagatttagcctcataaatatttctataacagaatataacctatatttcttaatacacaaggcaaatgtaaataaaacaaagatttgctggtctaaatacccaattctttaaaagtaaaccaaaattttcccatataaattttcctttggagaacacaggaataaatcccatctgatgaaggaaattatcaaaagaatacacattgatctaacatgtctggctcagtttgcctattataaacaattctggtctctggacatgaaaaactaataattttcagccacttgttttattacatctaagtctcaattattcacaactaaaaaagatagaataatgacattttacaatgtcccaaacacatgaatcaatcatacagcaggtggaaaaaatgctagaaaagataacatttgtgtcagctttacctctctctcacaggagtctcaacagtgtaaaccttaattcgtatatcttgactgcccagagccttccagagaaaaggatcatattgtctttttaaaaaatctcaattgtcaataactgaaggaaagcaagcatagctttccaaaacaactgagtccagatattttttccattgttgctgtcaattacttttctaatttctaattataattctaataaaaacttcagcataactaagaaagacaaactaaaactactcaggaattttcatgcaaaacttccaattatgtgtcctaaactcttttactccaacatgagttcacaaactctgacagatgttttataaccctgtttaaatatttagtcagtaaaaggataaaatttttaaaaaacagaatgatttcattcttttcaaaaaccagggtggtctatgggcaattttggtactagcagtgttgccgggggaacaaaatgaaaacaggtgtcatcaaattcaaattaaagatttacttctattttaaaccaccttaaacaatgtttccataaactttctaactgatactactataaatttgacaatattttataacaagaaaaggattataaattgtctgtagaccatcaaattttaactgtaacaaattttgactgattggcaacacttccttttaaaaaacttttttcattaaatatgcagcatcattttaaaaattgaatgtataaaaggcaagtcaaaataagaaaagagagcaagtatagactctgatagtcttttctgaaagattttactttgttttgagcctatgctgttttaaaaataaaaaacgaagtacaaaacaaatgttaaattcacaacatataaggaaaaagtgatacaattagtaacatgacaatcataacttttcctcataaacttaattgaactacaatcttcaatgttaaaaaaatccattaatttttgtgtcttattttggtaatgaaaagagtataaatacttggtttctaccattaaatagcacttatttttactcttaaaagagatgatgaagcaagtgactcaccatataaaagttaatcaatgcttaaaaatacattagagtattagacactttctcagttgtttaatacagtttcagtgacaaaatacacttacttttgttaaaagctttaattaagaaatgaacatataagaaatttttaaataggtaatattgcagattggttatgttcttcttaataaaactgtttaagattctttcagaatggattaaatacttacccagtgaggattctagatacaggtaagatgaggtgtacattcttcagtattattaatttaaacagaattaatttctctttgtattagttttgacaggtgaaaacttcttaaacttttaggggcatttaatcttgcactgaggagagtccttttatcttgactgtgaataatcaaattccattgtcatttcaaatctttcagacagttcaaagttttatttttagcagtgcttcagggaggcacaagttggttcactagtgtggaatcataacttacagtcagctccaccagttggattatttccaatatttattagtttcatcaactagttttcaaaaaagcttaaagtttcagtattaatagataaatgtctttgaaactaatatttctagcttaaagtttccattaaattgtatttataaaaataatacaaaatcttttttcagattactacatgtattttaatagtaaaagaaaaatatacagcattatataatgttgaacaatataaaacttcctttacagttagtttaaaataatctcacttgcatataattataaaattactatactcatctattgcttactttgaaagtgattaatcaaagtcagagaaagccaaccatcaactgaagtgtgttacaaatttccttctcagaggcacatcaaaaaaagatgagtcaattctactttaattaaaaccttgtttaagaatatgaaataagtgttttctgtataattccaattatatttcaattgtgttcagctttcaaactgcctctgctacttgattacacgtgccaaattaatcttgtcttttttttttttttttttttgagatggagtcttgctctcgctctgttgcccaggttggagtgcaatggtgtaatctcagctcactgcaacctccgtctcctggctccaagcaattctcctgcctcagcctcctgagtagctgggattacaggcacgcaccaccacacctggctaatttttgtattcttactagagatgtggtttcatcatattgatcaggctggtctcgaactcctgacatcatgatccacccacctcggcctcccaaagtgctgggattacaggcgtgagccactgcgcccggcccattaatcttatcttttaaatcatatcaacagttctaaaaaaagacttggattttttattgttctagtgggtattgttctagaagcaagactcctctaattgatcataacaccaagcctaccccttagctgacagttcagatgtgtgtttttggttggttcaaatacaggaagacaccctttgtatacatttgactaattagtcaaagaataagaaggcaggggaaagaaatttatctaaaatattttttgactaatacatagcagtcttccaaaaattcaaagtggaatttttagagaaactacatgttctaacatgttctcttagggtgcttcatacagatcgtcaaggaagtatcccaaaaaaaatcaatgaacacccggaatacagggtcttcaacagaatcaagcaacatgttacacaactgagggtaacaaagtatcagtccctacaacacttgtgtcaaacaaatctgtttctcctttcaccttacttacctcctttctcctaccctgttctatgtatggcctagcccttcgaagatacccaaacacaggaaagattaaagatccctttcaaacgatagaagatctctttcacacgatagatgataaaatgaagagatgttcagaaggctgtagctgctagcattcttccaccataagcttctccacctatatctgtagtagataactgtacttttagataacttttcaacccttttgaagggtttcaggttaacaaatatttgaaaattagtactcacaacactgtatataaaaatgaatagaggccaggtgcagtagctcatgcctgtaaatcccagcactttgggaggccaaggcaagtggattgcttgagtccaagagttcgagaccagcctgggcaacatggtgaaaccccatctctacaaaaaatagaaatattagctaggcgtggtggtgtgtgcctatagtaccagctactccagaggctgaggcgagcaggtgcccaggctcgaggggttgcagtgaaccgtgatcgcaccactgctctccagcctgggttacagagtggggcctcatctcaaaaaaagaaaaaaaatgaaagaagtatggactcaggaaagaagtactgacacatgataagcaataatctagatgcaaataaaaatcattagatttaatataacatctttaggctcaaatggaagctcactaaatattaagtcaatcaacactgatagaggcaggaagcagaaaaatcctagtcagacagggtgaaaccccaccttcaagtcaaaaacagcctgaaacccatgacccagagagagaacttctatttctgtttgcctgctctttcccaactggttctttctgaataatgctttttaaccaatcaaatgttgccttttccaatactacctgtggcccatgggcccccccgatcctgtgcccataaaaaccccagatccagccacactgagggagatgacccaacttcgagtgagagaccaccttcctgtcccctctctagactgagagctgcttcatcactcaataaaattctctgtcctcatcacccttcaattgtcagtgagacctcattcttcttggacatgggacaagaactcgggacccactgaatgtgggggctgagtgtgcagttgtggcagctgtgggatccacactggagtgcaagccagatgcggcctggcaggctgagtaaatggggcacctgctcctgcgagcccagcaaaggggccaagaaaaatcctgcatcaacactatttaaatgttaaaggaaaagtcaatataagtaacatgtataacacactaaaaatatattaatgataaggcaaaatgaaattagagaatgtataataaagctctgtgggataagaaccttctcttataacattctgtcaatggctgaacttccagaaacattacctatgaaattaaggacagcctttgtaaatagaagggctaactccttacatggagacttaccacccagaactattgtctgaatccatctgagggggaaaaaacccatttccatggtaaggaacaaagcagagacaaagttcattacagctacatacaaatggaaatgccataaattacataaaagctcatacaacaaagaaactagcaacttggttatttgtatacatagaaagacagcaggaaataaaatattttatattatatgaaaacaaaatgcttaagaactcactgacacagttatttgacaaatatgctgaggtttttgtatataaattttttagtttggggtttttttttgttttttgtttttttgggacagggtctctcgctctgtcacccaggctagagtgcagtggtgtaatcatggctcactgcagcctcgacctcctgagctcaaaagttcttcccacctcagcttccagagtagctgggaccataggcacataccaccacacttggctactttttaaaaaatcttttgtagataacagtgatatggtttggttctgtatccccacccaaatcttaccttgaattgtaataatcctcaggtatcaagggtgggaccaggtggagataactgaatcacaggggcagtttccccctgctgttctcatgatagtaagtgagtcctcatgagatgtgatggttttataaagggcttccccctttgcttgccactcattctctctcctgccaccctgtgaagaggtgccttccaccatgattataagtttcctcaggccttctcagccatgtggaactgtgcatcaattaaacctcttttctttacaaattactcagtctcgggtatttcttcatagcaccatgagaatgaactaacacagacagggtctctcaaacttgcccaggctggtcttgaactcctgggctcaagtgatcccccaacctcagcctcccaaatatgtagacccagcactttggaaggctgagacatggtgggcggtgggtgtggggggttagggggttagggggtgtgattggtgggggtgttgtgccaaggggcttgaggtctcaaagagctacgatcccgccactgcactccagcctgggcaacagagagaaaccttgtatgggaaagaaagaatttttgttttgttttgttttacagctttgggaaagatcttttctatagaatcatatatctgatattacaataaaattatgactcaaaaatttgttttacataaaatctctcatctacatgtcctcaagctaattacttaaacaacatcaccatctcttccacaggcactagcacatttagaaaagaaagaggtttgggttttgtttttttcctgtactcaaagttcagctaagtaaagaaacaattatttcccaaaggtttcaaagcaattgcctcagtaaatcaaaagaatgctttcctattagcaaagccatataatttaagagtaaagggttaagatgatttaattttctcaaagaaaaaagtgaaaagttaggtggctatacagttaatgaccagaattctggaaaactgccaaattcaggcacattctaaccatcaagttattactatttagtggaggtcgggggcagtcactaagaactttttatgcaggtttaaattttacatacagagaagccatataattattgtgaaatacttcaagggattcaagaagaagctatgacagtttgctgtgtttctttaaaaaaaaatgcacatttactgactttgagtggtatttagttccaaaaatatcaaaaatatcagaaagataatgtctatatttaatatttggtattacatattttggttatggcttctaaactttctcatagcccaggcactcagctattcaacctaaatttttccagttgcctcaatgttatataattcccttttcaattttgttcagtcatacttaggatctactttatacaaggatgaataaaacactattttacatctaggtcataagaccaggatataaagtccagtgtctgggttctaatcctggttctaccaattactagttctttattctctctataccttactttgatcatctgtaagctgtagatatagtactaacacccacaaaatagggtttgatgtgagaatcaaataagttagtatacaaaaaatactcagaacacaaccatataaaggaataaaatgcgtgctacaacataaatgaacctcaaaaacattaagctaagtgaaagaagccagacacaaaagtcacatattgcatgattccatttagataaaatatataaatccataaagacagaatgcaaactggtggttgccaggatcggaggggtggggaggggcaggtgggatggtggagaatggggataaaatgcttaacaagtaccgggttgtattttggagtgaaagaaatgttttagaactagataagagttctgaaggccactgaactgttcactttagaatggttaattatatgttatatgaaattcatctcaataatttcaaattttaaaaaaagaaataaaaaacaatttattaacaccatccaaaaaaatacttagaacaatagcagtgatacaaaatgagttcagtaaatgtacactgtaataattatcaatgccacataaactggtaaatatgtagaatactatgctacattccaaagattaaaataaatatacataggtttggagtttatgttttcttttaagtactcattttaacaatttatttctcctaaattcagcatgaaattatgtaattcatctacaaggaactctcgcttcctccaaaagagacactcagagagaaaatacatatgaaaaatggaaactaaaaatttattttgtacatttactgctatatgtcatccaagttatgttattttaacatacagtgcttatgtgttaaactatctgggaaataaagagatgacatgcatgaagaaaatatacacaaaaggacaaccaaagaattattttgtaaatttaaccccacaaattataaatattatattgttacattcagttgtttaaacaatatataaaataccactaaaagactcatacacatatttataaactcaatgaaatgttcaatttgtgatgaatcagaaaaaaatgagaaaacatcttcataatgggatacaaaaatggaatttagaactggatcagcctggggaaagcaaattttaaaaagacaaaatcatagggctagatttgtggatatgagaaatcaatgaattcatttttgaggcaaaaaaaggtcaaagtaaaaaagcattctatatatcaaacttaacacatttatactatagtttaaagaatatgtcaacaaatgaagagatcacagttcccaaataattatagcagccaaaaggtcaagtctaaaaacccttcacttcaaataaaaagctactaggagagactatgaggtactttctactaatatctcagaagaaaactcatgaaatattcaaaagcaagagaataattcgtatcttccgtttctttgcctcacatatttgttttactattagaagaaggctgtttttttgttttctttgtcatgactaatgtttatcttataaatttctattaaatgtgttaccaaaagttcctgtcgggaatggtaactacatttcacatacacatttataaacaacaaaagagaaaactgtcattaattttaatatggaattaaattattagaataaactttcaaacatatgttgaccagtcaaagaattgtggcatgatgcatgtagccttcactgtttcaaaagcacagagtttaggtcaagctccttaaaacagccaaatgttttaacaagtaaagaaaaatatacataaagtgcttcatgaataaaagtagttcaaatgaacaaggcttgtggaaaataaagcactgtacagattttatatcaaacatgccaagaatgttaataacactacactacactatatatgagaaagaactctccaactacaagaattgttatattaaaaatatacatgttatctttttctgttaacatctttaaacaaataagtcagctagcttcctgaaatgatgtaaatgtgattcaacctaaagatgtgattttcttgcacgtcatgagttccataaatctttgaatacaaatattatgcattttatatgccatcttatctgtatgtctataaaaaaaatggctgagctatggaaaaacagtatggtggttcctcaaaaaagtaagcatgaaattatcatatgatccagcaattccacttctgggtatatacctaaaagaattaaaagcagggactcgggctgggcgtggtggctcatgcctgtaatctcagcactttgggaggccgaggtgggtggatcacgaggtcaggagatcgagaccatcctggccaacacggtgaaaccccctctctactaaaaataacaaaaaactagccagacgtggtggcgggcagcctgtagtcccagctactcgggaggctgaggcaggagaatggtgtgaacccgggaggcggagcttgcagtgagccgatattgcaccactgcattccagcttgggtgacagagcgagactctgtctcaaaaaagaaaaaaaaaagcagggactcaaacagaatatttgtgtgtccacattcatagcacgattcacaagagccaaaaggtggaaacaatcgaagtttccatcaatagatgcacagataaacaaaatgatgtgtacgcataaatgaaatactattcagccataaaaaggatatgaaattctgacagttactacaagatgaatgaaccttgaatacattgtgctatatgaaagcagccagacagaaaaggacaaatatttcttgattccacttacatgaggtacccagaatagtcagatttatagaaacagaaaatacaatagttctaacttgaagctagaggagaaagtagtaggaagtaactgttttaacaggcatggagtttcagtttgggatgatgaaaagttctagagatgaatagtggtgatgttgcagagtaatacgaaagtatttaatgccacttaaaaacagttaaatggggcggggcgcggtggctcacgcctgtagtcccagcaccttgggatcacccgaggtcaggagttagagaccatccagcccaatcaacatggtgaaacccagtctctactacatatacaaaaattagccaggagtggtggcacatgactgtaatcccagctacctgggaggctgaggcaggagaatcgcttgaacctgagaggcagaggttgcagtgagctaagatcatgccattgcactccagcctggggaacaagagtgaaactctatctttaaaaaaaaaaaaaaagttaaacggtaaattttgttaagtgtattttgccacaataaaaaagtaaaaaaaaataagttctgtgtatggatggtagtgacggctgtacaacagtgtaaatgtgtatataacatctctgaattgtacacttaaaaatgttaaaatggtgaatttatgcttatttccacaatatttttaaaagctggttaaggtctttcagtaattagcttcactctaaattatttttaaggcagatcagaatatagttgctcagaggcttctaaatactttgtaagcaactgaaccaccactacagctaaccagcacccctaaaccaattattgcctagcaaagtattactgcctttcaacccactggccctgcctaagtctggcaaccatataaaatgcttgatactgcttctgcattaataagcagtgagctcttcaaatgtaacacttgatgtccagggcaggagcaggttatagacatagtatgcttaaatctactttccccatggttgatgactagacttaaatcctcagtcacattccctgctacctgactggggccttgtttcattatctgtcgcccttggccctactccttacatctttaatcctctcctctgggtcctacatctcattctaaaatcagactaagtctcctcatgccattaaaatcttccctggactctcaaaccttcaaatctcaccgcacccccaccccccgcccccaccgccacccaacttactcctcttcttggctaccgaacttcatttctggatcccccaggaattgacttcagcctgctacttgactgaattacactcctgaaagttaaccatgacctccaatctgataacctattattcatactacccaaactaaaggcaaaaaagaagaaagaagaagaaagacaaaggaggaagaggaaggaagaaggaagaaggaaggagaaggagacggagatggagatggagacagagaagaggacaaacatttgtaaaaggtcatcaatcacaacctccttaaaactattttctcccttggctgaaactctcctaattcttctcttactctctggtctcttttatctccttccaccaaatctccaaatatgggtacttgtcattctgccttcaccctttttcttccctctcctaggaatttttcagaacttttcttctcaaaacttcgcaaaacatttgaaaatgttttttacattttatatgaataccatcagcacaagaggttgcagaaggagtcaggtagttggagaacaattctgcctaccccagtaactaagaagctggcaacagaagtatgcttccctactgcacatgtatatatcagtgtccaaggttaagaaaaccacatttgtattttttggcaggtacaatacattttaaatgaaaaaaacatttagaatgttttcttttcaaaatgattgtactgatagaaggaagtatctaacaatctgttcattattaattgcatgttttctgatatggttaattatttaggcttgatgtaatcactcagctggttaagactgcttactgatacaaagttaaagataggatgtacaaatgcaattaaatatcagtttcttaaggttaaaaaaaataataatttcctccaatagagagttcttaacattctatgtggaaataaaatttgtagaaaagaaacagaaaaatgaaatccatagagaattgatatgctacaccttaaattaaaacttatcatcagaatacttaaattcttaaaaagtataatttatgatatttaataaataatttatgagtatgaaaaattaaaaccatggacttttttaaactttaggattaatgactagtaatggcttctttgcataagttgcttcctttcgccttaaacaaagaaaccatacattttaaagttttatcataaaaacagaatgtatatgaaattatttcactttagcaatttttaaagtattttaaggctcaaaaacttaaggatatgggaaagtgatcaagatgtagtgatagaggaaaaaaagaaagttataaaacaatgtaatctcatgattccaattttggttaaaaaccagtatgtactaatgggcacagtagatacacaaagtacacagaagcccatatatcaaaatgttaatggtaaatcttgaggtagtacaagtatttttattttcttccttatactttgttttcttcctttatacctttattcctttctatagcaaacatgcatcacatttacagttgagttttgtggaagaataaactctatatttcattccatttctgccttcctgcttatattttgatagactaggaaaggaccatctttcaaagctgtgcagagtaactctttagcattgtcagtgctctcatatacctaatccatcagcaaatcctgttaatccacttacaaaatataacagaattcaactactcactattttcactgcttcttcaagagaagtcaccgtcatctctcggtttatgcaaaagtctcctaactagtctatgtaattccacccttaccacctttctggctctaatgtcactcctctacttagaaattctgtgacttctcatctcattcagaataaaagtctaagcactgattgtgaccttctaggctctatgatctggaccaggaatcaccatgcacactcccacttcagcaccacagaacttgcagtaagttggctctgcctagatattctacatccagataccctcattttcttcagctttttattccagtatcatcttctcaatgaggccttcactggcaatccaacacaacacatcaaccactccaccctacccttgaaatttcctatcttgtttccctgttttattttttctactctagcacttatgactatctaagacacatgatgtatttatttatttttgatattatctccctccctcagtagaatataaactcaataaagagaaatttttacctttgtttttcctgctgctgcatccctagtacctagaatagtcccaagcacatggtaggtactcaatatatatctactgaataaatggataaatgcattccagtgaatccacaagcttaaacccacagcttctcagttacagtaatagttggctcaatgaatgtcatgaaatgatagcaacacatttattcatattctgagaatcaatgactttctaagtgactttgcatagggcaagagagctgaagaacagctatagtaaacaataatgtagacatattttctcaagcctaaaagggagcatctaggatcttagcttcaaaatttatgaataaaattatgacttgatttggtataacaaaggtaaggtaccctgagatcatattgctgttattgttggtactaaaaagtaagcaaaactgtctaaaatcatattgttactcttctaacttttccattagaatattcaataccagtctgtgaaactggatatataactttccttatgcaaacaaaaaactagctgaatatcatactactatgcacctgagtatctgttatctgaaagatctttggatcttttataaacatcaatcaatgctgtgcagacagagctaagagggaaaggcaattagatactgtgaaaaaatggaggcaatcagaagaaatacagtccatggtggcagtgacagagctaagcaggaggtatggataatctgggtaagtgccatggaaaaataaatatcatgattgaacttgaggcaaatggaaacagttcaaattggcttcatacactactctgtggaacatatgatgtccatatgtccattaccaacaaactgaaacatggaaaataacaaaagccgatgctatgatggctataagaacacacccaatgccagtctctaccacaccgcagcagcataacttactacagctgccaggtaagttggctaagaagtcagaagcaataagaaaaaaaggagaaagaactaactataaactgttctctttccctacagaagacaaagttgggatctatactagaaagtagaatgtagcaacgataaaggctgaaagtaaagcacaattttttctctgtagacagtttctaaaagtataaactactttggaattaaagaaggcaacattttatccaaaactacaaacgatttaagatccagagaactaaataaaataacagaggaataagatggaataacttccaaataaaaaattataaatatgacctttcaagttttgaaatacataatagagtataaaaagaaactgaacaaaagatgtggtgggaatccattatgttttacatcagttttaattagtctaccaaattttccttctatagtttctaaccccacctttcttttttttttttttttttggtgttgttgttgttttgagatggagtctcactctgtcacccagggtggagtgcagtggcatgatctcggctcactgcaacctccgccttctgggttcaagcaactctcctgcctcagcctcccaagtagctgggactacaggcgcgtgccaccacacacggctaatttttgtatttttagtggagacagggtttcaccatgttggtcaggctggtctcgaactcctgaccttgtgatccaaccacctcgacctcccaaagtgctgggattacaggcgtgagccactgcacccggcctctaacctccacctttctatactctctaacccccaaagcgattcatcttcaagatacaataagagttgacataaaagaagtagagcttaacttaggcaagtatcatgaaggaccaatttacacagcaaagccaaaactgtaaaaaaaaataaaaatataaattttttaataatgtttaagtgttaaagcctatctggtggtcctgaccttttcaaccaatcaaaaccaggccagtcagatgaactgtataaaaataatatgtacaactactacatatccataatacttaaaatgaatgtttaagaaaataatctcagcacttattcagaaatatactagtgtcactcaaactatacagtaatgaaattcagcagctaaaaatatataactattttacagtaaatatcaatgtcattcctgtttcaacctgacttcccattctacccctaaactcccaaacttgaaaccaactacaatttcttgagtagctggagtgtggtttaggaaaggaagctatgcttgtttgtatggaatctgccatttcctccctgccaaaacacttgtttaaaaagtcatgtaatatttctattaaattgtaaatgcagtcgacaaggaaatggcctactagcagtgtattacctttgtggcagtgccaacgggcctacagcaaaatagtgcacatgataatttcaacatgcattcccaagtaacaaaattgtgctttacataaataccacagaacctgagcaagatccagaaaaagcaatgaaaatctgcccaagctttcatgcttgcctatatcaattgtatgtcataagtaaagcaaaatagaaaagcatctacatatgttcaagaagcttgtgaagttagatcatataaccctgggaaaactattgcagcttaaatctgtgtatttcttgttaaccactgtaacaactcactaataaaaatgaagaaaaaccatggatatcaaatgaaccaaaatgtactaactacatacaagtccttaaagatcatgatgcaacttattaacaggaacatattttcagtgtaagccacaattgttatgttaaattacttctttctttgatatcattcatttgattacagaatgtaagagattcacgagcattccaattaaaatggtgaccttcagtttataagtcacttaccgaaatgcttacaaagtcaccgctaatcatttatttcttaccttgcattgcatagcacaactacatttaattatgcaaattaaatgatcccagatgtaataaagatggttctattcatgtgaaagttatacttaaaaccaagttaacaaaattaaataattaatctgtaattaatatagtcttctaggacagctgaattctattctacagcaatttaactaaaatgcatatttattttataagtcaggtatgacttgtctttctttttaaaaatatcaatcgacacataatttcaaaatttaaacctgatagagacaccatttcctccaaaaatgtaaatttttaagtgttatacacatgaaattagagtaaatacctgccctcagtatacctccttccaccttcctaccctatgcacacctagctatttatgtctcctaaaataaatgctagcttaaatctctggcacaaatagttactattactggcttagaataaaataaaacttactatgaccaacagagtaagtccacacaattgcttttaagatatatatcttcaataatgcttaatggttgtctgttaaaacagttttcatccccaattagcaaaccaaagctactatatcctgaggccaaaattaagggtgcccactactgatttttctgatctctaataaggaacaggaactaaagtgccaaaaaataaataaataatataaattatatcaatttaaaatttaaatgttaaataaataaattgtgctaagtaaaagtttgaaaggcaagctgtgagggatgacagctctttcaagttggatttgattagcatttaattactttcactttttaatttatttcattgattcttatgctaagttgtaagtacaacacttattattttaagaaagaaaaatctgagcttaccagatttcagtattaacaccacagaagtatctttgagataggaaaggaaataagcacatattcaacaaaaatatttattggatattcttatgttagaatctgctagattcatttagacacacaaagatgaaacatacttgaatttaaaacttagatttagtagggaaatacgacaactatatcaaaataactatgataatacacagtaagtttaaaagtgccataagaaaattatagataaggtgatatgagaattcaaagaaagaaaagattttttaaatcagtgggatgaggaacttctaacaataattagacttatctaaaactaagctttccagaagtagaaagattacgggaggaagacatcataatctacatttggttccaggttgaaatgcagaactgtaatatgctatgataaagaaaatagtaaacaaaacactaccctaaatacacaatgtaacaagatacactcttgagggtcactgatattaagaaccacagttctcagttattttcgatcaaggaatccttgtttcaaggagttattattttcatttgatggaaaactatgaactatcttaccagaaaaatacatatctgcacaaacatcaatatttaagtgcaatttcataagatgtgctgactgaattctctgccccagaaacagctcattctaccctcttgtgaatcatggtttccattactgggctagtatgcagtataggggaaaatgaagaagtaaaaaataactgtttttcatcattagaaaagataaaatgtatcacagtcctaataggctcattattttcatattgcttccagtagaggctgcagaagacatctcagcagccataagcaagaacttaaaagttttcagcaatctcccctggctagcaataaactgtcaataagcaggttcaggcacagaaacagtaattcctttgggtactgtgtaacgtcccaatacctcccatcctactgaatgtcctacaacaaaatcaggtgatgaaaaacaactgctcgatccttccacagctcaaagttccttaagtaacaatagtaaatattaaacgggcatcctctgtaagaacctgaactaatttatagtctcaatatgttacttcaaaagcaacttcataaagctagttcatatttctacagtacttagtattttacatgtattgttcatatacactatcccttttgatcttcaaaaagaactctgtgaagtagatggatgagggtccattataactaattcagagataacaaaattgattcaagcctcacaagtctcaaacatcaggtcacaccattattacgtagcaacaatagaagcattcggactttgttagaatttggatttccaacacctggttcagtaattattgctctatagattcaagttgcaaatcattactgggtcataaaatcaatgtaatggatttggaccacacattttttaacgaaaagatgaaacagaatagaatactgtgatagaacagaagtcagagtgaatcacaaataaggaaaataagtatggtttcatgtatattttgtttcacttatgtgtgtgtgtgtgtctgtacacatgtgcataatggatcacactgtgaaaatatttctaccatggaccacaattttaaaagtctgaaatgtaaatgtcatctttcaatcattaataaatcaatttaactcatctcctttaaattctcccacacaaatacagagaaatattgcatttgtcagtatcccacattaaaatcctaaaaagatgaaatgtagtataattctttctcagtaagtattactctaagcaatacttaatggaaacacgtctccaaaactataattcatatttatataatttgtatgtcagtaggaaaatgataattatttcctcaatattaccaaactaatcatgtgtacagagcacttggcaataccaacagcaaggttagaatacagacgaagagtaggaatgcctctttcctgtgtaagtatcaggggtgaccccagcaggcttaatctagagaagttgagacctgtttattctcttcacttgttcatgtcttaaagaataataactctgacaagacaaaaatatgttgaaactgtcactgtaataaaccttaatccccagtttagggtctaggatgccttataccaccaccacccttcaatgtgtatcaggaccacaaagcagagaactcttaactttcaaatggagtaaaaatccatgtcttggaagcagtactgaaattccctgatgatcccatttctcccactcctctggatccttggatgatgtgaaagtacggttaatagaatcaaggtatcacctaaaataggcaaaaaaatagggaagagaaaggaaaggaaaccaaaggtagagaggggggtgaggggagagtattcacctacacaccctgtcaggaaacaaaaaaatgaaaagacaacagtaggaagaaaagaaaaaaaggaagataagggcaggttcaagggagaaatgcaagtaaagtatgtaatgacaaaataataaaatttttatctacaaccatatgatcttatgtaatttgagataatatatacatataactgaataaacgttttacagtgtatagcttcctattctaatcaacaaaactcttatctaccctttcctattaaataaaacagaaatctaaatgattctaacattaaaatgctagttatcactgaactataaattccaaaagaacagtgaacatgtctgctgtgcttactactacttcctaacagctcaagtggtacctgataagtgtgcaccaagtatctacagaaggaaataaaggaaagggaaagggagtaaaagaatacagaaggcactctagatgacatttaatttctctgacacaaaacaaccaatttgggagagaagagatactgtccaactggtcccaaagccaaatttattgcctttatgttagaatatgcatttcttgcattaacaatattaaatcaaaaataatttaatattaatgattaaatttagtattgacgaaaacatgggactgtcccatcatgagaagatacacatttacatggcagaaaatttcaagagtgtcattctcgttgctaaaagattcattaaaaattatttgtactccaaaaggtcccactagctcccaagcaattactcctaaccagaatgaaatgtatgaaataacagatacagaattcagaatatggatggcaaagaaactcaacaagatccaagagaaagttgaaatccaacacaaaggaaacagaaaaataatctaagatttgaaagacggcacagttattttaaggaagaaccaaacagaacctctggaactgaaaaatttactagaggaatctcaaaatacagttggaagccttaacaacagactaaaccaagcaaaagaaagaatttcagagattgaagatcagttcttcaaatcaacccagtcagataaaaataaaaataatttttaaaaatgaaaaaagccttcaagaaatatgagattatataaaatgaccaaatatgtgacttactggcattcctgagagagaagagaaagtgagcaacttggaaaacatatttgaagatagatataattcagaaaaaattccacaatcttgctagagggatcaacatgcagatacaagaaatccagataactcctacaagatactacacaaaatgactattcccagggtacacagtcatcagaccatccaaggtcacccaaaagaaaaaaccttaaaggcagctagagaaaagtgtcatatgacctgtaaagcagcagtctccaaactttttggcgcaaggaaccggtttcgtggacgacaagttttccatagatagggttggagggggtggtttagggatgaaactgttccacctcagttcatcaggcattagttagagtctcatgaggactacacaacctagatcccttgcacgtgcagttcacaaaagggttcacgctcctaagagaatccaatgtcagtgctgatctgacaggaggcggagcttaggctgtaattcttgatcgcccaccgcccacctccagctgtgtgacccggttcctaacagttcatggaccggtaccagtctgtggcccaggagttgggggacccctgttctaaagggaaacccatcagactaacagtagacttctcagcacaaatcctacaaaccagacaagattaggggccaattttgagcattcttaaaagaaatgccagccaagaatttcatatcttgccaaactaagcttcataaatgaaggaaaaataatgtatttcccagacaagcaattactaagcaaattcatcactgccagaccagccctacaagagatgcttaagggaggtctaaacatggaaacaaaagaatgacatttactaacacaaaagcacacgtaaagcacataacccacagactctataaagcaactatacaatcgagactacaaagcaactagctaacaaccctgtgatgggaacaaaacctcacatatcaatattaaccttgaatataaagggcctaaatggcccacttaaaagacatagagtggcaaactggaaaaaacaaacaaaatccctctttctcttatctgcaaaagaaccatctcacaagtaacaacacccatagactcatagtaaatgaatggagaaagatcagttaaacagaaaacaaagaaaagcagaggtcttatattagataaaatagactttaaacaaacgactgtaaaaaaggacaaaaaagagcattatataatttttaaagggttcagttatacaagaagacttaactatccttaaatatatacacactcaacactggagcacccagatttatgaaaacaattacttttagacctaagaaaagatgttgacagccacacaataacagtgggagacttcaacaacccactgacagcattagactgattatcaaggcagaaaactaacaaagaaattctggacttaaatttaatgcttgaccaactgaacctgatagacatctacagaatactctaccaaacaaccacagaatatacattcttctcatatgtacatagaacatactcaaagactgaccacctgctcagtcataaaggaagtctcaataaattcaaaaaaatcaaaatcataccaagcatcttttcagaccacaatggaataaaaatagaaaccaacaccaagaggaactctcaaaaccacataaatacatgaaaactaaacaacgtgctcctgaatgacttttgggtaaacaatgaaattaaggcataaataaaaaagttctttgaaaaaaatgaaaacagagacacaacataccaaaacctctgggatacggcaaaagcagtgttaagaggaaagtttagaatgctaaatgcctacatcaagaaaatggatctcaaattaacaatctaacctcacacctaaaggaacaagaaaaaactaaacccaaagctaggagaagaaaataaataagtaaagtcagagtagaactaaatgaaattgagaacaaaaaaccatacaaaagatcaatgaaacaaaaaattggttttttgaaaggatgaatgaaactgacagactgctagctagattaaaaaaggaaagagagaagatccaaataggcacaatcagaaataacaaaggtgacatcacaacgaagcccacagaaatacagcagatgttcagaggctactatgaacatttcagtacatacaaagtagaaaatctagaggaaattgattaattcctgaaaacacaaaacctccaagattgaactaggaagaaacagaaatcctgaacagaccaacaagtaacaagattcaatcagaaattacacacctaccaatgaacaaaatcccccaaagagagagattcacagctgaattctaccagtcctaataaaactattacaaaaaatcgaagaggagggcctcctccctaactcattccacaaaaccagtatcatcctgatatcaaaatctggcaaagacataacaaaaaaagaaaattacaggccaatatccctaatgaacataagacccaaaattcctccacaaaatattagcacactgagctaggtggaatggctcacatctataatcccagcacttggggaggctgaggcagaaggatcactggagctcaggagtttgacaccagcctgggacatatattgagatcccatctctccaaaaaaaattttttaattagccaggtacagtggcacatgcttatagtcctagctactcaggaggctgagatgggaagatcacctgagcctgtgaggtcaaggctgcagtgagccatgactgcaccactgcaccccagcctggatgacaaagtaagcctgtctcaagaaaaaaaaatttatatatatgagcaaaccaaatccagcagcacatcaaaaaattaattcaccaccatcaagtgggctttattcctaggatgcaaggatgattcaacatatgcaagtcagtaaatgtgatttaccacataaggagaattaaaaacaaaaaccatataatcatctcaatagacacagaaaaggcttttgacaaaatcctatactccttcattataaaaatccacaacaaacttgacatcaaaggaacataccttaacataataagaggtatctattacaaactcacggccaacatcatactgaatgggcaaaagccagatgcattcccttaagaactggaccaagacaaagatgtccactcttaccattcctatccattatgtcactggaagccctagccagagcaataaggcaagagaaagaagtaaaagacatataaataggaaaaaaagaagtcaaattatctctcttcactgacaatataattgtatactagaaaatcctaaagattctgtcaagactcctaggcctgataaatgatttcagcaaagtctcaggatataaagtcaatgtacaaaaatcagtagcacttctatacgctaataatgttcaagctgagagccaagtcaagaatgcaatgccatttacaattcctaccaaaaaaaaaaaaaaaacaacctaggaatacacctaaccaaggaggtgaaggatctccacaaggagaactacaaaagactactaaaagatagcagagacgacacaaacaaatagaagagcattccacgttcccaggttggaagaatcaatattgttaaaatggtcatactgcccaaagcaatctacagattcaatgctattcctatcaaactaccatcatcatttttcacagaattagaaaaaaactattccaaaatttatatggaaccaaaaaggagcctaaatagccaaggcaattctaagcaaaaagaacaaagccagagacatcaatttacctgacttcaaactatactacatggtactgtaaccaaaacagcaaggtactggtacaaaaatagacacacagaccaatggaacagaatagaggcataaaaaaataatgggatcatgtcctttgcaggaatgtggatgcagctggaggccatagtcctaagcaaactaacacagaaacagaaaaccaaacactgcatgttcttacttataagtgggggctgactactgggttcacacagacataaagatggaaacaacagacgctaggaactctaaaaggaaggaaggagtggagaggacaagggctgaaaaacttcctatcggatactatgttcactatctgggtgacaggatcagcagaagcccaaacctcagtaccatgcaatatacccttgtaacaaacctgcacatgtaccctaaaataaaaatggaaacttaaataatacaaactgtgaaaaaatatttttaaaaaataatttccaaagaatatgaaatgctgatttacaattattaaatatttacacaacttcttcagaacacacctattgcataatgcaaagtacatatatatgatttaataaaaataatcctctacttggtagacaactaagtcatttgcatagaaacagtgaaaagcattctgattgaaagatctctcaatatagtgattacaaagaagacatacaaagggactcagactgtgtattataattggggtggagaaagtgatatggggacaactggaaagacaataaacaggcagtaaaaagttaaaggagtaggacaccttcaccagcatagaaacaacaagcaggtcagtactagagagaggttaaacaaaaagcccaatttaaaaatgggcaaagcagcaccgggcgcagtggctcaaaacctgtaatcccaacactttgggaagccaaggtgggtgaatcaaaaggtcaagagatcgagaccatcctggcaaacatggtgaaaccccgtctctactaaaaatacaaaaattagctgggcgtggtggcgcgcatctgtaatcccagctactcgggaggctgaggcaggagaatcgcttgaacctgggaggtggaggttgcagtgagccgagatcatgccactacactctagcctgggtgacagagcaaaactccgcctcaaaaaaaaaaaaaaaatgggcaaatgaattgaatagacagttcccaaaagatatacataatggataatggacaataagcatatgaaaagatgttcaatatcactagtcatcagagaaatgcagatcaaaatcacaatgagatgccacttcactcccattactatggccattagcaaagaaaaacaacagaaaataacaagtgctagcaggaacgtgaagaaactggaactcttgtacattggtggtaggaatgtaaaatggtacagctgctgtggaaaacagtatggaggttcctcaaaaaataaaacactcttgaattgatgattgtggatccagttcatggtagcattattcacaaaagccaaaaggaggaagaaacccaagtacccatcaacaaatgaatgaataaacaaaatatgctatatacatacaaagaaatattattcaggctttaaaaggaagcaaattctgacacattctatgacttgtataaattattgaaaacattaggctacataaaacacacacacacacaaaagaacaaatattgtttgattctacttatatgaaatatttagaacagtcaaactcatagagacaggaagtagaatactggttgcgaggggttggagcaagaggatatggagaattattgtttaatgggtacagggtttcagtttgagataattaaaaaatttctagaaatagtggtaatgattgcacaataatgtaaatgtactttatggcaatgaattgtatagagtactttaaaatggttaaaatgataaattttatgttatatattactcattaatcctaattataatcttaaattatgtaattatacttatactatataaatgttaatcttaaattatacataattattaatcttaaattttctttctctatttgaaagaagagaacatattatggggagtgtagtgagttgaaaaatggccatcctcagaagatatgtccacatcctaatctctgaaacctctaaatgttacacaatttgggggggaaaaatacaatttatgcagatataattaagttaagaatcttgaaagcagaagatcatcctggatcatctgagtgggccctaaatccaatgacaagtgcccttataagagaaaggcagagagaaatttgaggtagatagacaaaaaagaagacacagggctgggtgcagtggctcacacctgtaatcccagcactttgggaggccaaggcagacagactgcttaagctcaggagttcgagaccagactgggcaacatggtgaaccccatctccacaaaaaaaatataagatttagccagccatggtagcttgtgcctgtagtcccagctacttgcggggctgaggcgggaggattgcttgagcccaggaattcgaggctgcaatgagccatgttcacgccactccagcctgggtgacaaagcaagaccctgtgaaagaagaaagaagatgatgatgatgacacagacactcagaggaaaatgcaatatggagatgtaggcagagattagagtaagacaactacaatctaaggaaaacaggattgcaggcagccaccaagagctggaaaaagtgaaaaatagattatcctgtagagccccttgagggagtacagtcctgccaacactttgatttcagacttctggtttcccaggctaaatgaagatactcctctatgccattcaccactgtgttaaatccttgcaaggaatcttccaacaggtggtgtcagacaaacacaggtgcacatacactaagacatccaaggtatctacaaatacctacacagcagggactgggagatggaaggtgtgttaagtgtgttgggtgtggtattactcaagtctcaccactacagagaatcagttttccagaatttctcaagcaaattttattattaattgagcaggaaaggaggacatggatgcttttctcttttttggtgttgggtttttttaaatattaaaaaacggttaactaagtgttcactcttcacatgtggacataaccacattttttgtctctttttttaaaatcctttctttgtgaaaaaagtagtgccatgggatttccaatgggagagagctactgtgttttactttttgatatgcactataaagaatgatcttctaacccatgtctgtttttacgctgcctatactaaagcatttgttgcatctatttaaatgctatgtttctccaaaaagggaggtggaagccagttggaaaatatggtgggttaaggaaaagactcttcaggaaaggatagcattatttttgaaaacatcattcatcaaaaatgactccttatgtttgaaaatatctgcagggctcctttatttgtaagtaggtagtgtaaggacacagagatagagacctttttttaggctaaaataattctttttttttcatactttaagttttagggtacatgtgcacaatgtgcaggttagttacatatgtatacatgtgccatgcgggtgtgctgcacccattaactcgtcatttagcattaagtatatctcctaatgctatccctccccactccccgcaccccagaacagtccccagagtgtgatgttccccttcctttgtccatatgttctcattgttcaattcccatctatgagtgagaacatgtggtgtttggtttcttgttcttgcgatagtttactgagaatcatgatttccaacttcatccatgtccctacaaagaacatgaactcatcattttttatggctgcatatcattccatggtgtatatgtgccacattttcttaatccagtctatcattgttggacatttgggttggttccaagtctttgctattgtgaatagtgccacaataaacatacgtgtgcatgtgtctttatagtagcatgatttatagtcctttgggtatatacccagtaatgggatggctgggtcaaatggtatttctagtcctagatccctgaagaatcgccacactgacttccacaatggttgaactagtttacagtcccatcaacagtgcaaaagtgttcctatttctccacatcctctccagcacctgttgtttcctgactttttaatgattgccattctaactggtgtgagatggtgtctcattgtggttttggtttgcatttctctgatggccagtgatggtgagcattttttcatgtgttctttggttgcataaatgtcttctctgagaagtgtctgttcatgtccttcgcccactttttgatggggttgtttttttcttgtaaatttgtttgagttcattgtagattctggatattagccctttgtcagatgagtagattgcaaaaatttcctcccattgtgtaggctgcctgttcactctgatggtagtttcttctgctgtgcagaagctctttagtttaattagatcccatttgtcaattttggcttttgttgccattgcttttggtgttttagacatgaagtccttgcccatgcctatgtcctgaatggtaatgcctaggttttcttctaggatttttatggttttaggtctaacgtttaagtctttaatccatcttgaattaatttttgtataagttgtaaggaagggatacagtttcagctttctacatatggctagccagttttcccagcaccatttattaaatagggaatcctttccccattgcttgtttttctcaggtttctcaaagatcagatagttgtagatatgaagcattatttctgagggctctgctctgttccattgatctatatctctgttttggtaccagtaccatgctgttttggtaccagtaccatgctgttttggttactgtagccttgtagtttgaagtcaggtagtgtgatgcctccagctttgttcttttgggttaggattgactcggcaatgcgggctctttttgggttccatatgaactttaaaatagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcatgtcccttgtaagttggattcccaggtattttattctctttgaagcaattgtgaatgggagttcactcatgatttggctgtctgttattggtgtataagaatgcttgtgatttttgcacattgattttgtatcctgagactttgctgaagttgtttatcagctaagggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttatggagagtttttagcatgaagcattgttgaattttgtcaaaggccttttctgcatctattgagataatcatgtggtttttgtctttcgttctgtttacatgctggattacatttattgatttgcatatattgaaccagtcttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgtcaggctttggtatcaggatgacgctggcctcataaaatgagttagggaggattccctctttttctattgattggaatagtttcagaaggaatggtaccaattcctccttgtacctctggtagaattcggctgtgaatccatctggtcctggactctttttggttggtaagctattgactattgccacaatttcagagcctgctattggtctattcagagattcaacttcttcctggtttaatcttgggagggtgtatgtgtcgaggaatttatccatttcttctagattttctagtttatttgcatagaggtgtttgtagtattctctgatggtagtttgtatttctgtgggattggtggtgatttcacctttatcattttttattgtgtctatttgattcttctctcttttcttctttattagtcttgctagcggtctatcaattttgttgatcctttcagaaaaccagctcctggattcattaattttttgaagggttttttgtgtctctatttccttcagttctactctgattttagttacttcttgccttctgctagcttttgaatgtgtttgctcttgcttttctagttcttttaactgtgatgttagggtgtcaattttggatctttcctgctttctcttgtgggcatttaatgctataaatttcactctacacactgctttgaatgtgtcccagagattcttgtatattgtgtctttgctatcattggtttcaaagaacatccttatttctgccttcattttgttatgtacccagtagtcattcaggagcaggttgttcagtttccatgtagttgagtggttttgagtgagtttcttaatcctgagttctagtttgattgcactgtagtttgagagacagtttgttataatttctgttcttttacatttgctgaggagagctttacttcctgttccaaaatgtggtcaattttggaacaggtgtggtgcggtgctgaaaagaatgtatattctgttgatttggggtggagagttctgtagatgtctattaggtctgcttggtgcacagctgagttcaattcctggatatccttgctaactttctgtctggttgatctgtctaatgttgacagtggggtgttaaagtctcccattattattgtgtgggagtctaagtctctatgtaggtcactcaggacttgctttatgaatctgggtgctcctgtattgggtgcatatatatttaagacagttagctcttcttgttgaattgatcccttcaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattttgatgttagctggttattttgctcgttagttgatacagtttcttcctagcctcgatggtctttacaatttggcatgattttgcagtggctggtaccggttgttcctttccatgtttagtgcttccttcaggagctcttttagggcaggcctggtggtgacaaaatcactcagcatttgcttatctgcaaagtattttatttctccttcacttatgaagcttagtttggctggatatgaaattctgggttgaaaattcttttctttaagaatgttgaatattggcccccactgtcttctggcttgtagagtttctgctgagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccgtcactttcaggtacacagtgagatgaagatctggtcttttcacatagtcccatatttcttggaggctttgttcatttctttttgttctttttctctaaacttcccttctcgcttcatttcattcatttcgtcttccatcactgataccctttcttccagttgatcgcatcggctcctgaggcttctgcattcttcacgtagttctcgagccttggctttcagctccatcagctcctttaagcacttctctgtattggttattctagttatacattcttctaaatttttttcaaagttttcaacttctttgcctttggtttgaatttcctcctgtagcttggagtagtttgatcgtctgaagccttcttctctcaactcgtcaaagtcattctccgtccagctttgttccattgctggtgaggagctgcgttcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtgtgttggagtttgctagaggtccactccagactcggtttgcctgggtaccagcagcggtggctgcagaacagcggattttcatgaaccgcgaatgctgctgtctgatcgttcctctggaagttttgtctcagaggagtacccggccgtgtgaggtgtcagtctgcccctacttgggggtgcctcccagttaggctgctccggggtcaggggtcagggacccacttgaggaggcagtctgcccattctcagatctccagctgcgtgctgggagaaccactgctctcttcaaagctgtcagacagggacatttaagtctgcagaggttactgctgtctttttgtttgtctgtgccctgcctccagaggtgaagcctacagaggcaggcaggcctccttgagctgtggtgggctctacccagttggagcttcccggctgctttgtttacctaagcaagcttgggtaatggcgggcgcccctcccccagcctcgctgccgccttgcagtttgatctcagactgctgtcctagcaatcagcgagactccgtgggcgtaggaccctctgatccaagtgcgggatataatctcctggtgagccgttttttaagcccctcggaaaagcgcagtattagggtgggagcgacccgattttccaggtgccgtctgtcacccctttctttgactaggaaagggaactccctgaccctttgcacttcccgagtgaggcaatgcctcgccctgcttcggctcgcgcacggtgcactgcatccactgtcctgcgcccactgtctggcactccctagtgagatgaacccagtacctcagatggaaatgcagaaatcacccgtcttctgcgtcgctcacgctgggagctgtagaccagagctgttcctattcggccatcttggctgcttccccaataaaatcaataattcttaatttactcttaaacagagattgtcatgctttatgtgagttaaatttccagaaagttgacaagtgcctccaattatctccttaaatcacatttgacataaatcttccaaaatacactatttatttacacatctttttttaaagttataaacattcagtattgcattgcatagaagtaaaaattcttggtttgatttctattttctttcctttgcctgattcaagaaatcatcaggtacttctcctgctgtccacagagtgatccatacagttctttccttacccctttccctatgctgaacaacaggtaagcaaacacaaagggtttttacaggttacgcctgtactcccaactactcaggaggctgaggcaggataattgcttgacccagggaggcgaagattgcagtgagcctagatggcgccactgcactccagcctgggtgacacagcgagaatccatcaaggaaaaaaatacaaaaatttgctgggtgtagtggtgtgcacctgtagttccaggtattcgagaggctgaggtgggaggattgcttgagcctgggaggttgagggctgcagtgagctgtgattgtgccactgcactccttcctgcctgggtgacacagtgagaccctgtcacatggatggaaggaagggagggagggagggagggaaaagaaaggaaaggaaaaaagtaaagagaaaagaaaagaaagagggaaggaaggacggaaggaaggaaatgatactatttattcatctcctgatttaaaatatatacatatatatacatacttcctaaggctgagtgcactggcttacgcctataatcccagtactttgggagaccgaggcaggtggatcacttgaggtcaggagttcaagatcagtctggccaacatggtgaaaccccgtcactactaaaaatacaaaaaattagcttggcatggtggtgcgcacttgtaatcccagctacttgggagactgagctgagacaggagaatcgcttgaaaccgggaggcagaggttgcagcaagccaagactgccaccgtactccagcccagacaacagagcgagactttgtctcaaaaaaaaatatatatatatatatatctatacacacacatatatatacacacacacactcacacacacacactctctctctctcacactcacttcctaaaggcctgagaaaaagagaagactgatctcctcaaaagtatgtggttaactgaattcaaaactaaatttttttaactattctatttatctaactgatcaaaattaatttggtggtttcatatttaactttataaaataaactgagttttaatttaaaaaaatttgtttcacttaacattctgattagacttactcccatttgccactactcactaattttaatctcatagctgaatataaatttataagcacttttatccctctcctgtttaaaagctttatatgtttcaatgtgtacatcatcatttccctttactaaacagataatcattactgtctaccacagtgaagattcggtttacatatactacaagtttctttggggggaagaaaaagttgtatggaaactaacaaatttggttaactccttgccatcaaacaaatccagtgtttttaatagttcttcttattagaaaatttctccttgaacatctatattccaaatattccttattctgcccaggaatgataaaagaaataatcaatctctgacaaactgataaactaaagcatataaaacaaatgacctcagacttaacacctttgaaagacccattctcaaataactgcaaatttccaatttaaccactttcattttctaatttagtgccatctttaagttcttcgtatccctcagactatgacaccctaaatatatgtcctacaaaaaccttaatcagtgaaaaacagtattaatttgtggccacttaaggagaagcaactccattctaaattatccaagctcaaggcatctctttttgcccctaatttttgctggcctaagcaatactactttacaaacaggcctggtacctaaacacggtaaaaggctgagaaaatgactgggaaaccaaatcccagttcactcagtctacaaggcagcaccactgttctggagtgttcctaattatatacagctagtgggcaggcatagtggaaagggctagaactctgtgaggatgaatgcaaggcatttcagaaagactggctagaatcctcactccaattaggcaataccaccagtggctgggcaccccactatagatggaggctggggaaactcacccaccacatcctaactttgtctctaactttgttctagatagccatgtatatgtagtaaattgtatcatttacttatattaaaataactatcaggttttttgcctgttatcagctgtggggtcttcatgtcaatcacatctttgtctcattgtggcaactttgtagattattgattacctcattagcctatatgtctaccaaaacatggctggaaaacaaaactttaaaaattgaaatcttacctaggttaccatatttcctgctactctggaaaacttagagggttcagattttaaatcagtaattataatattgtgattacatggttttaaaatgtcttatttttgttagccgctcctccacttgcactgagttgggatattaacacagaggatatttctttggtgtctaggcaaaaacacagaacaaactgagttcatatctcagttctgccactgacaagttatgtcatcttaaataacataatcttatccatttcatccaatccacccaatggaggataaaatatttatttcacaaaattactacagtacaaaaaaaaatgttggtaaaaaacttcaatatttcactcacttaccatagtgtcatatcctaccagctttctcatatcttaactaccactttatctcctctctaacctcctgagattctgatttaatctgtttagggtagggctccccacatgacggctatgcagcaagcatggagaacactacctattctttgatcaccccatttccttacactctctcttttctttccagactgtgccctgttagtaaccccttgaactgtctctcagcagcatccttaaattccctatagccccatccttctaagacactcattcattaaaacccaaaccctccatatcaaggccataatgcattctactgcacagcagagcacactaccataggaaggcccacaaaccaggattaattacactatactttcccaattaccaattttagctgggccctcaacaatttttctctcttggacagctctttctttcattgccctcactataccccccacaaaactactgtaaaccttgatgaaacagtaaagtttattaattctattaaatttctacacttgaatatgtatttttaatattctacattgacaaaatggaaaatatgcataaagcacttccccacatatcaaagaacaacaataatctgaaaaaaagcagttgtgtgactgagctgcaagctaaataaactacaaggctcttttcaaagaacatcatttttacttgaagaataactaacagaaaactaaggttacacagacttgggtatttgacagacattttctcaaaaaggaaccaagtgaacctgtcatttcaaggaaaacaaaaggcagtacttgttaccagtgataaaactatctgttacatgatctcaacagcttccaatacttgcagttcaatactctactttgtaagacagctcacaaacacaagaaaagttaaataatgatattatttaaataggaaataaactatattatgtttggaaatgcacgaggcaacacttgattaactgtccaaagaactggactgtgaagaaattgcctatatacaaaatatgaggaaaaagagaaatttacttgggcgatagctgtcaagaatggctctacacaggcataaaatccaagttgggacttgaaaaactggtaggatttagatttaaaaaaaaaaaaacagtgagcaaggcatcctaggaagtttgcaatacaggtatatttttttctaaaagaaatattattttcaggtatatttttaataatgtataatgtattcattcaaactctcaggtaatattagaagatccttaaaggaagaggccacatattacaattctctgctatctgagcacaggatcaaatttaacatgttgaactatttggttggaaaaataagatttacacagggaagaagcagaatagtaataatggaagtcctaagttaaatcccagctcttgtacttacctaggttgccttgggtaatttagtaaacctcactgattcaaactcaaatacacctactttgaggatcaccctacaaacatcctaactaaaagaaccacagataactaatgatcagagatgaaataagactttgtgttcctgtttttatgctgaccttgttgtttttcaagttattttcaaacaattgatgcatttttatctttcatttaccaaaaggaatttatatacaccaggaagatgatacatattgtatacaattacattactcaaagaactctaggctgggcacactgctgtaatcccagcactttgggaagctgaggtgggcggatcgcttgagcccagaagttggagaccagcctgggcaacatggcgacaccttgtctctacaaaaaattagttgggcatggtggtgcatacctatagtcccagctactctgcaggctgaggtgggaggatcacctgagcccaggaggtcgaggctcgagtgagccatgatcgcactactacaatccaggctgggtgacagagtgagaccttatctcaaaagaaaaaaaaaaaaaactctctttaaaatgtttcaatacagcagacagatttttaaatattttctgtataatacactgttacctatattatcgaaatttaacccacaatggcattataatatcagatgtaattccaatttattcttcttcagatattctaaaatatctgaatttttatgcattcttcctctttctatctatttacttcacattcctccagccaccatgatattatcttctcttttctacaaatacacacatacatacactcctcccctcattcctacatccttattgagataactacagccactagagggcaataagtatacaaagatcagtgtacctatttatgatgatgaacttatctatatgattcacatagtaataaacctaaaaagtatatcatcacaaaccctgaaacacaggcaattagacttgaatatgcaaaatatatatttcaaactcaaaaattatcctgcagagttcacagaagcatataatgatgttcaaaaaaggaattccattttctcagcatgcattcattaaaaaaaattagccgaattcctttatatgtgcatagtaatattagaaattaggattgcttaataccatcctcagaccaaagaagagaaaaggcagaaaaaaaaaaacacacagtaaggtataaatcacagagtgggtaaaaaagtgagaaatgattacttccaactctttcactaccacaatcaagaaaacaataaactgaagagcaaagaggatttaccaaccctttcttctattgaaaagcaagcaaaaattttacaagtatatttttgggggaggagaacagtgatggtagagatatacaaagccttcagttcttttctcacaattaagaatgcagaaggaagagaagttaacagttactaatctttaagaggtaattttaccatttttaaaaagaatacatttaaatgaacttatttagtttatatttacttacattgacattacaaaacggcaacacttatataaggctaacattttcagcaaaccataattttcttaccctcattggatgtatatcagcataaggaggttttccttcagccatttctatagaagtaatgccaagggaccagatgtcggccacacagttatagcctatttcttgaatcacctcaggagccatccaaaatggagttcctattacagtattgcgttttgccattgtatcctgcaataatgttacatagccataaatgctactacaaaagcacaaaggaaatctgtatgccaaacatacttttaaaaaatgttaaaacctccaatgccacagattatatcagaaattgactattttgctaaaatttcaactagttatgacatacttaggaattccgaattctgaaaataaccaagagtccacaggtaacttatccacactaccatcattaaacacagtcattaaagatagtgctacaatgataaaagctacagaaatgagctacgtagcttcccttttagaacatttaagcattttgattataagatatattttcacattcaatcaccctaaattataaattaaataatactcaaatttggctcaattatggttccttctccacaaaaattaaaaaactacacatttctttccattccccctcaaaaagtaattgaagtttagttataatcaaatctgaacaaattagccaagtgtttagaaaaccattaaagttaacttactgttaactgaccagccactccaaaatctgccaattttgcatgtccttctgtattgaggagaatatttccagcttttatatctctgtgtatttttctcataaagtgcaaatattctagtcctttcaatgtagatttaagaatggttgcaatttcatcttctattaactggaaagaaatatttttaaaaccataattaaaatgccacgttagataaaatcttacgaaagagcactagtaacaagtatgtctttccgtgtgtgtgtgtgtgtttttttttaagagaccccactctgttgcccaggctacagtgcagtggtgtgatgatagctcactgcagcctaaaattcctgggctcaaggcatgctcccacctcagcttcccgagtagctagaactacaggcacatgccaacccaataggctaacttatttttatttttgtagagatggggatctcgctatgttgcccgggctggtcttgaactctttgcttcaaacaattctccttcctcagcttcccaaagtgttgggattataggtgtgagccaccatgcctagccacaagtacttctttctaatgaccgctaaacctccaggaaaatgctaaaggggtaaataatcgagaacctcttcttcccacaataagctttcttattacacattttactaatgaaaggatgatcaaatttctctctttaagattatcagtatcagcagggcgtggtggctcacacctgtaatcccagcactttgggaggctgaggcgagcagatcacttgaggtcaggagttcaaaaccagcctggcccacatggtgaaacctcgtctctactaaaaatacaaaaattagccaggcgtgatggcgtgcacttgtaatcccagctactcaggaggctgaggcaggagagtcacttgaacctgggaggcagaggttgcagtgagctgagatcacatcactgcatgccagcctgggcgacacagcgagactccatctcaaaaaaaaaaaaaaattatcagtatcattcctaaagcaaacaacatatctcaagaatcagcctgatataaggaatcataatagtgatttcccacatcttctaatactgggagggcactatcacagctaatatctgttctgaaaaagtaaattcagatacttcccctgagatatttcagattcttgatgaaaatgaaaccaacagctttacataaaggaaagtaaatgagggagggaggcttgcaatgaatcttctgcgagaagctcctacaccaatgccactcctaacccttccaagttctggacttctgacctaatattgagaactcagaagaaaaaacgtcagagaaagattaggaaaatggaaacacaagcaaagactatcagaggagggaaaaaggggagagtagagaaggccgaggaagagacggatgggaaagaaagaaaatcttcttaacagttgtagcagtagagccactgctatctgtaccaggcaatgtgctaagagttatgcatgcattctctcatttattcttaaaacaaccttgtaaggtagtgtgatattatgaaatcacaggaaatatttggtctttgtaggttcttggcacaaaatctcctaagaccctgtgaattgactgagtgagtgagaagttgaatcaagatattttatctttgttttctcaccctctcacaagagtgagaggggctgtcttttgtcattcataataagctcctttcaaccataccagaatttatactgatcaggtgactcttggtgggagcctagatagcttcaggatgggagctggttgccgaaaaaaccaaccaagtgattagatgtttggaaatttctgcctgacccctgacttacgggagggctgcaaggagagagggggtagagatttagttaagcacaaatgtccaaagacttaatcaatcatgcctatgtaacagaatcaaccataaaaattctaaatgattagggactgctctcaagcttatattctatctataagcaacgggataatttgatagaaaataggataacacaggaaaatgtctgtgaaaattgctatgaggacaacaatagagagctactgatagagaacgactgagaagctactttagattgacattcaagaaggcccaaaagacattttactgaagtctaaatgatataatggggccaaccatgtgaatggctatctgggaacatacactccacaaaaaggaaaaaaaaagattaaaatatcttgattcaacttctcaaattttctaaaacactgaagaaaagagaacacttccacactcattttaagaggcattattctgatatcaaagccagacaaagttaccacaaaacaactaagaccaatatcccttatgaacattgatacaaaaatcctcaacaaaatatagcacactcacttcaacaggattgtaacaggttatacactatgaccaactggaatgtattcctggaatgcaaggttgattcaacatacaaaatcgaacaatgcaatacaccaccttaacagaatggagaagaaaccacatgatcatttcaaatgaaaacagaaaaagcatttgattaaatttaacttcttttcataaaacacacaactaatatgaatagaaggaaactatctcaccatagtaaaagccatatacaaaaaacccaaagtaaatgtcatactcaaagcagtaagactgaaagcttttccacaaagatcaggaacaatgaaaggatgctattaggttggtgcaaaagtaatcgcagtttttgccattttttttttaaagtaatggcaaaaaccgaaattacttttgcaccagcctaatacttctgttacatatagtactggaggttctagacagagcaattagggaagaaaaacaaataaaggcatccaaactggaaaaaaagaagtaaaattatctctgttcacagatgatatgatcatatatgtagaaaattctaaagattccacaaaaaaaacctattagaactaataaatagggatggagacaagacggctgaataggaacagctccagtctaaagctcccagcgtgagcattgcagaagacacatgatttctgcatttccaactgaggtaccagattcatctcactggggagtatcggaaagtgggtgcaagacagtgggtacagtgcactgagcatgagctgaagcagggcggggcatcacctcacctgggaagtgcaaggggtcagggaattccctttcctagtcaaagaaaggggtgacagatggcacctggaaaatcaggtcactcccaccctaatactgtgcttttccaatggtcttagcaaacggcacaccaggagattatatcccgcgcctggcttggagggtcctacacccatggagcctcgctcactgctagcacaacagtgtgagatcaaactgcaatgcggcagcgaggctgggggaggggcgcctgccattgcccaggcttgagtaggtaaacaaagcagccaggaagctcaaactgggtgcagcccaccacagctcaaggaggctggcctacctctgtagactccacctctgggggcagggcatagccaaacaaggcagcagaaacgtctgcagacttaaatgtccctgtctgacatctttgaagagagtagtggttctcccagcacacagctggagatctgagaacagacagactgcctcctcaagtgggtcactgacccccaagtagcctaactgggaggcagccccaagtaggggcagactgacacctcacacagcccggtactcctctgagacaaaacttccagaggaacgatcaggcagcaacatttgctgttcaccaatatccactgttctgcagcctccattgctcatacccaggcaaacagagtctggagtggacctccagcaaactccaacagacctgcagctgagggtcctgacagaaggaaaactaacaaacagaaaggacatccacaccaaaaccccatctgtacatcaccatcatcaaagaccaaaggtagataaaaccacaaagatgcagaaaaaacagagcagaaaaactggaaactctaaaaataagagtgcctctcctcctccaaaggaacacagctcctcaccagcaatggaacaaagctagacagagagtgactttgacaagctgagagaagaaggcttctgatgatcgaactactccgagctaaaggagaagtacgaacccaggcaaagaagttaaaaaccttgaaaaaaaaattagacaaatggctaactagaataaccaatgcagagaagtccttaaaggacctgatggagctgaaaaccaaggcacgagaactacgtgacaaatgcacaagcctcagtagccgattcaatcaactggaagaaagggtatcagtgatggaagatcaaatgaatgaaatgaagtgagaagagaagtttagagaaaaaagaataaaaagaaatgaacaaagcctccaagaaatatgggactaggtgaaaagaccaaatctatgtctgattggtgtacctgaaagtgatggggagaatgaaaccaagttggaaaacactccgcaggatatcatccaggagaacttcctcaacctaccaaggcaggctaccattgaaattcaggaaatacagagaacgccacaaagatactcctcaagaagagcaactccaagacacataattgtcagattcaccaaagttgaaatgaaggaaaaaatgttaacagtagccagagagaaaggtcgggttacccacaaagggaagcccatcagactgacagctgatctctcggcagaaactctacaagccagaagacaggggggccaatagtcaagattcttaaagaaaagaattttcaacccagaatttcatatccagccaaactaagcttcataagtgaaggagaaataaaatactttacagacaagcaaaggctgagagattttgtcaccaccaggcctgccctaaaagagctcttgaaggaagcaataaacatggaaaggaacaaccagtaccagccactgcaaaaacatgccaaattgtaagaccatgaatgctaggaagaaactgtatcaactaacgagcaaaataaccagctaacatcataatgacaggatcaaattcacacataacaatattaaccttaaacgtaaatggactaaatgctccaattaaaagacacagactggcaaaattggatacagagtcaagacccatcagtgtgctgtattcaggaaacccatctcacgagcagagacacacataggctcaaaataaaaggatggaggaagatctaccaagcaaatggaaaacaaaaaaaggcaggggttgcaatcctagtctctgataaaacagacgttaaaccaacaaagatcaaaagagacaaagaaggccattacataatggtaaagggatcaattcaacaagaagagctaactatcctaaatatatatgcacccaatacaggagcacccagattcataaagcaagtcctgactgacctacaaagagacttagactcccacacaataataatgggagactttaacaccccactgtcaacattagacagatcaacaagacagaaagttaacaaggatatccaggaattgaactcagctgtgcaccaagcggacctaatagacatctacagaactctccaccccaaatcaacagaatatacattcttttcagcaccacaccacacctattacaaaattgaccacatagttggaagtaaagcactcctcagcaaatgtaaaagaacagaaattataacaaactgtctctcagactacagtgcaatcaaactagaactcaggattaagaaactcactcaaaaccgctcaactacatggaaactgaacaacctgctcctaaatgactactgggtacataacgaaatgaaggcagaaataaagatgttctttgaaaccaacaagaacaaagacacaacataccagaatctccgggacacattcaaagcagtgtgtagagggaaatttatagcactaaatacccaaaagagaaagcaggaaagatctaaaattgacaccctaacatcacaattaaaagaactagaaaagcaagagcaaacacattcaaaagctagcagaaggcaagaaataactaagatcagagcagaactgaaggagatagagacacaaaaaacccttcaaaaaattaatgaatctaggaactggttttttgaaaagagcaacaaaatagaccgctagcaagactaatagaaaagagagaagaatcaaatagaagcaataaaaaaatgataaaggtgatatcaccaccgatcccatagaaatacagactaccatcagagaatactataaacacctctacgcaaataaactagaaaatctagaagaaatggataaattccttgacacatacaccctcccaagactaaaccaggaagaagttgaatctctgaatagaacaataacaggctctgaaattgaggcaataattaatagcttaccaaccaaaaaaactccaggaccaaaaggattcacagctgaattctaccagaggtacaaggaggagctggtatcattccttctgaaactattccaatcaatagaaaaagagggaatcctccctaactcattttatgaggccagcatcatcctgataccaaagcctggcagagacacaacaaaaaaaaaagagaattttagaccaatatccctgatgaacatcgatgcaaaaatcctcaataaaatactgacaaaccgaatccagcagcacatcaaaaagcttatccaccatgatcaagttggattcatccctgggatgcaaggctggttcaacatacgcaaatgaataaacataatccagcatataaacagaaccaaagacaaaaaccacatgattatctcaatagatgcagaaaaggcctttgacaaaattcaacaacctacatgctacaaactctcaataaattaggtattgatgggatgtatctcaaaataataggagctatctatgacaaacccacagccagtatcatactgaatgggcaaaaactggaagcattccctttgaaaactggcacaagacagggatgccctctctcaccgctcctattcaacatagtgttgaaagttctggtcagggcaattaggcaggagaaggaaattaagggtattcaattaggaaaagaggaagtcaaattgcccctgtctgcagatgacatgattggatatctagaaaaccccatattgtctcagcccaaaatctccttaagccaacaggcaacttcagcaaagtctcaggatacaaagtcaatgtgcaaaaatcataagcatttttatacaccaataacagacaaacagagagacaaatcatgagtgaactaccattcacaattgcttcaaagagaataaaatgcctaggaatccaacttacaagggacatgaaggacctctttaaggagaactataaaccactgctcaatgaaataaaagaggatacaaacaaatgcaagaacattccatgctcatgggtaggaagaatcaatatcgtgaaaatggccatactgtccaaggtaatttatagattcaatgccatccccatcaagctaccaatgactttcttcacagaattggaaaaaactattttaaagttcatatggaacccaaaaagagcccgcactgccaagtcaatcctaagccaaaggaacaaagctggaggcatcacactacctgacttcaaatacactacaaggctatagtaaccaaaacagcatggtactggtaccaaaacagagaaacagaccaatggaacagaacagagccctcagaaataatgccgcatatctacaactacctgatctttgacaaacctgacaaaaacaacaaatggggaaaggattccctatttaataaatggtgctgggaaaactggccagccatatgaagaaagctgaaactggatcccttccttacaccttatacaaaaattaattcaagatggattaaagacttacatgttagacctaaaaccagaaaaaccctagaagaaaacctaggcaataccattcaggacataggcatgggtaaggacttcatgtctaaaacaccaaaagcaatggcaacgaaagccaaaattgacaaatgggatctaattaaactaaagagcttctgcacagcagaagaaactaccatcagagtgaacaggcaacctacagaatgggagaaaatttttgcaatctactcatctgacaaagggctaatatccagaatctacaatgaactcaaacaaatttacaagaaaaaaaaaacaaccccatcaaaaagtgggcaaaggatatgaacagacacttctcaaaagaagacacttatgcagccaaaagacccatgaaaacatgctcatcatcactgaccatcagagaaatgcaaatcaaaaccacaatgagataccatctcacaccagttagaatggcaatcattaaaaagtcaggaaacaacaagcgctggagaggatgtggagaaataggaacacttttacactgttgatgggactgtaaactagttcaaccattgtggaagtcggtgtggcgattcctcagggatctagaactagaaataccatttgacccagccatcccattactgggtatatacccaaaggattataaaacatactgctataaagacacatgcacacgtatgtttactgtggcactattcacaatagcaaagacttggaaccaacccaaatgtccaacaatgatagactggattaagaaaatgtggcgcatatacaccatggaatactatgcagccataaaaaatgatgagttcatgttctttgtagggacatggatgaagctggaaaccatcattctcagcaaactattgcaaggacaaaaaaaaacaaacaccgcatgttctcactcataggtggaaattgaacaatgagaacacatggacacaggaaggggaacatcacacaccggggcctgttgtggggtgtggggagtggggagcgatagcattaggagatatacttgacattaaatgatgagttaatgggtgcagtacactaacatggcacatgtatacatatgtaactaacctgcatgttgtgcacatgtaccctaaaacttaaagtataataaaaaaagaactaataaataaattcaacaaagtagcagtatacaaaatcaacccaagaaaatcagatatatttttatacattaccaatgagcaatctgaaaaggaaactacaaaaaaaattctatttacaatagaaatagaatttctttattttaaagaataaaatacttaggaattaatttcaccaaggaggtgaaatatctgtacaatgaaaactacaaaacactgctgaaaaaaaattttaggacattaataaataaaaacctatcatatcttcatagataagaaaatttaatgtttttaagatgcccatgctacccaaagcaacctacagattcaatgtaatccctatcaaaatcccaatgatgtttattgcagaaatagaaaaacttatcctaaaatttgtatgaaatctcaaggggccccaaaacaacactgaaaatagaagaacaaagctaaaattctcatagttcctgatttcaaaacttattacaaagctatagtaatcaaaacaatgtgatattggcataaacacagacagatagatgggaggaacagagtagaaaacccagaaataacccttgtatatataatcaaattattttcaacaagagtgtcaagaacattcaataggaaatgaacagtattttcaagaaacagtgctggcacaactggatatccgtgtgctaaagaataagtagaatccttacctagcaccatatacaaaaattaattgaaaatgaatcaaagacctaaacataagacctaaaactataccactcttgggaaaaaataaaacagggcaaaaacctcatgataccagatttggtaatgatttctcagatacgaccaaaaaggcacagagaacacaagaataaaacagacaaattggacttcatgaaaattaaaaaaaaaaacctgtgcatcccaagacaatatcaacagagtaaaaagacaacccacagaatgggagaaaacatttaaaaattacgtatctgataagacattaatatacagaatatatagagaactcctaaaacttaacaataaaaaaatcaaattcaaaaatgggtaaaggactcgtatggacatttctccaaaggtatacaaatggccaagaggcacgtggaaagatcctcaacatcaccaatcataagacaaatataaatcaaaaacataatgagataccacttcacacccattatgacggctattatcaaaagacagaaaagaacaaatgttggcaaagaagtagagaaattggaaactttgtgtatagctaatgggaatgtaaaatggtacagcctctgtggaaaatagtatgaagattcctttaaaagttaaacataaaattaccttttgacccagcaattccacttttgggtaaatactcaaaagaattaaatgcagggtctcaaagaggtgtttttgaacaagtttcacctcacgatgaacgtacacccatgttcatagtagcattattcacaatggctaaaaagtggaagcaacccaaatgtcattcgacagacaaatgaataagtaaaatgtggtagaaacatacaatggaattttattcagccttaaaagggaaggcaattctgcaatatgctacaacatggctgaaccttgagtacattatgctaaatgaagtaagtcggtcacaaaaaaaggcaactaatgtatgatcctgcttatatgaaatactcagagttaccaaaatcacacatctagatagacagtagaacagtggttgccaggggccgaggtagcacacaatggacagttagtgcttaatgggtacagagtttcagtcttacaagatgaaaagagttagggggatggataatggggatgcttacacaactttataaatgtatttaatgccactgaactgcacacttaaaaatggctaagatggcaaattttgtttatgtgtatcttggcacaataaaaataaaactgagggggggaaatgccttgattcaagaaaaagctcaccatatttgagttgaataaagaaggctgaagtttaatgcaccagaagactagctctagatgagatctgagagacaggcaaggaccagatcatgtaaggctttcctggccataggtaagcagtctggattatctgaaaattccggtacttccaggaatttattctctccttcagactagatggtctgacttgacagcgcagagaaagcaagcaccatactctaaagctgcaccatccaacagagtaaccactaaccacacatggctcctaaacatttgaaacgtgggtattctaatttcagttatgctataaatgtaaaatatacaccaaagatcaaggcttagtacaaaaagaatgcaagctattttgttaaaaattcacatactgattacccactaaatatttacatattatgttatgatattaatatattaatgttgaacatataaaatgttaatgtttaatatagtaagtattaaatatggtatttcatattatataatattgttatttattaatatgtgtgatacattatgaaagttaatttcactttttttaatgtggctactcaaaaatttaaaattacatgtggcttgtgtttcttttggacagtactgcactagaaagggtccacaagaatgttttgtgaacactttgttcactgatgtatccacaatgcttggaactatgcctggcgtacagatagcacttgataaataatgaatgaatgggtacagacttgtcgatacaaaaagaaaggagacaccttcatctgatgttcccaatctttctaagttagtggtgtgcagccaaatgtgggggagtgggaggtaggagtgtgtttagggccaccataatggaccactacagacggtgggcaaggtggtggtgctgtcatgtgcacctagcttttctcgtctgtcctcatcctccactctttgtataaagactaaaaagcttggggtgttaataaaggcagcatcagcccataaaattgtgtcttatttagttacttcagtacagacctttttagttacctagacttcaatttttatctcttaacattctatttccaaccaataagtcactaattttctattaactctgatttgttatctctgctcctgtaccctatatatcactgctctactaaagaatgttcagaattaaataaactgactgtacttcagggtcttaggatctgtctgattttaatgctataaagccactggacaaatccacagcaagtctaaaggaggattttccagggatattatactaattcatgaactgtctggctttgctcaatgacttgaaagggtcattccaactctatgattctatgttatcaaagtatcttcatgtagaggcaatcttcactaaataaaattctcactcatttgggcatcaatctatgtgttcatttagtaaatatattcttgactggctctaccacagcgctgatactcttcaaggtgctggatatacacggacagggaaactgataatcccagtcctaatgagcagacaagaatatctgagggcataacctgaatttggctctgaactgttaaaggtggagagtgcagatctgaagtttatacagcctctctttcattatgcttccctttggtaacaaatccctcccactacttcagagagtcaatgtcttcccattcgcttcatatcctccttaatcaaaaaatgatgcaatatccagtcattcatacaagtacatgaatagagcttaatttaaatttattttaacaacccaatttagtattaaggcttataagcagtatctgtactttaagacttttaaattcaattatgaaatgaaaggttcctatccctcaataaaatcactttaaacaacaataaacaggtggagaaatattttctagaacgtaaaggcatactgttgtcttaaatttttatatttatttacagtttataaaaagtattttatgtgatttctctacttaagtaagtaagcagaaacacttattattattccttttaacagacgaggaaacgaattcagagaaattaaatggactaccgaatgtcatacaactactaagtagcaaacctcacatttcttcaacaatcaatattacttccatcccaccactgccagatgtcacaaacataaatatatgaattagtctaatataagaaaaactggggccaggcacggtggctcacgcctgtaatcccagcactttggaaggccgaggcaggtggatcacaaggtcaggagatcgagaccatcctggctaacacagtgaaaccccgtctctaccaaaagtacaaaaaaattagccaggtgtggtggcaggcaccagtagtcccggctgctcgggaggctgaggcaggagaatggcatgaacccgggaggtggagcttgtagtgagcatagatcacaccactgcactccagcctgggtgacagagcgagactccgtctcaaaaaaaaaaaaaaaaaaagaaaaactgggggttttgagacttgttctaagtgtgatattcaaaatatctgacagtcattaaagcaaatgtctaattagaacagttgccaaccacaataccaaccaatcaaaacagctaccagtggtaaacaacagtaagaacagataccagccataaataggcagtaaaaaaaaatcatccctgaatatcagacagagtacctgccccagctcagcattcaaatttaaattattttcaatggtatgccagccaaacaaaacaaatatacctgttaatgaattgtagaagtaagcacactcacctggccaataatttttttgattcctttcaccctgagtacattaatgggtggctttatgagcattttattgaaaacagatgcttaattctgctaaaacaaatatataaatcaaagatttaaacattttaaaaatacttagaagaaaaccaaagtaagtttcaaatcactaagcaggaaagatagtttctaatcaaaaaaagcaaagaaagaattatgagaacttattagttttgtctacacaaaaacttaaaatacataagcttagaatacatacaaggttctacataaccttagaaaactcagaaaaatagccagttatggtggcacaggcctatagtctcagctacccagcagactgaggtgggaggatcacatgagcccaggagttcgttcaagtccaggctgggcaacatagtgaggcctcgtctctaaaaaaaactaaataaatttttaaaaagaaaaaaatagtcatagcaagatattaatatatataattatttatttagaacatagagctcatataaaaccttcagaaaaacaataaaatctcaataaataaacaggcctaagaaatgaatataaaattcacaaaactaaaaaaaagagctaattaacatacatggaaactactaaactgctctaattatcaaagaaaggcaaattaaaacaataaagtaccaaatataaaattaccccaggggttacaatattgctgtgaataacagcacatatataaccagaatgtaaaccagagtgtaaaagtgacataagaattcagaagtattttccaagaagcactaggaaacattgatccactgaaaaattatttattgagcacctactctagatttaatttttttttaaatctctaacctaacctcatggggctccaatctagcaggaaatacagacttagagactcataaatgatcataaaaagctctttcaaagtgaaacataaccaaaaaggagtgcaattaattaggaacagatagaggaagtggcattaaaatcaagctttaaataaaaaaagtagctcactatccagagaaaggaaagactactaatagagtaactcaaataatgaactaaagaatagaaatataacaattataaaatggcactcagaaaccaagtaaggcccagttttcttccttccactacaataagaaaaatgacaaaaagcgatagtccaaatttcagccttgtaccaaaacggagacaaatcttagcaaatttggaagataaatgtttacttggtctcttttaaatatcaatggtgccaaatgaactttggacaagagaaatatctgtatcaaggtttaaggtactctacaagtattgtgtgtcactaatggaaaaggaggagagtggaaggaaataagaacgtatacttagtggacaccatacagcaggttctgatctagatgtttatatcatgctcatttcatgtcatttggacatatgttaacctttttgttattaaaaaataaagaagttgacagtcattttcctagatagatggagttttgttttcaaataatctctagctgttttaacaaatttcattcacatataagcacagccaattaccaaaagtagctagatttttatttggcaacaaagagaactacttctttccattgtgacataaaatttaaagcagtacctttctcatatctgtaagacttttcatgaggctggataggtccatacccaactatttcaaaatggtcagatttatactgaaaacaccaagagggagaaaacacatgagagaggatctgcttcatatagaagaaggtaatgtaagaattcagctccaagatggaaaagcgttagatccattctcaaatcacagctagcacttccttcagtggtatctgttaagaatcccttaaaacaaacaaaaaaaaaattgtggacaccattgattggaatacaaaatattttatcaacagaatacttcatttgtggatttaattaggttatcctcaatacattacagatttcatttcatttaggtcactatacaaatggtgcgatgtcatttttaaatcctctgaatcacattttatagtctgttttgctgtatttttttaaagaagggtggtagagagataataaaccatgaatgaaatactcagcaatcagggataaaagtaagacatttatagctgagctaatacgttaaaagatggaagtctacatctggtttcaattggtatgaattcactggcaaatttaagaagaatttcattgtacgaaaacaaaaagatggttttgataggctttagtcctctggttacttttgtttctttagtcacatgattagtataataatatgatacatttaatatgtcactgtgtatatggttttgataaaaatacacccaccaacttgtctcaagggcacatgcacaaatggttttaaaatacatatactgccttaatgtttttagatcagtaaaaatgaattcaagtgaggttttaagttcacacaaaattaagaattttaattttctaataagtctttcgcaatgttagctaaacaccttttggacataattacttatgcatataaaatgacgcattaattctacatttaatacctattagatagtaaggatacaaaaaattagacatacgccccccttttcaaatgccataaatagataagtacaggtacttcatttaagttttactttcataggcacttgcataaggtcttaaaaattgatcgaaactcaccaatgtaatccttacacagtcttttaaggcctggatcaaactttgcctctttcaagaaatcaccctatattcctcgagtcaggattaatctatccagtgttaacaatggtgataacaataacagcttgcatttattgagttcttactagtcagccactccacaggtttcatttcatttaacacccaaacagaactgtagaaggtaggcactaacaaggatttactgaaagtctgttacatgatcactgtcttcatgacactcagaattttgtgggaagggaataggaacaattaattacaatactaagcgatgcctgcaacaacaggattagcaataggagcactccaggacagcagttcttaaagctgattatgcataagaaccagtactcttaaaatccaaaccatctaatacaacatttaaggccttgaatgatacaattcctgccagcctcgaccatctaccttaccattctaccactcaggaagggcttcacagagatgacttttgagctgactctaaaagagtgaacaaagtttatcaggtgaccaaagagggaaagatacataaggcatgtgcaaaggcactgagcataaaaatacataaagtgcattaccaatgaatagttctttgtgtttgaacatagtgtgtatggtaaaatagtgcaaaatgggaagtcagattagggccaaactgttttacacacccacatatttttaagtggaaagatgacatgatcatatctgaacttttaggaagaaaactctgacagcaggctctcagacaaagactaaaaggaggaaaacagaagtggagaatttaataataaaataattcgtaaaaataacagtagtagtagtaggagtaatagtaacaggtctataaccttgcttagaatcctaagagagacttgtgtggtagaattaatagtgaacaccttaagcaaaattattcagaagacgaagaagagtcagaccatgcagagaagccaaaaggtgccaaaagcaaaatccatctttcctaatttacgtaggtcttaaagactatctagagtcttttcccacaactgaaagtgccttagcactaaagaatcatatattgcttagttagcatcctctcagttctcccaaaaaattgttataaaaaatgaacatgtcctttgactcagtaattccatttcattaatacatccaatgaccacaacacaaatatgccaatacctatgtacaaaagttccctgcagctttgagtgtagcaataaaacattaaaaagttagaagtcactttcatccaggagactgaaaaaaatacattctgttacacacacataagacctatatgtactggtatgggaaggtatctaaaatatatcagaagttgaaaatgaaaaacggtaaggtataaaacatcacatatggtattaatcccttgtgtaaaacaagatatacatacatatgtggtgaaagaatccacaagaaattaactgacacaacctcaaggaagtaaaattgaagggtagatgtgaagacattaacttcctcttttgtacccttttgtattatttgaaatttttacaatgtgctcgtgttatgtttttctctataatttatataattaaaaggaatgaagcagttaaaagtacactctagttaaaagtacagataattatgcaacgcaattttagaagatctccatataatactgttaaaattagaaatttgccatccaaggaactaactttccatttcctggaatattaacttatatatatttcttgatttcctaagattaaacaaaagtaagataagacacaatgatcttttcatatgttttttctaatgctgaagaatatccactatttcaacaaacatcatacaattcttaaatcacttgtgatttaaaactaaataccactttttaaagtttttaccttaacagtaaaaagtggcaatttacatttgtatagaactttacaggttacagagtcctctgacacttaccatgtttttttcccacaagaaaacactgatgtaggtaaagcaagtaatatgatattagatcaatttcaggattaggaaactgaagctgagaggagttacacaatgtacccagggtcacagagctaataagtaacaacccaagcactgaagcttggtcttcctgctccacatccaaagggctttccactaaaccacatcactccaaataaccactgttacagcgtgctatggggtcaggcttctgacagggaagaagggctcactacagatctggcaatgacaggcagtctgcctgcagaggaatgtacaatacaaaaataaagtgtatgaaggtgggcctgactgacgaaagggaagtagaactgggagaaatgccaagaagaataacaaaggtgaaaactgggcaacttaccaataagggaagccaaggaaatacctttgtaaacttaatttacttagttaaggtagaagggatagtctatgtaggggactatatattataatgtggaaaaatcataaagtgtttataattcaatcaaaagatttagaaaagatgtaatgaagcgtgatgtgtatgctgtatttaatcagagattacaatgtggcagcacatgactgccatgaaaattttaatggtctaatcccacaatgcatatcctgttaatgttgtggcttagaactttaagaggcaagtgtgaagtacactcagaactcatactcactccatgggacacccgaaataaggagcaaaaagtatcactttctacacaaaagaactcattctcctaagattctagtacagcactgatcattagtacccactcagagtcagaaaatccttgtaagaacgggccagggacaccagaaataacaccaggatcaagccatcctggactaaagagaaccatgggtctttccactgagtactttccaggaaaatcctttagcaaacatttactgctgacctagcaggaacaggctccttgagaaacatcaaccttactgtcccttactgtgacagaaggaaaaaagagatgggacccaaaagctttgactcaatgtcaccagatgtatcttccacagtttaagattcattttgtgagctattttagagtttttaaattattgtcctttattcctggtgtgttttgaagtttagtaaatatatagaaacatctattattttttgccagtctagcactcatttgctcttctcctgctaaacatattctgatttccctctaggaaatcactacttctccattctcagaccatgtatttctggtagtcaagtctaccctagctccagattgaacatatgacctaggtctaagtcaattactaaatcacattgtaatggccacaatgatttgctcagagaagggcacatgacccacgcagaggcacaagattatcactcttttctgctggatttcaactagaaagatataacccagggaactgctggcagacatcttgtaactgagggaagagcttgtgtgagtgaggccaagaaagaggtatcagaacaaaaacatgaattcaagtaattcctctcaccctgaatcaagccatgcacaaactaactttgcaatgagcaagggttatgtgaacaaataaattccctctttggcttgagctggcttaggctgggttttctgtaacttataaccaaaagttgaaactgattcagtaaacttgaagtaaataccaaacaggagaagttcttggaaaagaggtttgtgtaaagcacaaaccactgactaactccagaaatgctagaggttattccagatgtataacagctttagatgtctgatctattttctactttctggcccatcaaaaaaagggatacaataattggcggaaagaaaagtagaataaacatattttttaaaaggaacatgcacagtcatttttttaaagtctcctgctgccttcattttcctactagcacctcccctagctagtttgtcattgtattcatttgcatttgatttctcattttacggaactctcagatgtttcagtttccattcatttttatggcataatcaactcacacaatagttaccaaaaccctttacagaaaaatcaatggtttcgagaaacttggtgaatatgtagcaatttctgaaatacttaaatctcaaaagtaatacttaagcttacatgtaagattttatctgatcattcatcaagcttcatattccaacttcttaacaaccaaaatttctccctgccccctcctcctctcctaggataaagaatacacacattaaattggggctcccaggtatcctggatgaggaaaatactctgggaaaaacagcacagctgttcagttaactcccttctaccctcacaaatctatttcattccacccccctaaagaagagacttgaaaatataaaatatccaaggttataaacaataaaaaaagttatggaatttgtccagaaaaacacaaatcttctgttcaacacaaagtacatacattaggaaaaataactagaatattttaaccattattcgagagggcagagagaggttgtctttcatgaaatctggattgcacatgtctggcaaggaaaaaaaagattaataatctatcacaaagccccacaactagtgattcaaaatgaaagctttcactacttacaccatatgtaaatatatatatatacaagctgcttataatcccttgatctgcagagaaagagaactgatactctactgtgaaaatggtcagtgggtacacattttaaaatcctttcccacatgaaaagattcctgaaaaagagatcagaagacaacagaaaagcactcaatatatatggagttgtaaatccagtatgaaccagtatctattacacaaaggaggaacatgcaacaaagtgattaggaaagtcaaacatgaattaatctaataacacaaaggtaaatataaaccccaaagagcactttattgaacagaaatccacacatatcaaaaagatgtctactattaacaatgacatatcaagcttttaaactccaaattaatcttaataatcaataatgcaaacttgatatgcccttaccaagaaaaaaaagtttgaagaagcacttaacatcaaggcagaacatatacatatttttaaaatataacaaaccaaatgtttaccataaaggctattacatgcaaggtattgattctaagggcacttggataaaatatgctagtatattttgaatagccactgcttgactcttttatttatttggttatttggttatttatgtatttatatgtttattgaggtggagtctcactctgtcacccatgctggagtgcagtggcgagatctaggctcactgcaacctctgcctcctgggttcaagtgattctcatgcctcagtctcccggcagctaggattacaggcgcatgccaacacaccaggccaatttttgtatttttagtagagacggggtttctctatgtcagccaggttggtctcaaactcctgagcccaagtgatctccccgcctcagcctcccaaagtgctgggattacaggtgtgagccacctcgcccagccaccaccgtttgattctattaaagaaactaacactgtacctaaaaatgtgaggtctatgttatggaatgtatactttcttcattaacaacaataattcaaagtaccaaagtaccaatggtgaatactaagattctatccttggttctatagttctctgcattcttctacccaaatacatctggtagatgatcatgtccaaaatgcaaagacacttttatctacctaagtgagatgataggataaggatgacaatgtcaaaagcaaatatatatagggccacttatgtgccaggtgttattctttaaatacatgtaatctttataacaactcatatcttgtcccatatatcagatgaagaaattaagtcacagagaagtttaaaaacttgcccaagttcagagaggtagtatgtagcagagccaggattcaaatcctggcagtctggctccacatttcatgttctcagctcaattctagtcttcagctataattccaatcctttctttccatatcactacttaacctccatatgtttccatttctcatctggaaaatgggtcattaatagttcttacctcatagagttctccaatcctcatgaggattaaatgccataatatacataatgtatttagaaaagtacctggcacataaaagtaatacatatttctgttgttattttatctaccaaatgtctgtcactggagttgagaaccattgttctaaaactgtaacagtgagaatttaccaagcagaatagtcttaatgtgcccttacactggtaactaaagaaaactggactttctcaattattttcaatataaaacaagtccaccaccagccttcaagaaaatatacaaatcatttaagagttgctatcttcagtctggaatttcttctccattattttgtgttccctcacacccacccaatattacagaaatagatctcatcctgataaaggtatatagtgaaaatgtctcttatatatcaaactgaatgtttatacaacttttaagacataaaggccaggtgtggtggctcatatctgtaatcccagcactttgcgaggccgaggtgggtggatcacctgaggtcaggagttcaagaccagcctggccacatggtgaaaccccatctctactaaaaatagaaaattagccaggcatagtggtgcatgcctgtaatcccagctacccgggaggctgaggcacgagaactgcttgaacatgggaagcagaggttgcagtgggccaagatagtgccactgcactccagcctgaacaacagggcaagactccgtctcaaaaaaaaaaaaaaaaaaaaaaacacctgtgtggtattttaatgtaattctcatctatacagctggatgctgggtactcttgaatcagaatactactcccagagtttggcttcacgaaagagctacaaagtgtgaagactgagggaactacaaccatcctttaacccagggactaacgctgatcgacatttaaatatgcttctattaatagttttctgttgtgacaacactcttgcacaggccccactatacaattgtgccaagatttctcaaaagtacagaaggaggaggaaaaccactggatagagcctagagtacatacatattcaacgacaggagattatcaaattactctttgaagtagttgtactaatttaaattcctaagagtatgatagcatatagagtatatataaggcacaagtgagtacaataaatttggaagcatttctatggagaaggtcataaccaagagcagacaaagaagtgatctaccaagtaaaccccagaaggactccaagcttagaaccatagggtagggagagcaagagggaaagggagttcactttttcacggaagctgtaaagaagaaaatggaacaagagttggctccttgaccccagtctgcccctgctcccatgtacatgcagattacatgaattctggcatttatccccagatcaaaaaaaaggggaaagggttcctctctaaagaaattcagggggccgggcgcagtggctcacgcctgcaatcctagcactttgggaggccgaggtgggaggatcacgaggtcaggagatcaagaccatcctggctaacatgatgaaactccgtctctactaaaaacaataccaaaaaattagccaggcgtggtggcagtagcctgtagtcccagctactcgggaggctgaggcaggagaatggtgtgaacccgggaggcagagcttgcagtaagccgagatggcgccactgcactccagcctgggcgacagagtgagactccgtctcaaaaaaaaaaaaaaaaaaaattcaataaaaacctgttgtaggccctttcccttaaaagctagctcccaacccattcaccctaatattatgcctgtcagtcaaaaggcattgtcccagtgcttacggtgagacctgagcagccttccagtcccaagggcaagaccagaataaataaaacaaggaaatccataaccctagaagaaacagaaatgattcaggaaacagacaatagcatttatttaaaaaacgtattattcttaaagcaatttcaaaagcttttctatccatgtcagcatcaatatgttatgaaaaaggaataatcaaaagagttcttgtaattaaaatataactgctaaaataaaaagttcagttagaaaagtcagaaaataaagcaaaataaagcaccccgcctcctccaaaaggcaaaaagacaaaaagagacggataatctaagaggaaaaacaaattcaggagattcaacctttcaataaagaaaatagaaattttccaaagctgaagacagacaattgtttatatattaaaaggaactactgaatgctgagcataactaataaaatggactcacatctaggcacattcttgtgaaatatcagaaacgtcaagataaaaagaaaactccagaaatttccagagggggaaaaaacctacaaataagtaagactctgacagccattagcaacactagatgttagaagataaatggaggaaagtctcaaagctctgagagaaaattattttcactgtaaaattctacgtaggctatcaaccaagcataaaagcaaaataaagacattttcagatatgcaaaggctcaaataataattgaccccttattcttgtatcatgaagaagacagtttaggaagaatacaaaacaaaggtaaaaaccaagaaaacaggaaatatcctttttttaatggtggcactaacccaagagtcaagtgaaaagaaattctaaggatacggctataaaacagacctcaaagcaataagtccacattagaacaagaaatcaggaagctccaaagaaatctcaaagaagaatcacatacatttcaggaaataaatacactgagtaagaagctcaaagatattaccaaagggataaaagatgcatacattgcttttttcaaaataacaaaaaaagaaaaaactcccagaaacagaaaattatataacaacatgatcctaacatagagccatcaacctaaaatgtggcaatgattttgagtaattaattgtgagaaaagtaaatccatttagaccacatgctgggaacattcttctttgggtaacctaggggtacaacactggatatttagagacagaaataaaatttgagcatatcattgtttcctcttccaagatgttctttgccctctcttctctgacttactcatttattcattcactctctcaatatttactgagcacccatcctaggagctaaagataaaacagtgaacgaaaaaagaaaaacacctgcccttttgaagcttatattcaataactcctattctttcaagaatctgctaaagcaggagtccccaacccctgggtactggtccatggcccgttgggaactgggccacatagcagcaggtgagtggcgggtgggcaagcattactgcctgagctccacctcctcctgtcagatcagcagcagcattagattctcataggagaataaaccctattgtgaactgcacatgcaaggaatctaggttatgcactccttatgagaatctaatacctgatgatctgaagtggaacagtttcatcctgaaactatcacccccatccgtagaaaaattgtcttccatgaaaccagtccctggtgccaaaaaggtcgaggaccactgtgctaacggattctctcaccaatgaaactttttctaaattgttaggctatgtgcatctccttttttcctcctaaagaactctaactctttgcaaaacagaatttggctttttacatacctattacctcatctagtgtgtgaagaatgcaagacagcaacatttattagttatttgtacttctagtgaacagcactgggcctaaatcaataaatgtgttttgaacctttccattcaaccaaaatgtaaataaaactgctgtattcatccactctcacactgctataaagaactacctgagactgggtaatttagaagaaaagagatttgattgactcacagttccacaggctgtacaggaggcatggctggggaggccatggagactcacaatcatgacggaagggcaaaggggaagcaaacaccgaattctcatggcacagcgggagagaggatgaagggggaagtgctacacactctcatgagaactcactatcacaagaacagccgggggaaatctgcacccatgatccaatcacctccaatccacctccatgatccaatcacctcccaccaggtccctccccgaacactggggattacaattcaacatgagatttgggtgggaacgtagagctaaaccatatcaactgacaagtaaaatgtaaagcactaggcaaatgttacttattacttaacagatgaggacactgaagtccttgtcagttgaatgatttgctacagaccacaagactagtctgtagaagaaccaaaactaaaacccatattgctgaaagcctgggttcatgccgtttctcctatactaggttgaatgaaaacaagtagtcaaatcaaaaaatgggcctaaatgggaaagaataaccttaggcattttcttagaatgtttttaagtatacaataaacatccaaaatatagactctatttcttccatatgtcaagacatagctttacaattatgtaaagatcatttggaaagcctctaatcaaaaatctaacctatcttttaagagcttcaatttcacagagttatgcatttctactctgcagtatatgtttgaaatgcataaatgtttcgagatgtttaacggcatttaatataatataaattggtttttaaaaaatttcttcatgggaaaccttcaaaacttactaccacaaatatactaaagtttttattcttttaaaacttgaaaacacttgactcctcaaaaaaaaaaagctcatattaccttacacaaacaacaacaaaaagctttttcatgagtcacagaaggcctatggttaaaattatcaagatacacatttttaaaattaagcaaaaaattaaacagacacatatataacttttgtaaaaatcagggaactaatgaaacattctggtatttcacacatgccaaggttactagtaagcatactttttatggcttgtctttggtatatgaccatatttgttcagcaatccacattattaataccgaatagtagccatgcaaattataacttatccacaaaaatataacactgaataaagaggtagggtaattttatattcacaggacaagaagccaaaaaattggctgtttcagctcaacatttatcaaaggcttgtaggtgccaaaagctattctaggcacttggaatatttcaagattaatatattaaaactcctgggcaactgcaactactcttctcccaaacactaaaagctgactaattaaatgtaactcccatatataggataccatgactgggttatctacaaagaagtttcatcaaacttaaaagatagtttaaaatactgtgaaaaaatcagttactgaatgtgaatgatacgaggacttgagctgtgtttgtgagtctgatcacaaaaatcagaaatttaagtcacatatactattttatagagccccaaatacttaaaaaccaaaaggactcaatgaatactaatcttacagtgatttttactcataatgtaaccagaagagtcagagaaacttttatcacccattagaatacaggagttttacctttttcctaattctagtaccactaccattaattaccacaattcgttaccagctcaagtgccaactctgtgatctggcccatgttgagtaagaatcagcacttaaatagacaaaatctctaccctttacaactcagactcagttacaatcactggaatatgtctaattaacccacaacttaattctatgccttcatcttttcctacatgtttcccaaaggaaaagtatagatcagattttgaaggtccttctttaatatctatgctgacaatcagataatttgttttatgacttttaaaatatgtgaagtactcatataactattagcaaactgtcaagcaataaaacataaaaaaaaggccaacagaaacaacaaacagcaaagaacaggcacaaaaagaacatgaaacagccaatacaaatatgaaaagatagcctacctaatagtcaaaataaacatcatcatcacagtaaaaatagcatttattgtgctttctttatgtaagagtgaatatgcaataaacacccaattaattaatcaatgaattactaaatagacaacaaactacctgagaaaataagcaaattttcaaataagaggtaacattttcagctgggccttcatggatgcaaatacactaggcaaagactgggggtagggataacactaaaagaagtgcagaggatgaggcaagggcatacatataatcaccaaaatatgaagccagttcttattctaggagccagttctcattgtaacactgaactggaaagtacctgataaaacagtgacaaggtatgaaactgtacaggaagaaaggaggtaatacataaactctgtttatacatcaggctaaaaaatttgaacttaaatgttttatttaaaagacatgtaacttaattggacttgctctttcctgtgccttttattttcaattttcaaggaaatatttgttcaaaaatagacaatagtcaataattcagaatcaagaacgctttacccctaataagatttctttcaaagacaagcacaattccacacacaaaataaatatgttacttaggtggttctccaagacttactactcttaaaacaaattaaaaatttagaatctattgtcaactccctaaatcatcacataattttgtttcttctctataataaatgaagctcactatatataaatatgtacaaatagaatatgcaaattatacatagacaatatccagaaagtttctaataatgtaatctaaactgtccattactctgagaaagcttactattaatgtggttaatatatgtagtatatacataatcaaatgaattataaagttaaggtctcacatcagaacaggattatgctgtcacaacaacatccatctgggtccacttgagcaccaatccaaccttgttctcaacctatattttatagtttttattaacaatttaaagataagcacaaaacaatttcagtaatcatgtttttatatctttttttagatttataaaggttaaagctgtcaataaagttttacatccacagatcatacatgaattcatttaagtgaatataataataagaaaagtcaattcaagggctctacctgacatacccaaatgaacaagagtaaaaagagatgcaagcaaatgagtaaaccagtatctgagatactcactccaaggaaaaggccccaaacataaagcatgagtttcaaggacaagataaaactcctaaaaagagattaagagaaataaatggggtactaggcaagaataatacaaaatgtcacacaggattattaactggattacaaaaaaggtacatgaatagaaaataaataagcaaatgactaattagtaaaatcaaggaacagggtcagaggagtaacaacggtaaaaactgctatggtgaataacaaaaatatatgagatacagcattcttagatactagcattagccgactagaaaatataacagcaacaaaagatcattcacattagcagtaaaaatgacaaagctcctagaagcaaatcaaatttaaaacgtatataattttctttttcttttttttttagatggagtttcactctttcgcctaggctagactgcagtggcgcaatctcagctcattgcaacctctgccccgcaggttcaagagattctcctgcctcagcctccagagtagctgggattataggcacctgccagcacacccagctaatttttttgtatttttagtagagacagagttttgccgtgttggccaggctggtctcaaactcctgacctcaggtgatccacctgccttggcctccagaagtgccaggattacaggcgtgagccaccgcacccggccgaatgattttcaagaggatttaaaaatgcatttaaatacaaaaaagaagaactgaacacaaagatattctatgatcatgcattggaaaatattagttaacacaaattatgagttaaatgtaattccaatcacaaacccagcaagactttttgtggagcttgacaacttattctaaaacttatgtgaggccagacacggtggctcatgcctctaatctcaacactttagatgaccgggtggatcaccccacgtcaggagttccagaccagcctggccaacgtggcgaaaccctatctctactaaaaatataaaaattagctgggtgtgatagtgggtgcttataatcccagctactagggaggatgaggcacaagaatcacttgaatctgggaggcggaagttgcagtgagccaagatcacgccattgcactccagcctggggaacaagaacgaaactccgactcaaaataaaataaaaaataaaataaataaataaataaaacttataagagagatcaaggaaaacaaagacaagggaattgcatcccaaacatcaagcacgccaccatataattaagaacatatttctggatccgggagccaagatggctgaataggaacagctctggtctacagctcccagcgtgagcgacgcagaagacgggtgatttctgcatttccatctgaggtaccaggttcatctcactagagagtgccagacagtgggcgcaggacagtgggtgcagcgcaccgtgtgcgagcctaagcagggcgaggcattgcctcactcgggaagcgcaaggggttcagggagttccctttcctagtcaaagaaaggggtgacagagggcacctggaaaatcgggtcactcccacccgaatactgcgcttttccgacgcgcttaaaaaacggttcaccaggagattatatcccacacctggctcggagggtcctacgcccaaggagtctcactgattgctagcacagcagtctgagatcaaactgcaaggcagcggcgaggctgggggaggggcgcccgccattgcccaagcttgcttaggtaaacaaagcagccgggaagctccaactgggtggagcccaccacagctcaaggaggcctgcctgcctctgtaggctccacctctgggggcagggcacagacaaacaaaaagacagcagtaacctctgcagacttaaatgtccctgtctgaacagctttgaagacagcagtggttctcccagcacgcagctggagatctgagaacgggcagactgcctcctcaagtgggtccctgacccctgaccctggagcagcctaactgggaggcacccccaagtaggggcagactgacacctcacacggccgggtactcctctgagacaaaacttccagaggaacgatcagacagcagcattcgcggttcatgaaaatccgctgttctgcagccaccgctgctggtacccaggcaaacagagtctgtagtggacctctagcaaactccaacacacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagtgcctctcctcctccaaaggaacgcagctcctcaccagcaacggaacaaagctggacggagaatgactttgacgagttgagagaagaaggcttcagacaatcaaactactccaagctacaggaggaaattcaaaccaaaggcaaagaagttgaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagacgaaataaatgaaatgaagcgagaagggaagtttagagaaaaagaacaaaaagaaatgaacaaagcctccaagaaatatgggactatgtgaaaagaccagatcttcgtctcactggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttaaaatgaaggaaaaaatgttaagggcagccagagagaaaggtcgggttacccacaaagggaagcccatcagactaacagctgatctctcagcagaaactctacaagccagaagacagtgggggccaatattcaagattattaaagaaaagaatttttaaaccagaatttcatatccagccaaactaagcttcataagtgaaggagaaataaaatacttaacagacaagcaaaggctgagagattttgtcaccaccaggcgtgccctaaaagagctcctgaaggaagcaataaacatggaaaggaacaaccggtaccagccactgcaaaatcatgccaaattgtaaagaccatcgaggctaggaagaaacggtatcaactaatgagcaaaataaccagctaacatcataatgacaggatcaaattcacatataacaatattaactttaaatgtaaatggactaaatgctccaattaaaagatacagactggcaaattggataaagagtcaagacccatcagtgtgctgtattcaggaaacccatctcacaagcagagacacacaaaggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtagagggatcaattcaacaagaagagctaactatcctaaacatatatgcacccaatacaggagcacccagattcataaagcaagtcctgactgacctacatagagacttagactcccacacaataataatgggagactttaacaccccactgtcaacattagacagatcaaccagacagaaagttaacaaggatatccaggaattgaactcagctgtgtaccaagtggacctaatagacatctacagaactctccaccccaaatcaacagaatatacatttttttcagcaccacaccacacctgttccaaaattgaccacatagttggaagtaaagctctcctcagcaaatgtaaaagatcagaaattataacaaactgtctctcagaccacagtacaatcaaactagaactcaggattaagacactcactcaaaaccactcaactacatggaaactgaacaacctgctcctgaatgactactgggtacataatgaaacgaaggcagaaataaagatggtctttaaaaccaatgagaacaaagacacaacataccagaatcgctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcgaaccagaactgaaggaaatagagacacaaaagactaatgaatccaggagctggttttttgaaaggatcatcaaaattgatagactgctagcaagactaatgaagaaaagagagaagaatcaaatagaagcaataaaaaatgataaaggggatatcacgaccgatcccacagaaatacaaactaccatcagagaatactacaaacacctctacgcaaataaactagaaaatctagaagaaatggataaattcctcgacacatacaccctcccaagactaaaccaggaagaagttgaatctctgaatagaacaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaattctcccaaactcattttatgaggccagcatcatcctgataccaaagccgggcagaaacacaaccaaaaaagagaattttagaccaatatccttgatgaacgttgatgcaaaaatgctcaataaaatactggcaaaacgaatccagcagcacatcaaaaagcttatccaccatgaccaagtgggattcatccctgggatgcaaggctggttcaacatacgcaaatcaataaacgtaatccatcacgtaaacagaaccaacgacaaaaaccatatgattatctcaatagatgcagaaaaggcctttgacaaaattcaacaacgcttcatgctaaaaactctcaataaattatgtatcgatgggacatatctcaaaataataagagctatctatgacaaacccacagccaatatcatactgaatgggcaaaaactggaagcattccctttgaaaactggcacaagacagggatgccctctcaccactcctattcaacacagtgttggaagttctggccagggcaattaggcaggagaaggaaatcaagggtattcaattaggaaaagaggaaggcaaattgtccctgtttgcagatgacatgattggatatctagaaaaccccattgtcttagcccaaaatctccttaagctgataagcaacttcagcaaagtctcaggatacaaaatcaatgtacaaaaatcacaagcattcttatacaccaataacagacaaacagagagccaaatcatgagtgaattcccattcacaattgcttcaaagagaataaaatacctaggaatccaacttacaagggacgtgaaggacctcttcaaggagaactacaaaccactgctcaatgaaataaaagaggatacaaagaaatggaagaacattccatgctcatgggtaggaagaatcaatatcgtgaaaatggccatactgcccaaggtattttatagattcaatgccatccccatcaagctaccaatgactttcttcacagaattggacaaaagtactttaaagttcatatggaaaaaaaaaaaaaagagcccgcatcgccaagtcaatcctaagccaaaagaacaaagctggaggcatcatactacctgacttcaaactatactacaaggctacagtaaccaaaacagcatggtactggtaccaaaacagagatatagatcaatggaacagaacagagccctcagaaataatgcttcatatctacaactatctgatctttgacaaacctgagaaaaacaagcaatggggaaaggattccctatttaataaatggtgctgggaaaactggctagcgacatgtagaaagctgaaactggatcccttccttacactttatacaaaaattaattcaagatggattaaagacttaaacgttagacctaaaaccataacaaccctagaagaaaacctaggcattaccattcaggacataggcatgggcaaggacttcatgtctaaaacaccaaaagcaatggcaacaaaagccaaaattgacaaatgggatctaattaaactaaagaacttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaagtgggcgaaggacatgaacagacacttctcaaaagaagacatttatgcagccaaaaaacacatgagaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttgatgggaatgtaaactagttcaaccattgtggaaggcagtgtggcgattcctcagggatctagaactagaaataccatttgacccagccatctcattactgggtatatacccaaaggactataaatcatgctgctataaagacacatgcacacgtatctttattgcagcactattcacagtagcaaagacttggaaccaacccaaatgtccaacaatgatagactggattaagaaaatgtggcacatatataccatggaatactatgcagccacaaaaaataatgagttcatgtcctttgtagggacatggatgaaattggaaatcatcattctcagtaaagtatcacaagaaccaaaaaaccaaacgctgcatattctcactcataggtgggaactgaacaatgagaacacatggacacaggaaggggaacatcgcactctggggactgttgtggggtggggggtggggggagggatagcattaggagatatacctaatgctaaatgacgagttaatgggtacagcacaccagcatggcacatgtatacatatgtaactaacctgcacattgtgcacatgtaccctaaaacttaaagtataataataattaaaaaaaacatatttctgttgcagaagcaggcaaataaatctctgctagaacagacagaccaaatatagagacaaatatatacataactttagtaggacaggcttataagccagttaaaaagggatagaaaattgtgttaggacaattagatttccacacagaaaaaaaaaaaagtgctgtatacccctatctcctatcatatacagaaataaactccagctagattaaagatgtaggtaaaaagccagcctattgcaagataagagtgacaccatttcaaagcaaaaccaccataatgacaggagtttggctccagcagcaaggtctttaaacaatgcctgtagcatagacaacccctcataaagatgtttatctaacctctccagtggtcatgagtagcaacaaagtctgaggtgtaaccagctgcatatgttttaccaaaaaagcttgctatataaaggatattttcgggagggtggatgtgggaatacaccacctcttggccacccaaaacattatttctgtttgttagtctgtaataaatgtttttttataagaaactggatttgtcagtgtctttcttcagctctcagctcccttagcctttgggggtagctttgcatatgtttgctcatagcagaacagaactgctaataacaaaacttgtactatttgaaagagttccacttctggtagtgataaactagataattcagaccactctcctgcttaaagaactaaaatgtctggagaaaatacatttaaaagtctatgttaaggctaatgaagacacacgagcagtgtattttgtctgaaaacaaaatattaaaaaaagaaaaaagaagaggtaagcctagcaataagggctgcttttccccaagaggcatctatcaattatggaacagaggccaagaggctaataagcagagcagaccttttgactgacttacaagatgagaaggtcaaagactggaaatcaaaacctaccgagaaactgagaagccctataatgccaaaggaccatatcctagatgtaaaggaggatcaaccctcaaaagtacagtcatgtgtcacctgacaacatggatacattctgaaagacatcattaggcaacttcatcattgtgtgaacatcacagagtgtgtttacacaaacctagatggtatagcctattgctcctaggctacaaacctgtgtagcatgttaccgtacagaatgctgtaggcagcagcaacacaatggtaagtattcgtgtatctaaacacatctaaacatagaaaaagtacagtaaaaatacgatactataatcttatgggaccacaattctacatgcagtccatcattgatagaaacatcattatgtagcacataactgtactgaagcccagattcaaattatctctaaccccaattgaattaagtgatccaggattgctagttctagccaccagatagaaacaaaaaccttaagtaaaatacgtcaacattcagaagttcaaataacctctatcacgttttacgcaatgtctagcactctatcaaagatcacaaggcacagacaaaaacaataaaaaacaagagaaacaatataaaatagaaagagacccacaggagattaacatttaaaagattagcagacagaattagactataattaatatgttctaggatatgagcctaggcagcgaagtgagaccctatctcttcaaaaaatcaaaaaaattagccaggcatggtaccacacgactgtggttccagctactcaggaggctgaagtgggaagatcacttgagcccaggaggccggggctatagtgagccatgatcacaccactgcactacagcctgagtgacagagcaagaccctgtctcaaaaataaaaataaaaaataaaaataaattatgttcttggatataaaatacaagatttctggataatatctttaaaaggctaaaaggaatcactaacctagaattctttacccagcaaatatactgttcagaagtgaagtgagggtcagacatggtggctcacatcagtaatcccagcactatgggaagccaaggcaggagaattgcttgagaccaggagttgaagaccagcctgggcaatatagccagaccccatctctacaaaataaaattgttttaattagccaggcatgatggcatgctcctgaagtcctagttactcaggaggctaaggctggaggatcgcttgagcccaggaattcaaggttgcagtgaactgtgatcacaccactgcattctagcctgggcaaaagagcgagaacctgtctcagaaaaaggaaaaaagaaaacatgaagtaaaataacaacattttcaccaaaaaaaaaaaaaaaaaagacattatcatcatacccaccacacataaggaaatactaacagatattcttcagacaactgagaaacacagaaagaaataaagaacaataaaaagcataaatatatgagtaaatataaacatttgcaatacaaaataagaataacaatataaaataacaagaattccatgtgctatttaaaatgtatacagaatttaaagaaacaaagcagatcacaaaaaaaacaacagaccatacaagctcttaaaaacaaattgccatattcttaggaaaagattgtttcatgaccatgaaaacaattactagagtgagttttacacctgtttaatcaaagacgactgttagactcgtcaaatttttgaaagccagtcagtcagtaatagtcatgcttctgaaattcagacaatcaagagttaacactctagtgaacaaaggcctacaacatccagatattttttaaataggatgttacgtatctttatattattaaccttaacaataatggtactctttttggataataaataaatgaagaaaaatgtccttgcactagaaaagaaagatacaaatattcttgagacttaataggagctgtcatcaaggcaacactcagaaacaatatacctacagctcctgatcaatctcttgtgcagctctgggttccttttcatatatggaaattagactcttaccatgccatcccagaacccagggtacctgttgtgtgagcgtaacaactatgttattccaagtgtacaactccccaacatgctcagtggactgtgtcttataacaaagaatatgaatggataaaatctttcctttgataactgacaaagagttttctgaagataatgatctgatccatacctatctttaagaactatagtatgtcttcacagttgtaattattggcaacaagcattaaacttcttggatcaaatacttcatatctactcaaaattgtaacattaacacttaaaactaagaaaatagagatgtttaaaattttccatttcacacactacttcatattcctacctgataactttaaataccaaatgcactgagtttagccctgaaatgagtttaaaacaattctctaactgggatataattactttccactgaagcatttttctgccactcaagaatcatctgatttacataaatgctagttaagcaccatagaaattctaaaatatatcattagcagaatgtcacagatcacttaatctactctgtcaaaacagggattatttcaacttctgtttcacttcccttaaaagaaatcctatttactttcttttctctaacagggaaaaaaaattagtaaaataaacttacagtgtacttcccaaatcaaactttaaaatgattctggttaactacaaattgactgaagtattttttctgaatgtattttactgaaacatggctgacaacatataataatgttactgctacagaattacaaattatttcactgattactcttcctattcaagaaaaaaaggtcactttggtccatacaaattgtccaaataaactagatgtattactagcttaaagtaaacaattttgtaaatagcacttctagttagagttaaaacataaccataaaaagcttttattaaacaatacatttcactaagctaaatttatagaaatatatatatttctatcactttcacacatcctgacaatatttgggaaaataaatacaaaaatgtttttttttaattcagaagtatataatttcttcaaatattccagccataaattataatacataaaatttaagatacgtaaataccatgaatattataaactttaaataaaattctagccataatttatgaaactcacattattaaacaacacacacacacgctgattccaaatgaagaagagaagtaccatggtagtttctctgtgacacaccaaaaattatcctaataaataaattaaacaatcatgtaattcctaaatttgttacagaaagatatgtggctggttctcacacctcctactagatatctttacaccacttaaaaccttttcttttttcatgctattattttctgtgtaacaaaataccaactagtcagattctaaaatatcaatctttagaaatgatattagcaaaacaattttaaaatacttactgtcttgtttcgtaatctaattatgtctgagacagagccagcgccacagtactccataacaatccagaggtctgtattcttaaaataactgccatagtactttacaacatatgggctaaaggaaaatacataaacaattaaatttagttaattcccaaagaaatttttttcttaatcccaatacaaagtattttcaacatttcatactgttccaataagttaaataagtaaatttctattgcacatcaaattctcaatatctggagttcaccaactatgcataattaggctttacttcatggacgaaatttaacaggattacaaaccagaagaggcccaaatgttttgagtgattctgaagaaaataagacttcattttggcaaagaacttactacttaacatgaggaacaaatgaaaatttttccctttaactaaagcattttaaatatgtcttctaaaggattttgcattcagtcaaatattaatcaactcgaaaataatctatatttccatgaggccaaaaagttattttaaattttctttcattctggcttttgaaaattctagagaaaaaaaattataaatttttctgcttaaatttatagaattaaaatattagcaatttaatttctaaactgaggtcttacgtcttccagagcagaataaactatgtttatagccaagctgtcttcaggaagatttagaaagggacaaatgaccatcagcaataatgtatattatggataaactacatatagtgatgtatgagaaatctaacctatctcaaagaggcagaatatcatattcaaaaaatgcatagagatagaaaatacaagacagcagaaactaaataggacacaactttaatgctacaagagctcaaatgaggaaataacattggaatcatccaaagagaactttgtggaagggagtgggatttgaatgagattttgaaagaaaagtttaaactccaaaatgtagatggagaagagggataagaaaattctagaaaagagaaagaccatgaataaaggtacacaaatagaaagggaaaaaccaagtatggcatgtaagaggacaacttgttcaaataaatacttctatctagtaatagctacaatcaaaaacagtagccattttgctgggcacaaatgtaagataaatatgacagaaaaacaaataagcaaaaaaaaaaaaaattgaaagtacaataaaagaacacgtagagactctatcaattgtggaggttaagagaagactgtcagggaagacttctcagtacagcctttaaaattttagctatgctctaacactgaggcagtaataaacagcctaccatccaaaaaaaaaaaccacccaggaccagatggacttagggccaaattctagcagatgtacaaagaagagctggtaccatccctgctgaaactatttcaaaaaattgaggagaaggaaatgctccctaactcatcctatgaagccagcatcattctgataccaaaacctggcagagatacaacaaaaaaagaaaactttaggccaatatccttgatgaacattgatgcaaaagtcgtcaacaaaacattagcaaaccaaatccagtggcacataaaaaacctaactcaccacagtcaagtaggctttctctttgggatgcaagattggttcaacatatacaaatcaataaatgtgattcatcatataaacagaactaaagacaaaaaccacatgattatctcaatagatacagaaaaggctttcgataaaatcagacatccattcatgttaaaaactctcaacaaactaggtattgaaggaacatacctcaaaataataagagccatatatgaaaaacccacagccaacaatcatactgaatgggcataagctggaagcattccccttgaaaagcggcattaagacaaggatggactctctcaccattcctgtttaacatagtattggaagtcctggcaagggcaatcaggcaagagaaagaaataaaggtcatccaaataggaagagaggaagtcaaactacccctgtttgcagatgacatgatcctgtatctagaaaaccccatagcctcagcccaaaagcttctcaggctgataagcaacttcagcaaagtctcaggatacaaaagcaatgtgcaaaaatccctagcattcctatataccaacaacagtcaagccgagagccaaatcgggaactaactcccattcacaactgccacaaaaagaataaactacataggaagacagcaaactagggaggtgaaagatctccacaaagagaactacaaaacactgctcaaagaaatcagagatgacataaagaaatgggaaaacattccatgctcagggatagaaataatcaatatcattaaaatgaggctgggcactgtggctcacgcctgtaaacccagcactttgagaggatcacttgaggtcaggagtttcagatcagcctggccaacacggtgaaacccccatctctactacaaatacaaaattagctgggcatggtggcgcatgcctgtaatcccagttacttaggagggtgaggcaggaaaatcacttgaactcaggaggcggaggttgcagtgagctgagattgtgtcactgcactccagcctgggcaacagagcaagactccatctcaaaaaaataataataaaaaataaaaaaataatatataaacacacacacacaaacacacatcattaaaatggccatactgcccaaagtaatttatagattcaatgctattcttactaaaactactatttgagattcggcacagaactagaaaaaactattttgaaattcatatggaaccaaaaaagagcccgaatagccaaggcaatcctaagcaaaaagaacaaagctggtggcatcacactacccgacttcaaaatacactacagggctacagtaaccaaaacagcatggttatgatacaaaaaaagacatacagacaaatgaaacagaataaagaactcagaaataagaccacacaactacaactatatgatctttgacaaacctgacaataacaggcaatggaaaggaaaaaggattccccattcaataaatggtgctgggataaccagctagccatatgcggaagattgaaactggacccctcccttattatcatgttcaaaaatttaactcaagatggattaaaggcctaaatgtaaaacccaaaaatataaaaaccctggaagacaacctaggcaataccatccaggacataggcaaagatttcacgacaaagacacccaaagcaatcacaacaaaagcaaaaattggcaaatgggatctagtaaaatcaaagagcttctgtacagcaaaagaaactatcaagagagtaaatagataacttacaaaatgaaagaacatttttgaacaaactatgcatccaataaaggtctaatatccagcagctataaggaacttaaacagatctacaagaaaaaaaaaacaaacaaccccattaaaaaatgggcaaaggacatgaacagatacttttcaaaagaagacctacatgtggccagcaagaatatgaaaaaaagttcaacatcactgatcattacagaaatgcaaatcaaaaccacaatgagataccatgttacaccagtcagaatgactattattaaaaagtcaaaaaaaaaaaaacagatgctggcaaggttgtgaagaaaaaggaatgcttatatactgttggtgggagtgtaaattagttcaaccattgtggaagatagtgtggcaattcctcaaagacctagagacctagagacagaaataccattcaacctagcaatctcattactggatatatacccaaaggaatataaattgttctattataaagacacatgcatgcttatgttctttgtaactagcactcttcataatagcaaagacatggcatcaacctaaatgcccatcaatgatagactggataatgaaaatgtggtacatatacacaatggaatactatgcagccacaaaaaagaacaaagtcatgtcctttgcagagacatggatggagctggaggctattgtccttagcaaactaacacaggaacagaaaaccaaatactgcatgttctcacttataactgggagctaaatgatgaggacacatggacacacagagtgaacaacacacactggggcctatcagaaggtggaaggtggaaggagggagaggatcaggaaaaataactaatgggtactaggcttaatacctgggtgataaaataatctgcacaacaaacccccatgacacaagtttacccatgtaacaaacctgcacatgtacctctgaacttaaaataaaagttaaaaataaataaataaataaataataaaaacatcagtcatctaaaaaacaaaagtttaaaattttcccattataattaaattttatattaaaaacaaaggcaataaatacaaaaaaaaataactatgtcttgaagtcaaaggtagaacagagtggttggagctgaagggcctgaattcaaacctgttttatccccactgctactccgttacctcttgcacagacttgctccccactggtctccttgtcttagttttctcccctgttctagtctatgctacatacagttgacaaggtaccttactttaaaacaaaagtaaaacaagctgatcatactgctctcctagttaaacaaaaatactctaacagctctccattacccaaaggaaaagctcttaactgcttcatatcgcatacaagttatttcagagtctaccttgttacccgtatctctgattactctccatctcataccttaaatttccagacacactcagctttgctaggtcttgggaattgaaagtatgtatttggagttcataaatgttcactgaaccatttaagaaaagtgcttgtttacaaacaaatgaaactaaatacagacttagaactgcaacatatgagaaacaaaaaaaaaaattctttacatgtactcctttaaggtatggcgcctatgtggaaacttttatagggagtagcgttcctacacctggctgtgcatgagagccacctgtgacccaagcccacactcctttgaggttctgattcagtaggtttttaaaagctctaccggtgactctgacatagacccagagttaagcttcactctaccagtgaatagactgtatatccttcaggggaaaaaaaaaaaactctctctctctctctttttttttctgaagcagaatctcattctgccacctaggctggagtgcagtggcaccatgtcggctcacagcaatgtctgcctcctgggttcgagtgattctcgtgcctcaacctcccaagtagctgggattacaggcctgtgtcaccacgcccagctaatttttgtagttttggtagagatggggttttgccatgttgaccaggcttgtcttgaactcctggcctcatgtgttctgcctgcctcagcttccaaaagtgctgagactataggtgtgaaccaccatgcccgccaaaaaaaaattctttaaatatgaatgttctcattcaaaattttgaaaagtgttaagtaacaatgaattgacgattatgttcactgaaaagcatacaaaaaaatgtacatttttcttgccatacacactaatcagcaatgctaagggtagaagtgacaactcatgaaaattaggaattctaacctgggcagccacctgaaaacacagccctatctctccataagagtaagtcaagagaaaactttggcaaaacgtaaaattctcttcaaaaaaataattcatggcccatctaacacccacgtaagtagatggatccaagtccaacacctctataacataaaacatggcctcactaactttaacccagcaaagtatttaagcaactagaactaaacagccacatgcattcactgaccctctactcgggccaggcatttcaccagatgttcagtatgcactagtgaaacacacattcacaatttggaccctcataccgaatacactagcatgaatatacaggaattaaggaagtaaactcacaaataaatatgattactaaccatggcaagaaaagaagaaagggtgctataagataaactggctgtgactttattttgtattcaccatttctgcaaataaaattgctcctagttcatatgaaggaatggaatgcattcatattccatggtagcctctgagacttggaaggcactggagtatgtgaaaaacctttgaaagcagataagtgagctttaacaataaaatgtcctttctccactgaactgctgtgaattacaaaatccacagattggaaaagaaagaaatgcttaaactccagagttcatatgtatacagtggccatcctctgacactttctaagtcagcaccttttatactgtaaagcacttattacatcctgcaaggactttgtcattgacttttatctgcctcccccagaagaacagaagctccataaagataggtaccaatctgtctcgctttccattttatcctcagtagctctcttctcctatatacaaactaaagaagcaggccgggcacggtggctcatgcctgtaatcccagcactttgggaggccgaggcaggcgaatcatgaggtcaagagatcgagaccatcctggccaacatggtgaaaccctgtctctactaaaaatacaaaaaaaattagctgggcgtggtggcaggggcctataatcccagctactcaggaggctggggcaggagaatcgcttgaacccgggaggcagaggttgcagagagacgagatcgtgccactgcactcctgcctggcagaagagtgaggctccgcctcaaaaaaaaaaagaaaaattaaaattaaaaaataaagaaagaaagaaaagaaccaacgaataaataaatcacacaaaaaactaagacaggacctaatttaggactctccaagggaataatatttaagctaagatgcaaaacttaacgagaagttagccagataactaagcactaagaactgccctgcaaaggccctgaaagacagaacaaatcacggtcaaagaactgaaagattagcgggcccaggataaagtgagtaaaggatacagtagaacataatggagttgcatatgtaggcagaagcctgaccatgaagggcctcaaaaccaaggtaaagagactgggctttatttgaaatacagaaaaaaaaatcagtgaagaattttaagcagacgaataacatgatgtaaagtttctgtggttgctgaatgaaagctagattgtagggaagcaaatgtgaatacagagagaccaattaaaaagtaatgttagtccatgcagagattatagtaagcatatctttttattttctgtattcttgatgctttggtatctgggaccttgctaaaactgaagcgactgcccctctcagggtaagctaattcctagagacagcaaactaactcccatggaaggatgtctttcatatgcacaccaacctatctaaagcccaaacctccaaccacctctatggttacactctagggtcaacttttcacctgcccaaattgccccagggccaggtaccagacaaccagagaaagccctatgccccagaacccactcaaaatactcaaagtagccaatcctaaacctgtttaccctatctcacctgtcccttcccagggaaaccacacaaacattcttgtccacttcttcccccctctttctctgcctcctaactgactctggtacttccccgtggagcccctgtgacacagcacgcctccttctcttgtgagctgtatatataacaatatatcttttccatagcaatagtctcttgatctgttggcctcatgatatgtgagtaataataaagcatactttttttttttgagacagagtctcgctctgtcgcccaggctagagtgcattggcgcgatctcggctcactgcaacctctgcctcccgggttcaagcgattcgcctgcctcagcctcctgagtagctgggattacaggcacccgccaccatgcccggctaatttttgtatttagtagagatggggtttcaccaggtcaggagttcgagaccagcctgaccaacatggtgaaaccctgtctctactaaagatataaaaaattagccgggcctggtggcatgcacctgtaatcccagctactcaggaggctgaggcaggagaatctcttgaacccgggaggcagaggttgcagtgagccgaggtcgcgccattgcattccagcctgggcaacagggcgagactccatctcaaagaaaaaaaaaaaaaaaaaagcctaccaataggctcagacagttcaagacctgagacttctaaactcaagtctatttccattaacacagatatgcattcaaattcacatttatttatctttttttttaagtaattcaaacaacaaatattcactgaacaagcctactagcagaagctagggagaaaaatggaaaaacattagactagtgacaaagaagaaagggcagtccaggcaatggggaacccctgaagaaatttatataaggaaataatacaatcaaactagcatttaaacattatcctgagcaggattgtcaaggatcaaacatgatgttgttcattctagccagcaagttaactaactacaattatttagatgttctaacatctgtttttaaaccagcatgttgattattaaaggttagggaagaaggggagagagtttcactcaaaacactgtaacactctagtgttatatacaggcaaatctataagatattgcaggtttgattccagaccacctggataaagcaaatatcacaatacagtgagtcacacaaatttttgttttccagaaagaaaccttggatcaggcagattcatagctgaattttgctaaacgtataaagatgagctggtaccaatcctactgaaactattgcaagaaagctgaggaagagagactcctccctaactcattctacgaggccagcatcattctgataccaaaatgtggcagagacaaaatgaaaaagaaaacttcagaccaatatctctgatggacataaatgcaaaaattctcaataaaagacctgcagaccaaatgcagcagtacatcaaaaaactaatccaccacgatcaagtaggctttattgctgggatgtaaggttggttcaatatacacaaatgaataaatgtgatttgccacataaacagaggagattttgcaaaattcttgagggtcctaagatttttggaatgggcaatgaacactggcttcaacttaaagtcatgagaggcatcagcccctaacaagagagtcagcctgtcctttgaagctaagcagtgacttctctctagctaggaaagtcctagatggcatctccttccagtagaaggctgtttcgtctacattgaaaatctgttgcttaatgtagccaccttcatcaattatctcagctacatcttctggataacttgctgcagcttctatttcagcacttgctgcttcatcttgcacttttatgttatggagacagcttctttgtttaagcctcatgaaccaacctctgctagcttcaaacttttgttgcttcctcacgtctctcaaccttcatagaattgaagacagtaagggcattgctcgagattaggctttggcttaagagaatgctgtggctggtttgaacttctatccagaccactcaaactgtctccatatcagcaatgaggctcttccactttcttaccactcatgtgctcactggagtagcacttctaatttccttcaacaacctgtcctttgcattcaagcttggctagctgtttggcacaagaaccctagctttcagcttatttcggctttcaacctgtcttcctcactaagctaaatcatttctagcttttttatttaaagtgagagttgtgtgactctccctttcacttgaacccttacggaccattgtagaattactaattggcctaatttcaatattgtgtctcaaggaataggaaagcctgaggaaaggaagggagatggggcccacggcctagcagtgggacagtcagaacacacacgacatttatcaatttagttcaccatcttacaaaggtgcagttcgtggcacctcaaaacaattacaacagtaacatcaaagatcactgatcacagatcaccataacagatataataataatgaaaacgtctgaaatatgggaaggattaccaaaacatgacatagagacatgaagcaagcacaaactattggaaaaatggtgctgacggacttgatttgctcagtacagttgccacaaaccttcaattaaaaaaaaaaaatgcagcatctgcaaagtgaagaagtacaacagagtaaggtatacctgtatataaattttaagcaatgcagaaagttttaattcagccatatgcctaagaattttgactaagccagtatatggacttgcaggttgtatcagaacccagcaattctatacacagtcatccctcaatatccatggcgaactggttccaggaaccccacagataccaaaatccatgaatgcacaagttccttatattaaatggcacagtatttgcatataactacatacatcctccagtatactttaaatcatgtctagattacttattacacctaatacaatgtaaatgctatccaaataattgttatactgcattggtttttttttttattgtttttttctattgctttttttctcccaatatttccaacatgcagttagctgaatctgtggatgcagaacaagcaggatacagagggctaactgtagttttgttacattttttatttttattttttaagagacagggtatcactctgtcacccacgctagagtgcagtggcacaatcatagctcactgtagcttcaaactcttgggctcaagtgatccttccacctcagcttcccaagtaaccgcaactataaacatgcacacacccggactaattttttttattttttgtacagacagggtctcactacgttatccaggctgctctcaaattcctggcttcaagtgaccctcctgctttggcctcccaaagcactggaattacaggcgtgagccactgtgcctggctagttttgtctcttttaaagaggagtaagcagctatgtctttgaaaatttcactgggtggaagaaccaggaaaacacaaaggaaattacagactacaccaggaagcagaggtgaaatatgatgccttaataactagcatgccaatcatgagccacattctatgcctttctcttatgcatcttctctccatttcatcctcctgtctcattaattttttccttcccctatttaacgccttcaatccaataaaatgacgtatcttgttctcgttttcttttttttgagggggtggggggcttctgggcttcctctcatctcatacctaatgatcacatcctttccatttccatcttcactttacagctccctacactctttatcctaatggtcctcctctagtatcacaactcaaaatagaaagagtattaaaaaaaaatgagaaaaaccaaaggggaaaaatggaaaaaggactacatactcctatctaattgtaccttacttaaacactatgcatgatacaaattatacggactgaatcattacgtttaagcttcttataaaaatccaaatgttctattcataacacccaaaatatggaatcaatctaagtgtccatcaacaacatcatataattaaataaagaaaatggaatactatttgaaaatactgcttgaaaggtgactttttctttttttttttttttgagacagggtctggctctatcacccaggctggagtgcagtggcatgatctcaggtcattgtaacctctgcttcctgggctcaagcaatcctcccaacctcagcctcccaagtagctgggactacaggcacgtgccaccatgcctggtgaatttttgtattttttttagagagagagttttgccatgttgttcaggctggtcttgaactcctgagttcaagcaatctgcccacctcggcctcccaaagtgcaaggattataggcatgagccaccacatacaatcaaaaggtgactttttaaatagtaacttgaatttcattctaattgaagaaaaccatatatagctaaaggtatactttttaaaagtcttcctaatatgagcatgtgataattaaaatactaaagaaatggctatttttaattacatcattttcatcaacatcttactataatcttagtagtgttctataacttagtatggtaatacagtgtttttacaaaggcaatgtggatattctattaaaactgagctgtttccagcataaatctcaatcacacagcaatttatttcttggcccacccaaaactgaatatacaaattgccaaagttcaaattgctgatacaaattgccaaagttcatcaataatcctccaacatggtgattttgaaacttttgattttttatttatttatttatttatttatttgcctcagaaacagtgttcaaatggaatcttatctagaaacatgaggaaatagaacaggtaagaatgtagaatactctggtagaagccaaggggtgctcagtgacaccctgaacaggccagctgaaaatgctctatttcaccataagagttatctcttctctttgcccagcaaatctaactcatcaatcaggactcagctgaggtatgacctccctgggaaaactttccctgaacctccaaacatgaggtgttagatatctcttccaacccacatacttccccatatctatcccatcacagctgttaccacactgtgtactgaaacagcctacccattcgtctgtttcttccagctgagtgaaagtctctctaaagcctcaaacccattcttttttgtttcttttttttgttttgttttgtttttgagatggagtctcactctgtcacccagactggagtgcaatggcacagtcttggctcactgcaacctctacctctcgggttcaagtgattctcctgcctcagcctccccagtagctgggattacaggtgcctgccaccacgctcagctaatttttgtatttttagtagagacggggtttcaccatgtttgccaggctggtctcaaacttctgaccttgtgatccacccgcctcagcctcccaaagtgctgggattacaggcgtgagccatggcacccggccgagacccattctttgttgtatctcttgtgagagcacatcaggcctacacttaggagtaggtggtactcaatacatactagttgaacaggtaaaaaggggataagtgtgtgccctgattcataacaacatatttatctttgtttagatatgaaaagttccttctctgcatataagcaccaggagggtagggactatgtcagttgtgattaccttgtgtacatattacctgccacatagtattgctaaccagctgttgcctctactcctaggaatgccttgagagtgcttcactttgaactgttggaatctttttacaggcattgctttcttcaacactggccctgaagtagggtaaatgtgggttcttattgcatctcagtcactaactagcagtgtgattttgggcaattcatgtaaaagctctaggtctcattttctgtatctgcaaaattgtttttaaatatgctttagcactagaagacttttcctcaaataaaaatttcaaaagagtcccatatataaaaaagataaaagcaataatgaggttctcattctactcaattcttcagtgaagaaaatgcccctagaagtaccttcttagagcagggtatgatttgaaaacactaaactagctgacccacagaagttgaatctagcactaatattctatgatttatccatttaataaatactcattaaatgtatactctgtacctggtactgaactaggcactgcacattcagcaataaacaaagcagatgggctccctgagatatttatgctaacatgtagtattcagcccattattaaatattcacttaaaatgaacaaaaaaagattaaaacaccacctctggtccttttatagagtatagaaaacaagacaatttaccaaattcacaaatagctgaatgtattaagaaaatagttaaatttcagaaatgcatatctcattttccctatcaaaatttcagtgtattatttgggaatttttcaattcatactgttttcttccaatcatttttatgctaatttcttaataacacatttacattaatactagttattggtagctaaaatctaagtttctccctgtcatttcctaattgtttttctttttcttttttttttctttttgagacagagtctcactctgtcacccaggctggagttcagtggtacaatctcagctcactgcaccttccgccttccaggttaaagtgattctcctgcctcagcctcccaagtagttagaattacagtcacctgccaccacgtccagctaatttttatatctatttagtagaaatggagttttgccatgttggccaggctggtgttgaactcctgacctcagatgatccacccacctccgcctcccaaagtgctgagattacaggcgtgagccaccatgcccggccctaatttattttttactagtcctatcttttagcattttaggatcttttaaccaactaattttttgatccttcgcaacttcatacttacaatatgaatttgacagtaaaatcttaaaaggcagaaaccatttttcatcaatatttgcctcagcatttatttcattcaacaaatatttgagaagtacctactatgtgcaaggcattctgctataaagtggtacaaaagttctagaattctataacatttccttctcattgtattctttacttttctttccctttaaaagcttaaagtgcataacaagaataagtacctgatttccctggggttccctcaatctgtaatgctcttccttgtactcctcatacataccacaccctttcattcattcatcaaaaagtatactgctaggcgctgaacaggtgctaataaagaaaaatatatggttcctttccttaaggaatgaagagaagaataaagatagtgatgacatttcagaaggaaaatctacaagactcagtatcatctgaagtatcataaaaaggaataaagatgattctcagccttgctaaaagactaagtagatgatgatgcctttgatacacaggaatttgaaaggcttgtctggaatgtttaaaactggttttagaatgttaaatgtgtaattccctctggatagtctagttgagttgcccaaacagaaattattaaatagaagtactcattagtatctgagtaaccattatgtggcaggatccaaggacactgagtaaaatacaatccccgaactcaaggaacttaagacttagatgatagagaatacaagtaaacaggcacttaaaagagaaactcaggtaagagactggaggtgtaagcactagatggaacatgaaggaccttgtatgccactcttaggagactggatttctcgaggcaatggggaaccatgggttttaaacagggaatgcttgattacatttgcattttggaaagaacgctctagcttcaaggaagataatgggttggaggaggcaaacaaagtgaacaaataagatgctgttgcagaaatctgaacaagatttgagggaagagatatgtaatagtaatatttgagaccctgactttcctagacaacactcaaagtacaatgctaatccttgaactatttttaaccataataacaaaataatactcgcatcaggcaagtataaagcatacctggtggccgagcactatgctatctcatctcttattctatatcaaattgtgggaaccacagttgaggaatgtatctttttttttcctataaccacttgaatttcacatgctatgggaaatatgtaacataatttaaatatacagcatattctaaagaaaagcaaaattgaacagatccaagcagcaaagttcctctaggattatgcaatcacttcattagccaaaaagcttacaatctatagatcctatgtattgttaggagtgaaagctttccataaatctctaattacagggccctgaattgataaggggagacaatgtgcccagactaccctgtgtcaccagctctaagtcacacgagacaatttttacaaataagactgaagttgaaggtttctgggaaagccccttccctgcttcttcttttcttcctcctgcctggaatgtagacataaagctggggctgtagcagccctgttgtagccatgagataataagcatgaggacaaagcacatgctaacgatgagagagtacaagaaaagaagactgagacatggctgttcctttgttgctgctgtactagcagactttttgttaagggagaataataaatccctctgtggttaagtaactttaggctaaacatagtcataatttatatactctgaatcccttatagaataaagcctaggctacttcacattgcataagatgcttctcaccatcagctccatttaactatccaacctcatttcattctgttctctgtcccatactttccattccaataattctaaatcttgtcagatgagcacaccccaatgagttgtttttacctttctacctgtcatccccttgactctcccttatcactccatttcttcacccaattaactcttcgtcagcattccagatttcctggctccactggctgaggaagatgccctgccttcttcttttcacattaccccatgcaccagtcactacaatgagtgtgctatattacagctatttatttatatatttgtcttcccaactacactactgacccctcaaaaagaaaaaagtatcttagttcttttggcattcttagatcctggcacagtaccgggtcaactggggatgctcagtgaatgttgaatgaattagatttacataaaacatgacttcttaattagtaaaagtgattacataatacagactgttaaatgacccctttaacatcaaaaactcattctcatccataaatttgtcctaaaaaagtccaggctatagtgcagtgctgcaatcatagctaactgtggccctgaactcctgggctcaaacaatcctcccgcctcagcttcccaagtagctagaactacaagtccaagctaccacctggataattttttcttttttggtagagaaagggtctcactatgttgctcagactggccttgaactcctgggctcctttaccctcgatgctctggcctctctaagggttgagattacaggcgtgatctaccacatccagcctcatttctgcttttaagcagaaaagctgcaaagagctgtaagtcctaaagacacttgacaaagccatcctcatctgccttaaaggattaatctcacttccaatgggaagtcagaaatgaaaactaggccaggcatggtagctcacgcctgtaatcccagcactttgggaggccaaggcgggtggatcacctgaggtcaggagttcgagatcagcctgaccaacatggagaaacccatctctactaaaaatacaaaattagccaggcatggtggcacatgactgtaatcccagatactcagggggctgaggcaggagaatcgcttgaacccagaaagcggaggttgtggtgagccgagatggcgccattgcactccagcctgggcaacaacggcaaaaccctgtctcaaaaaaaagaaaagaaaaagaaatgaaaactaaacagatgatcaaagaataaattttgttatattttattagcaaaactcgtcaaaacaagggtaagcaaagaaataaaatctcttcatacctgtcacattgctgcattatggaaatttctttgattatttcctgaagatctgattcaacaggtacttgtttaattgcgacaacttgaccggattccttgtgtattgctttaaatacacttccataagacctaaaagaaaccaagacattatttttttcctatcaaacatcgtaactataagattaaaagtctactatgagttttctgtggatagtcttttctagtttaaaacactatttaaatgattaaaaaatcaaagtaaacaagtaacaattttaaaaggtaatgaattatatcttagctttattgcttcaactacagacttaaaatagtcaagttaacatataatgagtagctatttttcttatgaatgaaagaaacagacttgcgtttggtcaactcaaacaaatgcagcattaagaagatataaatggaaattaaaagaatgaaatgtagattaaaaatagccaaagcctcaaattaggagaaaaggctgatctcaaggaaaatgacccccagaatatcaaaaagtcacacttctgttcagagtaccttaacagttaaaaccctcagctggggaccatattaacatcaaagttagagaagcaaggaatctgcagccatctgcttctacctgatttacagatccaaggtctctttttaaaaagttcctttcattaccttttcctcaagagaaaaactacaaactcacaggtaaataaaatgaggaacagggtctaatagtcacttgcccaaaacctgtctctgctacaactcctgaaactttgccaactgaatattcacgtgttttaaaaagcaaaaacaaagaaggaagaagccatttgtaccttagtatgaacttaaaaacgaggttaaacactactatgtactgagttcttactataaaccaggtcctatgctaggtgttttacatgcattatgaaattcaaccctcacaatcataaggaaaaacactattatcgtcattaaaagatgagaaacagaccagtagggccagaattcaaacacattcccaccccaaaaatcaggtttttctcaccatatttttctacagaagagaaacaagagcaagccaatggaaaacatcgaatgtttcctaatattagaaatctatgcagaagcccttccaaatttataatcttttaaaataagtgaaaaagagacaaataagtgataacgcggctacttcaataaaatacattttatcctctcctctgtttctttgggctctctgaagtcatttaatttggtttggtacccaaagtcacattgggctgggtgtgggggaatgtatgtgtgtgtatctccccttgaaagccatatgtgtgtatgtgtgtatattccctcaaaagctaacatagaattcagtgctagatcatctactgtcaattaggcaacaccatcactcctttctaaggactcctcagcactacgaaagagaagctgcaatccccacttcccagaatccccttccctgaatggttcctcattaaaagtctgccagtgagaaaaacacgtatgtgtgaatgacgaaaggagaaaccatttttctccagatacagttgtagcagatggactgacagatatgaagtgcacagcagcttcctgctgagcttccaacagccaccactgctgcagactgaggtagttggtgggagtttctcaagactgcaggattccagcagattcccagagagcttttgagaaacacccacttcagtgcttcaggctgagatcttcaatgctgacttcgaccttcaacctttggcaacagttttcatgaactttgcatccctggcccctccacaattcatttgagctcctaacttcattactaaattcttcatatctatagagtacatacagtagcttatcttttccttgatagcaatatagtttttggtagaagaagtgtttccaagggaaagaatcttaaagatgagaatcttgaattagttctttcttagatgttgatatggtttggctatgtcccacccgaatctcatcttgtagctcccataattcccacctgttgtggtagggactcagtgggagatgactgaatcatgggggcaggtctttcccatgctgttctcatgatagtgaatgggtctcacaagatctgatggttttaaaaatgggagtttgtctgcacaagctctctctttgcccgctgccatccatgtacgatgtgacctgatcttccttgccttccaccatgattgtgaggcctccctacccacgtggaactataagtcaattaaacctctttctttcgtaaattgcccagtcccaggtatgtctttaccaacagtgtgaaaacagactaatacagatgtgtagacagtaatgacttcaatacaagtaacaaatagtatactgatggtctatggcattcagtggcaaacagttatttaaattatcacccttagttgcctggagtctaagcaaagctttaaaagaccaagtagctgtatcaatacaatgtatggtgaaaataaagtataaggactatagaatgggctgctgcctctgcctgcactggaaaagttatagaacaaacacagcaagctaaaggcttaaatgtccagctcaagactgagagaaccagaaaacttctgaatttcttaattcttacagaaacagggttgagatttctgaaaaacaaactctaggtatagtcttactggaagttgaattacatttcaagttgaattcacatcagcaccaggtctgttatgttaaagttaaggtatctaacaataaagagaagtacctagagaactggtattaggacatttagatagattctcattaatctgagtaccttgaatccccaaatcctatcaagcctcccttgataccaaaagcaactctgccctcctgtctgagaaaattaaccttacaatgcctgaagactctatctacctcctgaggcagtcacttttcagcagcatgcagtggtcctccagaccactccaccaccacttattgcttccagacccaaagttatactcaactcccatagacaccagggagacaagtataaaatttaacccaagcagctactattcacactaaaaaagttgcaagattttgccaatttttatcagaaccctaaagaatatgtgtgagaacaaattctaagatttccagagaggaagaaatgtactgatatggatgcaagaccagaaattccagactcagcatgttagctcaaacagttgggggtgtccctaacagttgctcagccagttaactgaaacctggactcaaaagtggcccatattaagtgagatgctaagtgagcctcagtacacaccaaaggaagcatatcaaaggctcaaggaaatgggatactagaatggatatatattataagtgccatgctcacatactccctaactatgttgacaaaaagggtccagaggataccagcatcgaccaaagctctattagtgcaggggaaagatgacaaatatgccaacagtgaaactggctccttgagtttaatagataacaggatcccagcacaagagaagtggcaacagctattcacctgagacaaagtgggaacagttaccataatgagtaacaaagcaaggctgaattacagttttcttttattgtacatttaggtcttgatattaaagttacactagcttcatttaaaaaaaaactataattaactgtcctttaaacactgtataaaacagtgtttaatacagtggaacctttctggaggggaggaggtgaaatacacacaacataaaattcactgttttaaagtgtatgattcaatggcatttagtgcattcacaatgctgtacaaccattatctgtatgtagttccaaaatatatagaatctgctttctgtctctacagatttatctattctagatacttcatataaatgaaatcatacaatatgtgaccttttatatctggcttcttccttcacttagcataatattttgtaggtccaactacactgtaaaatgtaccagtacttcactactttttatggctaaaaggtcactgtacagacatatcacgttttgtttattcacctgggatagcagatggacatttgagttgtttccacattttggctattgtaaataatatgctatgagttggtacctttataattaacagttatttaatcatttctctatcactggctatatcttccttcttattccaaatcttctgtattttctattttctttagtcaacattgtaagaggtttaattattttactgatctcttcaaaagcttttatatatacaaacatatacgtatctttttttttttgagacagagtcatgctgtgtcacccaggccagagtgcaatggcacaatctcggctcactgcaacctccgcctcctgggttcaagcaattctcctgtctcagccttccaagtagctgggattacaggcacatgccaccacgcccggctaatttttgtatttttagtagagatggctactctactaaatgacaatatggtttcaccatattggtcaagctggtctcgaactcctgacctcaagtgatccacccacctcggcctcccaaaatgctgggattacagcgtgtaagccactgcacctggcccatatttatcatttctaattttttttctatctcattaatttcagctttttctttaattcaatcttcagtttcttttggtatgtttcataatttttctaagttctttaagtaagcactaagtttattttttgcctttctttgttagtctaatgaaagaatttagaactaaaacttttaattagttttgctatattccatagatactggcacaatgtgttctccttttcattgttttataatttataatatcctcttcaatcaatgggttacttcagattatgtttcctaatttctagttggtgtggattttgtcatattataattacttatttctaatttagtgagtataatcagtgatatggtttgcatatttgtcttctccaaatctcattttgaaatgtaatccctaatgttggagatggaacctgttaggagacgtttgggtcacaggggcagtttcctcatggcttggtgctgtccttgagatggtgagttttcacaggatgtgcttatttaaagcggtgtggcaggccgggtgcagtggctcgtgcctgtcatcccaacactttgggaggccgaggtgggaagatcacctgaggtcaggagttcaagaccagcctggccaacattgtgaaacctcatctctactaaaaatatgaaaattagctgggcgtggtggcaggcacctgtaatcccagctactcgggaggttgaggcaacagaatcccttgaacccgggagaaggatgcagtgagccacgatcacgccattgcactccaggctggatgacgagagtgaaactctgtctcaaaaaaattttaaaataaaaaaaaataaaactgcgtggcacctcccctgccctatcttgctcctgctctcaccatgtgagacatctgctccccctttgccttcttccatgactataaccttcctgaagccctcaccagaagcggatgccggcaccgtgctttttgcagtgtctgcagaaccgtgagccaattaaatttttctttataaattacccagcctaaggtatttttcttataacaacacaagaacagcttaatacaatcagaaaatgtgacctgtaaaaatctcttattttttagaatttgtaacttttcttttatcaatggtcctttgaacatacaccagaaaagcaggtctgcaagaatatatatgcatagttatatagacatacaggtactttatatatttttactttatatatatttacatttctataaaatcaagtgtattcatcataatgtttaatccctctatgtcctttctcttttttctattatatctgtccaattctaaaagagatacattgaaatctcccatgcaattatacttttattagatgcctctgacatcactaatagcttttctgtcataaatttagctgccatgttgtctgacatgttttgttataaattgtccttgatattgctacctaatatatctctttatttagttgaaaccttttaaactttaatgtatctaatataaatattgctactattactttctgtttttttatttgtatgtttatctataatatttttataagaaatatccttataggctatgcacagtggcccacacctataatcctaacaatttgggaggccaaggaaggaggatcacttgaggccaggagttgaagaccagcctgggtaacatagcaagatcccatctctattaataataaataaatagccttatatttccattatttgttttacttgcatctcctataaacagaatataggtagatttcgcatgttcatttactctaacagtttgtcttttaatgggaaaattaacatttactgaaaagtacacttgattttattccttccatcatgttcagcttatttttattttttatttatttatttatttatttatttattttttgagacggagcttcgcttgtgttgtccaggctagagtgcaatggcgtgatctcagctcaccacaaccttcaccttccgggttcaagcgattctcctgcctcagcttcccgaatagctgggattacaggcacccgctaccacgcccagctaatttagtatttttagtagacatggggtttctccatgttggtcaagctggtcttgaacttccgacctcaagtgatccacccacctcagcctcccaaagtgctggaattacaggcgtgagccaccgcgaccggcctagcttattattttaccttttcattttctctatttccttgtccttgttcttgctgatctataagcttcttttaattctgttttgtacctttattattttggaaattctcctatactttgccattccattaaatgctccctacctttctctctgctcaaaccggcacgtttctctactgttattttgaaatcatgtcaactattcttctgcctatataaactgtttccctcactaagatattcttgtcatatcaagacaaagactacttaccttttccaaaataaaatgagcctcaagatctaaaaggatggccttatggtcacttgcctaacaaagtcaaaaccttcaaacgtattaataagaatgccgtaagggatgaactaacaaaactcttaaacatcatttcacagcacatttcttgcttttcccttatatatatatatggcctactttctctgaaaaaacactattaccagatttagcacaaactaatctttaaaattcagtatcacctgccaagtttaattactattaaatactattcaattcatacgaatatactctagttgaaagattaacatcatataatattttttaaattgttctgaaattatttacatgctttcatactttttgtacttacccttctccaagcttctctaatacatcaaaaacttcttcaggctgcttagtcaaactgtcttcactcagcttttttagtttactgatttaaaaaagaaagaagaaagaaaatattttctttaaagaccttttacaaaatttttaatttttaaaattttaccaagtttttaattttattttaatatattcagaagactcaaacaatataaaaacatacatagtaaacattctcctttcaagccctgttcctcatgtgcccagcaacacctccaaaaataatcacttttattagttttttgtgaaacctttatataaatatgaatacatattcttaattcctcccctttgaatatataagaagcatatacacacccttctgtataaatattgtcatgttgtctactgttttctcttgacaaaactatgttagagatctttccatacaggttaatcatccataatccaaaaatctgaaatccaaaatgctccaagatctgaaattttttgagcaccaacatgatacccacaatggaaaatgccacacctgacctcatgtaatgagtcacagtcaaactgtaagcacataacacaatttaaggaaaaaagatcctccccagcccccttcagctctgacatatcttttccatgcatgcacagattctcccacccaagcacatccaaagaagggtaataaaatggcacaggtacacgccagacgcaccaatgataggttccccacgatgccccacacggagccaagactgtgcattactcactgtgggtttttttgcttattctctgctttgttggataaagacaatgttgaaaatctgagtaagtgacagaaaaagaggaagcatttatgcttatctctagccaaaaagtcaagctgctggataaactggaaagcagtatgggaaatgtcttacaaaagagcatggtgttggaatgaccaccatatacaacctgaagaaacagaaggataaattgttgaagttctatgctgaagtgtcaatgaacagaagttaatgaaaaatttttcttaattgcagaaaaccaaatgaagatctcaaatgtgtactgaaagagtaaatctgtcagcacggcagagaaaacatactacttaatggtatggtgctcatgaaacaagcaaagatatatcatgatgaactgaaaattgaagggaactatgaatattcaacaggctgattgcagaaatttaagaaaagacacattaatttttcaaagatttgtggtgaataaagcaactgctgatcatgaagaagcagaaaaattcattgacaagtctgccaaggccatcactgatgaaaatctgacaccagaacaagtctataatgctgatgaaacatcacagtttagtgttagttccccagaaagactctgactacagcccctacaggataagaatgccatggacagagtaactgtcctgggaggtgctaatgcagaaggcacactaagtgtaaacctgctgtgtgggaaagattgggttcattattagactaacaaaaaggcatgggtcactagggacatcttttctgattggtttcacaaacattttgtagcagtggttcaggtttgctgcagggaagctggactggatgatggctacaagattttgttattccttgacaactgttctgctcatcctccagctgaaaaatctcattaaatataatgtttattccatgtacttttccccaaatgtgacttcattaattcagcaagtgagcagggtatcctcagatcaataaagaataaaaataaaaacactttcttgaacagcctacttgcagcagtgaacagaaatatgagcgtggaaggttttcaaaagcagttcagcatttagaatgctgtatatgctattgtcgatgactggaacacagtatctaaagacacagttgtgcatacctggcacaatctctagcttgcaactatgttcagtaacgatgatgaacaaggcaatgactttgaaggattctgtatgtcaagataaaaaaaaaaaaaaataggccaggagcggtggctcacgcctgtaatcccagcactttggaaggccgaggcggtggatcacgaggtcaggagaccgagaccatcctggctaacacggtgaaaccccgtctctactaaaaatacgaaaaataagccaggcatggtggcgggtacctgtagtcccagctacttgcgaggctgaggcaggagaatggcgtgaacccaggaggcggagcttgccgtgagccgagatcgcgccgctgcactccagcctgggcgacagagcaagactccgtctcaaaaaaaaaaaattaattaaaaattttaaaaataaataaataaaaataaaaaggtgtttgacttccttacatatacaaaaaaataccttcagagtctgtcagtaagttggaagaaatggatatcaaataagtttttaacattgataatgagtctccagttgctcattcattgaccaatggtaaaatagcagaaatgggctgggcacggtggctcacgcctgtattccagcactttgggaggccgaggtaggcgtatcctttgagctcaggagttcgagaccagcccgggcaaacggcggaaccctgtctctattaaaaaatacaaaacgtttggtgggcatgatggcacatgcctgtggtcccagctacttgggagactgagcctgggagatggaggttgcagtgagccgagatcacgccactgcactccagcctgggtggcagagttagaccctatctcaaaaaaagaaaaaagaaatagcagaaatggttctgaatcaaggttatggtagtagtaatgacaatgaagatgatgttaacattgcagaaaaagtgccggaagacaacatggtgtgatgggcttattttaggactagagtgcattcttaacagaataggaaatcacgtcactttataacatcaaagagagacttctaagacaaaagccactgttaatgaggcagacgattctcgaggaaacattttaaaaagccatccaagcaatggggaaaggattccctatttaataaatggtgctgggaaaactggctagccatatgtagaaagctgaaactggatcccttccttacaccttatacaaaaattaattcaagatggattaaagatttacatgttagacctaaaaccagaaaaaccctagaagaaaacctaggcaataccattcaggacataggcatgggtaaggacttcatgtctaaaacactaaaagcaatggcaacgaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacgatgaactcaaacaaatttacaagaaaaaaacaaacaaccccatcaaaaagtgggcaaaggatatgaacacacacttctcaaaagaagacatttatgcagccaaaagacacatgaaaacatgctcatcatcactgaccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagacagtgtggcgattcctcagggatctagaactagaaataccgtttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggtacatatacaccatggaatactatgcagccataaaaaatgatgagttcatgtcctttgtagggacatggatgaagctggaaaccatcattctgagcaaactatcacaaggacaaaaaaccaaacaccgcatgttctcactcataggtgggaattgaacgatgagaacacatggacacaggaaggggaacatcgcacaccggggacggttgtggggtgggtggagcgggcagggatagcattaggagatatacctaatgctaaatgacgagttaatgggtgcagcacaccaacatggcacatgtatacatatgtaacaaacctgcacattgtgcacatgtaccctaaaacttaaagtataataataataaaataaaataaaataaaataaaaaagccatccagcagaatgtttccttatccctagcagacctatttcctggcccctcagctgcttctgatgtttcttctcaactaaaaaaaaaaccacacagtgtataatagtaacctttcaatcaaaaatcagcatcataggtgaaaactaaaagcctgccgttgtttgttgttcctgttgtttaaaagctgatagaggtattctggtaatgccactgtgctgcttcattaccctgaacatattttttttccactgtattaatgttatgccatattttttgcagttaagtacttatgcatgagcaagtataagaaaatgattgcttatcagtagcatgtaaattcagagtcagaaatgaaggtgatgccaaacaactccacagactgtccacatgggtggctgagatagtgacacctttcctttctgatggttcaatgtatgcaaactttgtttcatgcagaaaattacttaaaatattgtataacattacctacaggctatgtgtataaggtagatacaaaaatttcatgtttggccttgggtcccagccccaaaatatctcattatgtatatgcaaatactccaaaaaacaaaacaaaacaaaattcagaaatctgaaacatttatggtcccaagcatctcagataagggattctcaacctgaataaagcatcaatgttcttttttacagctgcatcctattcaattacagagatatagcatatcttacttgcccagtcttttgcttatggacatccaggttctcttttgatatgataaacaatgctgcactgagtaaccttatatataagtcaatgaatgaatgaatgaatgaatgaatgaatgaatatatataaacttatatataagtcaatgaatgaataagtcatgtgctagtatatatgtggaataaattcccagaaatgaaactgagaatacagacacattcacacacacataaatataaaagtagatatgctgacaaataagtatataatcatgtaataatataattttaataatgtagtataacataagatcactattgtcataactatatggtaattattaaaattattgattacattatggtatattttacctattataattatatgttatataaatatatatacatatacactgatttcagcaagttgtcctccatagagtttgtactaatttattctccaacaagtaatatatgagagcccttctttcccacagttccatcaatagggtatttaatgaaattatttggattttagccaatctgtgatgaaaacttattagctcagtgtagacttaacttgtattattatgagtgaagttgaccatcttttcatatgattaagaagctaaatcacctacttgttctttgctcatttttccactgggttttcggtccttttcttatgtgtatacaaaggaaactagcccttttttcgagattataaacattttcatttggattttgacttcacttataagcttttagttttgcagtctatttgattttttgccatataaaaaatgtcattattttatttttgcaaatgagtggatggtaatgccatttactaaggtaagaaacacaggggaaaaaaaaaacagtctggaggggaacaagatgggctcaattctagtcatctaaaagtagatttccggtaagcaactggatttacaaatctcaggagagatttgaactagaaatataatttttggtgtcatcagcacattgcttaaagctttcagaagagacaaaatcatcaagaaaatgtctaagaaaaaataagagtcaaacacaaaacacatatcaaggaaacaccaatatttaagaaatgaggtcatgaagcacaagaaggtaatatttggctacatcaaaagctaccaaaagtgcaagcagcttgaaagtttaagtatccattgtagaacttccacttctagccaccaggtttatgacaggaagcagaattatctgtcagctgcaaatagctacaaaactcaacaaaatgtaagaaactattttcagatgctggctatcaggcattccagaactggatatactgaggtccccaagagaaggagaagaaataagatgagccctgccatcgcccaggctttagatctagagactatgtcagactgtagcacaggaaaagaagaactcaaagagaaccaagtaattttgctgagttgaagaaatagagcttagagtttggtgaggaatcaaggcaaatggaaattccattacagagtatcgggagaagggagctatgcagggaaaaggttcagcaatctatctagaggtttccatgaaatgccaatctgtgcatgcttacaaaacactcctcaaagcccagcaaaaccagtttcttaaggcgaaaaaaaatgaccagggaggaataaaaagcaaaattcccagacaaggcaatttatcacaaaatatcacaaggcagggaatctttcccactatccagagttgaaagaactccacgaatacaaaggtcattcagaaaagaactcagaacagcattattttagaaaggagattatattaccaaaagataaaggatattccagattctccctagaggagcttaaaaactaacctcaaaagcatcaagccaaaccacaagacaacttgcttaactgcctaccagaacgagtctgtaacttcttaagcaaagcaaaattcaacattcacaaatgtaaaattaacaatgtcaaaaaaataaaaaaaaaaattattaaacctatgagtaatcaggaactataactcataaagagaaaaattagccaataaaacagacccagaaacgaggtggtgaaattgataaaaatcttaagaaaacctcttatgaatatactttcacatactcacagatgttaaaggaaatggaaggtagggggaaagataaatggaaatttaagagataaaaaataaaatatttgctttcgttgctgcagcagacgctgtgagtattttcaatgcttcagaagaggcttgcctctagtgtcctccgctgtggcaaaaagaagatctggctggacaccaatgagaccaatgaaattggccatgccaactcctgtcagcagatccagaagctgatcaaagatgggctgattatccataagcctgcgactgtccgttcctgggctcactgccaaaaaagcaccttggcctgccagaagggcaggtacatggtcataggtaaacaaaaagggtacagccaatactcaaatgccagagaaggtaacctgggtgaggagaataggaattctgcatcagctgctcaaagatactgtgaatctaaaaagactgatcgccacatgtatcacagcctgtacctgaaggtaaaggggagtgtgttcaaaaacaggtggattctcatggaacacatccacctgctgaaggcacacagacccacaagatgctcctggctgaccaggcagaggcctgctggtctaagaccaaggaagcatgcaagtaccatgaagagcgcctccaggccaagaaggaagagagcatcaagactttgtccaaggaggaagagacgaggaaataaagctccccttctcttgtctgtacatagtggtcttggtgattatacagatcaatcattaaaataaaacaagcctttatctgctaaaaaaaaaaaaaaatctgaaatataaattttgttgaataagattaaaaggagattagacagtgcagcacaaaagatgaaatcatttgaaaaggaaaaagtgttatttaaataaaggaagaaacaaaaagcctgagtcccacatgaaaaagaaacaaatgggatgggaagtaaggaaagaaaagtaaggaaaggaaggagggaaataaggagaaacattttccaaattttatgtaaaccataaacccacacagatgcatcaaattcaacaaatttgaaaagataaaacacacaaagagagaaagaaggagagggagagagagagagagagagagaaccaaaatatattatgatcaaattgctgaacatcagtgagaaagaatactaaaagtagtcacaggaaagacatataggcatatctcagagatactgcaggttcagttccataccgcaacaataaagcaaataccacaataaagcaaataacacaaaaatgtttgttttcccaggatatataaatgtttacactatactgtagtctattatgtgtacaatagcattatgtctgaaaaaacaacgtacataccttaatataaaaataatgtttgaggtgaaggatacccactatgccctgatgattgttatgcattatatgcctgtatcaaaatatctcatgtacccaatatatacacctactatgtacccataaaaattaaaaataaaaaagattttaaacactttattgctaaaaatgccaatgatcatctgagcctacaacgagtcaaaatctttttgctggtggagaatcttgcctctatgttgatagcttctgcctgatcagggtggtggttgcaaaaggttgggttagctgtggaaatttcttaaaataagacaacaatgaagtttgccacatcaattaattcttccttcccaaaagatttctctatagcatgtgatgctgtttgatgcatcttactcacaagtagaactttcaaaattggaatcaatcctctcaaaccctgccactgctttctcaattaagattatggaatattctaaatccttttttatttccaagatggcagattagaggcttttagtgggcctcattcacttggaaatagcaagatagtgtacaaaggccaactctgagagctttaattcacaaaggaaaacaggaatccactggaatcgtgacagacacctcagatccaaggaagacacacaaacacaaacagcccctattatggcatccaattgataaaagtgagggaagcccaagtatgcaagacagtcagaaagcctccctctgtgactcacttttccactggagatctgagcaacccaggtcaagaaagagcactttgtttcttctaagccctggatctaacttggggacaagctgatttggagatgctgtgagggacagacactcggaaaagctactggcatttcccagacccaggatggagagcaggacactattttaaatgtgggtgcatgcaagtcaaccattctttggcaacccagtagcatggccacataggcttctggctctggagcaggacagaggtcttcacagccacactgtagttagtgcctcagcagtaggtgctgggattgtgctctcctccactgcaggtcaaggatgagagaagagctgctacagctattgtttctcctggacaaccagacttcaagccagatccagcttagcaacctggaactggtctgcatgtgccatgattggttgccacagcctgttcccctgtggtgcagcagggccctctctgctctactccctggcaaaaatccaggcatttggagcaactgtttgcctggacaagcaggctgaaccacctcacccttcatggatatagatcatggcacagtggaggcctctctgctccacatgcaggcagatctagagctattcagagcaccccctcacctgcaaccgcagtctgagttgccttacccttcctgtgtgtgcatagattgtggtacagtggggccctctccactccacatggagacagatacccaggcatctaatgcacctgctcacatggactagcagattgagttgccccacttttcctgtgcagagattctgtgcaggggggccctctctgctccatgcccaggcaaatctccaggcattcagagcatctgctcacctgaatcagcagcctgacttgcctcacccttcctgtgcagagatcctagtgtagggaggccctctctgcttcacactcagacagatctcccaggcattcagagcacccactcacctggatcagcagcctgaactgctccatccttctatacatagattatggtgcagcaaggcccttccactccattgcccaagaagatctccagatattcaaagtacctatttgcccaaattggcatattgggccatgccactcttcctatgaagagatctgggtacaggcaggccctccctgcttcatgcccaggcataactccaggcattcagagcacctgcttgcctggttcagcagcctacatcaccccaaccctcctccgcagaaatcttagtggtggtggggtggcagggggaccctttccacttcatatccaggcagatgtccagccatctggagcacctactcttcaggattaggagtttaagctgccacccatccctgtgcagagaacttagggccaaggaggtctcccagcttcatacccaggtacacctctgggtgcttggtgactacccactggattctccctatgcgctgacacttgtgcttgccactggagggtctggcggtgagcctgcccagtccagccctgcatatctttccctctgccccctcagggctgagcaggaaactcagactactgtacactccacaaatcagcccactgcctgaggcaacggagagctgctcccagtaaacaaggatcaaatatatacccagtcacactggcaacacctggctcttacccataagcttataggccaaactacacagcccaatataaaacctgccaactgaagtgcataggactataaaaacaaagccaaaagactctacacagcattatttccactcacaacccctaaggagtaggggaaagggaaagaagaaaaaaacaacattgtaagacaagaaagaaaaaatcctaccagtacgaaaataattacacaaattagcagtgccagtgtctccagatgggaagaaaccagtacaagaatactggcaccatgaaaaaatctgaatgtagtgccaccacagaaggatcacactagctctccagcaatggtccccaaccaacaaggacactcagaaatgacaaagaactcaaagcatgggttgcaaggaagctcagagatccaagacaagattgaaaatcaatactaaaaaacttcaaaggaaatccaggaaataagaggtaaagatttttaaaagaaatcaatcagagcttctggaaatgaaaaaggtttacttaagaaatttcaaaatataactgaaagctttatcaatagactggaccaagcaaaagaaagaatttcaggccaggcatggtggctcatgcctataatcccaacacttgaggaggctgacgtaggaagaccatttgagccaagtagcttgagaccatcctggaaaacataaagagaccgtgtctttccaaagaaatttaaaaattagctgggcatgatggtttgcacctatcgttctagctacttgggaggctggggtgaaaggatcacctgagcctgggagttcaaggctgcagtgagccatgatcacatcactgcaaaacagatgaacaaaaggaaaaaagaagaaaggaatgaaagctgatcttttgaactaacccagtcaacaaaaatagaggaaaatgaacttttaaaattgaacaaagtctttaagaaatacaggattatgtaaagcgatcaaacctataaattattagcattcatgatacagaaagagaaaaagcaaacaacctggaaaatatatttgaggaactaactcaaaaaaatttccctaatcttgctagagtagtagacatccagatacaacaaatccagacaacaactgtgagataatatacaaatccagacaacacttgtgagataacatacaaaatgaacatcaccaaggcatatactcaccaggccgtccaaggtcaatgtggtgcggtggctcacgcctgtaatcccagcactttgagaggccaagacgggcagatcaagaggtcaggagatcgagaccttcctggccaacatggtgaaaccccgtctctactaaaaatacaaaaattagcttggtgtggtggtgcatgcctgtagtcccagctactcgggaggctgaggcagaagaatcacttgaacccaggagctggaggttgcagtgagctgaggtcgcaccactgcactccaatctggcaacagagcgagactccacctcaaaaaaaaaaaaaaaaaaaaaaaaaaacaagaactgaaggaagagatatttaatgaaatagatagcataaataaaaaaacttcaggaaacaatggacacatttacagaaatgcaaaatgctctggagagtctcagcaatagaatcaaacaagcagaagaacgaacttgagagctcaaagacaaggtttttgaattaacccaatccaacaaagacaaaggaaaaagaataagaaaatatggacaaagcctccaagaagtctgggattatgttaaacgaccaaacctaagaataatcagcattcctgagaaagaagataaatctaaaagtctggaaaatatatttgggggaataattgaggaaaacttcccagccttgatagagacccagacatccaaatacaagaagctcaaagaacacctggggaattcatcacaaaaagatcatcgcctagacacactgtcatcaaattatctaaagttaagacaaagaaaagagtcttaagagccatgaggaaaaagcaccaggtaacctttaaaggaaaacctatcagattagcagcagatttctcagcaaaaactttacaagctagaagggattgcagccctgtcttcagcctcctcaaacaaaacaattatcagccaagaattttgcacccagcgaaactaagctacataaatgtcggaaagatacagtctttttcagacaaacaaatgctgagagaatttgccactaccaagccagcattacaaaaactgctaaaaggagctctaaatcttgaaacaaagccagaaaacacatcaaaacagaacccctttaaagcataaatctcacaggacctacaaaacaaaaatacaatttaaaaaacaaaacaaaacaagaaaaccaaggtatacaggcaacaaatcgcataatgaatggaatgatacctcacatctcaataccaacgttgaatgtaaatagcctaaacattccacttaaaagatacagaactggccgggcatggtggctcacgggggtaatctcaatactgggaggccgaggcaggcagatcacaaggccaggagttcgagaccagcctggacaacatggtgaaaccctgtttctactaaaaatacaaaaattagccgggcgtggtggtgcgcgcctgtaatcccagctactcaggaggctgagacaggagaactgcttgaacccaggaggcggaagttgcagtgagccctgattataccactgcactccagcctgggtgatggagtaagactccatctcagaaaaaacaaacaaacaaacaaacaaaaaaaaaaatacatatataattgcagaacggataagaattcaccaaccatctgctgccttcaagaaacacacctaacacataaggactcacataaacttaagctaaaggggtggaaaaagacattccatgcaaatggacaccaaaagcgagtaggaatagctattcttataccagacaaaacaaactttaaagcaacagccattaaaaaagacaaagagagtcataaaaggccttgtccaacaggaaaatatcacaatcctaaatatatatgcacctaacactggagctcccaaatttataaaacaattactaatagacttaagaaatgagacagcaactataatagtgggggacatcaacactccactgacagcactagacaggtcatcaacacagaaagtcaacaaagaaacaatggatttaaactataccctggaacaaatggacttaacagattatacagaacattctactcaacaactgcagaatatacattctattcaacagcacatggaactttctccaagatagaccatatgagaggccacaaaacgagcctcaataaatttaagaaaactgaaataatatcaagtactctctcagaccacagtggaataaaatggaaaatcaactctaaaaggaaacttcaaaatcatgcaaatacatggaaattaaataacctgcttttaaatgatcattgggtcaaaaatgaaatcaagatggaaatttaaaaattcttcgaactgaacaacaatagtgacccaacctatcaaaacctctgggatacagcaaggcagtgcttagaggaaagtttataaccctaaatgcctacatcaaaaagtctgaaagagcacagacaatctaaggccacacctcaaggacctagagaaccaagaacaaaccaaacccaaacccagtataagaaaggaaataaccaagatcagagcagaaataaattaaattgaaacaaaaaaaatacaaaagataaatgaaacaaaaagctggttctttgaaaagataaaataaaattaatagaacattaacaagattaccaagaaaagaagaaagaaaatccaaataagctcaattagaaccgaaaagggagatattacaactgataccaaggaaatacaaaagatcattcaaggctactatgaacccctttatgtgcataaactagaaaacctagaggagatagataaattcctggaaagataaaaccttcctggcttaaatcaggaagaattagataccctgaacagatcgacagcaagcagcaagattgaaatgataatttaaaaattacaaacaaggcacctgggaggccgaggcaggtggatcacctgagatcaggagttcaagaccagcctgcccaacatggtgaaaccctgtctctacttaaaatagaaaaaagtagctgggcgtggtggtaagcagctgtagtcccagctactcgggaggctgaggcaggagaattgcttgaacccgggaggcagaggttgcaatgaggcgaaatcgcgccattgcactccagactgggggacaagaaggagacttcatctcaaaaaaaaaaaaaaaaaaagtccaggactagagagattcacagcagaagcagaagtctaccagacattcaaagaagaattggtgccaatcctactgaaactataccacaagacagaaaaagaaggaaccctcccgaaatcattctatgaagccagtatcaccctaataccaaaaccaggaaaggatgtaaccaaaaaagaaaactacagaccaatatccctgattaacatataagttaaaatccttaacaaaatactagctaaccaaatccgacaacatatcaaaaagataatccaccatgatcaagtgggtttcataccagggatgcagtgatggtttaacatacacaatgtgatgatacaccacgtaaacagaatcgaacacgaaaatcacatgatcgtctcaacagatgcagaaaagcattcaacaaactccaacatccctctatgattaaaactcagcaaaatcagcatacaagggacatacctcaatgtaataaaagacatctatgacaaacccacagccaatgtaatactgaataggaaaaagctgaaagcactccctctgagaactggaacaagacaaggatgcccactctcaccactcctcttcaacatagtactggaagtcctagacagaccacttagacaagagaaagaaataaagggcatctaagccgggtgtggtggctcacgcctgtaaccccagcactttgggaggctgaggcaggtggatcacgaggtcaggagttcgagatcagcctggccaacatagtgaaaccccgtctctactaaaaatacaaaaacttagttgggcatggtggcaggcgcctgtaatcccagctacttgggaggctgaggcaggagaatcacttgaaccccagaggcagaggttgcagtgagctgagatcgcgccattgcactccagcctgggggacagggtgagactccgtctcaaaaaaaaaaaaaaggcattcaaatcggttaagaggaagtcaagctgttgctgtttgctgatgatatgattgtttacctagaaaaccctaaagactcccacagaaagctcctagaactgataaaagaattcagcaaagtttccagatacaacattaatgtacacaatcagtatctcttctatacaccaacagcgaccaagctgagaatcaaatcaagaacttaactcctcttacaatagctgcaaaaataaataaaatacttaggaatacacctaaccaaggaggtaaaagacctctacaatgaaaactacaaaacactgctgaaagaaatcatagatgacacaaacaaatggaaacacatcccatgctcattgatgggtagaatcaatattgtgataatgaccatactgccaaaagcaatctacaaattcaatgcaattcccatcaaaataccaccatcattcttcacagaattagaaaaaacaatcctaaaactcatatggaaccaaaaaagagcccacatagccaaagcaagactaagcaaaaagaacaaatctggaggcatcgcattacctgatttcaaactatactctaaggccacagtcaccaaaacagcatggtactggtataaaaataggcacatggaccaatggaacagaaagaacccagaaataagcccaaatacttacagccaactgatattcgacaaagcaaacaaaaacaaagtggggaaaggtcaccctattcaacaaatggtgctaggacaactgacaagccacatgtaggagaatgaaactggatcctcatctctcaccttataaaaaatcagctcaagatggatcagggacttaaatctaagacctgaaactataaaaattctggaagataacattggaaaaactcttctagacattggcttagtcaatgatttcatgaccaagaacccaaaagcaaatgcaataaaaacaaagataaatagctgggacttaaactaaagagcttttgcacgacaaaagaacggtcagcagagtaaacagacaacccatagagtgggagaaaatcttcacaatctatacatctgacaaaggactaatatccagaatctaaaacaaacacaaacaaattaagaaaaaacaaacaatcccatcaaaaagtgggctaaggacatgaatagacaattctcaaaagaagatatacgaatggccaacaaacataggaaaaaatgctcaacatcactaatagatcaagaaatgcaaatcaaaaccaaaatgcgattccaccttacttctgcaacaatggccataatcaaaaaataattgatgttgtcggggatggagtgaacagggaacacttctgcactgctagtgggaatgtaactagtacaaccactatggaaaacagtgtggagattccttaaagaactaaaagtagggctgggagcagtggctcacgcctgtgatcccgacactttgggaggccgaggtgggcagatcacctgaggttgggagttcgagaccaggctgaccaacatggagaaaccccgcccctactaaaaaaaaatacaaaattagctgggcatggtggcgcatgcctgtaatcccagctacttggaagactgaggcaggagaaatcactttaacccaggaagtggatgttgcggtgagctgagattgcaccattgcactccagcctgggcaacaacagtaaaactccgtctcaaagaaaaaaaagaactaaaagtaaaactaccatttgctccagcaatcccactcctgggtatctacccagaggaaaagaagtcattataagaaaaagacacttgcacgcaagtttatagcagcacagttcgcaattgcaaaaatgtggaaccaacctaaatgcccatcaatcaacaactggataaagagactgtatgtgtgtgtgtgtgtgtgtgtgtgtgtgtattacatatgtgtgtacatatatgtgtatgtgtgtgtgtatgtatatatatgatggaatactactcagccataaaaaggaatgaattaatggcattcacagcaacctagaggagattggagactattattctaagtgaagtaactctggaatagaaaaccaaacatcatatgttctcactgatatgtgggagctaagctatgaggacgcaaaggcataagaatgacacaatggactttggagactcagggggaaagggtgggaagcggataagggataaaagacgacaaattgggtacagtgtatactgctcaggtgatgggtgcaacaaaatctcacaaatcaccactgaagaacttactcctgtaaccaaacaccacctgttccccaataacttatggaaattaaaaaaaaattttaataaaaaaatggagaaaccccatctctacaaaaaatacaaaaaattagccagatgtggcggcacaagcctgcagccccagctactcaggaagctgagatgggagaatcacctgaatctgggaggttggagccgaaattgtaccactgcactccagtctgggcaatcagagtgagacagtctcaaaacaaacaagcaaacaaatacttctagacctaggaaaagacttaaacaaccatacataataatgggagacttcaacagcccactgactaatgcattagcctgaccactgaggcagaaaactaacaaagaaattctggacttaaattcaacacatgatgaattggacctaacagacatctgcagactacttcatccatcaaccactgaagatacactgttctcgtctgcacatggaagatactacgagatcaaccacatgctcggccataaaacatgtctcaattaattcaaaaaaaaaacaaaatcataccaaccatactctcagaccacagtgtaataaaaataaaaatcaataccatgaagatctctcagaaccacataattacatggaaattaaacaacttactcctgaatgacttttgggtaaacaattaaattaaagcagaaatcaaaaagttctttgaaataaatgaaaacagagtatcaaaatctctgggaagcagcaaaaaagtataaacaggaaagtttacaacactaaacacctacctcaaaaaatcagaaaaatctcaaatcaacaatctattatatctagaggaactagaaacaaaagaacaaactaaccataaagacagcagaagaaataaaagcaaagaactaaatcaaattaagaccaaaaatacaaaggatcgatgaaacaaaaagttggttttctaagaggaaaaacaagaccgacagactgcaagctagattaacaaaagaaaaaagagagagaagatccaaataagcacaatcaaaatgacaaaggtgacaagcaaccaatgccacaaaaatacaaaagttccttagggacaattatgaacactcctatttacgcaaactagaaaacctagagaaaatggataaattcttggaaacccacaatctcccaagattgaatcaggaagaaatagaaaccctgagcagacatcagtattgaattctgaaattgaatcaataattaaaaacttatcaaccaaaaaaatccctggaccacatggatttacagccgaattctatcagatgtacaaagaagggctggtatcaatccttctgaaactattccaaaaatcaaggaggaactcactgcaactcattcgaaggatgcatcaccctgatacgaaaacctggcaaagacacaaagaaaaaagaaaactacaaaccaatatccctgatgaacataagacacaaaaatcctcagtaaaataactagtaaaccaaggctcggcacagtggctcacgcctgtaatcccagcactttgggagcctaaggcaggtgggtcacctgaggttgggagttcgagaccagcctgaccaacatggagaaaccccggctctactaaaaaacccaagttagccaggcgtggtggtgcatgcctgtaatcccagctactccagaggcttgaggcaggagaatggcttgaacccgggaggcaggggttgctgtgagacgagatcgcgccattgcactccagcctgcgcaacaagagccagacaagagcaaaactccgtcgcaaaaaaaaaaaaaaaaaaaaaaaaatatatatatatatatatatatatatacatactagtacaccaaatccagcagcacatcaaaaacttaattcactgtggtcaagtaagtttcattcctgggatgcaaggttggttcaacatatgcaaatcaataaatgtgatccaccacataaacagaatttaaaataaaagtcatatgaccatcccaacagacatggaaaaagctttcaataaaatccaacatcccttcatgataaaaaaaaaaaaaaaaaacctcttgaacaaactagacatcaaaggaacatacctcaaaacagtaagagccatctatgacaactccacagccaacatcatactgaataagcaaaaaatggaagcattccccttgagaactggaataagacaaggatgcccactcttagcacccctattgaacacagtactggaagtccttgccagaacaataaggcaaaagaaagaaataaaaggcatccaaatagaaaaaggagaaggcaaacaatatctcttcacggaaaatatggttctatacctagaaaacctgaaaggctccaccaaaggctcctggaactgataaactacttgagtaacgtttcaggatacaaaatgaacaaaaaccagtagcatttctatacaccagtaacgttccagctgagagccaagtcaagaacacgatcccatttacaatggccacaaaatacaatacaatacaatacaatacaatacaatacaatacaatacaatacaatacaatacaatacaatacctaggaatacatctaaccaaggggatgaaggatctctacaaggagaactataaaacactgctgaaagaaatcagagatgacacaaacaaatggaaaaacatttcatgttcatgaagtggaaaaatcaatatcattaaaaataaaaaacatttcatgttcatgaagtggaaaaatcaacatcattaaaatggccacacagcccaaaggaatacacagattcaacactattcctatcaagctaccaacatcattttggacaaaactagaaaaaaactattctaaaattcatatggaaccaaaaaagggcctgaacagccaaggcaactgtaagtaaaaaggacaaagtcagagatatcacattacccaacttcaaactatactataaggctactttaaccaaaaaatcatggtactggtaccaaaacagacacatagaccaatggaactgaaaagagaacccagaaataaagctgcacacctacagccatctgatcttcaacaaaattgacaaaagcaatagggaaaggactccttaattcaataaatggtgctgggatagctgactagccatacgcaaaagaatgaaactggacccctaactcaagatagattaaagatttaaacagaagacctcaaactgtaggaatcccagaagaaaaaagaggaaacaccattctggacatcagccttgggaaagaatttatgactaaaagcaattgcaaccaaaaaactgacaagtgggacctaattaacctaaagagctgcttttgtgcagcaaaagaaactctcaacagagtaaacagacaatctacagaataggagaaaatatttgcaaactatgcagccgtcaaaggtctaatatctagaatctgtaagaaacttaaatcaaaaagtaaaaagcaaataatcccattttaaaaatcggcaaaagacatgaacaaactttcatcaaaagaagacatacaagtagccaaacatatgaaaaaatgctcaacatgactaatcataagagaaatgcaaatcaaaaccacaataatataccatttgtaccagtcagaatgacaattattaaaaagtcaggcctcggatttctggactgatagtgagcactggcttcaacttaaagtcaccaacctcaccagtccctaacaagaaagtcagcctgtactttgaagttttgaagccagccactgacatcttttccctagctatgacagtcctagatgacaccatcttccagtagaaagctgtttcatctacattgaaactctgttgtttacagcagctacactcatcgattaccttaactagatcttctgataacttattgcagcttctatatcagcatttgctgctagtgggtggtttcttggcccacctgaagggcagacagcttttgcttctacttgcccatcagaaacatgattttttgcctggagtcagaatgaaaaatattcctatccttcccccatcagcagatggcttttccttctctctctctcccttaggacaagtatatcatgtgcaaggattggaagacaatatttttaaactcaatcctccccagtttgagcttagatcaaggcaataagaatcaaaatcccagaagcctttctggtatgtcattacacatcactttgaaaggtgcatgccaaaactgagagaaagtaagataactgactgcaaaggaacacaacacaactttttgaggtggtagaaatgttctaaatcttgatttgggtgagttacaggattatacacactttgtcaaaactcatcaaactgcacacttagagaacatgaactttattatataaaaatattaatgatcctatcttttaaaacttcagccagtttttctagtagaaattgacaagctggcaatcttagagtttgtgtattttcttcaatgctgctcagaactctgacagtagaatttgtccagagttagcattttccaggcagatgccacagaacaacaatgatataagggagttaaagatattagcaaaagaatggttgatgaaatagaccgagcagagaaagaaattttaaaagagggaggggaactaatgagcagggagaggaataaagtagaaacattttgtgaacgattaaagagcatattcctatagaaagagaagcaatcttttttaaaaattgacaattgtgccttagaaatcaaagagacttcaccttcatggctaagctcaagatgaagccatccacatgatacagcaatagaggcagcactatactaacaaatctcattaatattaaaccaaacaagtaatctaatggctacattattctccaggagtaaaaagtttgcttcaaggcagctcataatctggctcactttaaacaaataagtcaaagatcccccaaatgaatccagtaaacacgagaattttctatatttctatatttctatgtcaatataaaatacacatacaacacaattttctattttcctgacttggcaaacacaatataatgtacagagtttcatctgtctttgacatattgtgaattttaacacctcagaatatcatcataaaggtaatgtttttaatcaaaggcccccaaaaacgttattcttgactgagtggctttagagcatgtactcttctagttgcttgggaattttgtggagaacaagttacccacaaagtacctctcctggaagttaaaacagaggatttcttatatgcttaggcagacatactctagaatcatctttttaaaataagcaactagcaaatgcaatctggttttcctattgctatgttttggatatgtcccctccaaaattcaggtgctgaatctaaacggtcaatgtcatgtattaaaaggtggggtactttcagaagtttgaggttatagtgagctatgatcatgccaccacactccaacctaggcaacagagcaagaccctttaaaaaaaatcaggcctttaagaggtaattaggtcatgagggctcctcacctcgtgaatgggattaagaccctaatgaaagagatttcacccctgtcctttcacaatgtgaaaacacagcattcctcaccaccagaggatatagcaacaagacactatcttggaggcagagagcagcccttattggacaaccaaacctgctggcagcttgatcttggacttcccagtctttagaaccatgagtaaataaatttctcttctttataaattacccagtctatggcattttgttacagcagcacaaacagacttaagacatctatcatttgactatctcattaagtttaggcaagagcataatctcctattatactggcaatggaaatatactgaatcaaagataaaagcaatcatttttaaacattagtattacatgcagtgcaaaaacccaaagtgacggcagtcttacattgccaaagccatcaaaaggggaaggagagggaagaacagcagcataagctgctggcagaggcagggaaagacaagcagaaaggaaagagagaaagagacaaagtcagagagacacaggggaagagacagagagaaaaagagggagtcacagagaaagagagagacaacaaagaagtcaaaaagaaagggagatagaattagtaaagaaaaaagcagtgtaccctattcctttaaaagccagggtaaggttctgtctacccagccaaggtatattcttcttatgtggaatgtctacctatatctgcctccccactaactggaccggcacctgcaccttagtctttccaagttccaacattaacattgccccaggaaatcagaccctatcagtacccctcaaagctcaagtccatcagcacagagccatacaactaatacccctacttaatagggttaggaatggctactgctacaggaaccggaagagccagtttatctacttcattatcctactaccacacactctcaaaggatttttcagacagttttcaagaaataatgaaatctatccttactctacaatcccaaatagactctttagcagcagtgactctccaaaactgccgaggcctagacctcctcactgctgagaaaggaggactctgcaccttcctaggggaagagtgttgtttttacactaatcagccagggatagtacaagatgccacccagcgtttacaggaaaaggcttctgaaatcagacgcctttcaaattcttataccaacctctggagttgggcaacatggcttctcccctttctaggtcccgtggcagccatcttgccgctactcgcctttggaccctatatttttaacctccttgttttgtttcctctagaattgaggccaccaagctacagatggtcttacaaatggaacctcaaatgagttcaactaacaacttctaccgaggacccctggaccgacctgctggcactttcaatggcctagagagctcccctctggaggacactacaactgcagggccccttcaaagcccctatccagcaggaagtagttagagcggtcatcggccaaattcccaacagcagttggggtgtcctgtttagaggggggattgagaggtaacaacgtgctagcagccctcactcactctcagcacctcctcggcctcggtgtccactctggccacgcttgaggagcccttcagcctgccgctgcactgtgggagcccctctctgggctggccaaggccggagccggctccctctgcttgcgggaaggtgtggagggagaagcgtgggcaggaaccaggactgcgcgcagcactcatgggccagcacgagttccgggtgggtgtgggcttgatgggccccgcactcagagtggccagctgatgccgccagccctgggcagtgaagggcttagcacccgggccagcagctgcggaaggggcaccgggtaccccagcactgccggccctcccgcgctgagctcgaattcttgccaggcctcagccacctccccacagggcagggctcaggacctgcagccccccatgccagagccccccccaccaaggtgggctcccgtgcagccggagcctccccaacaggcgctggcccctgctccacggcgtccggtcccataaaccgcccaagggctgaggagtgcaggcgcacagtgcgggactggcaggcagctccacccgtggccctggcatgggattcactaggcgaagccagctgggttcctgtgttgggtggggacttggagaacttttatatctagccaaaggattgtatatgcaccaatcagcactctgtgtctagctcaaggtttgtaaacacaccaaccagcactctgtgtctagctagaggattgtaaatacaccaattagcactctgtctagctcagggattgtaaacgcaccaatcagcaccctatcaaaacagaccaatcagctctctataaaatggaccaatcagttctctgtgaaatgggccaatcagcaggatgtgggtggggtcagataagggaataaaagcaagctgcccaagccagcagtggtaacccgctcggtccccttccacactgtggaagctttgttctttcgctctttgcaataaatgttattgctgctcactctttgggtctgcactgcctttatgagctgtaacactcacctcgaaggtctgcagcttcactcctgaggccagcgagaccatgaacccaccgggaggaatgaacaactccagacacactgctttaagagctgtaacagtcaccgcaacggtctgtagcttcactcctgaagccagcaagaccacgaacccaccagaaggaagaaactccaaacgtgtccgaacatcagagggaacaaactccggacacaccatctttaagaactgtaacactcaccacaagggtccacagcttcattcttaagtcagtgagaccaagaacccaccaattccagacacattaggatatgccttttttttttcagtgacatccaaattctctagcacttcaaaacagtaagcttgttgtatctcatttttgttgtttcctgttcaatgtaagaatttccagccagaaacagtggctcatacctgcaattccagcactttggaaggtcgaggtgaaatgactgcttgaggccaggaattcaaaactagcctgggcaatgtagcaagatcctgtctctacaaaacattttaaaattagccaggcatagtaatgggtgcctgtagtcctagctattgaggaggctgaggcaggagaatcccttgagcccaggagtatgaggttatagtgagctatgactgtgccactgcactccagcctggactacagagcaagaccctgtctcttaaaaaaataaaaaaggaaaaaataattctgtcaaaatttttcctagctctcaatacaaagttttctaaatcttgaggggaggtgaagattctgtatagaatagtctccattttctccaaattcttcctaattttttataatttcaagaataagttacatttcaaattataccacagataatgctaatatggtgataaattatttaatattcttatcatttagagatgcatgctacaagttaagaacatatctaagattaacttcaaaataataaaggatgcagtatatataggggaatatattatgtaagattggccaaggaattaataattgttgaaactgggtgatgaatacatataggttcactttctcaactttgctaaactatgtttaaagttctccctaataaaaagatttttaaagagtaaacaataggtattaaatctaattaaattgttcttagaaataattagacacaaaaaacagtattaattgtaaattatttataacaaaatttagaaggaaattaaatgtccaaacataaaatattaattagttatagaacactcattccatgagataccaagtagccactaaaaatcatgttgcagaaaactcattgatataaaaagaattcacaatatacttctaagagaaaaaaaggcaggttacaaaataatatgtacagaattgaaccattttttaaatgtgagcatctgtgtgtgtatgtgcgtgtttgcatatgtgtgtatttctgccaaatactgacagactttgtttcattcactgctttatccccagcacaaaaaactgtacctggaacataataagaacaatacatacttgttgcaggtaaaggttttagaattccagacaacagggtttcccttggggtatgattctctctacgcttttgtttcatacggtttctcaaataaacattcagttttttctgttattgggggaaaacctttaaaattgtatctcacataacaaaattaaaatttatttgcctgattcaataattacttcatgaaatgcattcaataaaatcatcttatacactgaaaaaagaaaggcctcttctatactttgaatgaataaactggccacggcaatcagaaatagtaaaaacaggccaggcatggtggctcacgcctgtaatcccagcactttgggaggccaaagcaggcagatcacgaggtcaggagatggagaccagcatcctagctaacatggtgaaaccccgtctctactaaaaatacaaaaaattagccgggcatggtaggggacgcctgtagtcccagctactcgggaggctaaggtaggagaatgacatgaacccaggaggcggagcttgcagtgagccaagatcgcgccactgcactccagcctgggcaacagagtgagactctgtttcaaaaaaaaaaaaaaagaaaaaaaaagaaaagaaatagtaaaaacaataacctgttaatcagtcttatccctgtgagtgaattctgctgctgagcaataacataaccttactatctttaggaaactaatacttctaaaatgaatctttaaaacgggtacaaaaaattataaaatcagttttaaaaaattagtccattatattcattcaatacacacttactgaatttgtagacaataagttacctgctagggtaatccaaagaaaattaagttgtagcccttgataaccaagaggctcccaatctagtgggaaagatagatgaataaaagctaaatgaaacataataataaaggtagctgacatttattaggttctttttttggcattgtgctgacacttaacaagcattttctttcttttttttttgagacagagtctcactctgttgcctaggctggagtgcagtggtgcaatcttggctctctgcaacctccgcctcccaggttcaagcaatcctcccaactcagcctcccaagtagctgggattacaggtgtacaccaccacgcctggctaatttttgtatttttagtagagatggggtttcaacattttggtcaggctagtcttgaactcctggcctcaagtgatccgcccacctcggcctcccaaagtgctgggattacaggcgtgagccaccacacctggccaaacaagcattttcttatttaatccctataacaatctttttggtagttactacgatattctcagtttttagataagaaaacgttaagacttaaatgacttcctcagtcacttgagtaataaatggcaaaacagaatcaaaccaaataaaccctgtcccagatacaatatagtgtctctcattattaggatgctagtaaacaccaaagtggactctatcagttccatcagttactatcaagtataacacaatagtcaccttttttaaggtagatatccttttggaagtcttcccaagaatttcttatcttcaactcaactagttatctccactttgaaatacactattacaaccattaacctatgagcctctagagcacaggattcagtagtttctcttctcccagtgctatacaatgtatgcactcaagaaatattaaacagatgaacttttagcttcttttatgcttcctaaattccaaatcactatgccatattacataatagttggtctaggtcaatagcaatttcatttatgttattaggaaaatgtggtatgagagaatcagagaataaaattctgaagtgctaaattatggtggttatgctaatggcggaacactgctgactgtataagatgaaccaagatactcttcctccagggacttcttcctaatcttctaaatgtcctataagccaaattttataagagaactggaaatgtgcaaaactagggggtagttttgtttcttgcaaaaatctggtgataaagatctgagctaaaaatagcgagaatgatgggaaataattcaagagatatttcaaaagcagaatcatttctcactacatgcaagacaaaactcataactaactgcggaacctaagaccttctcagtcatctcatttctgtttcctacagcctagccagagtgaactacttcttaaaggtcctgaattctcacataacattttaaaactcccacaataactgtaatataggccgggcgcggtggctcacgcctgtaatcccagcactttgggaggccgaggcgggcagatcacttgaggtcaggagttccagcctggccaaaatggtgaaaccccgtctccactaaaaatacaaaaattagccaggcatggtggcgggtgcctgtaatcccagctactcgggaggctaaggcaggagaattgcttgaacccaggaggcagagttgcagtgagccaagatcatgccactgcactctagcctgggcgacaagagcaaaactccatctccaaaaaataataataataataataataataactgtaatataaaaagcagatagtgtgcagtcacttgtatgttacataagaaatagacagtagaacacaggaatgggaaaggcattcaaattttgtgttggaaaatgaatgaatgaagataatgcaggagaccttcataactgatttgagaagggactagcagctatctcttcatgatgagataatacaggccctacctctatatcaccattttctcttacaacatgatcttccccttctctctgcctgtcaaaattaaccacctccttaaagacacaatcaaaaattttctctgggaagtttaaagaaatcacctcctcacttctaccactgtccccacccatccacacaagcacacacacatacacaaagaactagtcccactgtctactatggtcccacagcacttggcacctgcctcattgtagtacttagtacagtgattcattattcctttcattattatgtactgtatgagaatatcactagagctagaatatgaattccataaagatatggatcatgtcttatctagcctatttccattaaatacctaccacagaacctcacacactactgtttaaataacatatctaataaataaatgaataaacaaatgaaaacaaatttgctaactcctggagacctaaaggaacctcaaaatgtctgtgacttaaaacatgcctttatgggaaaaaaaaaatatatcttcctatataaacgcttatggctaaccatgacctgcttcaacttaaatcagttttgctaccacagcaataaaaaatacacatatatggctagaagtcgatgcaaaggccaaaagcatccctaccagggctgaaatggccaatggggatattccaaattttatggttgcaaaatgacccaattaatcttagatttcagcaaagtatacatgctaactgaacaaagacaaaagtcactggagctcaagtcattattccaagtgactctaagctgttagtccctgtgttaatggagcctgttaaacaacccagtattagaaaacactggagctcagagggagcatgctaccccatgcacatttcccaagtatcctcacaataaacttctattactgaagataatctatgtacttctctaccttgagtcttaagagacctaagtaacagtaaataatataggaaaccaagcagaggaaagaatcacacaccaaatgtgaactggaaaaagtgacaacgccaattagtaaagattaggtgggctgaacacggtaagattaggtgggctgagcacggtggctcacgcctgtaatcccaacactttgggaggccaaggcaggcggatcacaaggtcaggagatcgaaaccatcctggctaacacagcgaaaccccgtctctactagaaatacaaaaatttagccaggcgtggtggcgggcacctgtagtcccagccacttgggaggctgaggcaggaaaatgccgcaaacccaggaggtagagcttgcagtgagccaagatcgtgccactgcactccagcctgggcgacaagcgagactccgtctcaaaaaaaaaaaaaaaaaaaggattaggtagaaggtgaggattcagttctgaacataatgcctttaaggagacagtaatcaaatatttgggtttttggttttgggggtttctgttttgttttggagacagagtctcattctgttgcccaggctggagtgcaatggcatgatcttggctcactgcaacatctgcctcctgagtccaaacaattcttgtgccccagcctcccgaggagctgggattacagaagcacactaccatgctcggttaattttttgtatttttagtagggatggggtttcgccatgttggccaggctggtctcaaactcctggcctcaagagatccagccacctctggctcccaaagtactgggattacaggtgtgagccactgtacccgaccagtaatcaaatgttatttaggagactggaaatagtgaataagactgagtacaaaaattccaagtctcaaaagtatttgtgggtcatttcaatcaaattgaagccattagagtagataaactcaccaaggaaataactatgcaaaataaataaataaaggaggaaaagatagaaaatgcaaagtcactgtcaattatgcactgtgaagatcagttcataaccgaacataaagcaggcagagaaacagaggcaacaggagaatcaaaatgccagagaaaacttcaagaaacagatatgaggaatgttaagaacagagaaaaagtttctggtcttgccaaaacaataactaatttgcaacctagagtagtttcattaataaacaaggcctgaccatgttggaaggctgaaacagaatacactcgtagaaacagatttttaaactggggggcaaaagtgtgattacaggaataaagtcctaagagctatgaaaagggacatgttcaaaggtcagataaaaggaagaagagaaaaaattgtcgtgtgacagaagcaaaaattatgtagaacaataatcaaatgaaattaagatgaaagtacataaggcagcacctcttcctaacagccactgtatttcaatcttctctaagaagtagcagaaagcatctgtgttaaattatatgaaaacatgagggcaggacaggaaagaaagtgtgaagtgagaggactggagctgtttctgaaaagtctgcaaacaccaaaacacatgaaacagctcagtcagtcataaaaggccttacggcagaaaaaatgaagggactatatttggtcctctttctttattttctctgtttccaaccttggaacagcagtttgcaagtttgtggacaggttgtaacttctgctaaggatgtctcttcagttttgaagagactcaggaaaagttcagaagaaaggagagagctgtttatgattggctaaaggcttttttttattattgtggcagaatatacacaacataaagtttactattttaacatgtacaattcagtgatccatacattcagctcttgtgcaacaattactgttatccatttcccaaactttttcatcatctataatatggtgatctagtaagaaattcctggcacactgcccctaaaacctttggaatttcccgaatgataagggtggaagaattatcttttgctattcataataagtccctttcaaacatatttgagcttatgctaaagagatgactcttggtaggcccctacaaagctgcaggggagtgggtagggaagctggtcacccaagaaatcaatcatgtgattacatagtcagaactttcagccccacctccagggaggggagaaggactagagactgacctaatcaccaatgaccaataatttaatcaatcatgcctacagggtgaagcctccataaaaaccctaaatgatgggactcagagaatttcttctggatcgatgaacacatccacgtgctgaaagagtgatgcaccccaactccatggagacataagctcctgcactggggacccttccagacctcaccctatgtgccttttcatctgtatatcctttataataaactggtaatagtaagtaaagtgtttccctgcattcaatgaatcattgtagccaatgactgaacttgatttgtagccaagtcagaagtaccagaggcctggggcttgcaactggcatctgaagtggtggaagtcttatacaactcagtccttaacctgtggtgtctgacactcactccagggagatagtatcaaaattgaattaaatgctaggacagagaactgagagctgtagggagaaaaccccatgtatttggtgtcagaagtcttataagtgtagaaaaagttttttatcatctccaaccaaaattctatacccattaaataactttccattttccacttccccatagtcccgtgtaaccactattctactttctgtttctatgactttgactattctagtggaatcatacaaatttgtccttttgtgtgtactttgcttcagttagcataatgttttcaaggttcatccatgttgtaacatgtatcagaattttatccctttttaaggctgaataatattccattgtatatatatataccacattttgtttatccattcatccgctggtggacacgtgagttgcttccacctttgggctgttgtacataatgctgctatgaatataggcacacaaatatcttgagaccctgctttcaattcttttgggtattgcattaatccgttctggcgctgctataaagaaatacctgagactcggtaatgcataaagaaaagaggtttaattggctcatggttctgcaggctatacaggaagcatagcagcttctgctctgcttttggggaagcctcaggaagcttccaaccatggtggaaggcaaagggggagtagcacttcacatggccacgtggccagagcaggaggaagagagagagatggggaggtgctacacacttagaaacaaccagatctcgtgagaaccctatcacaagaccagcactgtgggatggtgctaaaccattcatgagaaactgctctcatgatccaatcacctcccaccaggtcccacctccaacactggagattacaatttgacatgagatttgggcagggatacagatccaaagcatatcaggtatatacccagaagtggaattactgagtcacagggtaattctatgtttataatttcttgaggaattgctacactgtttcccacagtgggtgcactatttcactctcctaccagcaatgcacaagggctccaattgctccacatcctcaccaacacctgtgattttctgctgtttttttttttaataatagtcatcctaaagactatgaggtggcatctcattgtagtttccattgcatttccctgattactagtgatgtcaagcatcttttcatgtgcttattggccaatgtatacattttctttggagaaatctctaagttccttgcccactttttatttgggttatttgttttggagaaaagcttttaaagagagacacagaggaaagctttctgtacaatcagatctagctctctagtcaaaaataattggtgatatagtttgcatgtttgtcccctccaaatctcatgttgaaatgtgattcccaatgatggaggtggggcctagtaggaagtgtttgggtcatgggggaggatccttcatgaatggcttggtgttgtccctggcgatgagtgagttctcactctattaattcacaagaaagctggctgtttaaagagcctggcacctcctcttctctcttggtccctctctcttcccatgtgacacacctgctcccccatgccttctgccatgaataaaatcttcctgaagtgtcaccagaaactaagctgatgctgctgccatgcttgtacaacctgcagaaccatgggccaagtaaatctttcttcattaattacccagtctcaggcattcctttatactagcaacacaaaacagactaatacaattggtatctgccctctagatcttttaggaaactaatcatggagaagaggcactggcaagagtgctaacccagcagaagagaaaaaacttccacccctgagaacagagatttctttttcataaagtgccttctacctgatttcagctctgtaactgtcaatctctttttctcttctggcagatttccctatccactagagcataggttttaatgaccacactgctggtagctgtatcactactaatagtagctacttaatgagtcataagtgttactgctatgtgctaggcatgatccttcatctcatatgtgaaatctcatttaaaattaagtcctactaatgatgccgagaagattatcatggttcttacacaaggatgatatgcaaattcattaagtgttccatttaagaaaagaaaaaagaaaaaaaaaaaaaacctcttgtaccctagcagtttcatcttgaatactgttaaaaaaaaaaaaaaatacatctttaaaacacatgaaaggttttcatcctttagtccttcaatgtaacattattaaacgatgtcaaaaagtctcaaagttagcgttaaataacaagcattttctaaattatacattgaggagtctgatcttgaatccacaaaataaaacatcttttctacatcaactacaggaagtacatttttacctcaaactagtaaaatgaaaggttttgttgttgttttttgagacgaagtcttggtctgtcacccaggctggagtgcagtggcactgcagcctccgcctcccaagttcaagcaattctcctgcctcagcctcccaagtagctgggattataggtatgggacaccatacccagctaatttttgtatttgtagtagagacagggtttcaccatgttggccaggctgttctcgaacttctgatctcaagtgatctggccacctcaacctaccaaagtggtgggattacaggggtgagccaccatgcctggccattttttttttcaatcctgctcccttttgccttttaaaagctcaacattttataaatatttagcaaatgtttagctctgaagtaataaagttgatttttcttaaaaaattcaactagaactagaagtgaacatcgtctttttatactcttagaaagttatgtgtttctcatgaaaaaatgttcaccatcactggccatcagagaaatgcaaatcaaaaccacaatgtgataccatctcacaccagtttgaatggcaatcattaaaaagtcaggaaacaacaggtgctggagaggaagtggagaaataagaaaacttttacactgttggtgggactataaactagttcaaccattgtggaagactgtgtggcaattcctcaaggatctagaactagaagtaccatttgacccagccatcccattactgggtatatacccaaaggtttataaatcatgctgctataaagacatgcacacatatgtttactgtggcacaattcacaatagcgaagacttggaaccaacccagatgtccatcaatgacagactggattaagaaaatgtggcacatatacaccatggaatactatgcagccataaaaaagggtgagtttatgtcctttgtagggacatggatgaagctggaaaacaccattctgagcaaactatcacaaggacagaaaagcaaacaccgcatgttctcactcataggtgggaattgaacaatgagaacacttggacactgggtggggaacatcacacaccagggcctgttgtagggtggggggagtgaggagggatagcattaggagatatacctaatgtaaatgacaagttaatgggtgcagcataccaacatggcacatgtatacatatgtaacaaacctgcacgttgtgcacatgtaccctagaacttaaagcacaataaaaaaaaaaaaaagaaagtgatgtgtttcttcaaaagatgctgacgacgtcagacacactttttaaacagtttggaagctgtcttcagagacaaatgctttacaatcaatatttcatttaatcttcacaaaactcaaggagaaggtagtatataacttccattttacgagtaaattcagacagaaaagctaaataacttgcccaccactgcatttcagtaaatggcagagctgagattagagccaacatctatcggactctaaagcaccagctcttaattgcttcactttctatcattgttttgatagcaaaatagatgtaatctgatgatctcatagtgtatttacttttataaaacagtattaaatttatgggggtttaattaattattggcaccataaagacctgaaaccacctaagaaaataaatgctctgcaatagacagaagagcttttttaattatatgaaagtcttgtttttcaactctatcataccatttcctcttaagttgggctctttgcccaaaagtactctaaaattataattttctggcaaggagttttaaaagaagctgaaattttctcttcttccttcacccttggactctaatttttattatctaagaattttctccacttatcataaactggaaagtgatatgatttctttacatttcttgtaacaaacctatacaaaattaacaaacactgcaacatactccctatccctaagacatgttattacattcgctttcttaattactaattactcaaaaatcacaaattcagaaaatatagacaaatttgaaaatgctctaacatattcacgtcctattaaaataaatttgaaaattccctaacatattcatgttctagtaaaataaaaattaaaaataattttattagaaatatggacacctataaggctcatacattttaatccagttcgttgtaagtattctgaaataaccatacctagatttgagaactaaaaaaggcaactgaatctttaattgatttttttcttctttttgagacggagtctcactctgtcgcccaggcaggagtgcagtggcatgatctcagttcactgcaacctccacctcctgggttgaagcaattctgcctcagcctcccgagtagctgggactacaggtatctgccaccatacctggctaattttttttgtatttttagtagagacagggtttcaccatgttggtcaggctggtctcgaactcctgacctcaggtgatccacctgcctcaacctcccaaagttctgggattacagccgtgagccaccgcgcccagcattttttttttttttttttgtcacccaagcgcagtccaagctggaatgaagtggtataattacaagtcactgcagcacaacctcctaggctcaagcaatcctccaacctcagcctcccaagtcactgggacaaaggcatgcgccaccacgcccagctaattttttgtttgttgtagagacagggtctcaccaggtcacccaagctggagtgcagtggtacaatcacagcctgctgcagccacaaccccccaggctcaggcaatccttccacatcagcctcccatgtagatgggactacaagcgtgaaacaccacacctggcaaattttttttatttttagtttactttagtttgagacagggtctcactctgtagcccaggctggggtgcggtggcatgatcatcgctcactggaacctcaacgtcccaggctcaggtgatgctcccacctcagcctcctggctgtgaccacaggtgtgcaccaccatgcccagctaatttttgtatttttttgtagaaaccaggttttgccatgttgcccaggctggtcttgaactcctagactaaagcaatctgcctgcctcggcctcccaggtgctgggattagtgcatgagctactgcacccagcctaaaatctgctcttatcaacagtggtgttatttgtcttggattattttattttctatctttttcatttaaaatgacactaggtcatctgaaatatttagtggtgagaaaaaagtaagactgggtattaggattatagtgggtcaaagagcaaccagagcaaataggaagaacataaagataaaagtctgctctgaatagtctatatcacgtaatttgaatttatatatgcccaatttctgactcaaacttagaaaataaatgtgtagtggagagactatccagagaaaagagctcaaaaccaccagtgtcatcacttttggcagaatatccatagtttgaaagaaaaaatcagttatcctatctatgaataaaatgctattaaaaataacaggatattagttattaggatattagtctccaggttaggatcttgaaatatcatttcttactaagagaaaccacggctttttggagaaatggatgattccagatctaggacaagaagtatacaagatgggccccaaatatcacagcagacaacaaggaaactatcaaaaaccactagggtcatgttatctcctgaagagactcccactaaccaaaggtgagacaatttgcgcttcagtgaaagtgattccaatggattaaatccatcaagtatgtttaaatccatcttctcataatggcatttaaaagaaaaaaaaatggccacctttggagaaagacagggaactaattcgttatcttgaaaacttgtaaataaaaggaaagaatcaaacatttatcctgtctttcctttatcaacagtaccactgggtaactaaacagaagatgaggggaagttactttttataaaaacattccaattaataaatgaaagcaaaatgatgtatttagaatttcattatattgcaacacccactaaccatccacagccgctaacatcacaaaaaagaaagacaattagacattatgatattcccatggtcttgccaaaccccatctatatatatatatatatcacaatgcctaagggatcgaacttgagtctgctccatctctggatccagctgcacgtttgcagaaaatacagaagacaaaggaacatgttgaactgacctatattaagcaatcagcaaaatccaactctgggaaactagtacaaacaacctgggttctccaacaggaaaaggaaaaggatggaggactaaactaaagattaaaagtgacaactcatatcaaaactgctttttgggctgggtgctgtagctcatgcctataatcccaacacttggggaggccaaggcaagaccacttgagcccaggagttcaagaccagcctaagcaacatggcaagaccccatgtctacaaatacacaaattacctgggcatggtggccaatgcctatagtcccagctcctcagaaggctgaggcaggaggatcccttgagcccaggagggtcaggctgtagtgagctgagattgcactactgcactccagcctcagtgacagggcaagatcctgtctcaaaaaacaaacaaacaaacaaacaaacaaaacacaacctagagacagtgtttccctcttgttgcccaggctagagtgcaatggtgcaatctcagctcactgcaacctccacctcctgggttcaagggattctcctgcctcagcctcccgagtagctgggattacaggtgcctgccaccatgcctagctaatttttgtatttttagtagagatggggttttgccatgttggtcaggctggtcttgatctcctgacctcaggtgatctacccacctcggcctcccacagtgctgggattacaggtgtgagccaccgtgtctggccaaaacttactatttcttaatcatcaagactaacctacagtatctagcaatgcacatttgggttattactacacaagtcaggaaaatgattacttatagggaaaggccactgtgatctatttctcaacctgaggggtgattacaaaggtatctgccttataataattcaccaagccatacatgtgttctgtactaatgttttattttgcaataaaaagattttttttaaaatagcaggttaccagcacacctgaacatgtcaacacctaaaaacggctagatatgttttccattctctactctaactgagtgaaaacaataggataaaaatagaaatcaggccgggcatggcggctcatgcctttaatcccagcactttgggaagccgaggtgggtggatcacctgaggtcagtagttcgagaccagacaggccaatatggtgaaaccccatctctactaaaaatacaaaaattagctgggtgtggtggcacacgcccgtagtcccagcggcttgggaggctgaggcaggagaattgcttgaacctataaggcggaggttgcagtgagccaagattgcaccattgcattccagcctgggcgacagagcaagactccatctcaaaaaaaaaaaaaaaatagaaatcagtgtgcatcatttcctccctacccacttcctcttctaaaggaaccacttaatatcacattttaggccaatcagattcactttcttgggattatgaaattccaagaaagagactatagatatccaaacctgttctcccggtctttcctcattccccaagttgtttcaattcaaaacataggagccaggattgattctttttttcccctcattccccacatctagtctatcagcaagtccttcatttataactccaaaatatcgcaaatctctcaacttctatctccactgactctaccatctcaaatcacaaactattcaaatagtttcctaacttgtttctcttttattcttaaccctctacaatctactctacccaaagcagccaaaaggatgttttaaaaacataaactgcttaaaaacctttaatgacagcacacagagctctgacttaaatccaaattcctttccatggccggcatcattgaatccgtgcccatctctctgagctcatctctagccactgtcctcttctccaatccaggcacactggtgtcatttcaattcctcccacacattaagctctttcccacctccaggccttctcatagctttcccccctgcctggaatacttttcccttgctactcacatggataacttctcaatgtcaggttacaacttaaatatcaccttctcagagaagcctctgccaactgccctattaagcaggtttcaccatctttctctacacactacttatatctttcatagctcaagctacaacaagagtgtatgttatatgagggcaaagaacccacctgtttcattcaccaatgagcatctggaatgtggaaaacaattaataattactgaatgtatgaataaatgaggaaatgaatgaagtaaaggccgaatgccaattttgccatgagtagtgatcagtaagtaaagaaagccagttttcagaaagaacagagcaacacaacagagaacaggagactatgtggcttggttccataaacagagtcaagaaaattagctgccaattataaattataaatgtgtgtgtgtgtgtgtgtgtgtgtgtgtgtgtgtatcaagatagcagaaacatctgaaaaatttactcaattcacctctatactaagatgtctggtattatataaatctataaactaattcagaactcaaaataatactacctaaactaattatcattaatgttaacactttgtaattctcattttgctatgagtcatttttcaagatatactcctatgatgtactttcagaaattcaaggtaatcttcatgtcgatattcacggtatgtatgcaaacaatgaattttttttgttgtttttttgagacggagtctctgtcgcccaggctggagttcggtggcgcaatctcggctcactgcaagctccgcctcccaagttcacacgattctcctgcctcagcctcccaagtagctgggactacagatgcccgccaccatgcccggctaattttttgtattttgtttagtagagacagggtttcaccatgttagccaggatggtctcgatctcctgacctcatgatctgcccacctcagcctcccaaagtgctgggattacaggcgtgagccaccgtgcccagcccaatgaacgtttttgagacagggtcttgctctgttgcccaggatggaatgcatccacacaatcatggctcattgcagcctcaatctcctgagctcaagcaattgtcccacctctacctcccatttatgtaaatgtgtgggtctgtactgagtctcagtatcaatgaatttttttttttaaatgttgaaagccagtaatatatgatggcctgaagtgttcctagagtcaactaaagactgagtttctctagttgacatgcaacagaagtttgtttaccggaagtattgcaaattttattgtcgcactccctctctccaagaaggaagagccaactgactattcccatcagcacggcctaaagcaatcctaatcaagttaatgccaccctaaattaaccaagaaaagccaaagggaagacagcagatgctttagggaccaagttgttaattcagagatgctcctgtttggttggttcttttccccttggactaactactttgaatattttgtccacttgcctacctctagaattggaaattttccctagggccttcctctgagtctgctggggtttttttaagagttcttagagttcatcttctcaaagacaactccagctctctatttagtcaatctctctgatatacacacaattttactttccaacattccaaggaaacataaattagaaatatacacataaaatgacatccacccctcttctccctgcaataatatctttgtgatattcctactatctacttaactggtgtgttgctttctctcacccacttccattcataagcgctgagagttatctgctatctctctccattcctaattcctggcctgagatccgggctacagatgctacaagttgatgtgggctcttcatgctgaagaattcatgagtactttctgcttaactcctctatattctcaacccgatccctttgctttttctttccataataatctgttttctgatgggtaatccatccaaacactcatttgcccttatgaaattagtgttttctagctttccatttgcgtgaaggacccctaacatatgacttcaaccttcaattttatttcccccaaactaccctttcacactattaaaaataataataaaaaattgccacagaatccaactatagcttaaattaaagaactcacctgtcttgagagtaagtatgcttcaatagcttattcttttactatccttttagtgttttcattgttcaatgctaacctgccctccaaccataccttaatcaacgaattacacattttaaataactactaacactataacctatttgaggaacaagcctatctggtaaagtgtctcactccagcagtgatattctgtcctctctttgacaagtattaaatatattttcatgctgcccacctgtctatcatagagacccacctcccttctatgaaggttccacctggtgaagagcccatgttttctggtcatttacctttctacctatcaaagctggactattatgtggtcatttttctctcagctagcagttcccctataaaaaatccaataaattcggctgcgcggtaactcaagcctgtaatcccagcactttgggaggccaaggcgggtggatcacgaggtcatgagatcgagaccatcctggctaacacggtaaaaccccatctctactaaaaatacaaaaaagttaacctggtgtggtggcaggcgcctgcagtcccagctactcaggagggtgaggcaggataatggcgtgaacctgggaggcggagctcgcagtgagccgagattgtgccactgcactccagcctgggcaacagagcaagattccacctcaaaaaaaataataaaataataaaataaatccaacaaattccatctaaccaaaatgctaattaatgatcatttaataaaggagtccccaactcctttacagcacaatacagtggaccagtactggtccatggcctgttaggaaccaggcaacacagcaggaggtgagctatacgcgagcattaccgcccttgctctgggctccagctcctgtcagatcatcagtagcattagattctcataggagtgcgaaccctattgtgctgtgcatgcaaggaatctaggttgcacgctccttatgataatctaactattgcctgatgatctgaggtggaagtttcatcctgaaaccatttcgcccccaaccaaaccatctgtgcaaaaattgtttcccacgagactggtccctggtgccaaaatggttggggatctatgatttaatgaatttcccttcccagagggaaatccttttaataacgactttggccagcttgggcaacatggcaagacctcatctctacaaattaaaaaaaaaaaaaattaggtatggtggtgcgtgcttgtggtcccagctaatcagggaggctgaggtgagaggatcacctgagcacagggaggtcaaggctgcagtgagccatgattgtgccactgcactccagccagggcgatagagtaagacccaatctcaaaaaaaaaaaaaaagttaaaaagaaaaaaaaggacttctgaagacctcagtgacaagtatgttaacgaaatctaaggaatctaaaaactactctggtacctcaagttggtgacatgggtgaccacatctattgcctatgtttaacacaaaccttgttaaggagaccaaatcaatgaatatgagggtgagaggtgccttaaaaatcatctaggtctctgagtcatgattcttgaactgggctacacactggaatctccaactcccagaggagaagaagatgcccaaagaagcaaatttcaaagtcagtgacaaggccaggcctaatacccatgcctaacattatgtgttgatatgtgtacatacatacatatatatatacacacacatacatacacacacacacatacacacacacatatatatgtaacatactaaaaatataaaggcatgtatgggaaggacaaatatccaattcatgtcagtgattaccttttgggggatgggaagggagtgtaattgagaagaaatacacatggtggcttcaaatgtattggtaatatttttattaatatttcttaaactggatggtaatacctaagtatctattaaattaggctctgttcttttttctttttgttttgtttttatttttatttttgtttctttgagacagggtctcactttgtcatccaggatagagtgcagtggcacaatcatagctcactgaaacctcccactgctgggctcaagcaatcctcccacctcagccccacaaagtgctgagattacaaggcgtgcaccatcgcagtaggccctcattatcttctggatatctaaaattttgtaataaaatagaataaaaagatggtatataatcaaatgtatatcacattaggaattcagtgaaatatctcaggctagaaagtactcagaaaacatacttgatgaggtaggctttgatggaagaataaaacatagattattcttcaggcaaaaagtaacacaaacttttctaaaggaaaaatgtgaataaaggtaaagctgggagtacccacagcctataacataaataaagaacaacgggggccaggcacggtggttcatgcctgtaatcccagcactttaggtggccgaggcaggtggatcatctgaggtctggagttggagaccagcctggccaacatggcgaaacgttgtctctactaaaacacaaaaatgagctgggcgtggtggcgcccgcctgtaatcccagcctctcaggaggctgagggacgagaatcgcttgaatcaggatgccagaggttgcagtgagccgagattgtacccctccatctcaaaacaaaacaaaatagttttgaaaaccactggactaaagcgtccagctagaaggtactgctgcaattcaaaagtgagggtcataaaaccatggaatgggttttatggggtagtactcttgagaaagaaaacagaaaaaattaatccaccaactttttaatagaaaatttgataggctatagtgacaaactagatgggataatgaaagagtaagacctacctgaaaaaataaaaaatgccaactgagcagcagcttctagtcatacttgaacatcaacgacatcgataaggccatgtaaaagtcagcactaaggaagtgttattcaaggcagaaaagcaaaatggcacttttataaggattaagagcagaataagcaacagagaccaggagattacagaaaaagaggaccactacatcatggaatgataagaaagagagtttcaaaaagagccatcactgtatacaacaagagggtgcacagcctttgtagccaatcagatgcagaattctggcactttctccacttgaccaagttatttaacgtctttgagcctcatataataaggaaaacataagttaacaactaacactgttgaacacataggggcttcaaatatatttgtcaaattttatttcttaagctcagtcgtgatacataaatatttattaaattagtccccattatcttttgttgtttttgttttgtttttgtttttttgagacagggtctcgctctgtcccaagtgctttacatatcacctcatttaatccccacaatacatttcacagatgaagaaattaaacttagaactagcataataagtagcagagccaggattactatttcttaggatttaaataatgtatacttaaatttcctggcaaacaggatgacctcaaaacgagtagctatatttcattattaggagataataatcaataggggcaaaactgccagtaattcctgtcatagccttccatgtggcaaactctctcaacatcctcatctataaattaggattaatgcctataatccaatctactccatagggttgctgtgaggattaaatattatgaatatgaaaattctataaaaaatgttgagacattcaaatatcagggattgctgtcacatatctttcgccttcaaaaatgcttttgcggcatttttgttcactacttcaaaataagactctgaataagctaaaaataagtctgttaaaagtgcaaccaccactttgaaaagtataaatcaccacagaattgctgcctacacctgcccctgactcctccaggttctctaatgtctccacaagggcaaggattctcttacacctataatgaaactctgataacttacagtacagctaatcaatagagagctgcacttcaattcagagttgttcaaactggactactgtgttttctcagaggtgctccttccagttcttccagaaaagaaaaaagtgcccaattctcttatattgtattaaaacggtgcccaatgagtagaatgcaggtaacttacaaaatgctagaaaagaatctatcaattgacttgctcaagtgctctgacagcaggtcccttttggaaactccttcacgaccccccctttttttcacctgaacagatggcttccaggcttcaaggctcacatgtctagtcacacaattcacaatagctcccaaagttcctaacttttcaattatcccatgttcttgaacacacctttcatctaaagatctctagctgtcaaagcatacgaactctttaatcttcacaacagcactatctgagagattactatccttattttataagttaaaaatgaaagactgaggttaaatattttagcaacatcaaacaattcgttaattcattcttggggagagaggaatacatattatgaacttctgtcaatggacaacctagatttggcttcctaagatcattgcaaatattagctcaaacacatcccactcttgtatgcatacatttccaacacaggtgtcaaagattaaatataaactattaataacagtaaataccataccaaagcagcactatttttacacgcaaaactatattgggggagggggttctaatttaaacttcccactgtcttgcatccataaatacttttgaacttgagggggaagggggaagaacacctgtcagagcagcacatccacaatgttttacagactgtgtagctattaatatttaattcctcccgccccgggaggtcaggccgcagggagcccggcgctgcccacccgactttccacgcgccaggcctgccggccgcaggggaggctccggctcccgctcccctcaggtcccctcgcccgtggacagacgcggcgggacactcggacccgcctcccgacctcagcgcgcccggctcggggcccggcgggcggggagaggctcgcagcagggcctggcctagccacccccgccccgcggccgccggcgccgcttccctccttcttcccgctccccgattcgttacctcttaggcgccggcggctgctccatggcggccggggacagagagagggacctggtggacggcgaaggccgaaaggaggaaaggagccggggcaccggccggccgagcctagggcaccacagagggaaactctgggaactcggaccaactttcccgt

SEQ ID NO: 252 - DNA, 371051 bp, Homo sapiens
  source 1..371051: mol_type = genomic DNA
tatgctgggtggcacagtgaaatttatttgtctttatgatttacacataataattaaacacacaaaagaaaaaacactgtcaagatggccatatgtagcttaggaaatgactggtcccaatgcaatcatataaatgttcattcagcgtaaaaatgagtttctttttaatggttttaatcttttttttttcagtccccaaggcttgtaccactcagtacaaatgtttttgctactgggttatcatcaggaacatgatgtttaccaattcccaggaaatgaataaaatcaacagaaacatcctgtgacaacagagcacattttcatagaaatgaaattgatgagcttattacagtttgaatcagttcagctattagatctacacataaaacatgaaacaatattaacaaattacatttgtattaagtttttatttaaaaatatttatcacacttttttgtgcaagggttccattgatttctttggttttaaacacgatagatctattttacctaaatatatatagttctatttgtaccaaacatcaaaaatcaaaaaaacaaaatttcaaagggtaaaaatggaattattgcttcaatataaaaaaggcctagcccatttgagaactactgccattattgctttcctatttgaaaaactatcctggaaatcaaggaatgtaccccatagctccctgcagaaagtataaattggttgcacattatcatcatattaatatgaccctaccttcaccaaagctatcctgatcttgtccttaaaaaatgaaacaaagcaaaatagcataaataaataagtttacctaaggggatacaataaatagcctagtatactagataggaataaagaatattgtaacataaagcccttcagtgctgtacaatgcaacaatagctttggattttcaaggtttagagaccttgaaaatccatttcataacagttttattactggtatgcagctgacagaacaagagaatacacttcttttgttctcctcatcttagagtgaatgcacagcagatacaactgtcaattctgccttttgggaatttacctgggcatgtaccattgtcactttttgacctctgcctaattgtagggcaaaatcttaggattaaaaatatccaaatattccttcaattcctagtggtttcttggtctccagaatagttaaaaacagagaggaaattagactcaaaagttttgctgccttcttttctttgcatccatcgcatccagaatgggctgtcttttcgcagtgtatctctgacgaagttcttctatctcccgttccatcatggggtccagtgcttttaaccgcatctgtagttcttctaaacttagatttttcaactagatacagaaagaaagataccaatacaatgaaattatccacattatccacaatcaatacaatgaaattagactttaatgtctaatgagttttaacataaatatttcagcaaattctttacatcatctttgaagtatagttcaacaattaaaacaggaatttcttccttgaagaactcagaggtcatatcttgcaagaacctccagtaatctgcaatgaagcaatccgatcctctgcctttaataaagggcaaatgagaaaaatacgctgatggaatttgtaaaaaggtacaaagacaaatccaccactgccaacaaacagattttcagaatatgttccaggtatattcactctaactttttacatctttgccagctactgagtgctacaataatcatgaacacttgcagagatcactcaagaatgtgacaagactgaataaaggttaaattaaccattctatcctccattttactaaatgcttaataaagaagatgactgtggtagggggcgggaagtaaggctgaataggcctggtggggccccaaaagcaggaagccatgatcaattctggagtaggacagttatgtaagagtaatccagatttggttttcttttcttcttcttcttcttcttattttttttgacacaaggtctcaaacttctgggctcaagagatcctcctgccttgacctcctcagtagctgggatgtgccactgcacccagctcaggcttggttttaaaatgataaaacttgcaacttactttttgttttaagaagataattgcctttggttattttatgagtcaagctaggaaaaatactcattacttatagtcatccaaagtagcatttctcagcagatccttttactcgccatccctggccctatcgtgacttctgcttccaaaaaccaaattcactcttagctgaaaaagactctgaggatactgaaaagaatgagtcatagactctctgaaggaaattcaaaaaaggagttccaaaaatattttgagaaatgacagtgttatggagaagagtatgcaggcttccatgatgatgactttgaaggtgaatgccactcacttcggtgcataagaagttctggtatgtatattaataatcagccctgttattttgtagtcatatgtcatgaaagaacctagcttttaatattatgccataaaacatacatttatatatcatatgtagtattatacactttcttcattgatttttaatccaagtagtgatcttgcatctgttacatgctcagtgctgttcaaatcactgtggagatacagaataagacaaacagggaaactccaaactttgaactgtacacatcggtaatggccacattgaaaggccaatgtataccacacaaccacatttcccaagaaagacatgcccaactatgtctatgtaggatccagttccacttctgtgttcttcaacatcatctctatttcagcccatgttaatctttcccatttctaaatttctatgtaacactcataatttaaacaacacaatttagtatttgattctaaatcatgtactattttataattgatttttatgcatgagtttcatgtccctagatattccaaaaaatacttagactttagagactgtacatacaccaagaaactatcctactatactgcaaataacatgacgtaaacgtagatagataaatatgaataagaatatatgacccaaaggagtgggttactctaagatcagaagaactaacatattatataaagcaaacaattatcattactttaattctgaattaagatattcctgtaaatatcttgtactacttttactggggcaaactgccaataggtttataaatattgtattgcagtaatagactgaactcagaaaaagaagctacttagaagaaaaattttcttcctttaacagatttttatattatcaatgcgtaaaatttgtgaaaaacaggtctgtgatattagagaaacattatctaacattattaaggaattaggtgttcatgtaagtaaattaatgaagtacctaaatcttagttctttaagtgataaaactttgtctcaatatcacatacacacacatatacacacacacacacacacacatgtgcacacacacatgtatttacatatgctcttttttggttctatgtgacttttaggatttttttctaattttgtgaaaaatgatgttggtattttgataggaaatgcactgaatctgtagactgctttgggcagtaaggtctttttcataatattgattcttccaatccatgagcatgggatgtatttccatttgtgtcatgcatgatttctttcaacagtgttttgtagttctccctgtagggatcttttaccttcttggctaagtatattcctaggtaatttattgctattactattattattattaattattttacagctattgtaaaaggggttgagttcttgatttgattctcagcttggtcactgttggtatataatagtgctactgatttgtaccactgattttgtaacctaagactttactgatatggtttggctgtgtccccacccaaatctcatcatgaattgtaatcctcataatccccatgtgtctagggagacacctggtgggaggtgattggatcatgggggcagtttccctccatgctgttctagtgatagtgagtgagttctcacaatatctgatggttttataaggggcccttccttcttcaatctcactctgctctcccctctcaccacgtgagaaggtccaggcttgcttcaccttcaccttccaccatgattgtaaatttcctgaggcctccccagtcacatggaactgtgaatcaatacacctctttcctttgtaaattacccagtcttgggtatttctttatagtagtgtgaaaatggactaacacagttaactggcactgaggtagtggggcgctgctataaagatacttgaaatgtggaagcaactttggaactgggtaatgggcagaggttggaatagtttggagggctcagaagaagttaagaagatgtgggaaagtttggaacttcctagagacttgttgaatggttttggccaaaatgctgttagtgatatggacaatgaagccgtggctgaagtggtctcagacgaacatgagaaactcactggcaactggagcaaagatcactcttgctatgctttagcaaagggactggtggcattttgcccctgccctagagatctgtgaaactttgaacttgaaagagatgatagggtatctgggggaataaatttctaagcagcaaagtgttcaagatgtgacatgggtgctcttaaaagcattcagttttatggattcacaaatagatggtttgaaattggaacttatgtttaaaagggaagcagagcataaaagtttggaaaatttgcagcctgatgatgtgatggaaaagaaaaacctgttttctgggggagaaattcgagcctgcagcagaaatctgcgttaagtaataaggagccgagacaatggggaaaatgtctccagggcatgtcagagatcttgccagcagccccatttcatcacaggcatggaggcctaggaggaaaattagtttcatgggccaggcccaggggccctgctactctgtgcagccttgagacatggcaccctgcatcccagccatttcagttccagtcatggctaaaaggggccaaggtacagctcgggccatggcttcagctcaagccttggtggcttccacatggtgttgggcctgcgagtgcacagaagtcaagaattgaggcttgggaacctctacctagacttcagaggatgtaatggaaatgactggatgtccagtcagaagtttgctgcaggagcagagccctcaaagagaacttctggtagggcagtgtggaagggaaatgtggggttggagaccccataaagagtccccactggggtgctccctagtggagctgtgagaagacagccactctcctccagaacacagaatggtagatccattgacagcttgcaccatatgcctggaaaagctgcagacactcaataccagcctgtgaaagcagctgagaggagggctgtaacctgcaaagccacaggggtagtgctacccaagaccatgggagcccacctcttgcatcaatgtgacccggatgtgagacatggagtcaaaggagatcattttggaactttaaaatttaatggctaccctgctgggtttcagatttgcatggggcctttagcccctttgttttggccaatttctcccatttggaataagagcatttatccaatgcctgtacccccattgtgtcttggaagtcactaacttgcttttgattttataggctcttaggtggaagggacttgccttgtctcagattagactttggacttggacttttgggttaatgctggaatgagttaacacgttggggaactattgaaaaggcatgattgtattttgaaacgtaaggacatgagatttgggaggagccaggggcagaatgatatggtttggctgtgtccccactcaaatctcatcttgaagtgtaatctccataatcttggtttgtaatccccatgtgtctagagagagacctggtgggaggtgactggatcatgggggcagtttcctccatgctgttctcatgataatgagtgaattctcacaagatctgatgggtttatgaggggctctttctccttcactctctactctctcctgccaccatgtaagaaggtccaagcttgcttcaccttcaccatctgccatgattataagtttcctgaggcctccccaggcacgcagaactatgaatcaactcgatttttaaaaacatattgagacttgttttaggcctatcatatggtttatcttggagaatgtttaattttggataagaagaatgtatattctgcaattcttgggtagaatgttctgtaaatatttgttatgtccatttgttctacagtgaagtttaagtcctgtcttcattgactttctgcctcgatgatctgtctagtgctgccagtggagtggtgaagtcccccactattactgggttgcacctatctcttttcttagatttaagagtaattgttttatgaatctcagagctcaagagttaggtgcatatttatttaggactatatcttcttgttggattgatccttttatcattacataatgtcattctttgtcttttttttttactgatgttgctttaaattctgttttatctgaaataagaatagctacccctgctcacttttactttccatttgcatagaatatcttcttctacccctttgagtctatacaaatccttatgtgttgggtaagtctcttgaagacagcagatatgtggtttgtaattttttatcaattctgccaaccagtatcttttaagtggagcatttagaccatttacattcaacattaatactgaaatgtgaggtactgttccagtcatcacgttggttgttttctagatactctgttttcttcattgtgttattgtattacaggccttgtgagttttacgctttcaagaggttctattctggtgcatatctacctttcgtttcatgattcagaactccttttagcatttctcgtagggatgctctggtagtgacaaattctctcagcatttgcttgtctgaaaaagaatttatttctccttcatttatggaacagttttgctggatacaaaattcttagttaacggttttctgtttaaggaggttaaagataggaccccagtcccttctggcttgtaaggtttgtgctgagaaatctgctgttagtctgataggttttcctttacaggttacataacgcttttgtctcactgctcttggtgacatcttttttgcaacgaatctcctagaagttcttttttaattaaaacactttttttttttgtgggtgcataccgggtacctgaaatgttttgatactggcatgcaattgtgaaataagcacctcattgagaatggggtatccatcccctcaagcatttatcctttgaatacgatccaataacactcttcaagttattttaaaatgtacaattaagttattattaactatagtaaccctgttgtgctatcaaatagtaggtcttattcattctttttattttttattttttttgacagagtctactctgtcacgcaagctggagtgcagtggtgtgatctcggctcaccgcaactgatgagaaagcaaaaaatgtccatcaaaatatgaatggataaagaaaatatggtacatatacacaatggagtacattcgtgtgccatatctgtttctactcatgctgttttccttctctatcctatttcccattttatcatcttactcatccttcagtgagttagctgtgcatgggcctatcttgccagctagattgcaatcttgttgtgggagatagagtgttttactcatctccgaacctactatgctgtatttattttaaaaatatctgatttcagttttgtggttgtatgaggttgagtttacaggaaatctgacttctgcataagctacatatatcgctaggtcttcaggtgggctgtcagagaacttcaaagtactcactgacatatttattgagatttttctatggaccaagcatagtagaatgaattttcattcacatcttgaatagtttttcaaacttctttatgttgtttttcacctttctctcgtatctcctttggtagcttaataatcaaccttttgaattctttataaaaagatatttcaaagatttcatcttggtttagatcaattgctggagagctaatgtgatcttttcaggggtgttatagaaccctgttatgtcatattgccagaattgtttttctggttccttctcatttaggtagaaatatatggaatgcttcacgaatttgcatgtgagccttgcacaggggccatgctaatcttcactgtatcattccaattttagtatatgtgctgctgaagtgagcaccgtctcaattgttttgaacagaaaatctttataaagtgttccacagaatatactgccttctaagcagaggacatagaacctaaaacagtttccttgatatgagttatcattatttttattatggatggatgaatattgtttttagttaaattaaaaagtcaaaactactttttaatatgagtcaacactttgtttgtaaattgatatggtttggtacatgagtgacagcttaaataagaaattcattttgttagtgatagcccttgataattacatttcattcaggagatgaaagatcaatatacaaaactatgacatttctcagtatttctaaaaaaaaaaccaagtaaaagatacgcaaattaataactcagttactagctcttgtataaaacaggagcataaaaaactcagtgatatgagaagttagggtggaaaataagattaaatcaattcactgataattctgacatttcaaacctttaataattagaattatttctgaactctacaagaagtattgaaagtctgcttattactgatcagaaagagttgtcagtaaaattagaacttcctttaagtttacatatctagtctactataaaaacctaaaatatcacagtcaagtgataaaacttacttcataaaataattcatcttaaaatctctggggaaaaacactaagatttctatataattttgttttgtcaaaaatagtcgtaattacatgagcgatttttaagaagtcaaatctcaaatagcagaaacgggaatatgaaggttttgaatacatcaatgtaataacatttcaagacctaatgattctatgagttgctggaacaatcagtctgtcaaaataaatgagacactactacaatgaagcaaatggtcttacatgttaatgttaacacatttagtcaaacagtcaatcaagagaatcctaaggtttgctgtgtttactgggaaaacaaactcttcctagcaactgtttaaataaatcttgcagatgctacagaccttattagtggcctttgattaaaaaaatatgggttgctaatactgtatcctgactcatctattttcccatctgctagcaattctaacaatatgaactatcaacagaatggctaacaacaagaattttctatggcagttttgatgctgaattgcctatagcatttttaagatttaccagtgcatgtctcagactgttttgagtttcttgtggcctggagcaacatactcttttttcccttaatattccattttagctgaaatttttactgtgttgaacagaatcttgtttggttttagaaaacactgttgatggaggctgccacacatttaactaacaatgagaacaggaaacacaacaaagcactagtaaaaatccagtcaggtccactgattggtttagatatacataaacaggcaaggggccttttgcccataaggctgagccacagggataacaggtagtacttaaagttaaaaaaaaaaaaaaaaaaaaaaaagaaagaaagaaagaaaaaaaaagaaaagaaaacattcatatattaaggcattttcctgatttaattcctggcactgagaagcatacaaaaaaggagcattctagtcaatccaaactactatgaagcctgtttaaagaaaaccctacatatacatttaaaatatgcatttacaaaaataagatagtgataatttcaggcacttgataacactatagaagaaaagctgaattcctcactgtaaaaatgtgatcttaaaagctgcattaacatcaaatctactggcagaccccccttccccaaacagacattatttatcctgttctgagctgagaggcccaggtcttcagctgactgaataactaaaaatattctgggattacaattggaaactaccatgaatcattctgttttggctgtttaacttcagagcacctagaagaaacttaggattctagattttcattcccaaagaaaaggaagaatacggtttctcatgaatatcaatgaaggagtaggagaaagtgccaattactgattatttacaatgtgctgaatactatcctaaggtcctgtacactaagtcattgaagcctagcaatcaccttagggggcagatattaccaaccccgtttgacaggtgaggatgcttagagagatcaaatgatccaccctaggtctctcagctagaggtgcttatgtaggccctcaaaggcaacatctaacccacataaatttgaactgcagtctactgatagctgtttcatgggtttcccatgaactacaaaagcactacaaaatccaatgatcatgtgaaacagttttttcacaaattgtttataggttaaaaatagaaaaaattacttaaaaatcccaactttcctgtcagattgtacctggtgaagcattttacttataagctattcatgtattttagccatcactggccatatgaaataagtgcatatgtgttaattaagcatttttctatttaaccagctctttagccaaagaaacacatttctacatagccctttgggatagatttcctaatgttatcaataaatgtaacagagataccctgacaaaaccaataaaacatgtctccttcacattccagtgagactttgcctatgtctgttcagactgttccacagttggtttggtgctgtgtttaccttgaatctagtgcaggagttacaaactgatgagcattactataattatcttgtcttagagaaatctcggccacccatttaaaaaaggaatgatgaaattttcgttgcattcctcaatggcagctgagcacccatttcttatgtgcattttccgtttctggtaagtagctttgcttattaaaaatatcaggaaatacttaatttgggcacacttctgatatattgtaagcagctctaacattctaggcccaggacaacaaaatttaagtaactcaaaagcaaccagtaattaaatctttctggatctattaagggcagatgaaaaattgtattacctttgatttcttatctcagcgattctgattagcactttgaatagtttaaaacaccaatgaagccgtaaataagaggttaacaaattaagtgattaattttctttttatacttcaatttaagaaaaacattatatgagaaatatttgttatggaagatcacaaacattacaaaaacaacagtggttaaagtatatctgtaactagcttactgggtagtcaaacctctgtggagcaataatataaacttaaagtaatttaatttttctccaattacactctttcggctatgcaaagtcaaatttccttgacatatcccacagtaaatcttgggatgatttcactgatttctggtcacttttacttattaaaagtccagaccaaatataaacttcaatctcttattaagtgcaaattttgtcccttcccttagcatgagcttgcaccaatttacagtggggaaggatgatgtctatatctagaaccttctcgccgtctctttctaaggtctggttcctctagtgctgggagcaggaaggagaccggatgttattatgtaaatggtgacttgtcagtgaggtatgtttccctggtcttgctctggtttgtttgattactagtggtttgtgcacagaaagcgtgtgtatgtatttcctgatgttgtggttagtattatcctagtgcccaccccttttatagaggggctgcccaacatcttttctgagttagatattgtctcctctgacctgaaagccacctgggcagcattatgacttctgacctcctcttttggagtaaagagatcatggaagttctctacactctccagggactagtgggacccaaggaaggtaagggtcactactccaatggcccttagttatcccgcaggcctcggctctacctacagaagtctcctacctacaaaaatctttgggagagaagcagatatcagtgtctatgctaatataccttccaaacttccaggaactaaaggctctgcctttagtggcacaccagtgggtctacagattcagctagctcagtaagcaccttgctggggtaccaggtaaccgtatccctttcctgcaggcaccaccattctctgtgaatggatctctggaaggctccttatttgactttaggtaaggagagaactattttcttcccctcccaccaggttataaattccatttggatagggcctttgtctagtaaacagctacatctctagtgcctagaacactgcttgaaacatagtaggtgcttaatcaatatttattgaatgaatgaaaaatggtgggtctcttagtaatcgctggagggaggcggctggcttcagttgttggtggcatgctttagaatatcgggtacttaacacctgctgttttcagctgtggactctactaacaattttgtggtaacagaaagtcccttttgatgtcatagtacacatctattaactctatttaaaaaatgtgtgtgtgtgtgtgtgtgtgtgtgtggcatcaagttggtaaatttgcagttgaagtaaagcaaaaagagtatctgtgaagatgagggtattttttcagcatgtttaattaatattactacaggatagtttcatgctccactacatgtttattctgcatgtctgatgatacatttatttcaataataaggggctcatccttttcttagaataatggcttctctcaaaaaattctccaaaacaataataaataccatagttgactctttgaggaaacatgcatggagtgaagtgtgctggaagagcatcattcttactaatgtcacaattttctgcttcactgacatcacaatacttagtctaacaatttaaattatactatcttcatatcataaaaatgtaaatatttgtttcttgaaaatctataaagtagttttaaaatgaaagaggttagctaaaacccacaaatcatgcaatttagattgtaatagataatttttaatagtgaagcaacatctagaaataaacaagagtctcatattttagtttcgaagcatctaaatccacagttcatttaaaacagttcagaataagaatcgtggtctgttaactatttttaaaacaataaaactcaaaatatgccaaaatgtttctaaaacacttcaaaagaaaaaataaattcgatcatagttctgcattctcacttgccacatgggccttagaagataaaatgtaccaaaaaggaaacattttagcattctcaattttagaatggcatggtttgtggctgaaacaatatttaattttcccagctactgacagacaaatgtacaaattaaactaaaacacccatgaagagattcagatatttgtaaggacacaagaaaaaaggataggaggctcttatgaaaatgtttaaaaagcaaaattgattttgtctaccttaataataaataagctgtcttgtgcaaacttaaaagcaaaatcgtcgcctgaatgaaactgagattctattgttttttcattaatatttgttttaaaatatgctcacaaatgctatgaatttaaggtaaaagaaggtagagaatgagaataaatgaacataagtcctgctagttattaacttagatgtgtctcatgggggaagaatcaactttcaaatgtaaatgtttcaaatcttcaactttctgaattggggaaaggacaacagtgtttgtgggttatgtcagcattttagactgcgcaactaatatgcagaaatcacagaaaataaagatgagagccgggcatggtggctaacgcctgtaatcccagcactttgggaggctgaggcaggcggatcacgaggtcaagagatcgagaccatcctggacaacatggtgaaaccctgtctctactaaaaatacaaaaattagctgggcgaggtggcgggtgcctgtagtcccagctactcgggaggctgaggcagcagaatcgcttgaacctgggaggcgggggttgcagtgagctaggatcgtgccactgcacttcagcctggtgacagagtgagactccatctttaaaaaaaaaaagaaagaaaagaaagatgagaaagtaatatgccaccattacttccaaaaggctgagtaaacattgattacaaactaaaattttcacacttagatgattataatacacgaatggtccaaaaaggcttttctttgcgggggcgggggggcggtctgagaatggcgccaaattagatttttagaaactgtttttcggtatcaactaatttaatagagaacatggcatcaaaattttatctctaataataccttgcaaaatgagtgtgttcccaaatgttcctgcaagtcttcagcgctggggctggaccaagctgcacctcttgcaaaggcagcaaggctttggttttatcctcccttgagccagacacctgccttctgagtggcctcactactaatgtggacatggaagcagaggcagagaactgaggttgggggacagcacaaagaatggctgatcttactttacatctactgggaagccgggagactgtggtcatgagtggaaatttggggatcagaatttcagctctggtttgaataatatacattaatatggagtagttttgctagtaaatcttcacatttttattttacaagatgaaatttcagttcagtcttaaaaagtccattttaataaggataaaaggaaaaatgcatctttaattattgaccatatgaaagacatattgttggtttacctcctgtggaaaaagtaataacacagctatgtggctgctgaattcaatgtgctcttgaggaactttccaaaaaatattagtaactgactgacatacactgttattcaaggaagagcttatccactggataattattctgaaactggtttatattcacatacaatatatgtaactctcaatctgaaataaatgacccagcagacctagtgctgagctgctagtacctggtactaacagatcctagaattctccaaagcattcttagacaagaacaccgtgagtgaactttccattattagagtcagagtagcggtgcaataccagaaatgatcaactaattttgaaaaataccacatgcaaagaaattaccttcaaactgccaaaaacactgcaagctggtccacacaacactgcccatttctggatacccatgatttacctaagttcttctagcctattttcagttaggaatgcccatttgaatgaacctcctcctgctacagttctcttaaccacagtgcatgatcttgtgactctgtcaggtccaccctagccctgccaccgccaacccacagatctcttctaattaccccagttgtgagagacagtcatagtcttaatcattttcttttcacaggggtgttcactgcctcatctcacccgtactcagtacaaggccttttaagtaggccaccctcactctcacagttgtttctatagtcagaatagtcagctgtgctggaccaagctgtcaaaagaagggagagataactcttaaatactgaggaaattgcagattctgctagctattttttaatttttcaatgaccagaaactgtctttcattggtctttagtgagtgtcatccttaattatatcaactaattttaaagatgacatttttcctagacaattttgctagggtgacagcataagcttccccaacccttggtaaatctctgctctaagtataaaaaacaagacactgtttactgactcttaagaggtgtgggtttttaatcttgcagggtgaccaagtgttgaatatttggtaacaatttcgtaaaatcttttatatcccacttagaaattaactgatagaacacctgagggagagtggtaaaagtggaagcagtacaacagaataaaattaaatgatcctaaatcaactgcaatgtaccaaagccttctgaataggcaggtggcttctgaaaagggtaagggtgaatgaagttacagcttgactggctcagagagtttataggtttgtagaggatgagtggcttacagctcgatcactggctcctgaaaagttaggaagctgggccactatcagatcaatggtatcggaaactgagaaacatgaagtcactgagctctacagatatgaatagtggcatccactgaacccgctcataagggcaagatttcaacctctaagagagggctaagtcgctggctatacagtaccctctggtggccagatttgacactgcagatttttctgccttttaagaaaagaggcctggtttttttccttttcttttttttttttttttaatgcatagacttaccattgggttacgtcttgataaagccatcataaactaaaaatatctgcatttagtacagctaacctaccaaacatcatggcttaacctagcctaccttaaacatgctcagaataattaacattagccttcagttgggcaaaatcatctaacgcaaagcctattttataataaagtgttgaatatttcatgtaatttattgaatactgtactgaacgtgaaaaagagtggctatacgactactccaagtaccgtttctactgaatgtgtatcactttcatatcaccaaaaaactttaagtggaaccatcatatacctgggactgtctgtaattcaaaatctttctagacaaggaaggaatcaccagtagcactgctgggctatgggtaggtgggcaactacctactaggtgtaaatctgtcaaccaaaaaagtaaattatggtggctttaagggagaaaatgttcctctgaatgtgtttaaaatcccatgggtgtagctacttaaatgaagaaatctggtgagtacttagctatttaaaatttaattctttgcaggtacttactttacaagaagtattcttatatagagagattcatattgctataaatatgtacataatagctaacatgcgcttaccactggcagacactatgctgttatttaataggcaataatcctatgaattagtattattagtatcaccatttttcagaatttaagttttcagaggcaccaagagtttgaactttaagacatttagctaataaaaaaatgtggccaggatttgaatccaagggaactgaattttggagctggcactcttaaacactatacaatgcagttaaatatatgtagtttactgcccataataaatttttccaaaaaagagatggcttcttaaaaattttaaattagattcagattagtatagacacttgcaagtcaatgatgcttaaaaactaaactaaaaccctatgccagttgagtgtttatttcctggaatgtttactcacatacaccttatggtggagaggggagtttataattggccacagagcctgagacctaatatttttgaaatcataatatattttacagtacttcacaatttacaaagcatatttacatacattgtatcacatgaacctcaaaataatgctgtgaaatggggcagataattctgtaaacaggcattattcttaactttatagatgattaatgaggcttacaatgataagtcatttccttaaataacacaattctctcaaaatctaagatgttccaaatgactgaatgcattatgaattagcctatcataggctttatcatctgtcacataacatttaaaaaaagatttctcacaataaaccaaaataaaattttactttattttatttctgctttatctacaataaatattataattcaacagtaattactattgttgaactagcaaaacccacataacaaaataaaaatcagaacatgaaaagctatagtaaggagaatgagaacaagtatggatcataaaatccagaattaggagcgaaatggtccaaaaattatgagattaagatcaatgattacataaagcactcagcatttttgtaattacttaaatttgtaaagtgccttcaaaaatttgttactcttttataatccctaagagatcactgagagacaataatagcctttacacagcagatgaagaacattttgaaagtactatgaaattcagttattatttttgtttaaaagaaaacatcttgtgattctaaatcacaagagcccgaaattctttctgaatataagcaatgccatttacaaacattcctgctgcacccatcttctacaccccctgttgtaatgaattcgcatacctgcctccgattacaggctggattgccccaaagtagtcttctcagaaacctatctacacagttagcttctttctcttgtgcatcttcaaactctctttgtctttagcatcaacatgatatactttctgatatttcccatcttaaacttttattgttttttcttatctcaagaaaaccctgccttgactcacggccattcctccagttgtcacaattccatccctcttctcctttagaaagtcaaacttctcaaagtatggagaaaacaataaccatattttaaattggcaatcaaacttcaacttgctccatactggcttctgatcccctaatgctctccaaattcctcttgttaggtcgccaaagttaaatgaattctttttagtttctatcttatttggcccctccagctgtacttgatactttgtccacacctttccttcttgaaacctccctctcttggctcctacaacaccatgctctcttttctcctaaatttatggccatttctcaatctcctttattggcttcttctcaactactaaatgttagaactactcaggactctgggcttttactatatactccatttcctaggcagtctcatacatgccctgggctttaaataccatctatctgatagtatctctaatatagatctgtcttctgagttccagaacttagcaattctattagatgtctcctgggtattgcaatactcagtaagttcatatctgacagagaccttctaaactgtttatcttttaacctttcctatttcactaaatggctcttccaccatccaactagttgcaaatgctaagaacctaccatattcaaatgttgccatgccttgtggtgttcatactacttaccaagatatgtcaaatcgatgtcctcctcttcatctgctgtcatctccccagtcaaagccctcttatcttgagcacactgtttcaatagcttcctaactagtttccttctatctttgctcccctccaattcactctccatacagcagccagaattattgtttaaaaatgtatactgggtcatgtcctgcccctaagatacggaaatggctctttcttgcatatgaaatccaaatgcggccttgcctgaatctaatcctgcctaggtctgcagcttcagcttgtgctactctagccattactcctatgtttccatcatgactgattctctttcagtttctcagattcaccaagctctttgcatgtgaattgggagtaaaatcgtccaaaaattaagaggttaggattaaatgattacatgcctttcctttgcttagaatgttgttccacactccccactttggcttcaagactttgttaacacagttctgtctactgagagtgtcctttccctcatctctgcctgatgaagttctattcatctttaggactgatcttaaatgtcatcttcataaagtcttcctggtcaaattttccctgtaagcatactgagttacttttttctccatatacctaaagataattttgcatatgtctctgttataacatttatcaccgtactgcaatcattttttaaatttctgccacattagaactgtacaatatgagatacgtgaatataggactgggccttctttagatccccaaatttagcaggtgcctaacatcatccaatctgtcacccattaatattgctttaagaataagagccatcttacatggcaacaaccactagtgaagattgtatttattaacttgttagtgtttgtcatcacggtgacatacacatattcagaaaaatgagtcaatattaataattaaagacgttactgtgatgaagtttcctgaaatctgagctcatctgtatacccatatccaatgacttgaatgtctcaatcaattcattggctagcacaattctcaagccttattagggaccataatttctatggttgacatcttaatgctgagtaggagccggaagctttgtggactctcaggttcatgcacctgaaagtcctgtgcttaagtgtgtgcatgatcttgctcagaagcaccaagaacaggggtgagaagagagaatgtagaacatccattgttatacaagaggcagtgacaacagagatggcctatttaacttacttcaaaagcctttaattctcaagcaccaggaaaacaattttagagctgactacaatagatcttttgctagactgttctgaagactagttttttagaaagtaaaaccatattaccagaatattaatccacaataaggttgaatacaatttgttaaagaacagactccatgtactattacaaaaatgaggtctgacctgaaacaccatccatttgaaatatttaaaaataaaaatagacaactctcttaaggaggttttttaaagcatcatctgatatctacgctatgataaaagtcagcatcaagtttaaagaagtgaaacaaaacactgtcaccatgcccctatgagctaaaactttgagaattataaatggcggatttaacaatgataacctttccattcttttgccagacgcgaaacaaattatgctagttcctcctctagaatttcttgctttttctgcctatgaccttctcagctcacccacaagcagcaccattcattgactgaactgttatttgacagtttgtcataatcaaatacggtaagcagagtatcacgatgttctagttcactttaaagcaaactatttaggactataaattccatctaggccttagatacacttcaaggcaaaggtagggatactgggcagagaaaacaccaagatttgacttttactccaacatgtacctaagtgtagactggaagtttgtattcaaaacattgggggagaaaagtttaatgttacctgtgtattcaacatataatatcctctgttttatccagataattcatcaaaatcagaggcatgcaaggaaggtgagaatcaggctgtgatttgcttacagatatgaaatcttgggagcaactcagtccagtgaagagacttttattgccccacaaactctaatattgggcagacttgggtttttactggttaggtgatgaaaagtccaaggtaattatcaggactaattagaattacaaaggacactgacacggggtcactgtaataaagttatactttatatttaccagcagtcttagacggctatgggtaaatgttctggctctgcggccccctgaaaagcaggattttcattccaacagaaaaaggaaaaaaactgattccaggtggaaccaatgttgcttccccacccttttttcagttcagagttgacaatcatgttataaaatgaaaaaggcaaatgcatgaacagattttagtgttgcataaaacaaaacttaccacaaaactaatgtggctttgttaatgatatgaataatagattctgggtaaatggtaattattcataattaatttcatttcaaaaacagccatagccaaaattatttttacacagtcaactcaaaatgtttccaaattctctaacatctataaattaaatcactcttgatgatttccactacaaccatgcaaggcttaatacttttacaacaaaggaatttagaatatgtcaccccaaaatacattactctggcatactgactattttgagtaaaaggtacttgaaaaacagcaactgcaagaactctctgacctttcttcttcataaaagcaggaaatgaaattcccgtgtgaaagacagcctccctctaccagaaggaaagcatcattcttatcatcaaggacgggaagctgagaccgaggaaaatctgtacaaacaaaccttgttaagctaacccttatcttcctcgttacttctctgcccaattacctactctgcccaagctcctctgccttgtcacagtttcacaatttactactctttcgccaaaagagtagtaaattcagtatataagttttcaattctaactgcatctgtgggtcttcatttccttacaaaggctccttgccatgtaaaattcataagaaataaatttctatgtttttctcctgttgatctatctatgtcaatctaattcttaggcctagctgaaataccccaaaaactggtaaaggtacaatttcacctcacctacaacacatacatatcctttaaaaacatctttctcaaccccaactccctagcagccatggtgcaccctcaatgtccgtgtttgagaattaagggttcctgagcttttctcctctgcaaatcccactcatgggtccttcaccaaatgtccattagcaattcattcagccatttcctatctcagtctccaccagaaagggccacccctgcagctctgaaatgcttgaggggcttgggaagctgaaattctgtggtataaggtttcaatggctagcctcgcataatcatcacacttggcggggggggggggggtgggcgggggggggccctaatgaaggcaagggagagggaagggaaaggacacagagaaaagccttcaggagtctgtttcagggcatctcagtcttggcactaatgaacgtttggtggggtcaggggtaattcttggttgtgaggggctgtcctgtgctttgtaggatgtttagcagcatccccagcgtctattcacaagatgccagtagctttccccaagtttggacaacccaaataaatcacccctggttgagaaccagcagtctactctagagtcttgagcatagagaggtataggaagaaaattaaacagaggaaagaacctgaattcagacagacccctgggctatgtgtagaagaagcaagtggctcttggtcacatgctgctctttgtgaacatgactcaatgtagcggaaatttgagagtgagcacaaggacaagaggaatggaagtcaggaaatgagaggaatctgtaaggaagaattccaacccaaatactctgcccctcactcacaaggtgatccctatgtatctactgaagagtactcaaactctttttcttaaggcgctggtttataaaggccatcaggaagcagactgagatttgggggtggggtggaagaaggggagttgggaggtagagaagggtttcccctacctaaactaagcttgggcttaagatccatcgagttcgcctcccgagcagagcaaagaactgaaacatgcgagagggttgctgtgaagcattttagccaacttttccaagccagatgcctggagttctcactgaggaagctggcagaacctagaaaaatccttattactccctcaaatttgcagagggacttcagatgactaaaactagctgcaggaaagaaaaaagacattttcttttctgcctagccatttataaagttttttaacttgcagaaaatcactgaagttctttcagtttcggagcctctaaaataaagtggaaatactataaacacatgtcacagagatgttctgaagattacatgagaccacagatgttaaagggcctagcacaaaggtggcataggtggctccctaccctctgtctctccttcatttttagttttctttgggctcatgcaccacatgcccacatctgtgccaccagagctttctctatctgctcttatacactatatttacgagcttctgtcgttatcttgttctgcgattttcctctctccctatgttcctgatgaggtggcagtggtacttgctgctaaatacatctaagtcctttcatcactggtgacaagagttcatgtgagaggtagcagtggagaagatgcaggaaaaagaatgccatagtgaggatgacatacttcatcactgttttacccttggcagctctcactccacctgcatgaagacatgaaaaaatctctttctgcgtgatagtgcaggtgtgtagtttagcaggaaacttgacaggcagttaaaagacaaagaagcggccgggtgcggtggctcacacctgcaatcccagcactttgggaggccaaggtggggcggatcatgaggtcaggagttagagaccagcctggccaacatggtgaaaccctgtctctactaaaaatacaaaaattagctgggtgtggcagtgggtgcctgtaatcccagtgactcgggaggctgaggcagcagaattgcttgagtccgggaggtggaggttgccgtgagccaagatcctgccactgcactccagcctgggtgacagagcaacactccgtctcggggggggggggggggcgggaaaggtgaagaagcatatcaggagttcagcttttgctaggtcagagaaagttcttaacagactaactcttttgcagataataaactgtggacaaaacacaaaaaccaactactgaagtctctaaagaatgaacaaaaacacattcttccccctccacaagaaaacatttacaatgtctgggatgtaatccaaaattacttgacatatgaagaatctggaaaatgcaatccacccccaatggaaaagacaatcaacagaagccaaccttgatacgacccagatatcagaaataacaagactttaaagcagctataattactgctgaggtaagagaagacatgctcattatggatgaaaagaatgggaaatctcagcagagaaactagaaatataacaacaacaaaaacaaataggagctttaaaacttgaaaaattcaatatctgaaataaaaagcttactggataggcttaatagcagaatgaagatgacaaaaaattgattggaaaaaggtcagtgaaaattacccaatctgaagaggagagagaaaaaaatttaaaaagaaagtgtttcaggaccctctgaagtcccagaaggtggggaatgagagaaagtggtgggaaaaaacatcagcataaattatagctaaaaacagtcctaaatttggcaagagataaatttataaattcaagaagctcatgaactgtaaagaagattaaaaacaacatcaatcacaaaaataaatgcctaggttgatagaaaccaaaaataaaaaagttgtgaaaggagacagagagaaaaaaacatatacagggcaacaattggaatcatcggacttctctttagaaaatatgaagtccagaagacacctggaacaatattttaaactttctgagataggagaagcacacttcactttaaatataaaggcacagacaggttaaagtaaatggatgtaaaaagagcatgcaaacagtgaatgattatcgtactaatattggagggggaagcatatcacctgcctagctgccacagtatgatttcaaaaaaaacaagaacattcaccaagaacaaacaaaaaaacctcttcaaatagaccatggaactgaattcaaacttgtatctgataacagcgatgacaatatctctctataacaatcctgaccagcatatatcacaattactacagaggctactgacaagaaatccaaccttggtatgctgtacacgactgtcctcccaccctcccagtgaaatcaaacaaaattaataatagtctactacatcagagggactccatttgggggaaagtttcaggctatgctcttgcctcaaaattggtggggaaaacacatagacatatacatacacacaaagcaaatacagcaaaatgttcaaaattgttgaatctaagtagtaaatgttaagtgtttattgtactatttttcagctttttgaatatattaaaattttttatactgaaaaaagagaaaaattagccagaagagctttattcaaaataccttcccctctctttccttcacattttgatatattcttgttggggaggtgtatcaggatattaactgtatcttttgatacgaaaaaaagtcacatgattctggtatatttcaaccactgctagaaaatccacatggataaatgctagaatgagggctaggactttttctagtttgtccattactgcatctagtatattttcaaggaaaaaatgttcaatgaataaatgaaaaatagctaccctagatgtttaataaaaaagacatctgcacttgtatgtttactgtggcacaattcacagtcgcaaagatatggaattaacctaagtgctcatctacagatgagtggataaagaaaatgtgttatatctatatcatggaatactactcagccataaaaagtaacatcttttgtagcaacttggatggaactggaggccattatcctaagtgaagtaactcaggaaaggaaaaccaaatactgcatgtttttacttataagtgggagctaagctacggatatgcaaaggcatgcagagtggtataatggacattggagactcagaatggggatgtgggactgaaaaaatcacctactgggtacactattcgggtgatgggtacactagcagcccagcttcactattatacaacttgcccatgcaaccaaaaaccactagtatccctaaagctattgaaaaaaaaaaaaaaaacttagtaagcctcctagactttataatctcaagacacgactttttaacataaattctgaacattatctggaaaaactgttgactggaatacgtttgtttggtattttttcaaggatagaatgatgttttgataatcagacttctcctttacttgtcacttagtaaccttctatactaaaaaaatttagtcattgaagtgtaacatgtattcaactgaagctagttgaattctcacgtttctcacactccccttgagctggcatcaaagattaacttaaaaggtcatgaaggaattcaaattcaaggaattcaaatttccagcatgcccatcttgacactttgaaataaatataaacacatcctgatgtcacttcattacagcattcccttcccaaggagctctaaaaagaaaataacctgcaggtgaatttttgacatgcaagtcttgaagataaaacaatatagcattcttccagatcagttatatgctttaaaagcattatttctccctgaataaaaatgaatccaaaggctgtgattcctaagaacaactgaagttaaagctaaatgttctcaaaacaattttacatagctcattctaaatgttctttaccaacttttaaataagaatgacaaataagagacagtcaaatgtttttatggatcttctgaataaactacgtaaagataaaaaatacatgtaagtataaaatacaatttgtaaatgagggccgggattagcaatgccaggatggataaagacatgttttctcgcatttaggtaactttgtcccctatgagatgaccctcagaagttgtctcgacgtttgctcagcagtgatttgattcaatgaccaatattcaaacagcactcccttagagactctacgcatgacctctgactgcttggtgcctaactctccacatatgtcaaacagagggaagaataattgctagctacctcccagcaattctagaagatttaatgaggcagggagccagacctccatggtgagtcaattattccctgggtagaagttatgttatttgtgaggtgccgtatttctaaggataacagagtattgtacaagcattacaaataggtatttctcgattcctcaaagtgttgacattaaatctttcagaataatatactcacctagtaacaaatagtctaatattttataaaacagtttgaatttgatggaatgaaagcatacggattttataatgttgtttcttttctgattattagtgagagagaacaatcttttaggacaaatgggtttaaaggaatagacagataagggagaagctctctaactgaatccagacctattaaaatggcgaccaggtaccatgacctatgtatttcattgagctggggccaagtccagagtccactaatttcagcttgctcaagtcaaggctaggatgctgccgtgatagaaaagatatggaactgctgaagaaatgtaattcaattcttataaagaaatggggcccaatattaacttacatgattaatataacacacataaataaaggcagtaacaaacacttaattttggattagtgatgtcacaggatctttaaatagttcatacaggatggtcatgctctcataagttaaaatggagaaaattgattttttacaccagattagccacacaatattaatcatataaaatgtttccctgaaagtcttggcataaaaatgggccaatgtgctctgttttgcctttttccccaaagtaaatttagatgggggtgaggagggaaaactttagaaagcaatcacaaatttcaaaatcaataaattcaaattgtttttaaggcagtaaatacatagtcctgccaaatgctgcaggaaattgatgtacaatctgtctggcagttggaccatgtgaaaaaattttaaaaagaccttaaaataaccaagattctgaaggctcaacaaactttgttttagtaagacaattttcctggtccataaaaaagataaggaagtaaaaggtgggataaccaatttaacttagggtgtggtgaattatcttgggtatcttaaattggtacttaatttggtctgggctcagaagaaatggtttaccatggtgattaagaccagctgctaggtgtcatagatttaaattatacaacagaacacaggagtgtgtttgaacacagacgggtaggacagtctccaaaaagctaagagtgccacctctgttcagtgaaaattaagtcagttttttactaccctttaagagctgcctccactgatttggccttgaacatagactgaatgagaagatttagtttcccaacacatgtgccaccatgacttaaagacttaatactaagtctttaagtattaaagacttaatactaagtccactaagtagacttagactaaagtccactttagtctaagtcccacaatttttcagaaagaccaggaggccatttaaacaaagaaaataatttctttcctacaaaaatcaggggaaatactaacctttgtcattcaaaatagttttagtttgataccaaagtatccttattaacactttgagcagggacaccaacatattttattttattgttcacttagaagttataaaagtagtctacattaaatgaaaaaattcaaacaataccaatataaaaatgtactaaatagtgtaagttcacttttgactctgaacccccagctaccaaactcaccagggaaaactactgtgatttgttgaagtgaagggagcgaagagtccacattaaattagaatataacagtacaagtttatggactttttacatcaatatatgtactttcaatgtgactaaacgatttcaccatttactatgctttttctttttcaaagtaactataaagacaggtacctttggggaagaaaaaagaaaagaaaaaaagtaaatataaagaaaacactggaactagattttcaatggtgcagttaataaggattagaaaatactatatataatagaaaatataagatttaaaattttaagatcttcttgttatgacaaataatatctatatgcataatacacatatgtacatgtgtatacatacatatacacaaactacatattacagcatacaaaatactgagtaacacaatgaatatgatctttttggatattcttgaaaaaagtaaacttcatcatttgatttatctagaagaattttattggccgggtacggtggctcacgcctgtaatctcagcactttgggaggctgaggtgggccgatcacctgagatcaggagttcaagatcagcctagccaacatggtgaaaccccatctctactaaaaatacaaaaaattagccaggcgtggtggcacacacctataatcccagccacttgggaggctgaggcaggagaatcacttgaacccaggaggcagaggttgcagtgagccgagattgtgccattgcactccagcctgggcaaaatgagggaaactgcgtctcaaaaaaaaaaaatgtatttataaatctaatgctttagtggcagaccaggagacaacccacatacaagtggtcaatttgaattttatctagaaccattactgttgccctgaaagccagattcactttagtcagctaaattttatggagtgtgttttataaacaaagcattgtatgaagctctagaaaatagtcagcagaagacagtccttcttctcaaaggctttccaacacattatcaagaacatacacagtcacaagcaattacaatttgaaagtagcacacagataaagaaattaattaccactggtggggctggagaccgtttaacagaacagataggtttaagctgggtaagatttcaactagcaacacaggaatgaagggtgcttgaaaacagcacagaaaggcacaaggaaatagtacagacaattgtacaagtaaagacaaagaagtaggaggctgccatgtacatgtgaaggataatgaagtggcagggcaagactagagttcgggggcacagagaaggcaggaatagaagatgagcctggagaagtagatgggggcagattttggagcctattagctataaaccaaaaaatttagcatttatattacagaagtagggggccatgaaagtctcaaagtgaatgacatgatcagaataatgatgcatgagttaaaatggaaaagaacagttaggcagagtacgacccatgacaaagctccaaagaagaggtaatgttgcgtagattaaggacagtagcaatgaaaactggataaaggaaacagaccgaaagacacattctgaaggcaagttgacataaggaaaagatcttaggccccaggctaaagatttgaattctggctcctccaactatttgccttttggcgttgggcatgtttcttagctcctttaacatatagtttccttatctataaaacaggaataatgcacttgcctgtgtgtgggggaaaaaaaactgtgagaaaaatacagaaagttgtctagataattcatgtcaacacacttatttattcaacatcatataatgataaaaagaataaaacgtagccccaatctggttggggaaacagacatacaaacaactaaagtgacaatgatctgatgtaactggacctatattaggagtaagatccaacagaaacacagaggataaggtgtgtgtaaagccactaaagaccgtgtaaaagtgctgaaaaggttcaatgaagttccacagaggtgatgtgtgaaccaggctactcacaacttttaatgtttcttattttcacatcaaatcaccaggtccttcaccacataaattatagtacacaaccccctaggacccagtggtatcatttgaattctggagtgtgaaagtccaaaggaaatggtggaggaaaaaaggggaggtgaggggagaggaagaaagattagaggagtatgaatgaattttaggcaaataacttctcaggaaacaatacttgaaagaaagccagataatacttagattctcagtgtgatacaatattaaggcagcaaaactcaaatgaaagaatgtaatgagttccaggtgtcgtttagtagatttttttcagtaggtgaagttgagttgaggtggctactgtcagtgtcaatgccctgtctgaacaagttttaatttaacttcaagcaatacataggcttttgtttagactgtttgcatatatttgtctactgctgctaagaggcaaaataacctctttctcgagaaagtgagataaaactatgattgcaaaaatgtttattttttaatcttttcatgaatcaagtaattttatctaatttattcaacaaatatttattgaatagttactgtgcataaggcccagtggggaatatgagagaatataatatgatatagattttatcaccaagaaggtctgagtctcataagttcactataaagtagaaggtaataaattcaatgagaagtatacagataaagtgccacacagtataaaggaaggagattactttgagctgggaggataaggatttggcactggcactaggacagaggggactatgttgtgttactcatgcaacaaacatttactgagcacatacaatgtgcatgcacttacctaaatgcaatgagactttgaggtgatttagtccaattccttcacttaattcactagaaaatgaaaactcggaaacctaaatagctaattcaaggccaagatacaatttgaattgatatctccagtctgcaagtccaataatttctactacttaccctgtcacctccaaaactcagtctaaattttttgtcaggtacaatcattatttcaaaaggcattccattccacttataaattaatttgttataaaatgtgttttctaacatttagttaaaagttgccttcatttttaactaaaaatgaagtggctctagtggctccccctgtagttacacagaacaaatagaatcctgtggccatgtgatcatccttcacatatatgaagacaatcctcacgtcccccactctagtaggcactcagtaatcactatagttggggaataagctccggaattagatgggcctggatgtgaatctcagcttcaacattcacttggtgtgtgatcatgagccaagttacttaatttagataatctgtgtgtttatttagacaatgggaatgtttatgtccttcatgccttccattcaacgtaatggccaataactatgatcaagaattggcacaacttttggtgtaactgtcagaacactagagtttctctatacacattaagctggcactgaatcataagaggaaaagttgcaaaactgaaaaagatggcagcacctgtctttctctcccacttctcttcctctctggcataactagtctgtgagtgacagctgtgaaatactaaagactgggcgacatggcttttccagataacctgtgaagaatggtgaagcatggcttcatcaaatgacctgtgctaatagagctgctggcaaaagtgcagtcattttattgagataaaacattgaaaataattttcataaaataaggcacagatgctttaattagaaaaaaatgtccttgagggtgggattcagatgcagttttataacttgtacggtgccttaaatgcattaaaagatagacaatggtacaaggactattctccctagtggtaacaaaactgtttcctagttactagggtagggtagggaggaaatgaaaggaagaagagaaaatctagagtttattcttttcctgcttctaatgttataagccaatgctaatgtttagtagtcacaacctcgtctgctaggcactgcaactaatttcccgtatttgggtagaaaaaaatgcatcatgtctcaaagaatgaactactgacagaaatttagtgactgatactaaaggtagatacgtagctgcagggtatgagaaagaggagacacagtcctaaaaataacagcaaaactaagatgaaaatgcagagaagtggtatggtacattggtagctatcccctaatatctattctacctttcttccatagaaatatcgttttagccaggcatacagtcattcggaataaaagcaacactttcggtctctattgcaactacatgtagccctatgaccaagtactgacccgcattatatggacgtttctgggcacctttctcaaaagatggctggggcatgcccatttcacccctttctccaaccagctgcctgaagtggagatgcctccacctttgaccatgaaactgagagcctcaccctaggcatggtgagtggtgagctggaaggagtggggctctcgatgcagaaactgatttttccatttttgttaaacaatgctgtcaaaaaggccctaaaaactatcttttgcacatatctatttccttagattacattcctagaagtgagtgagaggatatgaaaacataatctgtcatggaactagagttaaaaaaaaaaagaatatgaaaacattctaaagctcccaacacatatggtgaaattgttcttctgaaagtttaaatttacatgttctctacatgccttcccagcccaatgtcaggagttaattttatcattaattggtaagagctctcttatattaagggtgtgaataccatgttataaatacctcttcccaattaatttacctttcaatttagttactatttttgttgttgtgcagtaacttaaaatctttatgtaataaacctttttaaaaagtggtttctgcccttactattatatagtaaaaagtcttcccacgtatcaagattatgtacatatccacctatattttttctattacctttttgctttcacttaacctttaatccacatgaaatttatttttccacacatttagccgattgtaccaacaccaagattccacacattcaataatagatgctattgaatataactattcctaataactgaaaattccacttttatttattctgatatcttgaattagtattattagactgttttaattattgtggctttagaaaaaaattttatactcacttatgcaattaattcacattatttcttttttttacaaaagtgtgtttggtttacacctctaagtgaactttagaaacacattgtcaggtttggcaaaaagaaaaaaacacctgaaattttaactggaattgtattaatgatcaatagagagcaattggggtagggaatgcataactttaaaacattaactctccccattattcccacaaatatgagatgtttccccatttcttaaactgtttttatgtcccttatgttctatagtttatttcttatagttagtcgtagagtttacttgcttaaacttgaggcaagtttccttagttacagatcttttatttatatttgtgctattataagtaggatctttaaacacatacttgtctgtgctggtatagaggaaacactaatttctgaatttattttgtaattgaccatcatcttactggtatgtttttaataatgctcataagtgttagttgattatcttgggttttctagttagataactgtattttcaatttcaaataatgatgacacttctcacttcctttgcaatatttaaacttcattttcttgtcttattgcattagacaaaactttcaaaacaatattaaataatagaggtaatagctgacactcttttttccacccctgactttacttcttaggacattttcctattttaacccataaaacagctgcatcgtatcagtctttcatctgtttttacactggtcccaacccccaatccctaactatactgtaagttccttgaaggcaaaaactgtgttttgctaattttttaaatcactgtagcatccagcacagtgtctggcacagagaaaataaatcattaaacggatggttctcaaaactggtgagtcactggaattacatgggagcctttgaaaaaaaccaactgcaagtttcacaaaccatttacaagtcagaaattccctgttcgtgggggtgcgaatctagacgtgtcaaaagcttcttagatgatttctgacggcccacaggtttgagaaccactagtctagtatttttatcactcccggagattctgtttcagagtcaggggcctgatttttagtaaatcttcctgagatgattcagatagaagcaggtttggaaactactgggttagacagtaattcaaagaagggatcagagttttatttttttcctttatgttgtctgtatatttttcacatacaaaagtggaaaagatagcaagatatataaagaaaaggccaatctctcctacctctatcttctaaaagtagccatttattactgtgtagtggcatccttccatccctcttttcttgcttacacaaaataaacacgagagagagagagagagagagagagagagagagagagacagagagagagagagaagtactctttctgtttttattaaaacaatcagacacttattttgtaatttggtagtatttaaaaaaatgttatttcaaataaatgatgatgaaaccaatatctgttctcttgtctatatagatttaaatttagcgatgagtataaaaacattttcatttcatttttaattctttagcaggtataggaacaatttgggaagattcacctaggaaattttttttttttttgcgggggtggggcagggacgaagtctcactctgtagcccaagttagagtgcagtggcacgatctcagctcactgcaacctccacctcccgggttcaagcaattctcctgcctcagcctcctgagtagctggaattacaagcgtgtgccactgcacccggctaatttttatagtagagatggggtttcaccatgttggccaggctggtcttgaacgcccaacctcatcacctaggaaattctaaaactatcagttaatatactaaaggatatgggttcataggtcaaacagcatcttaaaaaccaggaggacagtattaatacaggaaggctaaaaatggcatataaagccttcttttctatacttataataaagtaattaaaagctacaaaaagaaaaccttttatgttacttatgcttagctattactcattttttagataaaagatatttttaatacaaaagcaaaactaaggcacaactgatctccacttacatgctttaacaaaacataaaaggcagcactcaaatgtacaccagaaataaaaattctaaaatagaactactaataaaaggaatgtaaattactggctaagacagaaacatcatattttagaagactaagccatgattttggtgaaatcagtacatcattcgtttgttattattaaattttcataaagcatctccaaaaagctcaatgacacacactaataattgttaaataatgcaaatgaatacttctaaattctccagtactgtaaattagcagacagtgtgggagttgcagagaacaatgagagagagaagtaaaaacaaagcaagcagtaatatgatatcttaaattaagttgcaatttctgatttactccaaaaggatctttctgggcaggcaggatttaaagagttttaagaaatgatgtctttctgcctgtcaggagtgtgttagaagtatatttaattctgtgaagttggaataggaaagagaacatgggggagaactaagttaatctagaagaggtgtgaaattggagaaaggcctaaaaatcaaatgcaaatatgctgaagatagtaataattttaaaaaggaaatagtttaaagaaagggaacaacattcagtgtggtaaagaagtggtattaaaaatagtgttttgtatttttttttggcaggaatggaatggattttatggttagataaatcaagaagacctacaatggcagttaagatttgaaattgctagatatttggcaagagaactgataaaaagagaggggagtaattatcaggtgtcacccacaccctgaaggctgcacccactcttatcctctaattcctttgacccagagtaacacttctccctcttcctgtccagatgtggtttctctactagtgctctaggtcccatcccctcctctttccttaggaacttcattccattgactatcttcagtcaatcctccaattcctgccattagctctttcagcatataaaaatcatcaagtatgccaggcatggtggctcacacctgtaatcccagcactttgggaggccaaggcgggaggattgcctgagcccaggagtttgagaccggcctgggtaacatagtgagacccaactctacatttttttttttttaatttgccaggcatggtagtgtgcacctgtagtcccagctacttgggaggatgaggcaggagaattgcttgagcccaggaggtcgaagctgcagtgaactgtgtctgtgccactgcatttccatcctgggcaatagagcaagaccctgtctcaaaaaaaaaaaaaaaaatcatcaagcgtttcatatctaaaagcaatataaaataaaataaaaagtttctttaatcttatgttctcctttaactattatatctcttcttttcacaagcaacttctaggaagaagtctacttcttccctccttgattcacttcccgctctgaagcagtctggctttaggcgtcaccatctcatggaggctgcttcacttaaaagcaacattgatctccttaacaccttatccaatcttcgggttttagctctcctatgattcgatcttgctgaagctttttacacattcatttcctctttcttgaaatgttctcctccctcagtatctaagatgtcacattcctttctctgttgttgctccacagggacccatctcagtctaatattattctccctctatactgatgacttgaactataccaattaaaagatgactcacaatccagaaatctctagcccagatctctgtggaactccaattctggttatgtctaagaagcatctctttctgaatgtctgatggtacttatataaccaaaatgaattcatcatattccaccttaaaaagtcactattccttaaattgaatggatccaccaacccctcttctctccttcacctagttattcaggtaatctgggacttatctgagatcttccttttctcttacttcccagatctaatcactaaggactagagattctctcaaaactgtcccctaatatcaatttcattgcttttgttcatttctcatttggactatgtcatattgcaacaatccccttaatgatttctctacttccaatctcaattttttgcaattctgtttcaagaggtcagcttgctgtaatttttcaatggctttcagttatccataagcccaactcccaacctccttgtaaggtataaacgctgctgcctactctccagcctcatttctaccactttccaactcaatttcatgctctagcaacactgaacatgctttcttatggctagtccttctgtaaatactgcagcaccattttttccacttgtctatctggtacattcttactcattcttaggtatctgtttaaatgctaacttctctaacagcatcccttttctctcaggtgaactttggtgttccttatatattcctaactgtagttttgaagactcttccattaaacaatgatcttattgcattataattgtttgcatgggcatcttaacttcttaactggcttagattagggaattaaaatagacattggctgggcacagtggctcacacctgtaatcccagcactttgggaggctaaggtgggtggatcacttaagaccaggagttcaaggctgcagtgagctataatggtgccactgcacactagtctaggtgacagagtgagaccctgtctcaaaaaaaaaaaaaaaaaaaaaaaaaagagagagagagattatgaaaacatttactgggagacctaacccattttttgcttcaggaaaccaatcttaaacagtgccaagaaaggcaagccaaagacagtggatgaagacagtggtggtgatgctggaaaagcccaggcaaactgaagcacagctactgtggaagagagaacagcaggaaaaaactggagagacaccaggagcccaactgtgaagggactgctaagagaaggttcagctttgtgcttccagtcactgattcaaactttcttcatgaatccaaccactaaattaaacaccagctttctaaaagctgcacattctcatactataaaagaaaatatatttcaaataaaatactttccaggctttccagaagaaaaaatccatcccatgtcacccactgtgactaagcacggaggaaacagattaaattagggatattttgcccgtacatctccaggctgcatgaaatgaaaacaaatgagagtcaggactctcaaaagtttcacagttctaaccatcaacgcaatgtgccaagcaacatagtaaatgttcacgtttcaaacaggaggaatacattttaccttttctatctgggatagaagattagattctaatcttttttggttttccactcagatgagcaccttaagtgggatcatatttctatattacaggtacttttttttttcctgaaagtctgtgaatacttaattcaaaggccatggacagcaacctagaggagctctgaccatgaaaaatgttttataaatagttccatgtgcactgttcatctggagtctcactagagatggataatgaccttgtattttgtactcatttactctgaattagccaaaccttctgtttttaattacatacttaattcacctagcatggtctaattacataaaacaaaacatcatttaaacaaaaggtggccttgaacttaatctatcaaaacaccagttagtttttaaagtttttagttcttaacaaactgccaagacatgcaatagcaattttccaaatgtgatcatatgcttttatagcaacagatttactacataatcaaacatctgtatatacttttgtctcactattaatgcaaatatgcttaagttttgatagacttaaaaatcttaaagctgaagttcatactacacaataatttttaaatatccatagtcattttggccttgaaatgacaagttatcataaccatggctacttatttacaaaatggtccagaactttgtaaaaactcatgttcagaattttccttaattcttcacagtgtaaattagtagcccttctctgtgttatcatagcaccttatatattttcaatcacagtatttataatgctgaatagttattggtttaaagatctgacccccaactagattgcaaacttcatgaaagcagagtttatgccttttatctctatcttgccaacatggagcacagtgcctagcacagagcaggtcctcaatatatatttgctgaattaatgtattaaaatacaatgttgtaaaactatctcaatttatgaatatgatcttatatgtagaaaatcataaggaattcaccaaaaaattattagaactaataaacaagttccaaaaggttgcaggatacaagatcaatatataaatatcaattgtatttctatgcagcagcaatgagcaaacaaaaatgaaattaagaaaaccaattccatttacaatcaaaaccgttaaaatattttgtaataaatttaacaaaagaaatatacaacctatactctgaaaaccataatcctcaaattgatctacagaatctagagatccaatgcaatccctatggaatcccagctgacttctttgcagaaattgacaagctaaacctaaaattcatatggaaattaaaggaattcaaaatagtaaaagcatataatggaatcctattcggccttaaaaaaggaacaaaatttgtcacactacaatattgatgaaccttgaggatattatgctaagtagaataaaccagtcacaaaagataatactgtattactccatttatatgaggtatctaaaatggttaaattcatagaaacagaaagtataatggtggttgccaggggctgatgggaaaggggagctgttatttagtgggtttaaagtttcagatttgtaagatgaaaaagttctggagatctgtctcataacaatgtgaatatacttactatttaactgtacacttaaaaatgatgaaaatggcaaattttatggttttttttaaccaaaataaaaaaaatttttaaagccaaaacagtcttgaaaaagaacaaagttggtggacacacacttttcaacttcaaaacttactacggagctacagcaatcaagacagtgtggtagtggcatgaagatagacatatagatcagtggaacacaattgagggtccaaaaataaatcttcatatttagagtcaattgattttctagcagggtaccaagataactcaatgagggaaagaataatcttcaacaaatggtgttggaacaactgaatattgacatgcaacagaacaaagttacttctatctaacaccatatacaaatattaactcaaaatagatcaaagacctatatgtaacagctaaaactataagactcttggacgaacatgtaagtgtaaagctttgtgacctggagctacacaataattttcttagctatgataccaaaagcactagtaaaaaaaaagaaaaaaggaaactggactttatcaaaatttaaaaatgtgcttcaaaggacaccatcaagacagtgaaaatacagcccacagaatgggagaaaatagttgcaaataaaatatctgataaggaacttgtatgtagagtatatacagagctcttacaactcaataataaaaagactaataaccaatttaaaaatgagcaaagggtctgaatagacatttctccaaagacaatgtgcaaatggacaataagcacacaaaaagatgctcaacatcatcagctattaggtaaatgcaaatcaaaaccagaacgagataccacttcatactcactaggatgactataatcaagaagatagacaatagcaagtgttgcgaggatgtagagaaattggaaccctcatacactgctgacaggaatgtaaaatggtgcagtcactttgaaaaacaacctgacagttcctcaacagagcatttccatattattcagcaattcttctcctaggtatactcaagaaaaaggaaaacgatgtccacacaaaaacttgtacaaaattgttcacaacagcattattcataatagtgaaaggaataaagtgttatctgcacttcatccttacacggcctcatagtattccatattatgtatgaacacaccacattttgtttatctgttcatcaattgatggatatctgggttgtttctacctttttttttttaaaagctattatgaataatgctgcaaacttttctgtctttaaatcctgacatgaagatctgggctgaggcaggggtagaggggtagagaaaatgcctatcatcaagttcttccctatgtctatggcctagatggggtgggtgtcggatggtgctgaggcaggaagaggagaggagaactctcagtaagttgctaatgagaagagatcccagaagctagttcctgtgttccattctgcagtaacatgtcctctctaccatgagtgatacaataggagaatgggtgaacactcccactgtggtagatcctaagcaaagcatgacatggccctgccctccaagaaattttgtccataagataagtcactatttcatgttactgtaataatttttgtcattatctggagcaaaaaggaggatcttttgcaacaaaagagtttatgaacctaaattgctcttgtcaagatcaccaatgacctccttgttgctaaatatccaatagtaaattataagtcctcatctttcttgggcattaacaaaatctgaaccagctgatccctctttttagaacactttcttctcttggcttccagaatatcacactctactagttattttcctacttcgctgatttgttccttatctgtcccctttgctgattcctcgtcttctccccaatctctcaatgttagagtgccctggggatcagtccttaaaccatgcagtgagctgaataatggtcccttgagataccatgtcctaatccctagaatctctgaatgttacctcatatggcaaagactttgcaaatgtgattaaattaagtctcttatgatcctaagaatggggagataattctgaataacttggatgggccctaaatgcaatcataaatgttcttttaagagggcaggataggaattcaaacagaaaaagacaaccttggaagcagaatcagagggaaaagatgctacactgctggctttgaaaatggagaaaagggctatgaaccaaggaatgcaaggaatacagatctagatactaaaaagggcaagaaactctagattctcccttaacagtctccagagcaagtgtggccctgctgaaaccctgatttagccccataagacttagtttggatttctggtccacataactataaaagaataaatttctgttgttttaagccaccaagtaagtctgtcataatttgttatagcagccataggaaactaatacagattttggagcctggaagtggggtggtacaaaaacaaaaacctaaaactatgaaagtggctttggacttgacagtaggcagaggctagaaggagtgggaggtgcatgatagaaaatactcagattgcctaaaacagatttttggtagaaatttgaacattaaaggcactgctggtaacagctcagaagaaagtgaggagcatggtagagaaatcctaattcatcttggagaacacatatatcatcataagcagaatgttggtagaaatataaacacagtaaagatggtactggtgagggctcagaaggagatgagcaacattttattagaaactgtaggaaaggagatttgtcatatagtggcagaaagcttagctgatgtgtgtcctacaattatatacaatgatgaacttagatttagatgatttggatgagatcttggacttttgagctgattatatttaggtgagattttgggttgaaactgaaatgggttgaggcttctggagatactgggatggggtgaatattttgcatgtgagatagatgtaaatccttggagacaagagggcagactgtggtaagctcctcaagatattcatgccctgatgcctggaacctgaaaatgctacctcatatggcaaagactttgcaagtgtgattaacttaagcatcttgagatatggagattatcttggattatctcagtgggccctcaatacagtcacaagtgtccttagaagaggggaggcagagaggttttacacaaaagaaaaaggtcatgtgaccaaaaaaaaagaaaacaaaaagaaacagataagagagaaaagatgctatatcactggctttgaaaatggaaaaagaaggctggtgtggtggcttttacctgtaatcccagcactttgggaggccgaggcaggtggatcatccgaggtcaggggtttgagaccagcctggccaacttggtgaaaccccatctctactattttttttatactttaagttctagggtacatgtgcacaacgtgcaggtttgttacataggtatacatgtgccatgttggtttgctgctcccattaacttgtcatttacattaggtatttctcctaatgctatctctacccctgccccctaccccatgacaggcccccatgtgtgatgttccccgccctgtgtccaagtgttctcactgttcaattccaacctatggtggtttttgttgccactgcttttggtgctttagtcataacctatgagtgagaacatgtggtgtttgattttccgtccttgtgacagtttgctcagaatgatggtttccagcttcatccatgtccctacaaaggacatgaactcatcccttttttatggctgcatagtattccatggtgtatacgtgccacatctttgtaatccagtctatcagtgatggacgtttgggttggttccaagcttttgctattgtgaatagtgccacaataaacatacgtgtacatgtgtctttatagtagcatgatttataatcctttgggtatatatccagtaatgggatctctgggtcaaatggtatttctagttctagatccttgaggaatcgccacactgtcttccacaatggttgaactagtttacactcccagcaacagtgtaaaagcgttcctatttctctacatcctctccagcatctgttgtttcctgactttttaatgatcgccattctaaccggcatgagatggtatctcattgtggctttgatttgcgtttctctaatgaccagcaatgatgagtattttttcatgtgtctgctggctgcataaatgtcttcttttgagaagtgtctgttcatatcctttgcccactttttgatggttttttttttcttgtcaatttgtttaagttctttgcagattctgggtatcagccctttgtcagatgggtagattgtaaaaattttcttccactctgtagattgcctgttcactctgatagtattttcttttgctgtgcagaagctctttaatttaattagatcccatttgtctattttggtttttgttgccattgcttttggtgttttagtcataaagttcttgcccatgcctatgtcctgaatggtattgcctaggttttcttctagggtttttatggttttaggtctaacatttaagtctttaatccatcttgaattaacttttgtataaggtgtaaggaagggatccagtttcagctttctacatatggctagccagttttcctagcaccatttattaaatagggaatcctttcccgatttcttgttttcatcaggtttgccaaagatcagatggttgtagatgtgtgttgttatttctgaggcctctgttctgttccattggtctatttctctgttttggtactggtaccatgctgtttcagttactgtagccttgtagtatagtttgaagtcaggtagcgtgatgcctccagctttgttctttttgcttaggattgtattgcctatgcaggcttttttttggttccatatgaaccttaaggtagttttttccaattctgtgaagaaaggcattggtagcttgacggcgatggcattgaatctataaattactttgagcagtatggccattttcacaatattgatgcctcctatccatgagcaaggaatgttcttccatttgtttgtgtcctcttttatttcgttgagcagtggtttgtaattctccttgaaaaggtccttcatatcccttgtaagttggattcctaggtattttattctcttagtagcaattgtgaatgggagttcactcatgatttggctctctgtttgtctgttattggtgtataggaatgcttgtgatttttgcacattgattttgtatcctgagattttgctgaagttgcttatcagcttaaggagattttgggctgagacaatggggttttctaaatatacaatcatgtcgtctgcaaacagggacaatttgacttcctcttttcctacttgaataccctttatttctttctcttgcctgattgccctgaccagaacttccaacactatgttgaataggagtggtaagagagggcatccctgtcttgtgcaagttttcaaagggaatgcttccagtttttgcccattcagtatgatattggctgtaggtttgtcataaatagcttattattttgagatacgtcccatcaatacctagtttattgagagtttttagcatgaagcgctgttgaactttgtcaaacgccttttctgcatctattgagataatcatgtggtttttgtcattgattctgtttatatactggattacgtttattgatttgcatatgttgaaccagccttgcatcccagggatgaagctgacttgatcatggtggataagctttttgatgtgttgctggattcggtttcccagtattttattgagaattttcgcattgatgttcataaggaatattggtctaaaattctctttttttgtgtgtctctgccaggctttggtatcaggatgatgctggcctcataaaattagttacggagaattccctctttttctattgattacaatagtttcagaaggaatggtaccagctcttctttgtacctctggtagaattaggctgtgaatctgtctggtcctggactttttttggttggtaggctattaattattgcctcaatttcagagcgtgttattggtctattcagagattcaacttcttcctggttttttggtcttgggagcatgtatgtgtccagtaatttatccatttcttctagattttctagtttgtttgcgtagaggtgtttatagtattctctgatggtagtttgtatttctatgggatcggtggtgatatctcctttatcatttttttactgagtctatttgtttcttctttttcttctttactagtcttgctagcagtctattttattgatcttttcagaaaaaccagcttggggattcactgattttttgaagggttttttgtgtctctatctccttcagttctgctctcatcttagttatttcttgccttctgctagcttttgaatttgtttgctcttgcttctctagttcttttaattgtgatgttagggtgttgattttagatcgttcctgctttctcttgtgggcatttagtgctataaatttccctctacaaactgctttaaatgtgccccagagaatctggtacgttgtgtctttgttctcattggtttcaaagaacatctttatttctgccttcatttcgttatgtacccagtactcattcaggagcaggttgttccgtttctgtgtagttgtgcagttttgagtgagtttcttaatcctgagttctagtctgattgcactgtggtctgagagacagtttgttgtgatttctgttcttttacatttgctgaggaatggtttacttccaactatgtggtcaattttggaataagtgtgatgtggtgctgagaagaatgtatattctgttgatttgggatggagagttctgtagatgtctattaggtctgcttggtgcagagctgagttcaagtcctggatatcctgtcttgttgatctaatattgacagtggggtgctaaagtctcccattattactgtgtgggagtctaagtctctttgtaggtctctaaggacttgctttatgaatctaggtgcccctgcattgggtggtacatacatatttaggatagttagctcttcttgttgaattgatccctttaccattatgtaatggccttctttgtctcttttgatctttgttggtttaaagtctgttttatcagagactaggattgcaacccctgcttttttttgctttccatttgcttggtagatcttcctccatccttttattttgagcctatgtgtgtctctgcatgtgagatgggtctcctgaatacagcacattgatgggtcttgacgctttatccaatttgctagtctgtgtcttttaattggggcatttagcccatttacatttaaggttactattgttacgtgtgaatttgatcctgtcattatgatgttagctggtcattttgcccgttagttgatgcagtttcttcctagcattgacagtctttacaatttggcatgtttttgcagtggctggtaccagttgttcctttccatgtttagtgctttctttaggagctcttgtaaggcaggcctggtggtgacaaaatctctcagcatttgcttgtttgtaatggattttatttctccttcacttatgaagcttagtttggctagataggaaattctgggttgaaaattcatttctttaagaatgttgaatactggcccccactgtctactggcttgtagagtttctgcccagagttccactgttggtctgatgggcttccctttgtgggtaactcgatctttctctctggctgccctgaatattttttccttcatttcaaccttggtgaatctgacaattatgtgtcttggggttgctcctcttgaggaatatctttgtggtgttctctatatttcctgaatttgaatgttggtccaccttgctaggttggggaagttctcctggataatatcctgaaaagtgttttccaatttggttccattctccccatcactttcaggcacaccaatcaaatgtagatttggtcttttcacatagtcccatgtttcttggaggttttgttcatttatttttactcttttttctctaaccttgtcctctcactttatttcattaatttgatcttcagtcactgataccctttcttccacttgatcgaataggctattgaagcttgtgcatgtgtcacgtagttctcctgccatggttttcagttccatcaggtcatttaaggtcttctctacatgtttattctagttagccattagtctaatcttttttcaacgcttttagcttccttgcaatgggttcgaacatcctcctttagctcagagaagtttgttattaccaaccttctgaagcctacttctgtcagctcatcaaagtcattctctgtccagttttgttccattgctggtgaggagctgccatccttttggggagaagaggtgctcttgtttttaggattttcagctttctgctctggtttctccttatctttgtggtttttatctaccttttgtctttgatgctggtgacctaccgatggggttttggtgtagatgacctttatgttgatgttgatgctattcctttctgtttgttagttttccttctaagaatcaggtccctcagctgcaggtctgttggagtctgctggaggaccactccagactctgtttgcctgggtatcaccagtggaggctgcagaacagcaaatattgctgcctgatccttcctctagaagcttcatcccagaggggcatctggctgtgtgaggtgtcagttggcccctactgggaggtgtctcccagttaggctacacaggggtcagggacccacttgaggaggcagtctgtctgttctcagagctcgaacaccatgctgggagaaccactactctcttcagagctgtcagacaaggacgtttaagtctgcagaagtttctgctgccttttgttcagctatgccctgcccccagaggtggggtctatagagtcagcaggccttgcagagctgcagtgggctccacccagtttgagcttcccaggctgctttgtttacctactcaagcctcagcaatggcggatgcccctccccctgccaggttgctgccttgcaggttgatctcagactgctgcactagcagtgagcaaggctccgtgggcatgagacccgccaagccaggcatgggatataatctcctggtgtgccttctgctaagaccactggaaaatcacagtatttaggtggaggcatcccgtttttccaggtacagtctgtcacggcttcccttggctaggaaagggaaatcccctgaccccttgtgcttcctgggtgaggtgatgccctgccctgcttcagcttgccctccgtgggctgcacccactgtccaaccagtcccagtgagatgaaccaggtacctcaattggaaatgcagaaatcaccgtcttctgcgtcaatcacactgggagctgcagaccggagctgttcctatttggccatcttggaatggaatccatgtctctactaataataaaattagccaggtgaagtggcagatgcccataatcccagctacttgggaggctgaggcaagagaactgcttgaacccaggaggcagaggttgcagtgagctgagattgcaccacactgcactccagcctaggcgacagagcaagactccatcaaaagaaaaaaaaaagaaagaaaatggagaaagaaccaaagactcaacgaatgcagctccagatactgaaaagtaaaagagattctctgctagagtatttggagggattgtagccctgctgatagcatgatttagcctcataacacttagttcaaatttccccagagaaggtgtggccctgctacaactcaggtttagccccgttaagatttagtttggattcctggctccagaactgtaaaacaacacatttctactgttttaagccactcaatttgtggtaatttgttacagcagccatgggaaatgaatacagaccccttcccttctctacatatactcatttctttgttacagcagccatgggaaatgaatacagaccccttttcttctctatatatactcatttctttggagagtcctttgaagatcccattcagtctcatggttttaaataccatctatatactgattaccacaaattccagcctagaactctcccttgaactcccaatttggacacacaatcgtatatttggtatgcccacctggatgcagaagaacttcccagccaacaagttccacccacagtcttccccagttcagttataggcaacaccatcctggctgttcaaacaaaaaaccttggaattatcccggatctttcattctcatattcagtcagttatacaattttgttgcctatatattaaaaagttatcaggaacctgaccagttcttactgtctctggtgctctttgcccggatgactgcttctacccttgccccactcaatcaattctgaaatgtggtcagagtaaactttttaaagtcagtcagttagagatcaagttatttctctatggctacatatttcttttagaacaaatgcccaaatctttacaataccttcagaagcctaccatctggtgcaccctaccacttccctatcctgctctccaacttcatcttcttatgttctggccctcactcattcagctgcccaaaatcaatgtatcactttagtgttcccccaacacaccaaaggaagcttccacttcagagtctttgctggtccctctacttggaatgttcttccttcagatatccggatggctcactccctgcttggtcctttacctccttcaagtctttattcaattgtcactttctcaatgaagccttctccaaccattctactcaatattgcaagccctttaccccaacaccggcctcattaccttacgtggttcttttttctctccaaagtacttatcgtcttttagcaaactgtatactttactaatttattatggttattgactgttttctccattacagtatatgctttgtgaaggtagagatttttgtctggtttatttgttgctatatcatgaatatctagaacagtgccaggcatgtattacatataactgatttctagtatataggaagtagactgcactaccctagtatttaaggtcctgatgaatccattacaaatattttatttcagacttcaagtttttatctatactgcttcaggaaacactttatgttaactattatcataggtggcaaattcctaagttacagcaatattacagtcaccctgctgtaataatcacctatctactagaaaggtagaaggaatagttgtggctcatattgtatgattctacttacacaaaatgtcaagacaggcaaatccacagagacaagaagtagaccagtggctgcctaggactagaaaaagaaaagggtgttgggaggaaatgggaagtgactactagtgggtacagggtttctttttgggataatgatgaaaatattctgaaatggattatagtgccagctacaaaactgtatatgtactaaacaaccattgaattacatactttaaatgggtgagttatatggtgtgtgaattatatctcaataaagtttttattaaaaatttttatgtggctgtggctggttatgttttggattgcttaagaaataaaacaattttggggaaaattatgggaaaacaaatttaaaataaagttcttaacaatttaggactaacaattactatcacaatttgacagtaattaattaaagtaagcaaaattattaggattctaaaaactttcaaataaatattttaactgcatagccttgttctatttaatgacacaaaagatttaggaaaggtcaaggtaagaactaatgatgtattcttacataccttataaattgagtaaacaaaaactcagggaaactcatctaaaaaaataaaaaggttttcaaaactcgacccacatttgcccaatcaggtactaactagtctttccccaaccatctttttttttcatctgaaaagtttaatgatctaacctgctagagattcagcatatgatgaaagggagcttgcagaaggcaaaataattatacgaacaaaatatctttccttttcttaacttggacaaaatatatttagacagaattaaatggcagtttcttgggtggttctttaaagttttcctaggcactcttaagattggtataacaatataaattttattatatctttaagcatctcagaaattacacttataatttatgctcataattataaatagatgtgtctatgtaaaatgtacagtgtactcatttaaaaatctagattcacagcattaaaatacttaggctgttttatataaactacaaacaaaaatacaagttttacttagatgactattgtgcagattattaagagactggtaagtttaatgaaaacatcctaatggaattattttattaaggagaattactttgacatttaaatttttacttgaaagaatcctacctagtaatcgaatagctttttaagaacagtgtataaaataaactataccataaacttaagcctagagttcatcacagattaaaacttttaaactttaaactaatcataaattaaagtatacactgaggaataagacatatacagaaagagaagtactatggccaacagctttttaacaagactgtaaataaaccttattttaccaatattaaaggattcacctaccatattctattaaaaattctatttttctactcataagttacctcaataacaaagatgtgaaaatctaatacttttctaaaacttactaacattttatttaaagtataatatctaatgcttattgacatttattcaaatcacttctttttaaataaaaacaagttctctattttgaaattttgtaggactcaatatcaggtattttgttaaatggtaacttagaataaattcaaaagaaaggtttaaaaaagaaaagttctaagcttttaaatgatcctatcaatattggtgtccgggttacacacaactataaatcaaagcagaaactggcaaaataaaagaatgatgttgacatacattattctaatacgtaatggatttctgtaaagaagaattactagagacaatagatgccccttttgttatgctgctattaagtattattgaacagtcacatttagtttaatgcctaatccagaggcatgccacaaatatgcaagtcctatttttgtctatgtctgaagacggttatgtgtgttctttttctccttccaatttcctaatcagttttgcaaatagttacaaaatttttaccaggccaaacagccccctgctccctaccctcacccatatatttgccttcattttcagcccctgtaacatcagagggtttttttttaaaactgtaaataaatcctgactaattatgatttattcacagctgctctcaatgatattatgaactagtatccttttccactattaataatttctataaaatatttaaatgcagtttttttttacaactagaattctcatttgaacaaacaagaaaatgtcatactgaaggtaaatacatcaatttaaaaatttctcttataaataagtatgttttaagtttaataaagtagctagcacagctgggaacaggaaaaatgctgtttgcttcaattttgcaagcatttgatttgattggatggcaaaatcagcttgactgtgttagaccttaaagcctaacggtgacataaaataggtaaaataggataccctgtgagtaaggtgggtgaagtaattgataatacagagatattttgcaagtggctcccttgactgcattactttctaaagggaggtgaaaggcacatagaagtcactgaaaatacttttgttgaacaaacgaacattaaaaactaaaaaggagttttgttagtgtgttattctagaaaaaaatataaaattagaacattaaatattaatttatacttaaaccaagtaatcctaaatcggtctcaaaaaatatgaataataacatattctaacctcaatgtgtataccttattaatattttctcatgttctggaaaattaattaaaacaaaagtggttcttattaaataaatgaataaaatctattgagacaaatgcttattcatattttttgaatttgaatcacttcaaatggaatatctaataattcagtatttacatatcccataactttaaaaatataacaatgtaagatactgaatcttaaacatacaagtagctactacatgttttgcacacctataatttgcatctattaaggattaaaaatattaaatttctttttattctaaaattcaaaaaaagactatattttaaatatagtcatacctaagtattttagaacattttcgcttaaaggagagctaattgatgctaccctaaatacaagaagctaaatatattaagtacatcaatatgaaatggagtatgaactggtatgtttcctgaatgccttctcttacattgttactaattcattttataatttaccatgaattaaaataatagtttcctaaaaatgactcatggaaatatatgggtgtataaataccatccactttctcctggaaatgtattatcaatctgaacacagaacacagaacctgaagagagaagctcaagtgttttaaaaatatttcgcctctcctcagcagctgatttttccatgcttgttttaaatattaatataaaacaggttttccttaaattacaaaataaaggtaactttaaagaaatattcatttaagttagaggttatgtattaaattgttgccagtgatactgttttaatgttttagttacgaaacagaaactgaagtgaaaaaaatcccacttgcataattttttttttaaattttttaattattattacactttaagttttagggtacatgtgcacaatgtgcaggtttgttacatatgtatacatgtgtcatgttggtgtgctgcacccattaactcgtcatttaacattaggtatatctcctaatgctatccctccctcctccccccaccacacaacaggctccggattgtgatgttccccctcctgtgtccatgtgttctcattgttcaattcccacctatgagtgagaacattgcataatgttttaaaacaacctttagcttgtaatctagatgtaatttgtttttaactttcagaacaataaaacaataaatagagactatagtaattgattggtctgaattgttctaagttccttagtatgaattctgtttcacagttaagccttagactcaacttgtttaaggcaaatagacaaagtataaaatattactttggagatacaagataagtataatttttgaagaagtctcagtttagaattttagatgacataaagaattaatacataaacaatatgtgccacatgtgagcagtatgcacttaataaaatatttgtatgaagctaaaaatttcttaccaaaaagttagtaaaaatagacattattattattccttccttgaaaaaacctaaaactaaatctttaagtaaatgatctataagaattcttagtctggtccatgtgattacatggtcctatgtacccagggccactggaaattctgtaagcttagatagcatgaattctgaatgttagacattgctgttcaataaaaaataacttgtattaaaatttcgtattttcactttcatggttttatttccaagtctggttattttcactacaacctgattttccagatcagtggtgtctggtcaatttatctatgggtaaaataattaagtgttcatatgtctatacccaaatgctcctccagagcagcaatttgcttaagttggcagtgcctaccgcttggcatgcaacaaggctgtcacaaaaaaatgtttactgaataaatgatgaatgaaggaaaaaataaactaaaatatttctgtagagaaagaaacatgaaatgctctaaaatgtcagtcatgtcagtaatgtttatttttacagaagaatgctgactgaaagtgtttaactgtcccctgaattgtgagactaaggctcacaacaaagacaaaaataatgtacaagcaccacctatcttgaagacagccaccaaccaaatggggccaaatcgccaaccttgagtttactcagaggttgaatgagccccaccactcccaaatcatcacccagcctacataagagggcaagggtacatcaggagcactggggtgcagtttttgtcataggagcttcctcactcaagccaagttgcacagcaccaagatattacatcaaagacacgttgtggtttcctgcaagaagaggagactggcatctcactttccagctggactgaatactgaataaagaacctgcaaacttgccctggtgctgccagtggagtagaatttagcctgctgaagtgttcatagatgacctggcatatgtccctagaagttggggaaaatatattggcctagaaacttgtctacttcttatctagagatttctgaagatgggaggcttgggtagagcagcctgcagcagcagacctaatagggccacagaaatagtatacctgggtggggcgggggagaagtggagagtacctctcacatttcccctatctacccactaattctctgagaccctagaaaaagaacaccactgactcccatggctcatatgagagaaccaggactggggaagaagcaagggctgctggtcaaacacatcaatgccccatctagagagaggggaggagtttgaacttatgaaacagaaaggagatatagctacccatctctgaggaagagctcagtgataaaggaagccaagataaagctatcatcccaagaaaaccacatattccaaccacatgaacatcatattgtcagagacattttgcagcacttagaaccagattatgccagagtgagacccactatcttcagataaccacgttcactcagatgatgacctctgcctctcttgtccttcctccatgctgcctccttcccctctctctccaagaattagacctaggaggggagaaagcatgccaacagtcttaggccacttaggtggtcttctctaagatgtagggtggggaaggatcaagtgagacttaaatcaaatttgagattaaaatcttaaactacccagacttttactaaatgaaagtgaccaaaaagttgtagcatttgtccaaaggcatagttaagagtcagaaaagggagattagaaagagcatgcttcaaagtatgttttttaaaaaaagtaatttcagatatattgccaatgagttgtaactgtttaaaagttatttacaccctgtggtaggatgaatgctcaaaaaactgctaacaaaaaacttgatagctaaaactattctttaagttcaagcatagactgatacctgcccccacactccccctacctccccacaaaaaaaaaaaacagtgaaatcctactcatggtaaattctcaggtgacagctgtaatcggcctacatttaagcttggttcaatatatccatgggtagatagagccagcctctgctcactgttcctgccccactcaccttacatttgggataccctagaaatccatttttggtaatcatctctcttcaagggtctctctggttgatctcatatacttttttccatgccaaatagtcccaaattcatggttccattctgtactttcaactatctaatagatttatatgtcctccagacactgaaaactctatacatccataacatatcttgttagcttatcctccacacacacccagtctctaaaatctgttcttccctttttctattctttatctcaaacaatagcaaaaccatcaatctaattatctaaatcagaaaccttcttcttcaccctaatcctctatataaaactgatgatcagatccagatgattctaaatgatctaatctagatgatttcttgaatgtagactctcttctctaattccactatctttgccttaatccacttttaacaatttcaacagtctttaatccagttatcctaggtctccagggtctccagttcctctctatgcttcactttgacaccaaaaaacaagtttgataagagttttcccctcataaaaattttttattagctatccattactcataggattacggctaaacctagaagcctcagcttggcagttaaagcctttaccacctaggttactactgcatcatatccaatactagtctgttcagcagacatggttgcctttaggacctgttctctgacccagctgaaatgtgcaaaaaagcattctgtgttgctggctaagccaactcagtctgcaccccgcacctcggcctgctccatgtctgtattcctactttattcgaatgggcttcagttttgctactacccagagtttggattcagtgctatgatttatgcatctcctctttctcttgactgatggctttacttctggctcaggctaacctcttcactaaaggcttagtgatagtatcattgttaaatagtacaaagtaaactcttaagtcagatttcctgggttcaaatttttgctctaccacctacaagctatgagattttgaccactgaacttaatctctccaggcattagtttcttcagtttttttttttattcttgcagcttttatgaaagttttcttttttaaaattttattattattatactttaagttttagggtacatgtgcacaatgtgcaggtttgttacatatgtatacatgtgccatgtttaaaggataataatagtaccttctgtaaaggatctcctgcattgtcaggaaagtgctttaaaaagtactcactacatactaagatctcaatatgtgtcagctgctgtttttcccaatacttattagtttattagccaaaacaaaaggacaggacaccctctgagccataaaattatatatgtagataaacttcacacaccattttcaatataaagactggctacttagaaaaacaatttcagatgctgaagtttccaacttaaaacagcctcctatcatgagtcatagcaaaatgtggcatagttgcccaaattaatagaagcctaatagtttaaatatggcgtcaagaggaaaaaaaagtataaatgaccatagacaaggaagaaattcttacaggtgagagtaactgatatacaatatggaaagacaccacaggttgactaattctggaaaattctttaaaaaatgacaacaaaaaagatgaatttccacatatcgaaagagctgctactaaatgatgactactagacacccaagggttacagatacttaataatcttcttcagttatttgaagaatattttttctagaagaatatacctctaattttataataaaagatggaagatagaatttatttgcagacttgagctataattcactgttccacaaagcaaggggaaattatctgcactttatttctattgtgccttatacagatatgctaaggggaaagtattttaatgttcataatcaaaacaaaaatgattaaatggtcaaaaccaaaagcaacgcaatttcaggaattctgtactatcactgaagttctaatgaattagtatatttcttttcatcaaagaatataggcattaaaatgacaattttagatctttcattagcaaagataatccagaactcgctagtcgttccactggactagttagtacaagaatatggccgataattaactttttatatatttatatatttgtagccttggctattaggtagtttcatttgcattctcaaattaagatagagagttaaaaactaaactgaaggtctgtgagaatgaaacttgatactctaacccaggttactgagccttttataagatgccttaataattaataatactatactgcatatcaaatttcaacatgcaccattactgaattcatgaagaaaaaaaggtctgttgagaaccatgtaaatgtgtcttcaaaataaatcagtaaggtatcttttttccaaaatactttcatctgctatgagaaacaacattagtttgaatgcccctatcactcatttatctccttaaggtctgtctatcgttctggaaaggtgtttcaacaactgatgaacacaattacaaaacaagactactttggttttgaatcaagacaactagattctggatttttaaaaaaagtctattatttactgaaaagtcttccaacatgaagaaaccaacctaatgagggctttctatttttatgaatgagaggtactatggaaaaggctaccaacctaatggcaggaaggaggaaaaggtgtcagcattaattcaagtaggccaacaaatatgataggcccccaaacaatgatgtgcatacttctaactgtggaagatagacatgagaagtatgatggaagtcagttatagaaagatttctgatagtgaactactatgcatactcagaaaacctgaattaagtataaaattacaaaaataattttagatttaaagaaatttcatgacagttcaagtacaaaactattccatcatcaaaacacaacctgatatatgcattactagtttcctcaatcaatttttaaaacttttttgaaatcgaatgctttatttatttcaaaaggtaaacactgttgggctatcagtcttaaattagaagatcataaattacattgtccactctttgatcctaaattccactattggttaacatctcttttgatgtaatcaccccaatagtccccagtgcttactgactaaacatccaaaattgggttatgaatagaaagcccacatagtcaaaataacttccttagacatcaacattagccacaacatatgcttggagtacaatatcttgttttaaaatgtagagtagtcaatttttcaatgtaatcttctaaataaatgacattttaaaaagagcaaactactatgaggagagtttgtgcttcttggagctctttttgtaagtcatttttcttttgccatgtgctttaaacatcttaataaattataacatgttgacaagaaaccacatactgcacctgtgctttctatcttaattaatccaataagtacaggcctgctcacttaaatttgtaagggaaatgatgatataatgagttttaacttaaggtattaattacctaaataagcagaattagcttaatgtttcagtagactttgcctagacacaaccaccaaataaaaatttcagaaattatggaagccttaaacagcaccattaggaataagaaagtgaaacgctcattctacctcagatagccaagtggattaaattctactaaagaaaaaaattttaaaaaccagtgcagcagttcagagacactaaaatctttgttgcttttaccgaagaatcaattaaatctagtttagctgcccagtgactaaattattattttctacttgtacataaacacttttctttgaagcaggtcactttcctttcaaaacaaaggttatgactatcttaaatgcctcagcagacggatggtcaaaacctcataaaaattctacatggacctagacaatcacatgacacaactgtgcacacgccacaccatctgttggatatgactgccagcacagatttcgtgagctggcaaaggactgaaatagtcaagaattctgcaactatttcaaagtgcaggcttctcattaattttaatttcctgttggctctacaaggaatgactgagtagtgaaagcacaatatgccacatacacttgagttcatgccacatgtacacctgtaatcataaactcttatccaaagctatccactggaacatttgggattttgtgtgtttatttcttctttaccctagaagaaataaatctgaaatatctatagttgtcttttcatactttgttaatactcttgcaaacatctggaaatacttgacaataatcatttaattaatgcaaaggtaatcgatgacaatatgcttaaatacttcactcaactgaagtggtttcctcagtccacagaactaaggactgtagagaacaagcagttctttgactaaggagtacactacaaggaaaactatagccaatatctcttttaaaaccagaaacattacctgcatttaaacaaagcagataacatgctgctatactggtaaaacaaacaaacaaacaaacaaacaaaaaactggtagatgctgctggcttaagtttttaccttaagctgtctacagggtctgtgttgctgagggcttactaaaggggtggccctgctcctctttttcggggctactctagtttctttatcactccttcacagttgctggctatagaggagggtgaaaagaccctgagaaagaaacatttctccagaacaagtgaagattcctaaaatgtccatgggcagctccagcagcagggttggtactttctctgccaaccctttactgttttctgcattttgcaacagtgacttttgttttgtttccctgtaatcatactcacttgctaatgcaggcaacaaaggtaggactgcggaaaaactaggaaagccccaggcaactttatacttggggagcaaagttagtttttttcccttctctgccacaatttttgggactttttcttcagtgtggccctggaggattcttgtgtcccttagctcaaaagaacaccaccaactgaataaatatttaagaatcagagtaattaagaaatgttaacttactattcagtatgagtcacaaccaaaaatggttgatttacctaatttctcttatactagtaattactgtcaatccaatttctttcttttttaaaatttggaaccaatgtagtgggttaacagatggcttttgaagtttttgttcttattccaaaatctttacattacccaaaatatatctatttaaatatgatactgtaatttctgcaaaacattatctacatgctctctatttaacactaaacaatctggatgttaaggctgtttggaaataattctaacaaaaactgaaacattagactagtgctataataaacagacttgccttttacatttgttttagaaatcttcataagcacatcctaaacataacttttttccggtagggttaaaaataattcaattagcccaaatatattttatctcctatctttttatgataatccccaatttggtgacatcataaattcttttatcatctccttacattcaggaacataacataagaaaatccatagaaaatcccaaagacaaatgctaacgatttaaaaggaagtacacaaattctattgcatacaggctttaagacaaggaatgcttcctaccctgcacatctgtctagcaggtgcctttccgaataagttttgtcctttaggaatctgctctgagtacctcaaaagacaataaagtgttctctttcatttttttttcttagaacccattttcctcaaggcagaaggatgaagccttctctgtcctgaaaatatggtcaaaacaactttggcttattttaagcaacttctatcaaatagacttaggaattatataaaatacagttctcttctagaaggcggcctcgagatgcatcatgaagagggaagataaacacataaaccttagtatgctttatactttaatgagtcatattttttaacattctgtaactaatagatgagggaatgaataagaccagatttccctcattaacagctggtatctttgcttttagtccacttccccattttgtgagcaaagcagtccaccaaatcacttacgctgtgctccacctatgcttcttcttttaaccattctctctttgcccctcttacacccttttccttgtcttttgccatactcactactactcttggcaattatttgttcatcttctggcaatgcttcctttattcatctcttatttatttccatttccattccgctcagtggcgattacaaacattttccactttcctcaaagtgatgagagggttgagcagttccagttgacaggtgtaataaatgttgagaaaggaagaactgttctagtcactccgtccctcctgcaattccctttttaaggctatctgccctatataagtcaaaaataaataactctgcaaaaattggatccagtcatatgatctcttgatatccctttccaactgtgagaacatcttcctttattatttttttttggtactgtcaccatttatcatttggttcctcaccttaactaatcaaaatagtactcttcaatctagtatttcagctatttctgttaatctttcctcctcattcttgtttttcttttcaattttattcctatattattttaagcttgtgccacataaccgatttcccctaccctgagtctcttcctatcaatccttcatgctatcttcaatattaatattcttaagatacttttcatcatgtcatcctccaacttaaaaccttcagtggctttccactgtctattaaataaatattcagactctgtaaccttgcaagctttcaccctctgatctggatctacttttccattttatctctcgtatttttccagattaactaccacagacttgaaggtctctatttcattgccacccaacacagattatgctttcctactgctaagctttttattacacatcattccttgtagttcctgccttctctctttctgctatccatttatcaatgcttagacaaagtcctcttccacattataatttcatatacaactccagccttcatcaaatctccctcttattcaaaaccacatggcaatgtctgagttattgttctggattacaatttaccacttcattaactcataccttgtcctcttaataaatcagtataatttatttttacccacagtgcctagcacaatccaaagtaaaatatttgttaaattagcttaatgttttctaacaaattttggaatttccagatagaatgactacaaaatctatgaggggctaaaaatgtttccaaaagttactttcaggagttagccattggaaaaatagattcacaaaactaaaatgagtctaagacagacagtagaaggctacatgtcaaaaattgtgtgtatgtgaaaaatctgaaagtagagtactgcaatggtcattatcaaaatcattaatgaactctgatttcctaaattcaacattctaatttctgttgaattttaattaacaccctttctattagattgtctgcaaagtatactgtaataattccttccatctcatagcaccctttgccatgtaactttgctgttccttccatcatgaggtgaaatttatttccatatcttatgaattaggactagacttctgacatattttgacaacagactatgacaacagtgacactgtgcaaattctttcccctcttctcttatgcattttttatgcaaaaaaatgcataacacaaaattaaccattttcaagtgttcagttaagtggcattatttacattcacactctcatacaagcatcactaccatccacttctggaacgtttttcatcttgcaaaacggaaactctgtacccatcaaacaataactccctatttctcacccgtgagaaccaacattttattttccatctcgatgaatttgactattataggtaactcatataagtagaatcatatagcatttgtccttttgtgacctggcttatttcacttagcataatgtcttcagtgcttatccatgttgtagcatattgcacaatttctttcctaaggctgaacaatattccattttatgtattacaacatttttttaatccattcatccatcaatggacacttgggttgcttctacctttttgtcattgtgaataatgctgccatgaaaaagggtgtacaactacctctttgagaccctgctttcacttctttggtacatacccagaggtagaattgctggattatatgataatgctatgttagtttttttgaggaaccaccatactgcttcccatagtgactacaacatacttccaccagcaggtgcacaaggaaaggttccaatttctctacgtcttcagaaacacttgttattttatgtgtttgtgttttgataatagtcatttgaatgggtgtgtagtatcttattgtagttttgatatgcatttctctaatgattaatgataattattgaatcttttcatgtgtttattagccatgcttatcttctttggaggaatatctatttaagtcctttgccctttttttttttttttttgagacagagtctcgctctgtcacccaggctggagtgcaatggcacgatctcggctcactgcaacctccatctcctgggttcaagtgattctcctgcctcagcctcccaagtagctggaattacaagcatgcaccaccacaccccagctaattttgtatttttagtacaggtggggtttcgccttgttggtcaggctggtctcaaactcctgacctcaggtgatccacccgcctcagcctcccaaagtgctgggattacaggcatgagccaccatgcccagcccctttgcccatttctgaaatggactgtttgggttttttttttgttgctgttgagttgtaggagttcattatacattatgaatattaacctcttatcagatatatgatttacaaatgttttctctcattccattggttgccctccactctgttgatagtgtcttgtgatgcacacaagttttccattttgatgtagtccaatttatctattttttgttacttgtttttagtgtcatagcctagaaatcactgctaaatccaatgtcacgaagtttttctcatatgtatttcctactaattttttagttttatttcttactgtaagatctttggcccattttgaattaatttttgtatatggtgtaaagtaagactccaacttcattcttttgcatgtggatatccagttttcccagcacgatttgctgaaatgcctcttctttgcccccactgaatggtcttggcatccttgccgaaaatcatttgaccatagatgtgaaaagtttacttctcagctctctattccattggtctacatgtctgtctttctgacagtaccacactgttttgatttcagtagcttggtagtaagttttgaaatcaggaaacatgagatcttcaattttgtttttctttttcaagattgttttgactaattagggtcccttgagaatccatatgaattttaggatgagtttttttctagttttgtaaaaaatatcattaggattttgacagagatgacaatgactctgtagattgctttaggcaatattaacatcctaacaatattaaagcttataatctatgaatatgtcttttcatgtattgatatctaatttctttcacccatatttttgcagttttcagtgtacaagtcttttacctacttggttaagattattcctaagtatctcattctttttgatgctattatcaatggacactgtgcagatcctacgctgatgtcaagaggccttacaaccttgttttcaccttcttggaaggctactactgccacatacaaactccaggcttgcctgatgagatcatatgacctagccaatagttagcacaattgccaacacatttgggaagtaattttagagagagtgttcagccccattcaagtcagcagatgactgcagtcacttaagaaaccccaggtaagcccagcagaagaaacacttagataaacctagacaaactattaacctacaaaattgtggttttgatgaaagtaaaatagttgttattttaagccattaaattttggggtggtagaaagattaactgaagcaaagttaaatcattttatttgccatttcttaaccatgataatttattcattactttgtagctcatttcaaagtgtttctcagagcccattaagatgtattccatactactcagccataaaaaagaataaaatcttatcttttgaagcaacatggatggaactggtagctattatcttaagtgaaacaactcagaaacagcaaagtcaaatactgcatgttctcacgtataagtaggagctaaacaatgtgtacacacggacacagagtgcggaataatagactatggaaacttggaagggtgagaggggaagaagggagtcagggatgagaaattacctaaagggtacaatgcacattatttgggtaatggttatactaaaagtccagacttcaccatgatgcaatatatccatgtaaatttaaaaaacagcaatcgtacccttaaatttatgccaaaaaaaaaaaaaagatttattccaactgacacaagacaactctttgaggctaaatactctacattattcattatattcatgaataatttaaagcttaaatgtcagcattctaaataatttataattttaaaaaagtagataggttaaaatgaaatcttattaggactaaagatgtattgattttatttttctaactgcttactacaatattgaaaaaatattaagtagacattgcaatgatgtttgcaagctaacctgtgaattatactgctaatatttgctagcaattagtactaaatttattggggatagattttgaaactttattatctgattatttaaaaactcaatcacaatattgaggaaaaaagtacttaaaatatttataattgcaaagcatttagagtcatgttgtctaagcaaaatggtttattattacttaaaaattcttaaatttaaaaaatgtacatatttatatttatctaaaattgtatttacttatccatacgtttattaataaataaaactataaaggattataaagttattttgtttgggaaaaaaaatcttccagaacaatatgcaaaagtaacattattatttaaaatgtggttaagtaaaaatttactccataaaattttcactccattaaataactcattttgagaatttactctctcaagttctggaaacagttactttaaaatagttcatctgtattttatgtattctttaaaagaagtaagaagaaccagggtagaagaaataatgagaaaatgtaacaaaataggtgataaggcagttttatactgaagtttatatgctcctaggtacagaataggactattatttctgagaaaccaagtggaattaacacttactcaaatagaaaccaactcatatactttaaaaattgaagcaaattctcaaactctatgtcataaatacctttgcttcattaattttggcaactgagtttactgaatgtcagaagtatctcatatttgcattattgaaaacatcttttaaaatagttgtcattttagttttaaggagtcctgaatatttatttaaatttgagctatgatttatttaactataaaaaagtatttctctgcaagtacatttctataagcaagctacagtttcacaatttctctaaccatgtatatggctgtataatgaatattaacatatggtctataattgtatatacatacacacagttcatatacatatgaactatgcttctcaatttgatgataaaatatagaaggagaaaacataaattgaagaattaaaatgtacttacaaagtcaaagtctccatcttgaggaactttccagttatcaggaaaaacgtttttggacatagggaagggttcatgcatgttctgattacagttttcgtgactcttattcttgaagtcttgcttatcaaagtagtccatgaaagatggtctttgtacttgtggtgaggttgcatttccttaggtaaacaaagaacataaggaaggtataagttcttacatttaaggaagtattttctttgaagtatgatttttttatgaagccatataataaatttgcactggtcagattcaaggccaacataattaatttcataaagaacaaagtgaaataaaataagaattaaaaaatacccagaccaaataaaaattaagctgatgattaggcaaaggtctggaatgtttagattgtagaaacatttcagaagtttagtaaaatcattatcagaattttattaaaaatcatttcagctttatttcaaatttctcaaagaaagtaaattttaaaaactcaggtgtttttggtgggctttttttctttgcatttaagcctgcattgctattgttattgtacattttcagctgtaagaaattatgaggacttggctaggcatggtggcctgtaacctcagaactttgggaggctaaggtggaagggatgcttgagcccaggagttcaagaccagcctaagcaacatagtgaaactctgtctctataaaaaatacaaaaaattagccaggtgtggtggcacctatctgtagtcccagctactttggggacagaggcgggaggatcacttgagcctgggaggtcaaggctgcagtgagctatgattgtgccactgcactccagcctgggcaacagagcaagaccctgttcaaattaaaaaatatatatatatgaaatacataaactttaaaaaaattaaaaaaaatcataagaacttactcagtttcctcttatatttatcaaactgcttcctcagtctttctgattccctctgtccctggacttccatggcttcgcctgccacacttacatccatgtctcccaacactacttctctagcccagactttgcgcctaagttccataactaactttgctagctattagacaacttaatctgaggtgagttgccaattaatttaccagttctaaaactaaattcaagatctttcccttcaaacctacagctcccccgacatattctatctccactaaagtcaaccttatttactcaatccccaaaataataaagttgagaattaattcagactcctcccttcccaccatagcaaactgattattaggtcttttaattctacttctcagtacagttaactataaccccttttctctacttatcattgcaactgtcttagtttagcttctaatcacttcttgcttaggccattgtagcagcctccaaactagtctccttgcttccaatatcacagttttgattttaatttccatattgtcaaagtggtgacctttctaaatacaaaccaaaagatgtcattctgctcagaatctttcaatggctcttcattttttatactgaatgactaaataggaaataaatatttggaataactagatttttaatctggctatattggtcttgatcagtggttttcaaattggatccttaaagccccagggctccaaataaatgtcccagagaccaccaagaaggcatttcccatataattctccaaatagaaagtaagctactttcctttttcttttctttttttttgagatggagtttcgctcttgttgtgcaggctggagtgcaatggcacgaactcagctcattgcaacctccgcctcctgagttcaagcaattctcctgcctcagcctcccaagtagctgggattacaggcatgcgccaccatgcccggctaattttgtatttttagtagagatggggtttctccatgttggtcaggcagtaagctactttcttaagaattttttgtggggagtacacctccccacaagggaccctgatgggcaactgtaagttacaaaaagtatttttaaaacgtaaaattgaaatctttccttccgtaatttacactcatgttccaaataaattactctttcgtataattgtccctcaaatatctgaagacagaggtaatggctcctgtcttggctgtctatttttaatataaaacatccccagttcctttcataggatatatgtttcagattcatcatcaacttgtttacttgcctatggagacattctagtctactgttcctctaaaaagaaacataatattcataacagttatctgaccaacctagattgcatttgtaatagtcctagcacagttgaaaactacagttactactatgacaactaagtaacaatgttagttgggacgagctttaaggtcattttggtcaaaagaaagcatgttaagacttatttttagtctttaaaaatatgagggaagcctaaatcgatgcctactttatgtggcaaatcagagagtccggaattcttaatcaaacttcaaaaaacaaaagggggggggacggagattgaactgacaggtaaacgtcctatctcctctttcctttctccctacttttggatctctatgtgtgttatttgacagattggaagcctaggtgaggcggcttaggtgaggttataagagagagtggtaatggtgatatttattcatcaaaagaattctgtctcattgccttaaaataaaatggtttgccatatcaaaacagaggttttattgacttcaccttatgtgttttaaaaaaatttttataagataaaatttaccatcttacttctgggtatatatccggaactgaaagccaggtcttgaagagataactgtaaccccatgtctattgcagcattattcataacagctaaaacatggaagcaagccaagtgcccattagcaaaatgtgaggaaggaaattctgacacatgctacaacatggatgaaccttgaggacattatgctatgtgaaataagctagtaacaaaagaacaaaatactgtatgattccacttatgtcaggtatttagagtagtcaacatcatagagacagaaaacagaatggtggttgctagggactaagaggagtgggaaatggggagtcggcgtttaacaggtacagcagttgagttttacaagatgaaaagagttatggaaattgatggtggtgatggctgcacaactttatggaagtgcttaagattaatactattgaactagatacaggcatatttcgcagttattgcaggtttggttccagaccactgcaataatgagaatatcgcaataatgtaagtcacataaattttttggtttcccagtgcacataaaagttatgtttgtttgtttgccttcacaacgtcaattttcttaaaaatttctttttaacttttaaggtcaggggtacatgtgcagatttgttacataggtaaacttgtgtcatgggggtttgttttacagattatttcatcacccacgtattaagcctagtacccatttgttttttctgatcctctccctcctcccagcctccactctctgaaaagtcccagtgtgtgttgttccccagatgtggccatgtattctcatcatttagcttccacttgtaagtgagaacatgcggtatttggttttctaaaagttatgtttaggagtgacatcagaaagatggctgacaagagaggcctggtgctagtccactctcaacaaaaaaagaccgaggcaacagataaatagctaagatttgactggagtgtcagtgggagaaccctggagaataacgagagagtgcagaggcacctgtgctgcttagaagtccagtttggggtggctgtagtgtttcttaaataataccgcagtgaagtttgctgtatcagttaactcttcctttcacaaaatgtttctctgtagcatgagatgctgtttcgtaacattttacccacagcacagtgtctctcaaaattgtagtcaatcctctcaaactctaccactgctttatcaactgagtttatggaaaattctaagtcctttgttgtcatttcaacaatgttcacagcatcttcacaaggagtagattccatcgcaagaaaccactttctttgctcatccataagaagcaactcttcatctgttcaagtttaatcatgagattgcagcaatgcaggcacatcttcaggctgtacttccaagtctagttctttcgctattaccatcacacttgcagttacttcctccactgaagtctttaaccccttaaagtcatccatgagggttggaatggacttcttccaacctcctgttaatgctgatctttttacttcctcctatgaatcacaaatgttcttaataacatgaagaatgatgaatcctttccagaaggttttcaacttacttgatccagatccatcaaagcaatcattatttatggcagatattgccttataaaatgtatttcttaataataagacttgaaagtctaaaatactcatggatctatgggctacaaaatggatgttgtgttagcaggcatgaaaacaacattaatttccttgcatatttccatcagaccccttgggtgaccaggtgcattctcactgagcagtaacagtccaaagataatctttttttctcagcagtaggtctcaacagtgggcttaaaatattcagcaaaccatagtgcaaacaaatgtgctgccatccaggcttcattattccatttatagagcacaggcagagcagaatgagcataatttttaagggccctaggattttcaaaacagtaaatgaacattggcttcaacttagtcaccaccaccagcctgtcctttgaagctctgaagccaggcattgacttctcctctgtagctaggaaagtcttagatgacatcttccaatagaagacttgtttattctatattgaaattctgttgtttagggtagccaccttcatcaattatcttagctacatcttctggataacttgctgcagcttctccatcagtacttgctgcttcactttgtacttgtatggtctggagatagcttctttccttaaacgtcatgaaccaacctatgctagcttcaaacttttcttctgcagcttccttacctctttcagccttccagaattaaacagagttagagccttgctctgggttagactttggcttaaggaaatgttgtgactggtttaatcttctatccacaccactcaaactttctccatatcagaaagagaaaggctgtttcactttcttatcattcatgtgttcactggagtagaacttttaatttcctttaagaagtttttctttgcattcacaacttggctgtttggtgcaagaggcctagctttcacccagtctcagctttcaatatgccttcctcactaagtttaatcatttctagcttttgatttaaagtgagagatgtgtgactcttcctttcactttagcacatagaggccattgcagggttatcaatgggcctaatttcaatattgtgatgtctcagagaaaagggaggcctgaggagagagacagagacaaggtaatggcctgctggtggggcagtcagaacacatactacatttatcaattaaattcgccatcttatataggcgcagtttgttgtaccccaaaacaattacaatagtagcaccaaagaccactgatcacagatcagtgtaacagacataataatgatgaaaaggtttgaaatattgtgaaaagtaccaaactatgacacagaaatacaaagtgagcacataacattggaaaaacagtgccaatagacttgcttgacacaaggttgccacaaaccttcaatctgtaaaacacagaatgtctgtgaagcacaaaaaagcaaattgcaataatgaggtatgcttatgtttaaaaatggttaagatggtgaattttaggttatatgtattttaccacaataaaaaaaatttttttaattaccatcaaaaatgtgccattcagtagcatgaagtattgtgtgaccaatcttcaccttgcaaaatggagactcttgtacccaatgaacaacttgccattttcccctacctctagcaaccaccattttacttcctgtttttatgaatcttactactctggatatgtcatataagtataatccattaaagtggtatttttttgtttttctttgttttttttatgactggcttatttcatttaacataatgacctcaaggttcattcatgttgtggcatgtgtcagcatttccttccttttcaagaataaataacattcaactctatgtatatactacattttgcttatccatttgtctgtcaatgaacacttgggtttttctacttttgttgaataatgctcctatgaatattgttgaataatgctcctatgaacatgagtatagaaatacatcttagagatcctgctaattatgtggctttgtgttatttactcttttttaaataagtttttctctatgtgcagatctttagttgcaagtaatcttattttttaatatctatccagaggccttttttgctttctaatgggtgttttgatggttgagcctaatctctgattaaatgaatgattacaatacaatgtaaacatgtgaataatataattattggtaaaagtaatttttatttttaccctatgagtatgttgtatgtatgtatgtatggatggatgggtgggtggactgactgatttgattgcctgacagggtctctccttctgtctcccatgctggagtgcagtggcatgatctccgcccactgaaggcttgaccttctgggctcaagcgattttcccatctcagcctcctgagtagctaggactacaggcatgcaccgccacactcggttaatttttgtttactttttgtagagatgaggtcttactatgttgcccaggctggtttcaaactcctggactcaagcaatcctcccattttggcctcccaaagtgctggcatcacaggtgtgggccaccatacctcgctgagttatgtcttttaaatgtgtttccatctttacttttcattaaaccgtaagttccctaatgtagaattccaaatcctttacctaaataatttcacagataactctattaatttgtgtttttgactgtctacccagatgttgaatacctatgaacaacagcaggagccatggtttttcatcattacttttgaattagtagatgctatatgtatttcattactagcattggtgcactgctgataatgtatttgagaaagtattgtgactactacaattattattaggctggtgcaagtaataacagaatgatctatcccagtagagtcagaaagaacctgattttcagaatatacatgtattagtggaaaaatagaaaaagactctcaacacaactgtttatctaaggaccaatcctctaattacagctgttccagctttagatggctagaaaatgtgacaagacatctgggacccaaatggtacccactgtaaagatattgagacattctatgaaatttaagatagtataaaacaccaatatttgtggtaaacctttagaacttagaacactctcatatctcacattcaaagctcatgaaaaagaaactccttagagacagttcagcatgaaaacagccaaagctgcctttagatttcctgtcataacagactttacaagtatgttaaaaatgaacaaaatatatagaagagaaggtgtaatatttcaacgatcaataaatatgctaaaaataaagatatggtgtctatggtgttcatcttcaactttgttccctgaaatcaacaacaaaaatagaaattggttaatttgatgggttacattactgacatttagacaggacacatacattccattaacattttcagcagatttttagtacctttgatttgtctctaggcttcatcattacaagacgtatttctctatattcagaattgaaactcggttcccatggtaacctcttatactaaaatagagtctaggaatttaacctgttattctccatttctgccccattttgtaagtttaaaaaaattacaagtgtagctcaacttacacatattttttataaaccaattgagtaaatcaaaccataaagctgggagaagggggataatcccttaaagaaattctttgctcaatattctttttgtttctttttctttttaaagggaagattaattctgtaatagaattatatatttagttgtaagttctgttttcatcaagaagtcttaaaatgtgtcacacacataaatacatctgaaaactttaacattcagtattatataataagggttatcaagtttgtcaaggaaagtcagaatcagggaggagagaaaaaatggtttctttagaaactaactgctggaaaagtaagaaactcctaaaccaccattatcaactgcatttgataatgaaaagaaaggtttcactgaagcgtatttctagatagcattctttaaaaagtaaatttagtatttgtaggtgctttggtaagaacaaaacaaaaacaatagaaactacaaaaagcatgcattgtagcactactaatccagtgaagacaacagcactctgtgacctatgttcctccccagatcatcttcctctctccacaccaagccaggaccacattgctttcattaattttttttttttttttcatccagcactggcttcactgctgaggctctcgttatggtcttgttttctcctcaactgggagataagaaactcttcatcccagaatctttacaaactccccagtgctgtaataaacagtcagggttctcttgatataccactgactcttactttggacctctatctgagaaaattcacccaaaccattattggagtaaattaaaaactaatcttttcctaccagaaactaacatttatagagcacctattctaatatgacctacatattaagagtagcagcatacactgggaaggagaaggagaaaaataaaatctcagaagttgcttttttcactacaaagaacagagtgggggaaattttaatcttctataaaaaccttcaaaacagaaagatgggctgagcaggcatttcctttagaaatgaggagagtaagaaaaaggctgaaggaaagacaatgttcttttctgcaatgagtcagagaagaaacagtttgattagagagaagtggtagcaacagaaaggggagaagcagactactccttggtgttgactaaataaagaaaggaaattactaggaaatttcattccaggaatctactcttccaaccccaacagccttgtgcgtgctcctgacaacatcccaatcaggagcttctaactgaagtcacataagccaccaccaatgttgtagtgtctcaaagtgaaaaatttgcctccctaatatctataatccctagcttcctgactaggggtgagaaagtatctatctcattggaaaaagtggccatgtaatacaattctggctaatgacacataaaaataagggtttaggccaggtatggtggctcatacctctaatcccagcattttgggaggttgaggcaggaggattgcttgaggccaggagtttgaagctgcaataagctatgggctatgatcacaaacaccatattccagtctagatgacagagtgagacccttctcttaaaaaaaaatcaagtaaggttttctaggaaagttctgttttcttgatataggcacaatcctttctgttttttgctcttttctactgcctggaatacagacttgatggctagagatcctacatttactctgcaggcaggagaacaagcataataccctaaaagatggtgtcacagaaatgatttctaatgacatcatgaactcactctgccagtgccggatactctgcttttggatttctcatcaaatgagaaaagaaattaatcttattttgtttaaatcactgttatttgggtttattggtacatacagtcaaattcagtccttaactgatacatttctattcccaaatggaggatgtagggagaagcagaaggagcagcaatctgcagtttcactgcagaaacatcccaatttcaaacttgaagtccactattatacagagtagtttaaatatcactacgtctcagatacattatagttttaaaggtttttttacaggctgacctaaaaaacctatggcaaaatgccttttggcttccatactcaaaaattttaaaaataacccactcctaagataaaaataaacattcttacagagttaacaaaagttttaaaagcaacttaaataaaagaaggagtctattctgtcagatttttctttttggatgatttaataacaagatactattaaccaagatatgtttacacttaattttttattcaaatgtataatgtatgtgcttatacttctaaatattttccattgcttaatttaaaacctagtattaacatttagagtatctctttgtcatacacacaaaaaaagattaaaaaacaatttttaaaaaattttaaagaggaaaacaggttaggtttgttttaaaagttaatgggagggggcagctgcaattgcccagtaatgtttaactacacaatatgaaacacatgccacaatgcgcagctgagtctccagggagatacatgttcacagaagtgggacagagaggatgatgtttctgacttacaatttattaaaaaaaatactaggctcttcaatgagaaaataaagcaggaaatctcaagatagtaaccactgtcatatgtgatgtggttgctatggcaaatactttttttaagcacaaaaagaataatcatataaaattgacatcaatttctccagctgcagccgaattctgaccccagcttacaaaaacattttattttaacaataattttaacgttcagaattacctagttcctcaattttggccctaattccttcaactagttgctcatggaactaaaaacctattagcaataaagaataaagtaactatcattcattctctttgtggataagaaattttaaagaaaaaggttgcttttcatctccttcatgcatccccaaaacatttacaagtaaactaaattgtgagaaatataataccgtagaaaatacgtcagtccacccacaattattcattaagtttcctaatttgcacatcttctaaacaagtaaaaagtcctcataaaaatttaaatatataaagtaatttttaaaaatactttaacaaaataatttaatttttaacttcttagcatgattatgacaaagatattcaagtttagagaataaaataacaatcataactttagtaaagtatgtgtcaacatcaaaaagatttatgaagattacctaatttgttcttctaaaaatattttaagatgtgggtggttccacctcattaatggccttcgaaatgtgtcctttaatttgctgccaagagtatagtgaatacatataaaaaccaggatgttaacacagaagctactgacatcagttttttcctgaacttcaccatactgtattttaaaacaaagaaggataaacataacatggagaaggtccacagactattcataaaagattaaaaagcttagaaaataatacctgcacaaaggttaaagagactgaaattattcagccaagaaaagtcaagtctgagaaagaacttaataagtatccaagtatttatgaagggttctttgcacagaaaatagtgaccagctgttttcaatctccaatgaagtcagaatagaaggaaacaaaaattgaagcccaaagattttagttaaataaaaggaaggagttcctgtgcgagtaatgaatattgtaatggtcactgtatctatgaaaatgctttcttccaaggcctgtacaggaaagatattttcatttttacagggaagactaatatttacatccttgtgtgtgttttgtgctaataaaagaggtatcctacaaccaaaatgcatacaccagcaggtctgagctgggttatacttcgttaaacgtcccacggaccaagagcacacagaatagtagactatactcagtgcccacagggaactccaaaccactgcagccacaccttacctggattcctcgtacttttgtaaaggaaaatgaatgatttctaattgcccagaaatatgatgggtatttgcacccagctgcaagagggacctgtagtttactgctgtcacctttattgtcatatcccgggcaacattaacctcctaagttaaagaggaatggaacagtttttcataaaagaatggtaagtgagaaagtagttcccctacacattctcctacccttgccaattatttcttggcatctcaaattccatccttagtgatttactcctttggctcaaggctgtacgattctgggagaaaatgtatttcatgagcattaaacattattaggcattttattcctgtgtatctggtctctttccaaaacagattttgggggaaaaaagggaggaaggaaaggatatgagaaccgagagaaagatattactaagcaaagaatacggcatggaagtagatgctcagaacaaaacaaattgcctcatacttcacgattttgtctaggaacaatggatgaaccagggagtagagtcagtcttctcttcttggtatctctcctcaactgacactaatatctagtatcgtttccagagtaactcctaaaaagctaaagcagaacttcatttgctttctcttactaattaagtaaaactgcatatatgtgctgtccaaaataaactctgaaattttcaaaatcaacaaatactatatgcatatacaggtaagacatttttaaaatgtatatttagtaaatattatttaacccagtatttaagaaatgataaacatttatgaaaggttaatataagtaaataatatacaacctaaacataaccggttatttctccacccattcttttttgtttttctgagatagagtcttgctctgtcgcccaggctggagtgctgttgcgggatctcagctcactgcagcctctgcctcctgggttccagcgattctcctgcctcagcctcctgggtagctgggattacaggtgcatgccaccatgcccagctaatttttgtatttttagtagagacggggtttcaccgtgttggccaggctggtctcgaactcctgaccttaggtgatccccctgccttggcttcccaaagtgctgggattacaggcgtgagccactgcgcccggcctctccacccattcttaatacaacatggtctccacctacatcgccatccagctgcctctctgttcaatgtgctccagtgtatctccagccttcttaaatactccaggtaagttctaaacacaatactccaggtgagttctggctcctgagagcagagggaagctgtttatttccttgttctaaaaagtggttatctgtcctagctgcacctcagaagcacttgtagagtttttaaattttaaaaaacgtattttaaaagcagagatgcccaagccctgctctagtcttcagaccagcatctctgaagagcgactgttacaatacatacttgtgaggctggttatttggacccaaaagcagggtttatcttgtaaatcaagcccactgctccagcctgtggtgatcttttaggatcctcgttctatcctataacatatttttattttgttccacttcatgttatttgcaattctgatggaccttcaccttatagcttcatccaagtttctatgaaaaattttgagctagccagggctggaggccgaggtcctgtatcacaaaatgagaaatcttccggtaaacaatttattatttaacattgtagtcgactgaaatttagcaaccactgccgtgtgcccctggtgagcctttgtatcatagaggctagagagctgaacaccacatttctcagaattccttgcaactagagttctgggtaagtgcactctttcgcaactggggtggtgggggcggtggggggaagcaaacagaagctatatgcctgctagtttagttatttccttcttacaagccctgtcatagaggcttgattatttacagcagcattctagcatctagtcaccagtttcacaggtactgaggagtggttgcagtaatatttagtagctttctaatccctaaatagcagtgagggttgatttcaatctgtattactgaactcagcggcgccagcggtagcctctggattgctattcctcgttgtggcagtagtagttgttccttatatgctcacttttgtggtgttgtgggagtcactcttgaagcctatgctacacagccttctcctctaggctttccattgattttcttaacttctacatctttaatatggcttggctctatgcccccacctaaatctcacgttgaattttaattcccagtgctggaggggggactggtgggagatgattggatcacgggggtagtttctaacggtttagcaccatccccctagtgctgtctcgtggctgagttctcacaggatctggttgtttaaaagtgtatagccccacccgctttgctctttctcccgttcagccatgtaggacgtgccagcttccccgtccccttccaccatgattgcaggtttcctgaggcctccctagccatgcttcctgtacagcctgcagaaccataagcaaattataccccttttctttatatattacccagtctcacatagttctttatagcaatatgagaacacattaatacaatctctgacttaaattgctttgtgtgtggaatacctggagtagattctgtttcctccaataaactctcactgatataagcacatttgagtataactgttgcactctcataacaggaccaccagctaggtcacactacatagtgtctacaagggtatcatgaaagaccttgtcaaatactttcctaatatcctaagatacaatattcaaactctgcattttctctgaccttgaagtttagcaatgctgtcaaaaaaggaaattatattattctgatacgatttcttctcagtaatctatgctgacttataacgatcctgatctttcctaaaggactcttaaatgttctagaatcctgcccaagagggacattgagctcactggccccagagtagtgatgtgattctagtgtcaaccctgtgtctatatactggtttcatcacttacttgctaggaaatcttgaacagcattcccaagtctcagtttccttagtgctaaatggtagtgaaatgctattttataggatccttgtgaggagtaaataagataacatatacaaaatcctaagcacagtgtttggcctgtagtaggagctcaattagtaacagctataacctgagaaattcacctttttctccatttccaaaaataaaataaaataaaatgtaaatgtacttttatacttccatgacactctcctcattttctcaaagagatgtcaaatttcacaaacagtggaaaacagttctctcatctcaagtcgtatcaatagatattatcaaacacactctcggtcaggagatgccaagtgcgctgagtacttctctagcatttgctcatcttgccattcaaacccctcttattcatgttgatgctactcagttcattttggagatcatcattctctatagaagcccctttgactagcttactaaaaaaaagagagatggagcaaggtcttggaggaggcagggaaaggtggaggcaagaatttgccgtgggaagaacagagttgctcgatagctcagcatctctggtcccaggaagatatgatttttatcaccgcatgggaagcagggctgacaatgcccagggcttcccggatgctccctcttatcaagttgttggaaggataaattaatagggtggacagatgaatattatcctttattgattatcaactatatttaaaacactgctaggcatgttttgaatttacctaatacacacacctgcacatatacacacaacagagagacaaatatttatcactgaaactcagacagaattaagcaacacaattactaaatgatttggcttcacatcccatgctcttcactataccacatcatttgttcagaaaacatttcatgaactcttaccaagtgctaggtattgtattaggtatcaaaaatacagtgggaaataaacaaaagcacacgctcacaataaagcatgacagtgctgtaagagtgaaagcttggggtgagatgggagcctattagaggggcacttattcctaacctggggttgatagaggaagcaacctcttaactgagcctgagtgaatgaatatgatttagcaaaagaagcataaatcccacaggaggatttaggcattgcaagtggccaaaggtaaaaaagctctgtaagagctgagaagctggaagaaggatgaagagggaatagaaaggtaagtaggaaccagagcatatactgcttcttaactggtgttgagctttagcctataagcaattggtagtcactgggagggcataagcagaagagaaatgtgctgaaatctgtatggtggggagggaatgaagattggaggcagaggatcagtttagaagcctcacaagtgagaaactatgaggacttgcactaaagaaatgcaagcagagatcatgagaagagaatagggatatttagggggcagaactgatgagatgttacttccatgaagggtgaaggaagaaacggaaattaagaatgactcaatttttcaaccttattccaaagaccacatttaaaacacctatacagcttctctaggtacttgcatgataacatttcactttttttctgtaaagtagggagcaacgtcatctactgaaactgagatgggaggcaggaagaagagatctagtgaagatctaaactagccactctgtagaatgaggaattgctgaacagagaaacacaggcctccaggaaagttgagggcccaaatgggggagaaggtcttgatctggcagccctcatctgtgcagatggaagattatctccagcagcactcaatagccagggtaaagatgcagagaagatgaacactgagactggaccatatcaaagttttccaggagaggcagaaaagacaagacattagggcagtggagtttagaatataagagagtggcagaagcaatgaaatatagcctctaagaggagtttagaacataagagagtggcagaagcaatgaaataatgaaatatagcctctaagaggagtttagaacatacgagagtggcagaagcaacgaaataatgaaatatagcctctaagctggatatagaagtgaagggagggtgtgctaataaaaagaaagcagactaggaactagggtcagggaactagagggctctcatgatagcatttcccaaaatgtgtttctcagatgcttattacacaggatgttaatcactgatacgttcctcattaaaagcttttcatggtcaaataagtgaaggaaagtttgggtaatgtaatttttaaactgtttccttcctgtactatttgtatttaataagttaataatatatactgtagttctctaataatttatctctaggataaatatgcatttcccaaataattctgattactgtatattatttatctatatttatcagagaatttcactgaatgggtatcttaaggaacacattttcagagggtctgctctgtgaaatgagaagcagggatggtagaacacttgaaaagaaagtatcttaccaaggcaggaggtttacctgaaagttctcttagcttccagagctatgtatctttaattctactataacacacacacacacacacacacacacacacacacacacacacacacagcttgactctgactctactgtaattagtattcattcatgaaaccaatattccaagagcatgtactattatgtggcagaggagatttatacagcattcttaccaggacaaacttcgtgacttatctggagaaacaacagatacacacatgaaaaataaaaacctggctggaaaatatggctcttcctcagatacccataagacatagtttccctccagggcaactagtgctaccaatctagccacagctctgtaagatcagaaagttcctccataaaaacagagctaactgagtagatctgagctgaacaaactaaaaagccccagtctttctttgctgaagctactactctcccagagtcacccatgatgaaataatctctcctaccccatcagtttgatgacatagattcttgacctggtcctaatctactccaggataataaatcctaaattgattttcttgaatgacaaccaacctgcttttacccagtgtcaagcattcagaattccaactggcacagactagtatggataaaacataatccataaggaagaagtagagatccacatgtaaataatggctagtgccagactgtgaaggatcttggtgacacagctgaagcctggacattccatggggaatgaggaggccttagggatatctgaataggaagactgggagcgggagggtaaaagtaatgccatcattgctaaaaacaggtttagaaagttattcttgggacatgcccatagggtccacgtccattttttaaaaggcagatcaaattttaaaatactttttgtcatttttctccacttcccttcaaagggtctgtgggtaattttcctttctagaggtaaggaaaataggcccataatttctagcttcatggttaaaggtataaaagagtaagtgtaaacataatttaaactgacaaggatgttaaatcaggcaactcacttgaaactccaatggaaaaagagatgaaattctaaatcttcagtacacattgtagagattttagaaaaccaaaaataatatactgctatcatcttattagggaacaaaaatgctaaagacacattagcaaatgtggctttgactgatgtgacataagctgagacctcataccaactaatttaagaagttttaaagatttagatcacgagaaaaacaaaactacaataattatatggtttcagaaaaagtaagtcttccctcaataacttcttcacatactttactactgctatactacaatatgacaatccctaggggttatactaacatcacttgattagaattttggaaacactgaagtctcacattacagaatgatgtctaacttgtaaaaacaaaaaacacagaaagttggctcatgggatttaaaatttgctgaggtccataaaacaactgcagctataaaaaccacttatctgttcaacttcaaaattggttttcactaaaatctctgtgacaaaaagtcatacctatacaatcagttataacaaaattataacatgtattgatttttgtggatgtcaaatctaaaagtcactatacaaaatgtcagaaatctgtggtataaagtatgatgtcggaaacatcatcattagtctctcttccttgaaatataatacactgcaatctaaatgaattagattctataaagactcatttttcttaactattatatatatgctgatgttcaactatatgactgcatgaaaagttgttcatatagtttcataaggagctcagtaactccctaaagacacaaaaaagcactcaatgatctaattgatctgttaagaatcataaaatttgagttaaaaattatatcagcttatggaaaattgatattacatgttgatgaaaaatgtgttaactgttttaccacagagtctttgtgatccacttgtaccccaacactagctggttctggaggccataagaccatcctctgcagtggagtgaggcacgttatggatgcagaaaacttactctagtcagatgcccagctaggaatttcaggaaatccaagatgtaggctgctttccaggaaaaaggcacagaagacccaccaatggcaggagatagaaaattcatactccacccccaggattatggcaatatagcaatctattacattttgtgcttcatgatcctctctatccaaagtacatatgcaaccatagtgggctacacagaactagggaatgtgaagaaagcagcagtactgagccacgtgacttgaagttatgggtcagacctcatggcggagtagcaaaaagaaaagggtgggcaaaaaggaaatggaagtatctgagagaaaattctggtatccattttgcagtaccagcaaatcacttgaatatttacaattttctaggttctacaatgctagaagtcatgtaattctgctgttctgccatggagaggcaatactcttcagtggaaagcagcctagtgcttgcttagactttgacactaaccacacaggactagggtaggagcatgacaggaagaaaaaggtcagttggtgctaagagaaaattcatttttgcctataactgtgaaatcacaatgacctacgatgttaactgcagtatcttaaaaaactgtttttaaaaaagagaagtgctagtctgtgaaagcattcctattgtcatcactttgtaagcaacagaggtcagagagaatgtttgatcatcattttagccactgcagcacccccagcactgtgcctcacatatgataagcagcagtaaatattcatgcaactgaatcttctgtatgagcatccctgtctcttaatccttctttctagtgcttcttattttcccaccttatttcttcccatagctcgcactgctctttgtggtttaactgataatttggacaacataaaataatagtctgttgaatttactggaagataattttaggttcacttttttaattgggaaagtaaatgttaggaacactatctttttctctctaaaatactttgcaaattaagccgtgggttagcaaccttcaacagaaaaaagttccataactctaagttgaagatgtgttgttttctgctatattaaaatacaattttaaaaaggtgacttgtgccatactcttttttactgttacataaatctaagaaacaaaattttccacagttggctataaaaagtaacacagaactagcctggttcctataaaagtatcctttcgaattagaaaactaatatttaatgtaaaaaagccacatacttttcatagttccatcttcttcttcctcatcctcactgtttatcaccatggtccccaagtcggattccaacatcgtgctattatgttcaatcatggtctgggccccttcactcatcgtgcttgtggcccgcatggtgcccacactctccacactagtcttcaccatggtgtgggaatccagctcatcttcatcctgcaagcaaaatactgcaatgagggaagacttttctatgacagctggatttcttaattcttaacaagagaatgaatatattatagttttaatacttattaaaaatactattagtactgattttaatataaatacatacatacaaatgttattttaagagtgaaaattattcaaaataacctaaagctttaggtaattacagatcaagcaacagaaactgatgaagtagaaggctgctagttgcttttaaaataaggattaagataggtaaactatcagcaaatgcataacaaagaatatggtgacaaaacaactaaatatatatgagagcacctttaagacagaacacattgacactttgtattataatgggcataatgatgtctataaccttgtaaaacagccattagctttttcttttaaattatggcaaaatatacaaatacatatatataaaattcaccattttagcaatttttaagtgtataactctgtagcactaagtatatttacaatgttgtgcaaccaccaccattatatgtttacagaactcttcattccccctttccccagccctggcaacctctattgtacttacaagaggtatctagaataggcaaattcatgagtactactattcataccatagtactaattcataattactattatacttatgaatttgcctattctagatacctcatgtaagtggaatcatacaatatattttgctgagcctaatgcattcaagattcatgcatattgtggtagaaaaatttcattcctttttaaggctgaatgatattccattgtatgaatacaccacattttgtttccctatttatctgttgatggccatttggattgttgacacctttggctactgtgaatagtgctaatgtgaacactgacctacaagtatctgtttgaatccctattttcagtttggttgggtatctacctagaagtacaattgctggatcacatggtaacttcatatttaattttttaagtgcccaaactgttttccacagtggctataccattttacactcccaccagcaatgcacaggattccaacttctccacatccttggcaacacttgttattttccatttttaaaaaataatagccatcctaatgaacatgaagtgttatcacattgtagtttgatctgcatctccctaatgactactgatgttgagcaatcttttcgcacgcttattagccatttgtatatcttctttggagaaatatccatttacccattttaaaatgggttgtttggtttttctgttgttattacaaattctggatattaattccttaccagagatataatttgcaaatattttctcccattctgtgtgctttttacttcatttatagcgtcttttgatgtaagtttttaattttgatgaagtctgatttatcaattttttgcttttgttgacaaatctcagcttttaaatgtttcacagaagaatcaagtcagtaataaaagtacaaattaaaagtgctctttagaacattcaccaaagatatactggaatagggtcataaaaataaattaacaaatcctgtttgaaagaccaactgataatcacagtgctttgggaggtcagggcagaaggccaggagtttgagaccagcctaggcaatgcagcaagaccttgcctccacaaaaaatttaaaaattagctgaacacggtggtgtgcctgtagtcctagctacttgatgggctgaggctggaagactgcctgagctcaagagtttgaggctacagtgagctatgatggtgccactgctctccagccggggtgacagagcaagaccccatttcaaaaagaaagaaaggaccaaagaatctgctatttagaaaaacttgattacgcacggaaattcatttatatttattccatttttagtagaaacatataagcaaaatctagttctggcagaggtcaaaatgcaaatctgagaacatcaatgttgagtttcagcaacttgggttgtataatataacaacagttggacagctgtttgatacctttcctcttcctaaacctacatgctaagcttgggcattaggtctcaaagtcgtttgcacttctttcatgatcctttctcttttagaagacctcttcattctcatgccttcaactatctaataagttgaggagtctcaaatcctgaaatcttcctatgtctttacttattacgtaaatacttaaagatgtctaaaatttgacagtcccaaatcagatattatttcatttatctctccagtctctcctatctgtctccatccccaacaaccaccacaaagcatggtaatcttcacttgctacataaaacttcaatgtcttcttacatttattttctctttcattccctatatatgcatcagtcaactagttctttaaataattctctcttagctccatctcttcttttccattcccactgctactgggtataatcctcactacatcataggtggtttactgcagctaatgcttcctgactgaggactctcccatctaactttctagagtcagacagacattagttcaaatcctggctcaaatcacttatgaggcataggatccttgtctccaaagattgatgattaaataaaaaggtaagcaaaatgcctgcatgctacctggaacaaggtagtttcacaccttcctcaaagtacacggcattatactaacctttcttgaatactatttctatcattctaatgaagaatctacaatggctcccagttcctgccttcattaaagctaaacatttctgcctaaatttcaatgtcttctatggaccaatcctattttcccattgttcatataacctccaatacaggcaggctggactttaactgaatctctttgccataactccatatgatgctatgttcattaaagacttcctttgtgtacgtcttattctctatccagaaggtccttcccctctatccatttaactaaatcatacctagtttcagatcaagtatctactacttccatggctaattcagtctttgttaattattctcttttctaaacttccatagaatttacaaccggcattagacacttctgtattcaatttatgatctcatattgcaagcaattgttttgcaaaatcttttataaatgtaagtaccctatggacaagaatgtcttagagtacctctgaatccactaaagtgcttcattcagtattcaaaacacagtaagggtttgtgaaagttgtcagaatcaaaatgaagtcatttctgtttaaaacaacaaaaaaacaaacaaaaaccaaccctgacaaatggagcaagggaaagccataaagagatggtcctcatgcataaatgcctgatagcgaaagctatcacaaaagactgccagaaccactatcttgcacaaaggccattgcaatcttacatgaaaaatactgcgaggacatctacccagcaactgcctatccaaccacagactggcgcacaaggataagcacttcaaaacaattaggcagttctccccatttttcctttaaaaacctttgtcttcctttaccccccgaatatgcacattgttttgtatagcacctttactcgcactgccctattctaaaataaatgttactttcttttagagagtctttgctatttaggttgacacgttcaatacatattgactttttcatggaattataaaatcaaggacctttacagttagagagaaactaattcaaaccatcattttatatctgaaaacactgaggtccacagaaaataagagacttccctaaggtcacacacctacttaaaagtaggtctgggactaagaaacaagttcttttatttcttagcccattattctactatatacatgtacctgaattatgtttaaatttttctctactcaaatgcttaagttggagatgtaagctcacaatttttaaaagcttatatcaccaccttctattcccagagtcccatataaattattccatccattctagtccaagccaccatcttctcccacttggagcatgaaaatagcctactgactgttcttattgtttccatttttgccccttttagtctcactcacataggcagattgatcccttcagaagacaaatgacatgttactctcctgctaagaactctgcatttggcctcctatcacacttagaataagatccaaaacctttatcatgtccaaatgtgatctggcctatcccatctagtaatatctgccaatcccatctcctatcacattccttcttgctcaccaagctctaaccaagctgacctcctttgctgtttcttgagcattctaaacatgttcttccttttgagcctttaaattggctgatctctcagactggaatgctcatccataaatcagtttgataatttatttaactcaggtatctatttagctgtgacctcttcggtgaagctttttctgaccaccaatctaaactaaagcctccatcattttccattcttctgtattcttcacagtctatatctggcctttacgaccactagaatgtaagtctgatgaagacaagagactgttttaacctctgaatcctcattattaaaacacctagcatacagtaggtacttgataaatatttatttaatgaataaatcaatttatattttcacttattaatcatccaacaagcatttattgtacatcaagtagtacaccagacattggagatgaataagatagtttaattccatttcagtttttagggagtttgagatctaagggaaatctactaccatgtgaacaataagttacaggacaatctattaagtgctacaagaaaagtgttgacagtaaaatgggaataccaagagtagagcctctaactctgcctttagaaagtgaagaaggtctcacagaggaggctgaacttgagtcagctcttaaaagatgagtagactatatatttaacatacaacagatacatttgggtggagtgttttacaactttttacattagaactacactcagacacattccttctcagctcagacaccccaagattgaattaggtgtcatgcctctgtattcccatagtactctgtgcttatgctgattttacagtactgtaattgtctattcacttaccttgtctaaatcccccattagactctcaaatctataagggcagtaaccacatcttgtttacagttgtattcctgatgtctggtaaaaagcaatgttcttattatgtaatttattgaatgaatgttaaatgcctcattatgaggtaatgccaaaacacagaatgaaggacaattttatgaggttctagtaacatgttcttattataaaacatagaatagctattaaagatattatactttgggacaggaaataatgccattaactacaattattcagttgatcatttatttaataatgaaaaaacacttatcaatgagttagaagcactatgctaaggtctttttaattctctttcggctgggcatgggggctcacgcctttaatctcgacactttgggaggccgaggtggttggatcacctgatggcaggatttcaagaccagcctggccaacatagtgaaactccatctctactaaaaatacaaaaaattagccaggcatggtggcacgttcctgtaatcccagctacttagaaggctgatgcaggagaatcatttgaacccgggaggcagaggttgcagtgaaccaagatggcacctgggagacagagtgagactccatcccaaagggaaaaaaaaaaaaagtctcttattaaccctcagaggtgctattattcctcttaggcaaaggaacctgaggctcaaataggtttcataatttgtccaaggtcatacaacaaataagtagagaagcaagaattctaggcaggtctaattctaaagcctaagacctaccttctaattatgtaaggcttttaaactatctacagcatttctcaagccccatttaactcatactacaggtttgcaagaacatgtttcattttccgaagtaaagagatgaagatgattttctatcagttccttttttcaaatctgctggttgaatatcttattttgtcacggttgcaaccagtttattcccaaaacactaactctattttaacacgtgtgagtcatttttctcttatccttgtgagattcaatgctgtgaccattaaacttaacaagaaacataacatctgattggtataaaatagtccttagcctccctatattctacattagagttgaatctacaaagggacaataaagcctgaacctctggattcacacaattggcttagataaaattgtaaaaacattgaattaagtttggaagggattgatcttactgcatattatttttacttacgtagtcaatttgctaaagaatgctaatctaatttacaaattgacagtaaaaaatagcaataaaaatagcatgaacactcaattcactaatgagagggtgacacacaaatagaaattaataaagtacagatggaatgataactagttaaacgaaattagaaaactcacttataatttggtgatggtgttgaaaacttttaagccacagcttttactttttaaaattcttaacttattcttgatattttagattagtattataatttcatttgatactttttatatttttataatgaaacatttatgttttttcaaaattatatttcacttacatatactctgttattcctcacaaaagaaaagcagaagaaaaacatgttgatacttcatagaaaaaggtctgcagaacagatgcttccccactgtagaaagcagccaattccagtaaggaatacaatagcattttcaatcagtggccatcatgtgccaggaatgcaaaacacagtactgatgataatccagtttatgaatcataaaatccacatggaatacaaatatttgaaaacattattaggaaatcctactccactgctaagacatgcttatgctaaaacagcctgagaaataatcagagattttgcattatctactagtagatatttgtaatatctactaccttaaagcattttctaaatactcagtaattgactgaattaaggataaaaagtatttatcacttgtgagactaatttgtcattagtgtcacaaaagacaaatactttagaatataaaattgtttctatattctcaaaatgtttagaatataaaaatagaatatttctcagttaggatacctgtttagtgagacagttagactactccttaaacaggtgtcctaaacggaaaatattctaattttatttttcttcttaaaatgacattaaacacttctttattgcacatgcaatcacataacagcatagtatcagtatcagagcagtgatcttaatggctttcattcaactggacaattctaacgagtatgcattctgctatagcatgaaaaaaatattcttcagaaaaaaacgtgtaaaatatatacttgaaacaattatacaaaaagttgcattatagtggtctaaatatttttaaaacctcttaaaggtgctaattaaacagcaaacaataaatgtaacaaacatactacaaatacatagctgagttttcaagatagtaagggctcaaaacggagctatggtaataagccaaatctaacttgaaggcttctttagaggcatgtgatgatgggggtgggggattagtggttaaataaggtttatattttaacagataaaagggaaaagggaagtatttggattctttccaaagtagaaatgaaacctccacttaaaattgggaattttgaaagtctacatcctcagcaaaaggataggcaagaaacaatttacccagtggcaaaggagatgacaagtcttacctgagctaggtaaggtaggggacagggattgggaagcctccctaaggtaggggacagggattgggaagcctccctttagaatttataaccatggtttaggccttcaattttacatcactcacacgctctaggggaacctcaaactgagaagttaaccaaatatagccccagtaaggtagcaccccaggtgcctgatagaaacaaatacaaatccatattacagggacgcatactgaaccctcaactcacaccattctcagagataaaatctagccaaacgtgaactcactatcccaaagataaatacatgagtaaacaagccactgagaatgggtagaaagaacaaacaacagaattaagatgcccttgctccttagaattaatttagtccccttagaaagctggatcttggggtaaaattagggaagaatagacagtggcattctaaactgcagaaataaccgagaacaaaagtagaaatattccagctagaatggaaagcaatgagtaagtttgattgaattagggaatgtcctacagctcatggatgctttcaacactgggagcccagcataagttgcttggcaaaggagtgataggaaccttgggaactaaaagatgatttggagaagggaaagactggagaaagactagaatcagacggttattactagaatccagatttgaggataattaattagagcctgtactaaaaagggtcatatagtaacagaaatgacaagctgaatctgaaagaaatcaccaaagaggaattaacattttctagaaagtttctaggcagtcaaatataatggatcaacaataactccaatattcagaacctaaagagatcaaactgaatctaaagagaaagttgagagagattttaatttgaataaaataggtaacaccagttatttgtaatcaaaaaatgacttactatactttgtcacttgaccatatgatcaaggaaatgaaatctaattattcattttcccatcaagtaagaaatcaacaaggcatgtccaatgcaactgcaagatgagcacaaaactggggaaaactagggtaagaatctttcacttctttcctcatgcataacggaattcgggggctggtgactgcttgatgctaacatgttaacctaggtcgataaatatattttaatcactgagttagaaaggcaaaaatcaaagggtactatcgtacatttgcttgtatgtctcgaatcatgtaagattcctactaaactaaaaacactctttcctatagcaaggtgaaactactgatgtgaccaacagagcattaccttgaaactgtacttccaactctggtaaaggatagcagttatcccattgtccttgttattaatacacaaggttgtacctgtttgttgtttctgtgttccaagtgaaattgcccacagtagatcaactggtaactctgatccaactgagctaaaaattactgagaaaacatcaaaaatagtctctttcaaatagccgcccttaagtgccacttcaatgtctgacgggctgaaaaaagtaacaaattggtattcacccattaaaaactaagatttacagtatctgaaaatctataaaaagaattaattgtcttctcactgctgtaagtaggtggtctttccctttcactacgaaatcagcttaatagcttatacagctgctgtctttgacatacctgtctttagcaaacagaaacttcatggatcctaactttttgcacattcacaggcatgttttaaagttacatcaaagctttcaggatctccaaacgtcataaaagacttattcatcagtataacaagcctaattggtgaaaaggcatgtgggcaggacttcagaggctccatgatgcaagactgtacaagtttttggcattataggagaagtttccaaacaaaagattaccttacatctcctgtgcacaatactaatatacaatagagtaaattaaaagtaaaagcaaccttaaccgtgacatttcttttttctttcacagccaaaagcatgtcaaaggattgacaaatataaagaaacttataaaatcaaatattttaaaataagaatgacacctttaaaaactgttgtgttcttacaagcagtttataaaacatccacaagagggaaccaaagacaaaagactaaaattccactatttggagatttacacaaataggtttataaaataggttattacattaactaacataccatcaatagctttcagaaataggctaatggtttcttgatacatttttaagcagtgatatatttaaaaatactgtaaccactgtcatgttgatacctttatataagcaatgtttatgttcctcaaggacaacaaatgtctttcacattcagtaacctccacttgcatataatagcatgaactcaatgaacaggtggtgattccacaaaatttatagaagtatacaaaagtaaataatgaatattcatattaatttatcaaaacttcattctaaattgcttttatatgaaaagatttatgattgtatatatcttatgttcttagaacaaatacaactaagggctaaagggtctttaaaaagatttttttcttttcttcattctttctttctctcattccttttctcttccattatgatagtatttttaagagttagcagaaattttgttgttgttctttttggtttgttggtagtaaacagaaattttaatacataaattgtatttttattgtttaaattttaacaacagaaatatcacctacataaacttagatataattttgtaaaataattttagaaaatttccaaaacatacaattcaaaagaagactacttgaaacatgctaaagtaacaatattgattttaacatacagtttacatcactgaacttcctgataaaaatgaaattctggggcagaaaaatgtcagggcaacaaaaaacaatctcccccacaacccaaatatttttcacacatttgacttaagcattgctgaagaaatacttcatgtgcaagtatacaccttattaattattaaatgcaaatacattctgtgttgatgattttgtggctggcactatccttaatgatgagtaaaagtcaggcaaaacctgtttaaaacagttttatacacgtgtttcttgatttgataagtatttaccaattaaatatttatgtaataaatgtttgctgtgtgccaggcaagtgtgttaaggtataatcttttccttgagaaatgtatagtttaatggggagttacaaaatagacaaacacagtgagataaatattctcagagctaaacgcagtattccatggtgaacacagaggagcacttgccaaactgaagcctggaggagccccatgaaaggcttcctctttccagaggaggcaatggctaggatgtcaagacaaaagcagcaacctacacttttctttaaccactttttgagcaatccaatctatgctcatggtttaactaccaactgcggaaagcactgatttcctaatttgcctgagttctcccttgggattcagaccgctgtatccaactgcctgctacacaaaatgacttaaatgacctatggacatcgcaaattaaataactgctaaagtgatctcatcttacacagaaatacgccttggagagaatactgctggagaatacttcagccacagtgtaagtgcaaagtgaaaaaacaaaggctctgactatgctatcaagaagtttagttgtaaataatttgttgttttttcccttattttttaaatggtcaaaggataactatattttgaatgaggaaaaagggcccagaagaaagggataatgtagctgactaaagaaacaagcagagaaggggccttttgagggaagtaaaaagaaaaccaagagcaataaaacaattactgttcatgcatacctctatcacagtacttgctacattgcattatgatcagttatcagtttatttgtctcactcattagattgcaatcttcttataggcaattaccatgtcttatttttcttccatatccatatttataaatgggaaaaatatataacctctgaaccagggagacaaggaaacatagtgaggatacagaaacatattaaagttaaaagaaaactgaggtctagttagtacaataagaaaaaagttataaagattggaaagaaactatctatatttgcagatgacatcattgtctgtgtagaaaatttcacagaatctacaaaaaactcctagaactaataaaaattagtgtgtgtggcaacgtcacaggatacaagggcaatacacaaaagtcaattgctttcttacataccagcaataaatgactgaaatttgaaattaaaaaaaatttcaacagaaaaaaaacccacttaggtctaacatattaaaacatgtacaggatctgtatacactgatgcaaaaaataaaagatgatctaaataaattgagaaacaccccatgttcatgaatttgaagactcaatactgttaaaatgccatttcttcctaacttgatgtatagatttcattcaatcccaataagaattccaggaagttaatttagaaatgttgacaaaatgatcctttctatggaaatgcaaaaggcctagaacagccaaggcaatactgaatcagaaaaacaaaatttggccaggagaagaggctcacacctgtaatcccagcactttaggaggctgaagtgggtggattgcttgagcccaggagtttgagaccggcctgggcaacacagcaagacaccatctctataaaaaatacaaaaattagccacatgtggcagcatgcgcctacagtcccagctacttgggaggctgatgtgagaaaatcacttgagcccaggaggtcaaggctgcagtgagccgtgattgctgtcactgtactccaacctggttaacaaagcaagatgccgtgtccaaaaaagaaaagaaaaggaaaaagaaaattggaagattcagtgtccaatcttaaaacttctataacactacagtaatcaaaacagcacagtactggcaaaagaatacacacatatatcaatgatgtatcattgaaacagaataaagagctcagaaacagacctacacaaatatagtcaacagatttttgaaaatgacacaaaggcaactcattggagaaagaacagtcttttaatcaaatggtgctagaacaaccggatatccatacggaaaaaaaaaaaaaggacccagatatagaccttacagctttctcaaaaattaactcaaaatgcttcaaagacccatataacatgcaaaaccataaaacctatagaagaaaactcaggagaaaatctatgggaccttgagtttggtagtgaatttatagacaccaaaagcatgatccatggaaaaaagctggtatcatcataataaaactaaacacttcagctgggcatggtggctcatgcctggtaatcccagtacttcaggaggctgaggcaggaggattgtagtttgaggctacagtgagctatgatcatccactgcactcagcttgtgcgaaagaatgagaccctgtctctaaaaaaacaaaaggcaaaaactaaaaactagaaatctctgctctgtgaaagacactattaaagaatgaaaaggcaaatcaaaaatgggagaaaatatttgttaaatacttactttataaaggactcgtatccaaaatacacaaactcttaaaaattcacaataagaaaacagacaacacaatttaaaaatggggaaaaatattgaacatacactttgccaaagatatataaatggcaaataagcatataaaaagatgcccgacatcttcatcactaaggaattgcaaattaaaacgagataccactaaacaccttttagaatggttaaaatgcaaaaacaaacaaacaaaaaccctgaccatacaaactactggtgcgcagcaacagaaactctcattccttggttagtaggaatataaaatgatacaactttggaaaagagtttggcagtttcttactaagctgaacataccataagatccagcaactatgatcctagatacttactcaatgtacctgaaaacttatatccatacaaaagccagcatatgaatgtatacagcagctttatttattgataactgccccaaactaataagtaactattgaagatggccttcaataagttaatggataaatgaactgtcatgtatctctgcaatgtaatactattcagtgataaaatgggctattaagccacaaaaaaaaccatggatgactgttacaaaaaacgtagtgttaaatgaaaaaagccagtctgaaaaggctacataatatatgattccaattatatgatattctggaaaagccaaaactataaatggtaaacagatcagcggttgaaagggggttgggggagagttgattatgtgaagcacaatggattttttttaagggtgatgaaactgttctgtttgacagtacagtgtatcatgtgtatcgttttgatgcctaataccatgcgtttgtcaaaactttacatcataaagagtgaacctactgaggcaggaggatccctcgagaccaggagttctagaccagcctgagcaatatagtaagactcccatctccacaaaaaatgaaaaaaaaaaaaaaaaaaaaaaaaaaaagtcaggcctggtggtgcatgcctgtagtcccagctacttgggaggttgaggcaggaggatcgcttcagcccaaaagttcaagacagtgagctatgtttgtgccactgaactgtagcttgggtgaaagagagagacccagtctcaaaagcaacaacaacaacaataacaaaaagagtgaacccaatgtatgcaaaattaaaaaaaaaaatttaggaggtcaggggatcccagggtgaaatgtagaatgtggcaaaaaaaaaaaaagtaactgtattaaaaatatattgaaacaaattcactgaaggaggtgagaagaaaaggtactaacctaagtaactttggagtaagtgaactgtgaattctgttagactaaagacaaaagaaatgatacataagcagtgtaactgataatgttgttttccatgttttccacatgggttaagaattctgaaaccactatacatgtatactggagttgagaaacttagtaaatgaatgataggagccaggtttctcaccattggagttgtaggttataaacaagcaagaggacccatctagaataataatggattagagtcagacacaacagtataaattaatgtttagtttaatacagatacagatgtatacacatacatatatatacacacacacacgtgcctacatatatagttataaatgtgtatatacataggctagtatacacacatatatctccttgcctcataagctgagagggcacagaagcaacaacatcccacagtacaaaaaagtccccctggaatccaaacttgatttcctacagttttccagtaaaaggaagtaggctccttattctagtactggaacaggaaatatacaagatgagcctagaatatcttatagtgtcagagagtaaggaagagctaaaaacaaaacaaaaccgcacaatgatggggatatgtcatagggacaaaggagtcaaaacaaaaggttcccaatggccaaagctggaacaatttaagcaaaataaataaataaataaacatagtagtattggattataatccaaaatataaactaataaccatgagtcaatattgatgcgaatgactgaataaatggggagaagagacaaatctcctgtgtagaaaaaattctaaatactccatcctcaagaaagtggagaataaccccccacttcttaaatgtgagctgtgtactgtgacttccttccaaagagtacagtatgaaaagaaagaaagaataattttactgtaaagaaacatgacatgctacctcagtcatgtgatcctggttaacatcaacagtggtaagtcatgttgacagaataatttactcttgatgtgatgagacttatatttatctctgggtcttttcaaaaaccaataagcctcgtctcatcattagaaaaaaaaatcccaattgaaggacattctacaaaatgtctaaccattattacccaaaactctcaaggtcaccaaaaacaaggacattccgagaggctgcgacatcatgaaccctttctgtgcctggcttatatcatttaacgtcctccaggtaaatacgtgcttgccacaaatgacaaaatttcattcatttttatggtatatacataccatgtgaaattagccaagcacagaaagactaaagaagctgatctcatggaagtagagagtagaaatggtggtttccagaggtaggggaggcttgtagaggctaggggtggtagggagagattggtcaataaatacaaaattacagttaggaggaataagttctggtgttctgttgcatagtacagtgactgtggtcaacaatactgtatatttcaaaatggcagaagattttgaatgttcttaccacaaagaaatgataaatgcatgaggtgatggaaatgctaaatattctgatttgatttttacacaatgtatacatgtatcaaaatatcacactttaccctgtaaatatgtataatcgttatatatcaattttttttaaaaaagagaagcctaaggagacatgatgactaaatgtaatatggtaacttgatgggtcctaaaacacaaaaagaacattaggtaaaaactaagtaaatctgaaaagaataggcactttagtttcaaatctgtattaatattggttcattatttagacaaatgtatcatacgaatataagatattaataacagggaagactgaatgtgggtggtatatggaaactctctaaactatttttctatttcttctataaacctaaaactattcaaaaataaaaagttaacttaaaaaattgagaaaatcctttgctttttaatttgagcaaatatttattatctgttttatcacaaggcccaacactacaacccataagtcagtggttctcacccaggccacacattggaatctgttaggaaggtttttaaaaaaatcctgatgcctaggccctagcctacaaaaattaaatgagaaatttcccagaataaaaatcaagcattgttttttgtttgctttttccaaaagccaccactaccacaaagagaaagctcaaatgatatagcaatttattaaatattttacatactatatcgagtatcacaaatcccaaagaatcatgtttctattagaggtaataaagcatataaactctaagtgattaatgtctacaatttttatattgacaagaactctgtattccattacttcaccaaaaactttttgcagtttcttttcagagtatttttaaaatattttacaaatttcaatatgtatatgcttttaaaaaatgcacttaagtacattctattttcaaaatagcatcatttattcaataatatattttaaactttcatatggcagagacaattcccataaatttgctttatatcatacacaacactaccgtagaatgctccttggtaacaacaaaatgttgcattttgaagctttattgcatagaaagaccaattttgttaatacatactctttaaaggtggacttgccataagcaattcaagtgtttacagtaaatatgaacaaacagatatattatttaatcaactcatgctaaagatttgggaatatcttccactaatatccagaaaacgaattcttactatgtaatacagttgacccatctcaacacctaatttacatcacatactcagaaatgccaaaagaagatctttgtcatatttaacaacacttaaactaacacaaaaactttgatattggattaaccttctacagaaatctctgtttgcaatttgtttaattttagaaatctgtacaattacctcagcacctatcaaaacatgtcaatttgtcaagatacattctcatcagacaagctttttctataataggtataaaaatcaaattcataaggcactatttccaatcatgctccatacttttcttgaataaaaaatattttaaaagatttgtttataatagttacccagggcacaggtgtatgcactaaaattttaaaaaccaacatatcttgtaatggttatcatataccatttcctttttaaaagccacattataaattgatgaaaatggcaatttaattttaggcccctaatttttccccaactgcaataagccaaactagatagaagtaaattaaatttggaaatttttctttatattgttataacccatacattttctgaaaattatgttaagaatgcaggatccacacacaatagacccaagtatcaatacttgatgtgaaatataaatctctcccttaatgtagcagcgaatttcagttctgaaattctgaaatcagagaaaaaatttgatctacattatctaaaaagttagttttatgaaatttttcaatggtccaatgctaaacttgctctgtgtcattatttgctccaccactgcttaaggaccaatccagagtctggactggaaacagctacagtaaaagctgccagagaatacaggtcctctgggctgaaaataaatcagaagcaaaagttggcaatacagatctctcaccatgctgaaaagacctttcatccatgaaataatcaaaaaggagaaaaaagaatggagaaaaatttcactgaaaacaactgggacaccaaaatatccatctaaaactttccgccatatcctaaaagaaagtcagttccccagtaccaaaactaagtaggtaatggccaaatgaatccctcaaactaaagcaaaagaaaaaaagaaaagaaccagaaagtttcatgggccaaaggtaaccaagctaagctgtgaacacaaacaagaggttgcaatgcaacaaccttgacttaacagatacacatgttaagtcaagcacagtatcaattagataacaaggggtccaagcttgtactttcgttccataacctagacaaaattattgtaaaagacacagtggttaagaaaaagaaaaatatcatttatgtctattctttttgttgtgttgttgagacagggtctagctctgcagtggcgcaaagtcgactcaatgcaaccttagcctcctgggctcaagcaatccttccacctcagcctcctgagtagctgggactacaggtgagcaccaccatgcctggctaatttttgaatttttggtagagatggggttttgccatgttgctcaggctggtcttgaactcctgagcttaagctatccacctgccttggcctctgaaagtgctaggattacaggcatgagccaccgtgcctggaccatttacttctattctaatcaactataaatttggatatgatttgctttaattgtcctgattccttgtaatgctaccttacagaagttttcccttccctgcttgtcactttgacaacttgtctaaaacaaatcagaattgaacaaactatgattttttctttgaattgttctaatttatgggcactcaaggagtttgttaatcactgaaatatacggagggttttatagatttataaagagatcatattacaaactcaatatcaaaaattataattttaggccaggcacagtggctcacacctgtaatcccagcactttgggaggccgagacgggcaaatcacttgaggtcaggagttcaagacctgtctggccaacatggtgaaactctgtcactactaagagtacaaaaattacccaggcatggtggcaggcgcctataatcccagctactcgggagactgaggcaggaaaactgcttgaacccaggaggtggaggttgcagtgagctgagatcacaccactgcactccagcctgagcagcagagtgagactgtcttagatagatgatagatagatagatagatagatagatagatagatagatagatagatagactgatttaaaaaataaaataaaaattataattttagaacagtccaagaaattacaaatggcaggagctcccatcaaaatggagattagaacacacaggtttacacctatccctctcaaaaccctctcaaaactacaataaagccacagaaaaggataaaccccaaaagacaaacagcacaggaattgaatagataacagtatatgggagatgtcaaaaatgtggaagctagaaaaatgtttggaagttagaaaacagataaatatgtaagcagctaactcagcagaccaaaaataagacttaagcttgcaaagagaaaagtcacaagaagcatgtgaattcagagtagtgaaccctaacatcttttacagcaaaatttgctggtcaactagttccactcttacacacagagctgccagaggtaattttagtgcttctctcaaatataatccccgtacatttgaagaaagcccataaagtgaaatgtcagagatcaaaacaaacacaaaagaacagacacaaggcagggagcaaaagataactcaaaataataataatgaaataataacgtagaagagaaagctatcttagacattaaatatctgatatgaaaaaatagcaagtttggaagataaacttgaggcaatctcagaagaataaaaagagaaaaagagggaaaaggaaacagaaaagataattgaaagactaacctaaaaggttcaacaaccaaataaaaggagatccagagacagagaggagagacagtgaaaattaccaagaaatagcaaacatgaaatcacatagaactgaagggtgtttccagatttaaaaagtcaaaagacactccatacgatgaatggggaaaagatgtataccaaggcacattattaggaaagttttaaataacagggacaatgcaaagatccaaaaactcccacattcaaacattcaaagaatcaggtatctgaatggcatctatcttctcatcagcattattgctgagcaaggaaaaagagcaaggtcttcaaaattataaaagaaagttattttcaatccaaaattttacacccaatcaatcaatcaatcaattaagggtaaatgtacaataaagacacggtcagatatgcaatgactgaaaaaaactgctgctgtcaggaagctactgggagatatgatacataaaaataaggaagtaaaacaagaaagacagaagacagcatcagggataaagagattacagaagaaaaaaaagaggacattccacaggttgatgttgaaaggaagtcttaggatgacagctgctcaacactcctaaagaggaattagttccgattagtaaaggacagaagactattgaagggatgaatcaataaaaaaaaaaaagtacggcattaataaattgtgtttgaacatacacagaggagctcagagatccagcagagagtttgggaatatagcatttgggaacaaactagtgattagaaaactgtaaaaacaacaacagtaacaaaaacggagacaattattggttctgaaaatcacaaaaagaaataacatgtaatgataatatgatataagtgaacagtatttacacagttataactatataagaatttgttttaattgtgattacataggaaaaattagacataacaagtaatcaattcttttacaagttttcaatttgtggtaaataattttatctgaaatatttcttattaaataaaatttactttttaccatgtaaaggaatgagaataagtaaatgttctttactggttttcctcaaaaaaaaaaaatatgtgtgtgtgtgtgtgtgtgtatgtatatttatacacattttcaaatatatgtatacaaatatacatatctatacttatatttaggaaaaccagtaaagaacaaatacatattacatattaataaaaataaaaatattaaagaatataaaaatatatattgtaaaaatataaatatataataaatatataaatatatatatgttttttctttttagacagagagagagagagataaagagagtctcactttgtcacccaggctggggtgcagtggcatgatcatggctcactgcagcctcaactgcccaggctcaaaccatcctcccacctcaggctcccaaatagctgggactacaggcatgcatcaccaagcctagctaattttgtgttttttaatttttttttttgtagagacagggtttcactatgttgcccaggctggtcttgaacacctgggctcaagcaatcagcctgtcttggcctcccaaagtgctgggattacaggcgtgagccaccgtgcctggcccaaatatatttatttttaattttaaaactagatttaatatctaccaactcttccaaacatatttgaccagttaaaatttgttttaaaatgttttttaaaaaattgaatctatatcagttcacaccagatcagtaatgttattttggtggccacaaggtagggcaaaaccagtaagggcaaccagcaaaaaaaacccgaaaactaaacaaacagaacaataacaaaaacaaaaaacctggccaaaatgttacaacagcagtagtgatggtataagtagtggcattaataaaaacaaaagctaaactttattgagcatactatgtgcaaaacattgttctaggtgtgtatatatgtaattatatcctcataacaactctatttgcagatggtaaaactgaagtagagaggttaagtaacctgcccaaagacataaagttatttgggaacagaactagaattcacatccagatagtatgatctatttttagataatgcaacctcccttttaccaagtaagtacattacaggcttctggactgacttgggctaattctcctgctgttcttttctttacctaattcaaaaggttctcaaaaggtagacttttggccagaaacagtggctcaggcctgtaatcccagcactttgagaggccaaggcgggtggatcacttgaggtcaggagttcaagaccagcctggccaacatggctaaaccttgtctctactaaaaatacaaaaattagctgggcatggtggcacacgcctgtaaccctagctacctgggaggctgaggcaggagaatcgcttgaacccaggaggcagaggttgcagtaagccggggatcacgccactgcactccagcctgggcgagagagtgagactccatctcaaagaaaaaaagaaggtagacttttgaaggtccctattgaacaggggtaaggggaaagaggggaaggcgggggaagtttctgtctaagaaatgctcacctgaaactgtatcaccacctgaggggaatgggttattcaaagcaccctggcatttctccccacacccatgctgagaattaattgctttagtgaagcatgtttaaagagaacatgacattattcagacattaaggaccgcaacctgaacagctctgagttcagaccataagaggtcaccagaaagtcctcatttcttttccaaggatagaagctctaagacatagtctaagaccaattagacttcttttctttgagtcattaataagttaatatgaagtcaaataacacctttcttcagataaaagtaaaggacctgatacatgcataaaagtgaaaagatttcattcaagcttaacatcaaaaagtatcccattttttgctcaacatttcacttaaaattcttctacatccatttaactccttgtattttacttaacattgtgatccttaagaaacgtctgagctccagtgacaagcaattcttctaaactccttatcagtcttttaaagtgctttaaaaatagcatgtcaatgctacattctatgccttatcttataaattcaattaacatcattctgctttgaaaatcatcatccaatgtaccacatgtagaatatttgctttgctgttttacttaaaaacaagtactcttttactgtataaatatttaaaaactcattcaagtacctgtacaatattcaataagccataccagcaaacttacaaattagtattttaaaaatcatcaactaagttcaagaaatacataagaatgaatactgcttgttgtgtaactaccaaattaccaaactgcatgcttacattttgaatactagagttaaactagtactaactgcacaaatcctgtatgcctgctttttatatacacaacctagattaaactttgtgttcatttagtcaaaaatgaatgtaaattttataaaaaatattttacttttatgaaaaagagtatcacttcaatgaaataaattgtcctactgaacatcaagagatgtgtagtctatgataaattagctgatttaaaactgtatatgtaattcaatttaagccaattcacaaaagaatcccaaaggaataaatgatataaactatttaagattctgagccttcaatgtggataaactttcctgagaaattacatctactaattttaaaagttgctaaaaataaatggcaatgtaggatatacatttactgtagaaagacttcagattcattctgcctatctcgttcttttaagtgcttgtgagagtgtatgtgtgtacatattgtatattttctatgcagggcaacaacagataaaataacctcaaaatggaagctactgcctgaaaaaataatctgaagaaagcatgtgaatattgctcaatgtgtgactctccaaactttttacttttttcttataatttcagtaaaaaagactataagagttttacccagaaacactaagctttgccccagagaataaatgtttattcaggaaaaaaaaatcataaaaacctgacataatttttaagtgctcataatatttcccctcaccttgaatatggacaggaccaagtaacatatacctaaaacgacttggtatcattggatttgaaactaagcagtgggcagaagctagaagcactttgaagacagttttagtaagagcctgaagagtcattaaaaaactgtcagaagcctgacagcctttaagaaagtttcaggaaggtaagggaaatattagaaagctggagaaaaggagattcttatgtggtggcagaaaatttagaaactgttgtattagtccattctcacactgctatgaaggaatacctgggtaatttataaagaaaagaggtttaattgattcacagttccacatggctggggaggcctcagaaaatttacaatcatggcagaaagcacctcttcacagggcagcaggagagagaactgctgagcaaagtggggaaagccccttataaaaccatcagatctcctgagaactcattcactatcacaagaacggggtggttgttccctgattcagttacctcccaccaggtccctcccatgacgcgtgaggaataagggaactacaattcaagaggagatgtgggtggcaacacagccaaaccatatcattctgcccctgccccctcccaaatctcatgtcctcacatttcaaaacacaatcatgcctttccaacagtcccccaaagtcttagctcattccagcattaactcaaaagtacaagtccaaagtctcatctgagacaaggcaagtcctttacagcagcactccactacttggtaccaatttactgtattagtccattctcacgctgctataaatacctgagactggttaatttataaagaaaggagacttaattgactcacagtttcacatgaagcctgaggaggcttcaggaaaattataatcacggcacaaggcaactcttcaaagggcagcaggagagagaagcgccgagcaaagagggaaaagccccttataaaaccatcagacctcatgataactcactcattatcatgagaacagcatgtgagtaactgcccccatgattcaattacctcctaccaggtccctaccatgacacatggggattatgggaactataattaaagatgaaatttgggtagggccacagccaaaccatatcaactgttggctataggaaccagaaaagtaacaggaaaagtaaaaaatgtacctaatgaactgggtggtctagcaaagcatgtaagatgttgcctggtttcttcttgctgcttataatcaaacacaaaaggagagagataagcttaagaaacgacaattaaacaaaagagggactgagacttgtcgattttgtaaatctccagcctctatagacagcaaaccatgctacagttatgagacagcttgcaagcaaacctcaaatccaggcaatagtcaggaaattatggtctaaatatcaagctgaaaaggtgactgtaaaatcctttgttcagatttctgacagatccatgcagttcctcaacagggcttctaagaagcttaaaggcattgtccctgcacaatctcatcaagaggccaaaatcagggaaacaattatctcaacaaaatgtatgagtatagattattctaatggagtaagctgcaatgagatttataggagacccacaaagtgtttttggcagaaacactaccagcattgactgcatagcacagagatgcacgaaatgaaaagagggctttggactccaaaatttctaaccacaggaagcaggctgagaaaactatctagctcaacacacaggctaccttccatgaaaaaggaagaactcagtgggcagagcaaaaaactcagagaacacagaaaggagccatgaaaaactatcctgaggtaggaatagaacttagttttaatgaagaaacttctaacatttgcttggctggattccaaaactgctatggaatagtgactcgtgcacttcctgtcttcctttttttttaaacagaactacccataatgatataattttatgcctgacccaccattgtacattggctattcggggtggtgggggtgaggtaagaaacatctcttttgtttataggtcttcagattgaaaggaactggacccaaggaacattatctctatctgaatgtaatttagaagatgacattctagattttgagctgatattgtaaagaaataatacttggggtagatgggatagtgcgtgtattttgcatgggcaaggaatgtaaataaggtgcggccagaggatagtctgagccagttttaaaacataaccataaattctttggcaattctcccctcaaaaggtggagcctcattcctattgccttgagtgcaggccagacctagtgacttgtttttttttttttaattgaggtgaacttcatatacaaaaaattaaccattttaaagtatacaaatcagtggcacttagtacattcacaatgtgcaaccatctcctctatctagtatcacagcattttcatcacctcaaaagaaaacactgtacccattaaggagttgctctccatccttccttctttcccacaccctgcacaccacaactgggccctgtcctggtctctggtaaccaacaacaatttgcctataattcaattgtaagttgtaagagttctctatacagtttgcttttttttttttcttttaaacagatggggtctcattatgttgcccaggctagtcttgaattcctgggctcgggcgatccacccgtctcagcctcccaaagtgctggtattacaggcatgagccaccgcacccagcttctatacattttggatactagacccttatcagaagcataatttgtaaatattttctctcattctacaggctgtcttttcacttcttgataatttattctcttatgcacaaaaatgtttaattttgatgaagttcagtttatcttttttgttatttctgctttagtatcattctctaagaattcactgacaaatccaaagtcatgaagaataaccctatgtttttttataagagttttaaagttttagctcttacatgtagggtgttgatccagccaatcagatcttatactaaaaggctgctgtatttgataaaacataggggtctaacttcattcttttacatgtggctatccagctatcccagtaccatttgttgaagagattgttcttttcccattaaatggtcttagcaactctgttaaaaatcagttggccatagatttatgggtttatttccagactttctattctattcccttggtctacatacctatccttatgctagtactacactgatttgatcactgcagtttcatattaagttttgaaaacagaagtgtgagtcttctaacatggttcttcttttttgatatgttttggctatttggggccccctgcaattacatatgaatttgagaactgacttttcctcttctgcaaaaaatgacctgaaatttggaaatagatctttaaaatctgtgaattgatttgaggagtactgccatcttcacaatataatgtcttctaatctctgaacacaagatgtctttctattgatttaggtcttttagcaatgttttgtacttttcactgtacaagttttttaactccacggttaaatttatattttaggtatttcattcttttggatgctattataaatggcattgtttgcttaatttcctttttacatttttcattgctggtgcctagaaatacaactgagttttgtggttgatgctgtaccctgaaactttgccaaatttatttactagctctagcagatttagatggttgacagataacaaacaggaagttgctctagctcatggggggctgaaacaaaggtatctgcaccagtccctcagggaaccaccagacaggtcaaaatgaaaactacaattttttttcagaacaaggatcttattgtccccgtcctggcaccagtgagctacaccgggaatatgggttgctggccccatagctgctgctgagctagaaaataaaggatattaggtatataagcaaaaatgtcataatgctttcttatcaaaatctggcactcccctggatgctgttaagttttctatcagattccagagttatgcaaaagttgatttgtcagttttttccagtttaacatagttgcttctgtggaggtaactgattcttagagctccttgctccaccactcacttgcttttaaaaactgggccgggcgcagtggctcatgcctgtaatcccagcactttgggaggccgaggtgggtggaacacccaaagtcaggagttcaagactagcctgaccaatatgatgaaacctggtctctactaaaaatacaaaaattagccgggtatagtggcatgagtctgcagtcccagctactcaggaggctgaggcaggagaattgcttgaacccaggagatggaggttgcagtaagccaagatcatgccactgcaatccagcctgggcaacagaacgagactcggtctcaaaaacaaaataaaataaaaataaataaatagaatgtggcagaagtgacagtatttaactcctgagactacaacataaaagacagtgagaggtcctctttgttctctctcttggaccactcactctgagagcccctgaatgagccatcctggaagtgaatcctccagcccttgtcaagccttcagatgactgcagctctgatgaacacttagattgcaatctcataagaaaccctgagaatgaatcacgtaactaagaccctcctgaaatagcaatctacaaataccatgataataaatgtgtgttgttttaaggtgctatgttttgggggtacatgatatttaaagctgagactcaaaagaaaagaacctagccactccaagagttctaagaaaaagagtgtttcaagtaccgggtatagcacatgcaaaggccctgagtaaggaaagatcttaagcatgttaaaaaaaaaattaaaaatctgaaagactagtgtgacttaagctcagcgaaggaaagaaaaatagtgaagaaagagacccccaaaggggcagaaagaaaccaaaattactataacaaagtcttaaaaagtagtaaaaactgataatatatgataaagtgcctttgaaaccacaagaaacaactacaaaaatttaacatttagaaacattaactggagagaaatctgaaactaaatgtatctatcatcacacaggaatccagggtaggaaatatgaaaccccctgagagcaagaaccaagggtctttacatctcccatatcacctactcatctttgtagaattaatgcacaatgacaaacctgaaaaaaataccttttgaagacactatttaaaattctaagtaatgaattcattggtgaaagattttaagtctagaatacaggcttcaagtatctcctcactaggtagtccatgacaacggccaaataaataactcatgtagctgcatatctaaagaacatgattataaatcagctctacaaagatgcacatttctccttgtcctgggctaccatgtgataaaaggttttataattggtaaaaagagtaaaagaatttcaaaagaattcccaactggataaccagtctctgaaattaaaactgaatttaatttagcaaaataattccatttgtatacagaaactgtaagatttttaaaatgaacttttatgggagaacatactgttacgaaatacattttcaatcagtaaaacataaaataatacatgtgttttcagattttatgactatttgaataccaagggttattctcctctatatctttatccagaaaaaaatatataacttgaaacacaaaggcaaaaaataattagcaaggtatagaagcactagacactacaaaccaggtgcagtggctcacacctgtaatcccagcattatgggaagttgaggtgggtagattacttgaggtcaggagtttgagaccagcctggccaaaatggtgaaaccccatctctattaaaaatacaaaaattagccaggcatggtagtgtgcgcctgtagtcccagatactcatgaggctgaggcaggagaatcgcttgaacccgggaggtggaggttgcagtgagccaagatcgtgccactgtactcccgcccaggtaacacagtgagactctgtttcaaaaaaaaaagtattagacactacaaaatgtggtaaataaatacaattattttatttcgttatttaaatgtagtaacatcaatataaagtaaaaggaattaatagctagtttaatatgctaggcctttttatgtcccacctgcaactcctgctatggtacgttttatctacagcatagctggtgaccagttaaaagaaaattccagaagatatgacacaaaactgtataaattcaagacaatatttatttaacaaacccagagttagtatcaactagatactaggtactgtggaagttcatcctatcaacattacattccactaatcactaattcttaagacatcagaaaaagatagcaaacatataaggcaaaccaaatatattttgagattcaatgaaaaaacatatcttacttgtatagtaaaacagtaagtgcttttaatatattttaacagaattacagacaaataactcagaagaaaaaaatcaactttttgaagataattacaaaccgaattttcttcttcctcttccaattctcgttgctgttcctcatgtcttttagctttgatctccatagcttctgtgatcaggtctcttaatattgatacaggtttggcattcttgataaaaggatgctaaaaaagtaaaattcaatggtataaattcaaaagatttttccgaattatagctaacaaatgttaaaacaacatgtaaatgttaaccaggatcacaggcttcaatgattgttttttcatctagaattaaatgtataggttaagaaaagagagtatggccactgcctagaaataaagaatttgctttggggcttgtttaaaaaaaaaacttaaagcacacatgcaaaaatgcaaccctgttaataaaactataatatccttaaagatctaattgtccaaaggaagtgtacattaggagtaaaaaagattaagttaaaaataggattacagattatattacacatagaaataaacttattttggtactgagttacgtaatttaattaatcttaataagttgacagccaaaatcagtggccaaaaggagagcaactattttgttacttctttaacatattttctattttattgtatcttaagtaatttaaccaagacaaaaatattttttcagaaaatgaatgttgcctaatttctttactatatataaaataacttgtcactttttaaaaaatatcaccctgatctagctaaaatagctaagctctctatcattctgacaaagagaaggaaaactatcagaatagacctaggttttgaatttctttttattgagaaggagggacatgagagaaagtagagtgaaaggttataattttggatagataacctaaatttggggcagcaatcagtttcagtaattttcatagttacatgtcagtagatagcatcaggtaaaagtgacctgactgagtgagtgagttatttgtttatttgtttgtttgagacaggggcttgctctgttgcccagatgcgagcacaatggtgcaatcatggctcactatagtcttgacctcctgggctcaagtgatcctcccacctcagccttcctaagtgctgggaatagaggcatgagccactgcacccagccctgagttattttaataaacttcaagagaacacaaaaatatatttaaagacaaaaaaaattgtgctgaagaagaaatagatacttgaaagagggtttaaaatggcaaacatatcatttgggacaactataagaaagaactttttcagagtacagaaatactaaaatcaattgtaaagaaccaataaattattttagaacagttatagattaatcttaccaaacaaattaagtcctattaacatatctgtggtagagactcctggtcatacaccaaaaatagagttgtggttggaccgacaattgcccaactggatcctacgtttctcaacttaacccattcaggtggttatatgcgactaagtgaatgcgggagcaaatactgtgttccacttcctggcctgggctatggagggctccttgttactaatggataagggtgagaggtcaggttctcccagagtcctgtactggtactgtgggaagtagtctcattttagctgattggcgatgaaagtcctgacccttcaccagactgcctctgaccccactccaacagggaggttgttgggttcttattcctgcctggtaggagtataagtctaggctcccacatggtcttcactggcactccccacttagggagggaatactttctacactgccttgtggagatgaatgccttagcatgacagccttctctgacaccgcctgagaaggactggacagcctcaaaaggatagaagtctaggttctccatttagcctttgctggtgaccggggtaggccatagttttcttggtggtgtttggctagagtagaacggttatcatctgaaagttttcagtcttactaggctgtccatttctccgtccttctgcttgaaagagcaggtttttatttctagtttgtgtccaatgttgtttctgggttgttggcttctccactacccagtgtgggataaatgagggaaaaagaaaccccagggaactcacagctatgtctttccttgagtcccaccatctctagcagtctattgccttctttccaccttttagagtctttttatgcttgttttatatacttacaatgtccatggttttagctgtactttaatgaggaagtatagagaaaaatatggttactcaatctgtccagcggcagaaatgccttcttcaactcactttaagcacttgttttatctgaagtgtttttgtataaatcattaattttgaacactatcagtttagaaattgataattcagaacatgaacaaaatttaagaggaaatatttcagattttaaaagaataaacttttcaagcagtctcaatttttaaaatacatcatcaagaatgtgataggttgatctgcagtaatttctgtcttctcattactttaggtggtttaagaatcctcaccctctttaatttttattttagacacatttagaaataggaaaactttactgcctattagaatctggtacattcatctttttcttgttgaaatactttataaaacccttcatataatcagccccttgcctgacataaatatatatatatattttttagtttccgttttttgccattcatgcattttttaagttatatgtattcaaatcatccatttttcttttgctttattgcaccggaatgaatatataaatattctcctatattaacccctagttctttcctatttccattttttgttttagtttttttaacatttaagaccttaatctatctggaaattactttggtgtttctgtggtgaagatctaagttaatcctcccaacaccccctaaaggcaggcagttatctcagcaccatttttactttgtttttccctcactgattagaaatgctatcttcataatatgctagtttcctttgtatattatataccatttgtgggcatttaattctgcttcattattctatctcatactggcgttacatacttttctaagcatttaacaaaaagatgtaatttgtttattaaacataaaatttgatttttctattaaatcaatcactatataattcagatgatgtttattttttgcctatatggttactcagtgactgaaaacggaatatcaaaatatcccaatttatttatttagagcaacctcttatgtctttaatttgtaacatacaatgctatattaatatatcaagtttataactatatcttcctttatattatgttctttatcaatattaagtgactccatcctcatttactgatttctgctgtcaattttgcttttttgatcatgttattcatactatctttttatattttattaaaatttcattgcctgtttttaacttttttttttaaataaaaacagacaattgaaacatttttattaggttaatttcactttttacattactacaacaataacaaaaataccaataccattgaatacaattaagaagtttacttaaatcatattcctcaaaatttggtgtgtatcatcacatgtgttagaatcatgggagcgagggcagagggttacttctaaatattcaaattctcggcctcccctagacaaactgaatcagaatttctaagaatgttgccatagaatctgcattttagcatttctttccaagtgatttttatgcaaaccaaaattaaaaatactgcattgacattttccatcccagtcttctgaagattgaaagttaacagcagggttggggtgggctggggtgggacaaggtcatgggaaatagcagcccaggaagcatcagcactgtcatcctcactgtggtttggatgaagtaccttttcaataagctcttctgtatctcttgataaacagttacatggtaatgaaacttttcaaggttatttccttgagaatacagctaaggcagcttcttgcgtctttccaagcagaatattctgatattattattaatctttatcttgtcttgttctgaaaacaatttgagctatcttatgaaattcatagtctatattagtttaagaagtagatgagaaaataagctcaggaaaataaacctatgggtaagagagagagtgtatgtgtgtgtgtgtgtgtgtgtgtgtgtgtaagagagacagagagaagaaagagagagaaggtaacttagagattaataaatacttcttttaaaaataggagttatttgtattttagtttttaattcaacctaaaccttctctctgtagggtttcacaattttaaaaaagtatgtcttttaatttaacaaaatgcaaacatgtatctctgctagtggagaaggtagtgaaaatctttttttttttaaagtttttttttcttttattattatactttaagttttagggtacatgtgcacattgtgcaggttagttacatatctatacatgtgccatgctggtgcgctgcacccactaacttgtcatctagcattaggtatatctcctaatgctatccctcccccttccccccaccccacaacagtccccagagtgtgatgttccccttcctgtgtccatgtgatctcattgttcaattcccacctatgagtgagaatatacggtgtttggttttttgttcttgcgatagtttactgagaatgatgatttccaatttcatccatgttcctacaaaggacatgaactcatcattttttatggctgcatagtattccatggcatatatgtgccacattttcttaatccagtctatcatttttggacatgtgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttagctgcataaatgtcttcttttgagaagtgtctgttcatgtccttcgcccactttttgatggggttgtttttttcttgtaaatttgtttgagttcattgtagattctggatattagccctttgtcagatgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaaggccttgcccatgcctatgtcctgaatggtaatgcctaggttttcttctagggtttttatggttttaggtctaacgtttaagtctttaatccatcttgaattaatttttgtataaggtgtaaggaagggatccagtttcagccttctacatatgactagccaattttcccagcaccatttattaaatagggaatcctttccccattgcttgtttttctcaggtttgtcaaagatcagatagttgtagatatgcggcattatttctaagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggcctttttcacgatattgattcttcctacccatgagcatggaatgttcttccatttgtttgtatcctcttctattttcttgagcaggggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgaaactttgctgaagttgcttatcagcttaaggagattttgggctaagacaatggggttttctagatatacaatcatgtcatcagcagacagggacaatttgacttcctctttttctaattgaatacccttgatttacttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatatcccatcaatacctaatttattgagagtttttagcatgaagggtggttgaattttgtcaaaggccttttctgcatctaatgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattaggctgtgaatctgtctggtcctggactctttttggttggtaagctattgattattgccacaatttcagatcctgttattggtctattcagagattcaacttcttcctggtttagtcctgggagagtgtatgtgtcgaggaatttatccatttcttctagattttctagtttatttgcgtagaggtgtttgtagtattctcggatggtagtttgtatttctgtgggatcggtgttgatatcccctttatcattttttattgcatctatttgattcttctctctttttttctttattagtcttgctagcggtctatcaattttgttgatcctttcaaaaaaccagctcctggattcgttaattttttgaagggttttttgtgtctctgtttccttcagttctgctctgattttagttatttcttgccttctgctagcttttgaatgtgtttgctctggcttttctagttcttttaattgtgatgttagggtgtcaattttggatctttcctgctttctcttgtgggcatttagcgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagtggttttgagtgagattcttaatcctgagttctagtttgattgcattgtggtctgagagatagtttgttataatttctgttcttttacatttgctgaggagagatttacttcaaagtatgtggtcaattttggaataggagtggtgtggtgctgaaaaaaatgtatattctgttgatttgggatggagagttctgtagatgtctattagttccgcttggtgcagagctgagttcaattcctgggtatccttgttgactttctgtctcgttgatctgtctaatgttgacagtggggtgttaaagtctcccattattaatgtgtgggagtctaagtctctttgtaggtctctaaggacttgctttatgaatctgggtgctcctgtgttgggtgcatatatatttagtatagttagctcttcttgttgaattgatccctttaccattatgtaatggccttctttgtctcttttgatctttgttggtttaaagtctgttttatcagagactaggattgcaacccctgcctttttttgttttccatttgcttggtagattttcctccatccttgtatttttagcctatgtgtgtctctgcacgtgagatgggtttcctcaatacagcacactgatgggtcttgactctttatccaatttgccagtctgtgtgttttaattggagcatttggtccatttacatttaaagttaatattgttatgtgtgaatttgatcctgtcatgatgatgttagctggttattttgctcgttagttgatgcagtttcttcctagtctcgatggtctttacactttggcatgattttgcagcggctggtgccggttgttcctttccatttttagcgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacattttttccttcatttcaactttggtgaatctgacaattatgtgtcttggagttgctttctcgaggagtatctttatggcgttctctgtatttcctgaatctgaacgttggcctgccttgctagattggggaagttctcctggataatatcctgcagagtgttttccaacttggttccattctccccatcactttcaggtacaccaattagacgtagatttggtcttttcacatagtcccatatttcttggaggctttgctcatttccttttattcttttttctctaaacttcccttctcgcttcatttcactcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaagtcattctccatccagctttgttccgttgctggtgaggaactgcattcctttggaggaggagaggcactctgctttttagagtttccagtttttctgttctgttttttccccatctttgtggttttatctacttttggtctttgatgatggtgatgaacagatgggtttttggtgtggatgtcctttctgtttgttagttttccttctaacagacaggaccctcagttgcaggtctgttggagtaacctgccgtgtgaggtgtcagtgtgcccctgttggagggtgcctcccagttaggctgcccgggggtcaggggtcatgcacccacttaaggaggcagtctgccccttctcagatctccagctgcatactgggagaaccactgctctcttcaaagctgtcagacagggacatttaagtctgcagaggttactgctgtctttttgtttgtctgtgccctgcccccagaggtggagcctacagatgcaggcaggccttcttgagctgtggtgggctccacccagttcgagcttcctggctgctttgtctacttaagcaagcctgggcaatggcgggcgcccctcccccagcctagctgctgccttgcagtttgatctcagactgctgtgctagcaatcagcgagactccgtgggcataggaccctctgagccaggtgcgggatataatctcgtggtgcaccattttttaagcccgtcggaaaagtgcagtattagggtgggagtggcctgattttccaggtgccgtccgtcactcctttctttgactaggaaagggaaccccctgaccccttgcacttcccgagtgaggcaatgcctcgccctgcttcggctcgcacacggtgcacgcacccactgacctgcgcccactgtctggcactccctagtgagatgaaccgggtacctcagatggaaatgcagaaatcacctgtcttctgcggcgctcatgctgggagctgtagaccggagctgttcctattcggccatcttggctcctccgaaaatcttctcttgagaaaagtgaatggacaaataaagatttctcatttccgacaaaagaaaataaccagcattgatttgctatttctgttgttatgagtgcttccaggtggttgtctttggatctgctctgttcctgtgcacctcttcttggaatataaatttctgagcctcaatgtgccctgatgccgttcctttcttccaccgtaagagttaccgaaagctcggcgtccgtgatggggtagagggcttccgaggcgatcgggcagtgtcagtcttcagccgctaagccgagaagatctgggaaggagtcagagagccttgggccagagttccaggggctctgggagtggcggatttgaaattggtgagatgtatcttgggctggtcggtctgaggacctgaggtcctaggtggatctttctcaaggagcaaaaagcaggaggacgggggattgatctcccaagggaggccccccgatccaagtcacagcaccaaatttcatgcacgtccgtgtgaagagaccactaaacagctgtttttaacttttaacccaaattcttttaagtatgcctcatgtagaaacatgagttggattttatgtaagtttgtaagtttatctcatgtagaaagcatggagttgcatttatcttatgaactaagtgaaccatttagtacttaactaaatattatttaaaaaaattaaccacttatgttagtatataattatatgctaatgccattttatcacaattgttttacattatgtaaaacatacatgttttatcataatattctatcataaatgttttacatttgccatcttgttttttctgcattcttttttacgttgctttgcagttttaattttaccacctgctaatcttaaaatgcctttaaaaatatacagatagtccctgacttacaaaggttcaatttaggatttttcaactttacaatgctgcaaaagtgatatgcattcagtaggaaccatacttggaattctgatatttgatattttcccaggctagtaatatgtggtacaatactctcttctgatgctgagcatggaggtattaataagtcccagctcccagtgagctatgcgatcatgagggtaattaaccaatattctatagtgtactgtgttgtcagcattttttggatattgtgttttgtgttttcacattcaattgcgtctacaaaacactcaactacactaatgtatgtgttctgggcacgtttttggtaggctaggctaagctaggataggtgtattttaacacctttttgacttacaatattttaaaccttcattggggtttatcaggacctaactccattgtaagttaaggagcacttgtacttaaaaacttggcaatttgtctgataaaacttctcttctgactcaagaatactcaaataatatggtcttgctcttcatgtacccttttaactttattagccagttcctctttgttgatcaaaaccatgtctgcagcagttatgtagggaaagcatgagtacaaatgaaattggacataccgagattttgagattaagaatgttaagctctatagactaactgtagcataacactatagtgaattgacaatgaattgcataaaagcagggttgtggtaaattggacgaaccagataagtatattggcttttcttaaaaataactgcagcttagaagggtagtttatacattcccctgagaagataaagtataatgtagtttgaattttctatactttgttaaagaaatataattctactggtttctagtttctgtagtgttggtcttctctcacttctgttaatacataatcagtcactaaatccttctcattctttcatcagatttactattttctattttggcaactatttttttaaactcaggtccttaacaattcacacctgtattattacagtgcctcctcattctatttctatactttgttgcaatattatgttatcaaagacattcttttcttacattctcttgtttacatatgtaagtaaggtggctctcagacaaaattgaggcatctcatcctaggcatcagaatacccttcttgcttcactgttgtctgtatctaaactcagacaccacttctctaactggtgtttctattctggctaagcagatcttactgtgttctaaaatacatctcccatttttgtgtctttgttcatattgttcataccatttctcctccctaaaatgatctgcttcttctgtatgaggtatctgtgattaccatatccattcttctacttttacatttcttaatcatataggctgtgcatcatgaatgtaacttctacattgtattataattttttaacatttttgtctttcatttctcaaagaatataacttcagttttttgtgtgtttttggggtgtgtgtgtgacctttctactagtttgtcaaaaatgtttagagtaggacaggagtcttttctttcttattgctctacactcctctaggacactgtctttgtctttacagttgtttgaagttgtgttgtaagtacctctgttttccaacttgataaaaagggaagagatcatggaagactgctcactgacttactttatttatttatttatttatttatttatttatttatttatttattttgagacagagtctcactctgttgtccaggctggagtgcagtggtgcgatcttggctcattgtaatccctgtctcccgggttcaagtgattctcttgcctcagcctcccaaatagctgggactacagacgtgcaccaccatgtctggctaatttttgtatttttcgtatagacggggtttcactatgttggccaggctggtcttgaactcctgatctcaagtgatccacctgcctcggcctcccaaagtgctgggattacaggcgtgagccacggtgcctggccacttactgactttagaatctcggctgcccaccagcaggtataaggatcatcttcagatcaggaactccggtgctaatagactgaaactgaaccttgtcttttaacatctccagggttttaatttatctttaaaaactactaaaatttcaatttaataatctcaaaggatccttcccttctatgatttttaaaaatgtatacaataatctatctgtgtcatagaaaatcaatcactattttaaaaatccatcaggaatttctttttaaatattgtttctttgtttactggaaatgaatatggtataatctgtacacgtaagctatagatatatgtcaactaaaatttggtaatcagattgtccactgagagttaaactatgatttaaattaggggtccccaacctccagctgcagactggtacctgccttggcctgttatgaactgggctgcacagcaggaggtgagtgagcattacagcctgaactctgcctactgtcagatcagcagtggtattagattctaacaggagcacaaaccctattgtgacctgcacatgtgagggatccaagttgcatgctccttatgagaatctaactaatgcctaatgatctgaggcaggacagtttaatcctgaaacaatcccaactctgctcaccatccatggaaaaactgtcttccatgaaaccagtccctggtgccaaaaaggttggggacaactaatttaaatcataacagataagacatacaaaactccttgaagagacagaatggttcctaggcttcctgctaaataagactctaatgaggccaaagataattatcctacccccccaaaaaaaaatttaaatcagaagtttgttaggttaaatacacacatattaactttaatatgtacaagtactggatactaggagtccaaaggtagtaccctttggactactttaaaatacatatatatttcagcagggcgagatagctcacgcctataatcccaggaatttgggaggccaaagtgggcagattacttgagcccaggagttcgagactagcctgggtaacatggcgaatcctgtctctacgaaacagacaaaagttagctggatgtggtggcatgcatctgtagtcccagctactcaggaggctgaggtgggaggataggtggagcccaggaggtagaggtttcagtgagcgagatcatgccactgcactccagcgggggcaatacagtgagaccctatctcaaaaaatacatgggccgggcacggtggctcatgtctgtaatcccagcactttgggaggctgaggcaggcggatcacttgaggtcaggagtttgataccagcctgatcaacatggcgaaactctgtctctactaataatacaaaaattagccaggcatggtggcacacacctgtaatcccagctacttgggaggctaaggcacgagaatcacttgaaaccaagaggcagaggttgcagtgagccaggtgccactgcactctagcctgggtgacagagtgagataccatctcaaaaaaataaaaaataaaataaaatatatacacacacatataatatacatatataacacatacatatatatttcaaatgaatattgacaatatttcaaaataaatgttttaatcaatttttgtggaaaaataaaattttaccatcttaaccattactttttgaaaggtagtatttgcacataacccaaatcgcaaaagtctcataaacagttttcatcaaaaagcaagtctccatcccagtcctgccccatccatagttagttaccttttctggaggccagtttcttgcttatttttccagagatacttcattataagcattaagatatgtatatatgttgtgtgtacataggtgtatttttccagtaactctttttcttgtactttaaattgtttccaacttgttgacagacatttaggatctttccaatcttttacaatttcaatgttctacgaatatttttacacatgttatttcacacatggttaaatatttctgtagaataaattcctagaagtgcaactgttggatcaaagaatatatggatttttattttaaatagatattgctgtactggcatctatggagattgagtaccaagttacactttcataacaataaacattatacttaagagcctgttttccatacccctcaatacatccttttggaaaaatgggactttggaaagttacttttttttttttttccttttttctttttttgttcttttaacccaatggttcctttagagacagggaagtccctttttacaagaaccatgtttttcatccttttgtcacttaacaatagaaatcatttagcaaatatcaagttttgttaatgtgagacatacttattattagctgaaagttctaagactattctgttggggaaattaagattcacaaacacctattataaatattaaattatttctatttgcattaaattttaaggtagattttaaaatctactgacattctggatacaaagtctacttacaattattctatcaaaaaaaattgaaactctgaagctcttcatttagataatcctgtaactgatatttacaacgtgataatctcttcaaggagtccagggatcttgtacttacatattttatggtggagcaaaaagtcaaaggataaatgctgagtcaaggaacagaagaaaaaaaaaacatgagaaatagtaactatgaagacaaagattcctttctgaaaggagaatgctttggaaattttgttttaaaatgactctgggggaaatgaggggacgagaggggaggaaagaaaagaagggagcaaacaggaggggaggggaggtttacatctttagaaatcagttatgaaacacacagcaattctggccaatgtcagaaagctgaaaggtatgaagaaaatatccttcccttcgaggcacaagcactgacctgtaaaagttgtgttgcagtagctctctgctcaggattcttcaccaaacactttttaacaaaatcggtgaaatcatcggaccaaagttctggctttctgaatgttggtggtggatttgtgggaatcataaaaatagcctagtacaaatgaaatatccaaaagacagtaagaatcacactagcacaatcaaataaacaaatctctttatctgtctttttatcagactctaaatttgaaaaacaaatttaagctgttctaggatttctagtaacactgaaattcaggaagccagtccatctgctactaatgtaatcatttcccattaaatttcctctatttgaattgtagctcattgagcacatcattctttattttacctattacttttttttatcagtctctaaagaagactatatttctgacccactaaggactttccctaaacatatatattcccaaattttgctactacatgccagatttacttcttgtttcagttttatataagcattgctgcttaaaatgggtagtaggagtccaatttgcttttgcaatccagaatatttaagtaaaattactgctataatttgaaataatacttgacagagccaagacttttctctttttaaatatgagtcaaaatttcaaatgaaaaatttcaaaggtaatatactactttaatttattactaatgattgagtacttataatttagtggtaatgataatacattcagaaacctcaaaaatcaaaagccataaaaagagtccatctcatctctcgcctcctagatagtcaccctggcctgtttttgcttttaatctgagtatgtttatgacccaagaagtagattaaaaaaacaaaaacaaaaacctgaagacattctaaatatgaaatacaagtcagttagggggttaatgtagatgtcccaacatgagtaataaaatgttcaaactagaatagtatctacaggaatgaaatggaagaaatgaagcatgagatacttcaaaggaggaaccaagagtacatgctaataatattgttttggagaggtgaaaaaaggaagcatgaaaaattactccagaattcaagaaataagaaataggtaccttaaattgcaaggcactcaggtattttaataattgcctatatcattcttttgaatgccctcagaatatgcagccatttaatataatgcattatcattggtttcttacttggaaagtgatcaaatggactttctgtggacacagcagcaaagactcaatatccaagtctgttgattataggttaagagtcaatctttttaccagtatatgcatcttctttcaaaaaacgtaaattctttaatagattagaatattttatatacctcacgtcatgttatacatattacatctatgatagtctttcaaaagcagtgtagccagtattacaaaacaataaacatctttcaatcaaacaaatatttataaagcatttctgtgtgttcagaacaatgctataatttagaggtatcaaaacaaagggccacaggccaaatagtgccagtggacctacttcgttcagacaaaatcaatctcacattgccacaagatgaatctgctgtaattagactaatttaaactaggacatatgttcttccttttgcgtgagctctatctagcctggctcaattatctactttatgtgatggtccctttaaatatcagaccttataaacccggctattacagtttttaaaataggatacatatctcagacccccagagctcacagtcaacttgtgcagaaaaaaaaaaaaacacatatgaaacgaatagcaaacaactgagtgccagacaatgaaattctgcctgcaaataacctaattaatctcagacagctccacagttgaggcagaacctaataaggctttaaaaaatgagtaaaatggggttaaaagcagctgctggaaaaggcacacaaaaccacctgctacttccaactagagaataaaaataaatttgaactctcatctctgtgaaacagttcaaaggacttacataagcccctatatagactgacctcaaactgcaggtaaattatactagattgtctagataaatattgttcatctgcacttctgttgtaaactggtggataacacaatgatttatgtccttgaagccaatgctctcctttgaactttgaggcaatgagttgcagtcttatcttgagataatcttaacatataaggctcaccttagcagtagctattagaaacccaaggataaaaagcttaactctaactcttatttacccagtactctcataaagtgaacctaaaatgtcacattctaccctcaaatatgcattgaacaagcatgaacaccgagcatacagtccaaacaaataagtcttagcgtatgatctacaccaaaatgtctccaggaaaaccactatgccatttatttccattttttaaggttagctcatcaataatagattttcttgacagccttactgtactaatttaactaatttaacctaataatgaaccacagaggatcctcttaagaatctctaggttttatatgagttgattaggtattaggccccttctatagaaagttttggcaatcagtggctcactttagactaacaattcattcccttgccaccaaccaaatcacagggacacacattacagccatataatttatcttatctctaacaccattttgattgaagaatgttagtaaaataaatgacatgattatccttgtgtttgtttctacacaatgtgttgcttaactacataccaaacctctgattatgtttctaaaagaactactctgatcacaagcagtttaataacgcaagaaatctaggtgcttcaaaacaactaattatcttcatgcctgaaatgtcatgccttagactgcaagagtacccaggagatgtggaaagggctgaaaatgagaatcaacaatgactgaactttataatctcagtggaatgagtcaacacatgtctgactctacagcagctgagtctgtgaatgtatagaagtgatgggcatgccagaataacaaagaaattcatgctattatttaagaacctcagatatatgagcaaaaggttatcttcacaacaaataaatgagataaaggatgagaaaacactataaaactataaagaagtaaacaaatatagctgtttcctgatagcaaacataatacacaggtaacaagctaaataaaattttaaaataatttctggaaaggaaataaagtaattacactaatttataaaagacagtacaaataaaagcaaacagtacaatgtgatgaggccaatactggacatgagtcagaaaaactggcttgagttctaaatcactacctgactgtgtggctttagtatcattttgttttttttttccaagtaaggaggttgaactggatgtttatcaggtcccgtactgggtataaaaagaccctggcactctttaccacgtattaaaaaaccctggcactctaactgcctagcaattgaagggtaaaattatactaaacaagtattaaattgctagttaggaaagggatggagaagaggaaaaagagggaaggacaggaaaaggccttttagatgttaatataaaaatgtgaatctaggccaggtgcagtgactcatgcctgtaatcccaacactttgaggggctgaggcaggtggatcacctgaggccaggagttcgagaccagcctggccaatatggtgaaaccctgtctctcccaaaaaacaaaaattagccaggcatggtggcaggcacttgtaatcccagctactagggtggctgaggcagaattgcttgaacctgggagatggaggttacaacgagccaagatcacgccattgcactacagcctgggcaacaagagggaaactccatctaaaaaagaaaaaaaatgtgaatctaaatttttatcaccattccctcaaaagcaaatatgaaatatacagaaattttgaagagaatagtaaatctaaagtgaaactttctcctataataaagtttccacagtaagcacagagttaaagtattgggaacatgaactcacaattcactccagttccagtagcaatcattaatctggccaagaaaggccaatgtgccagcctggaaaccaaattaagggagagggtgcagctggtattctggaagtacaaagcaaataagagaaccagctctagatggcactgggtacataacagcaccattattagtaactatctgacctatttaactactctatgcctctgttcccatatcttaatatgggaatgttagggctgttctgaattttaaatagattaatacatgtaaaacacttagaatagtgcctggcacaattgtaaatgctcaataatgtgagctattattaacctaattttacgactgaggctcacaagagtaagctagcttattcaagatcacacagctagtaaagtgaatgtcaaaattagaacaagtttgattccttagcatatgctacctcacattaccactgcttccatcagatttctgctgcacataattttattttaagataaaggctctgttatatacattcagtctctagaaaaaagtggaaaagtatttgtaacaaagaagattatagttttactgtctctaacggtggaaaactgaagaaaaaaaaagtcaaacaattgagggtgctaagtaaactatatatgaataacataaagtaacatattgccataaaaactgacaaatgtgtgaattacaaaaccacaaagaaaagttcttaaaaagcaaaaatgagggagtaaaacagtaaagactgctttcacataaaaatgactagtatgcagcaataaaaactaaaagatggtatagaatcttaaaaatttaaactgtcaattcatagcagcaattatgtacaagattgtataagtgtctttaaaatttatttttactatgatggtttttaaatttttttttacttttaaaaattatacttgcagctaggcatagtggctcatgcctgtagtccctgagctgagaggctgaggaaggtggattgcttgagcccaggagctcaagacaagcctaggcaacacaatgagatcctgactctatttaaatatatatacatatatttaaaagtatttaaaaattatactcgcaattgcaaaagcttcatttgataccaccccttaagctgtcacctattccagtctgccccacaaccacctcttactcatgcactatttaaatcccaatacaatcaattgtaaatcttaaccatctttcaagactgaaatataatatccctttaatacaatccaacaatatcataaaacatggctgtagagaaaagcaaaagtgaacaaaagccaacacttaaagaactttatcacaaatttcactctctcagatagaagtcctatgatcagttcaactgacttttgtaagcacataaatgtatccatacctgcaatatattaacttcttcaagaaatttagagtctaatggaatataaaaatgtatatcagatcattttaataaaatagtgtaagtgctcaaatacatgtgagcaataggtattacaaaggatgacttagcccaaataggtatgtgagctaaatgggtatgggaagatgagatttcagctgagtcataaagaatgagtgagtcagtgaagcacagaaaggagaccagcatcttctcagttgtgaagtttgaaacctcatggagctgtgagagaaactgacttatttcagatgtagggcagggaaattacgaggtgagccaaaggcatcttgttgcccataaagaaagaaatcactcaaatactaactggatcacatcagaagttcagcacttgtagaacttagtatcagccataaaagagtctgatttaactgatctggggtgacgacaaggcacaatattttcttacatctcccaagcaattccaatatgtgagtaacatggagaaccactattctaaaatataaaatacaagacaagtgctatcactgtttaatatctcaacttcagaactttccatattttaatattgtactctgattagttataaactcattctaaatgccctggataacatgaaaactacctgaaggcaagacagtgtcttctattgtctgaatgtttgtgtctcttgcaaaattcttatgttcaaagcaaatcaccaacgtgatggtattagaaggtggggcctttgggaggcgattaggtcataagggctccacctttgtgaatggaattaatgccctcataaacaagtccccacagaaccatctaatcccttctgccaaataaggacacatagaaggtgccttctatgaggaacaagccctaactagacaccaaatctgctagcacctagatcttgaacttccaagcctccagaactgtgagcaatacatatcttttgtacataaattacccagtctaaggtattttgttatagcaacccaaacagactatacaatcacttaagttttatatgtcaactgcattaggcatagtacttctccatagtaaaacctaaatttatactgagagtgttgatataaagacatccagttaagtatggtaactgaacatactgatttacttcaactccttccccaaaatcctgctaaagtacagtaagaattttaaaaaggcttaacctccaaagagagaagggcaatagaaaataagagacagcaataaaattttggaaatagaaagtagatgaaagagtcataactgactcaaaagatctgagaaatcagtaagaagcacatcaattccctccaaataactaaaaaaaaaaaaaaagcctaagaacttggaagtaccaaatatatctaaagatagtggacacctgtaacaaggagcacacctggtaccaagatcttggcttctaaaatgccaatccccagtaaaagaaacctatgctccttgaggaaatgactaatttcaaaggtcaaaataggaaaatcacaaggttagctctgggtatcttgctaggccagaaggtaaggaaacactcaaagattaatggtattatgtcaaaaggacatataaataaccaaatttaggataatttgagcatcaaaataataatagtaataatgactataactgattataacaaattgaaaacaattagtctacagtgttttttttttttatttttgagatggagtctcgctgtcacccatccaggctggagtgcagtgacatgatctaggctcactgcaacttctacctcccaggttcaagcgattctcatgcctcagcctcccaagtagctgggattacaggtgcccgccaccatgcctggctatttttcacatttttagtagagacaaggtttcaccatactggccaggctaatctcaaactcctgacctcaaatgatctgcccaccttggcctcccaaagtgctgggattacaggtgtgagccaccgcacctggcctatgacaatatttttcaaagagtttaagaaaagctgttctttatagaaaaattctaaaaatacacagtaactgaaatacagtatcaacatattgcaccctcaatgtaatttaatgatcaattcaggcaaggaacaccaatggatacttgagtttggatatctgtcccctccaaatctcatgttgaaatgtggtcctcaatgctggaagcggggcctgggaaggaagggaagaaggaaaggaaggaagaaggaaaggaagaagggaagggaaggagggaaagatgatgtagagagatagaatgaataatgcccccaccccgcaagatgtctacgttctaatccccggacttgtgaatatgttactttacatggcaaaaaggattttgaagataagattaagttaaaagtcttgaggtggacagattatcctaaattatctaggcaggccaaatgtaatcagaagggtcctaaaaagtggaagagggagccaggagagtcagagggagatgtgagtttggaataatggtctgctttgaagcagtcttcaaataatgctgctttgaagataaaggaagagggccatgagccaaagaatgtgggcagcctttagaagcttgaaaaagcaaggaaacaaattctctctgagatactccaggataaaaaagcttccctgccaccacttcagatgtagcctagtgagatatgtgttagacactgtattttggaaagctccaaaataatctcctttgactccatgtcccacatccagggcacactgataaaaggcgtgggctcccaaagccttcagccactccatccctatggccctgcagggttcagcccctgaggctgctctcatgggctggcattgggtgcctatgggttttccaagtgcatagtgccagctattggtagctctatctggaggggtctggaggatggtggccctcttctcacagctccaccaggcagtactccagtgaagactctaaccccatatttccctcttgcattgccctagtagaggttctcatgaaagctacagccctacagcagacttctgcctggacattcaggcttttccatatctcctctaaaatctaggctggggttcccaagtctcaactgttgccttccttttagttatgaaaatggctgcagctggcttttgcaccctcaaataagtttttcttttctaccacatggctgggctacaaaattttcaacttttatgttctgcttcccctttaaatacaagtttgagttttacatcatttctttgctcatgcatatgggcacaggttgttagaagcagccaggtcacctcttgaacactttactgcttagaaatttcttctgccagataccctaaatcatcagtctcaagttcaaagatccacagatccccagggcaggggtaaaatgccactaggttctttgttaatgcataacaaaagtgacatttgctccagttcccagtaagttcctcatctccatccgagacctcatcagcatggatttcattgtccatatcactatcaacattttggtcacaatttaacaagtctctaagaagttccaaactttccctcattttcctgtcttcttatgagccctccatactcttccagcctctgcctgttacccactttcaaagctgcttccacattttcaggtatctttatagcaatgccctactccttggcactgattttctgtattggtctattctcacatttcaataaagaaatatctgagactgggtaatttataaagaaaagaagtttaactggctcatggttctgcaggctgtataggaagcatagcagcttctgtttcagggagacctcaggaaacttacaatcatggtggaaggtgaaggggaagcaagcacaccttttttttttttttttttttgaggcagagtttcactcttgtcacccaagctggagtgcagcggcatgatctcggctcactgcaacatccgcctgcccatttatggtgataacaacttcttcctctcttacttcctccctctctgtcttcgccctgcccccagctatccgtctatactagttttctatttctgctgtagtaagttatcacaaatgtagtggttcatacaacacaagtttattatcttacagctctttaggttagaagtacaatatggcttggctctgtgtccccgcttaaatctcctgtcaaattgtaatccccaatgttagcggtggggcctgatgggaggtgattggaccatgggggtggagttgtcatgaatggtttattatcatccccttggtgctgttctcatgatagtgagttatcataagatgtggttgttaaaagtgtgtagcaccttccccctttctctcttcctcctgctctagccatgaaagatatgtttgtggccgggtgcggtagctcatgcctgtaatcccagcgctttgagaggctgaggcagtcggatcacctgaggtcaggagtttgagaccagcttggccaacatggcaaaaccccatctctgctaaaaatacaaaaattagccaggtgtggtggtgggtgcctgtaatcccagctacttgggaggctgaggcaagagaactgcttgaagaagctgttatctccataaatgggcagtatcaggctagtatgatactgctgtagtgccatcagtatgtggtctccaccttccaatttacttcatggtttaagatgggtggttgaacattaccacacactgactccagaactcaaaaaaaaggggaagggaatggcaatatagagtattaatcagatctctttacccaggctccctggaagtccaacacaacatttctcttttgcagtgttctgaacacttttgaagctcttttccaagaggctgcaaaagcccatggaatttccagagatataaatgtctttgttatgctaaggagttgacacatgccaactgaagcccctagatagcttcaggatacaggatggtcagcagaaagaataagcatgtaattagcaggttagtatatttagctgcctgacctctggtgagtggatactaaagactgagctcaaacaaatggccaaaggtttaatcaatcattactacttaatgaaaccccagtaaaaactctgtacatctaggcttagcagagcctcctggttggcaaacacattcacatgtcctgattctacaaaaggaagtcacacaggctctgtgttccctctcagacaatcatatgggtctcttcatttgactggtcctcctgattagcatcctttataataaacctgtcattctaagtatagttctttcctgaattctgccagtcattctagcaagttatcaaacctgaggggatcaaaggaactgctgaatgtataaccatttagtcagaagtatgggtaacctagggacaaattaagtgtagctggtatctgaagagtggtcatgttggggatcatgcccttgaacttgtggggtctgagctaactctggatggttagcagtagaacagaaccacagtacactcaatttgtgttgaaatagaatactgtaattcaggtggtattcaaatgtattttcactgtttttcaaacatagcaaaatagtgaaattgataagcaactgatataagaagcactttttagacaaaggtgaaaaatactgtttctctaacagcttttctctacagttgtggttctcgaggtgttcatgaactccttcactgggccctttcagggatctaccaagtcaaatctttttttcataaaaacactaagccattcttttcctttttctctcaattgacatttgcactacaggtacaaaagcaatgacagataaaattgctggctccctagcaccaatgaagacagtggaacaaaactgtaatcattgtattcttcattgtcatgcattcacaatttttttgaatctgtgaattcacaaaaaagacacttttgattaagaaaatccttgatttaaaaaatactctttttagcaaatctttttagcatctttttagcattttgtagtgaaatgagaaatacgcataaactatacctgctacataatgaagtacaatggttgtctcaaggaaaattatctgtgattaaattgcatgttgaactacagcttttttcatgaatcatctttttcatttgaaagaaaaactgagagataaactttgattattcagatttggatactcaacagacattttctcaaaaatgaatcaactgaacctatgacatcatggaaacacagatggtttttgataacaattataaaatttaagctttcagttgaaaagtcaaattttcaaaagcttctatctgccaccatgaacttaacagtttcctagtatttagaaacttttctgatttttccaaatgacaaatacatgacattacccgttcacatatgaataaagatctattccaagtacaagatagagaaatagattttaatgtaacaaaatagaaaaactcactactatggtttcagattctaatactggaattaatctttagaaaattatcactgttgaattttggtgtagtatgaaaggaagaatatcataattaccagaaaacaaatgattagaatattgctccatcttaatcacatatcatatatgtgttaggccagatatttttcatacatttccattgaaataatgtgttacaacactcacaaataaaaaaaaaaattcaaccatcttctattaagctatccactcattatttttatgaaaatagtaattgattcatataaacaaaagctcttgggtcctcaattctttaaagtgaaaaggactgctcaggccaaaaagcctgaaaaccactattctatagtgaatgcaaaccagggaaactaacaggaatattttcttctgtttgatgcatgttcaccagcaacagtaccacaaacttgtttcattttatattatgtccttctaatttgtttacttttttacatatttgaaattttaacacagataaaatttggtatatagtttattttttctaagtaactgtattttaatatgcctgaaaaaataatgaagagacatggttcacaagacatcaaaagagcatccagaaaaatgaaattggtaatgtgtctccattctgtccaagaggatgccctggaccactaaaaaatatacctggtccttgcaatagataaattcaagtggtagacacggatgagcatagcttgatgcagtagtcaataagatcatccaactaatcaccttattctagtaaccattttcacctgacagccttctggtcaaaatttggattcccatgtaaaactgacttcagaagagaatatggtgatgaacatctgattacttgagggttaaatatctatttttaaagtaataaattggaattttgatttgtatatcagtgaacttggttaagtccatcctatgagacagttctatatttattacattggcagatcggtcttcgaataataaatgctgctctgtgatcttgtctgggtagccaactgatcttccttagaaaatacacaaccacaacccttccgcaagcattatgctcatactacatcactgattacctaaattcacaccctgacaaagaagagggctctgccaataacaaagcatattaagttatatatttcagaataacggaataagagtgaaactttactaagaatagtgaataaaataatattttaaatgttaaataagttttgagataaggccttttaatgtttaattttagaataattctaggcattttaacagcataataactcctcaaaaaaagaagtgtatggtttggatgtcactttaagccatgaaatttttatctcagctatttaaataaagtatctcatctgaaatatggtacaatgtatactttacactgcattagctataacaataaataatggatcataaacatttacatataaaaagaacaaaatgaaaggtaagactatgcggaaaaaatactagaacaaccactagaagtttacaaaaaataagaagacagtacaaaaacatcaataaaatagattgaaaaataaagctgatgaactaattgccttgaatgtatcagaaaacttaagggaagacaaaatattagaaatcagtggccaggcatggtggttccgcctgtaatcccagcactttgggaggctgacgcgggtggatcacgaggtcaggagatcgagaccatcctggctaacacagtgaaaccccgtctctactaaaaatacaaaaaattaactgggcgtggtggcgggcacctgtagtcccagctactcaggaggctgaggcaggagaatggcatgaatctgggaggtggagcttgcagtgagccgagatcagagatcgcaccaccgcactccagcctgggtgacacagtgagactccgtctcaaaaaaaaaaaaaaagaaataattgacatatatcagataaactaattgcatgtattatcaaaacaatttcagaagcatgataaaattaagaatctggaagaaaactttcatagtaacttatcttagtaataaaacagaaaatgaatcagagcttcaaaagcaagaaagaagaaccaatacccccatccaaaggaactatctggaatgtaccaaaatgtttcaaaacagaaaaaaaaaaaccatatgattacaaaatgagaaaaaaggaaataatgaacaaaagattcatgtaatgtaacttagtataatttgaccataagattagggaaataaattaatactagtcattagcagtttttgtatcatctggtaaaagagttccaaggacaagaagttcaacaccatgaagtactattagaagatcagaatattatatgcaatactgcctagcttcattttaccaaagtgcaacaataattcaattcaatccaaagtaaatcaatagcatccattgattttctttctattctattcccacctctgactcctaaaacagtgcggcacacacgtcttagctctatcccagtgcccccaccaccatatgccacccttgcaatagctgtgtcttgtccatcactagcctggtgcagtctgtcctaatgaggaaaagcagggaagatgcccgcataggctcaggaccatttaaatggggaatcctgggatcctgggtctgcagagcatgatctaggagggaaaactatgggctctagcacagagatgtagcatggcccatgcagggcataatctttgggcaaaggctccagttaccgggcctagtgcctataattgacatactatcctcaaaattatcatttagcataaaatcatcctgattcgagttaaaatattatgtcactttacaaccaaagtgcaaagactaagttgttatagaatctgtgaaagttaatcaagtaatcaaaacatagtaaaatataaaaatgctcattataaagaacacatcattcaaaatccagtcatatctaatagagactacaaaacttaagcagatgtttacacaaaggcctataaactcaaactgatacaaagaactgggttaaagctaaacaagcagaggtcagcacagagctcctgtgattgaatcacaataaaacaatacactagtcctaagatagcaagaatatgatgcaataagtgaggctctggtcccaaaacagtataatgcccagtacaaatcaatttcacaaaaatctataatagaagtcaatgtaaattaggattaagaaaatcaaaattaacaacaaaaaatatatgaagaacaaaaaagaaacaactgaaaatatgaaaagtttataattaaaaaaagacacacagacatatatacatacatcaaagtctacaatcagaaaaaaacaatagatctcagaaatttagtgtgaaatttaagagtaaatagtaagttttagaaagaaaagaaatctgtcaacacagcccctcattttcgtgcctagggaaaataaggcttaatctacagccttggccaaatatgattgccagataaataaacccttagattctaccataagttaattaaaatgataaaaaaaaattcatatattagtttctaactccaaatttctttaagaaaaccttatgattcacaagcaaccaaccaattccaaactctatgccagtggttcttaacactggctacatattagaatcacctgggaagcattctaaaattgcttattccctgaactcaacccaaagaatctggtgttgtctaggcctaggttggttggtttttaaaaaaatgtcctatatgagtgtaaggtgtatcaagggtcaaagatcactgcatgaatcaaacagtatggatccaaattcccactacatttagcacaagtttggggaataaaaacttaccatttttagagacagagttcataaatagaatgggagaaactaggaaaactaattcaggggccaactctaggcaacaacaatcaaactgttccccttgctaaataaataaatacatatatagtatataaaatatatataaatatacatataatagacatttatataaatatatatgtgtatgtatgtcactatattttatatttcatctaaaattccataaattagaaagtcattgctgtttaaaaactatgtgtaacttctgcttctaggaagatagagtagatgtacattttcctatttctctcgttaagtacaaccaaaaaccatggacattatgaataaacaagcatacgaagatccagactgggcacagtggctcatgcctataatcccagccacttgggaagccgagtggggaggactgcttgaaaccaggaattcaagaccagttcaagaccactgtttctaaacatatatatatatatacacacacacacatatgaattctatatatacatatatatcaattctatatatatatcaacccatatatatagagagattctaatatatatatatatatatgaaagatggagagaaggcagaacagctagggatcttggaacccaaggaacataactgatgacttccctggatcttctttgtcccttatatattccacacttggggccagataagccaacaaccagaaaaagctaacaggtacaaacaaaaaagctccgacaaaaccctgcccaaaagatgaagagaagaacaccatggaaagaagaaaactttaggcaaatttcactctatgtcagccaaacaccacagaaaaaactgtagtcccactctaaccatgtcagaaaggcttagtggacagcctaaagttctatcctcatgagactataacaaggtcccacaatactcctgacatggtgagaaaagaacaagtagggagccaagaatttcacccctctggaaagtaaaaggacagccccccctagcagtgtcagtagacagcaagtagaacctgtacttcctctccaaactggcagcaatgaggtgatcctcccactacccactgaggaggactagaaaaaagttaaattaagactttcactaaccagtggaaattaggtaagcaccaatacaatagagactacacacggagagctagaatcaccactctgactcagcaataatgaggagccactcctgctacttgagtagggcaacagagactgaaaggggaatctggacttcaacaaactctacctggcagtgatgagctcccttcccctcttaaagtaatgtcataaacattcacctaaaacagaaggtttaaataagatccagtctcagaatataatggggaaataggtcctgttttcaaccaaaaattactcatcagaccaagagtcaaaaaaatcacaaactgaccaaaaaaacaaaaaagataaaagtcaacaccaaaaaaagacatgtcagaagtatctgacaaatattttaagagtctttaaaaaaatgcttcaatgaacaatcatgaaaataactgaaacaatgtaaaaatagaaagcctcagctttaccagtaccttgtgataatttatgtacatatagaataatactaaaataaaccaccaaaaagttttgcatagaaatatcctcataaacactatagataaatcaaaagaaaactcttaaaaaaaatcaagtaacccacaggaagtaaaaaaaaagaaaacagaaattaaaaaaatgcaaaactttagccataacatattaataattacattaaatgtaaatcgcctaaatatgccaattaaaaggcaaaaactgaaaaggtagattttaaaatgcaactcaattatatgtagtatataagaaactaacttataatataaaaatacaggcatgttgaaagaaaaatgatggaagaaatataacatgcaaacaataatcaaaccaaagcagaagtggctatattaataacagataaaggagacttcagcaaagaaaattaccagagacagagagggacattacatagtgatgagacataattcaccaagaaaatataacaagcactaatgtatatgtaccaaccaacaagctataaaatatatgaagcaaaaactaaaacttgaaaggagaaatagataaattcaccattatcagtagaaatgtcaatatcctctaacaacaagagataaaacaaatagacagaaaatcagcaaggatacagaagaaatcaacaacaccatcaacaaaatttatagaataccccacctcaacaacagcagagtacttattactttcaagtaatcatggaccatataccaagagagaacatatactgaggcataaaacatacatcaacaaattttaaagaactgaacagagtagagtctccaagcacaatggaatcacattagaaatcaataacagagacataataggaaaatcaagcacttgaaaactaaagaacacgctttcaaataatctatgtgtcaaagaagatgtctcgatcgggggaggagccaagatggccgaataggaacagctccggtctacagctcccagcgagagcgatgcagaagatgggtgatttctgcatttccatctgaggtaccgggttcatctcactagggagtgccagacagtgggcgcaggccagtgggtgtgcgcaccgtgcgcgagccgaagcagggcgaggcattgcctcacctgggaagcgcaaggggtcagggagttccctttccgagtcaaagaaaggggtgatggatgcacctggaaaatcgggtcactctcacccgaatactgcgcttttcagaccggcttaaaaaacggcgcaccacgagactatatcccacacctggcttggagggtcctacacccacagaatctcgctgattgctagcacaaagcagtctgagatcaaactgcaaggcggcagctaggctgggggaggggagcccgccattgcccgggcttgcttaggtaaacaaagcagccaggaagctccaactgggtggagcccaccagagttcaaggaggcctgcctgcctctgtaagctccacgtctaggggcagggcacagacaaacaaaaagacagcagtaacctctgcagacttaaatgtccctgtctgacagctttgaagagagcagtggttctcccagcacgcagctggagatctgagaacgggcagactacctcctcaagtgggtccctgacccctgacccccgagcagcctaactgggaggcaccccctagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacacagagcgcctctcctcctccaaaggaacgcagttcctcaccagcaatggaacaaagctggatggagaatgactttgacgagctgagagaagaaggtttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctaattggtgtacctgaaagtgatggggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgaaagattttgtgaccaccaggcctgccctaaaagagctcctgaaggaagcgctaaacatggaaaggaacaaccagtaccagccgctgcaaaatcatgccaaaatgtaaagaccatcgagactaggaagaaactgcatcaactaacgagcaaaataaccagctaacatcatcatgacaggatcaaattcacacataacaatattaactttaaatgtaaatggactaaatgctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagacgttaaaccaacaaagatcaaaagagacaaagaaggccattacataatggtaaagggatcaattcaacaagaagagctaactatactaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaatttaactcatctccgcaccaagcggacctaatagacatctacagaactctccatcccaaatcaacagaatatacgtttttttcagcaccacaccacacctattccaaaattgaccacatagttggaagtaaagctctcctcagcaaatgtaaaagaacagaaattataacaaactatctctcagaccacagtgcaatcaaactagaattcaagattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaacaaagaaaaaaagagaggaaaatcaaatcgacacaataaaaaatgataaaggggatatcaccaccgatcccacagaaatacaaactaccatcagagaatactacaaacacctctatgcaaataaactagaaaatctagaagaaatggatacattccttgacacatacactctcccaagactaaaccaggaagaagttgaatctctgaatagaccaataacaggagctgaaattgtggcaataatcaatagtttaccaacgaaaaagagtccaggaccagatggattcacagccgaattctaccagaggtacaaggaggaactagtaccattccttctgaaactattccaatcaatagaaaaagagggaatcctccctaactcattttaggaggccagcatcattctgataccaaagccgggcagagacacaaccaaaaagaagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacagaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagatagggatgccctctctcactgctgctattcaacatagtgttggaagttctggccagggcaatcaggcaggagaaggaaataaagggtattcaattaggaaaagaggaagtcaaactgtccctgtttgcagacgacatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaatagaagaggatacaaacaaatggaagaacattccatgctcatgggtaggaagaatcaatatcgtgaaaaaggccatactgcccaaggtaatttacagattcaatgccatccccatcaagctaccaatgactttcttcacagaattggaaaaaactactttaaagttcatacggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaagtaacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggagtaaagatttaaacgttagtcctaaaaccataaaaaccctagaagaaaacctaggcattaccattcaggacataggcgtggggaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacaggtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtgaggggaggggggaggggtagcattgggagatatacctaatgctagatgacgagttagtgggtgcagcacaccagcatggcacatgtatacatatgtaactaacctgcacaatgtgcacatgtaccctaaaacttaaagtataataaaaaaaataaataaataaataaataaataaataaaaaggtcaacatcaaaaaaaaaaagaagatgtctcaagggaaattaaaaaaaatacactaaaccgaataaaaatgaaaatacaacaaatcctgttaaaatttgtaggacacatgctgctacttgaagagcctagacaaagaagaacaaaaataaatgcaagacaagaagaaagaaaataataaagagtagaaatcaatacaatttaaaatatgaaaaaagttaaaaatatcaatgtaacaaacagctattttaaaaaacacacacacaagaaattgacaaacctcttccaaaatgacaaaaaagacaaaaagagtagtaaagtttctaaatatatttttgttttttaagcaactgtaaatggtattgcatttttaacttcaatgtccatgaattcattgttaatgtacacagaaaaacaactgattttttttttttttttttttttgagacggagtctcgctctgtcgcccaggctggagtgcagtggcgggatctcggctcactgcaagctccgcttcccgggttcacgccattctcctgcctcagcctcccaagtagctgggactacaggcgcccgccactacgcccagctaattttttgtatttttagtagagaccgttagtatttttgtattcaccgttttagccgggatggtctcgatctcctgacctcgtgatccgcccgcctcggcctcccaaagtgctgggattacaggcatgagccaccgcgcccggccaacaactgatttttatatcttgcatcttgaaaccttgttgcgcttactcattaattctatgagtttattcattggtattttctatgtagaaaatcatatcatctacaaaaggagatggtttcatttctacctttccaatctgtatgccttttcctttcacttcttgcctttttgagctggcaagaactcccagtactgtgctgaatgagtagtgagagtgaacatcgttcctgttcccaacattaggggaaaacattcagtcttttaccattaattatgatgttagctgaaaggtttttataggtattcttcatcaaattgaagaagttatctttattcctattattctgagatcattcaataccgtaaatgggtgctgaattgcatcaaatttttttttctacattatgtgacttttcttctttagtctgttaatatggtgcattacattgattcagctgaatggtactctccccacccaacaacccagctgtctgtatgttcttaaggtggaagctcagagtgttgttttttttaacactatgaccctgaataaagcaacatatctatatagctagtcccagaatcactggtaattgcttacataagaagctccgtatggccagatgatacagattgtggacacatgagaaaaaccttcttgttgcaagtaaaatatatctgtggctgagaaaaaaagaccgtcaaatgaaaaattctacatacaaaaaaaaaaatcagacattgggcacggtggctaacgcctgtaatcccagtactttgggaggctgaggcaggcagatcacttgaggtcaggagttcaagaccagcttggccaacatggtaaaaccctgtctctactaaaaaaaaaaaaaaaaaaaaaaaattagctgagtgtggtggtgcatgcctgtgttcccagctattcgtgaggcaggagaatctcttgaacccaggaggcagatgttgcagtgagctgagattgcgccactgcactccagcctgggtgacagtatgagactccatctccaaaaaaaaaaaaattggatttttttggtttactttccctgattctattaatcactgaatacaataaaccaaatactaaataggattagttatgactcataaataaacataaggatgtatattacattgccattcattcattgtatgtaaatttcctacagctagactataatatacagcttcccaaagcaatctaaaagtaacaaactttaatgatatagcacaactgaagtttggtatagtaagtgcaaataagtattgcaatgacaattcatcatggtaaactcaagggtctgtaaaaaatcaaattatcgaggaccgagttcaagaagaactatattaatacatagatttctgtaacttggcagagaattccctacaattgctacatttaaagtaatcaacacatttctatatctcagaagaagacggaaattatgtgttcgcctatcctaatgtattaaacttttattacaatagttttagtatatttttagcttaacattaaggtagaaacattctatcaaactaagaaatagaaattgctctgaaattgcaaaaacctgtactatttcccattttaaaatcagaaggattacttctacagcatttaattgttacatcttacaataataaattacatgggactaatatgcataatagaacacaacggtagtagtaataatgattgagcagtagtatatttacataccgataaaagaaaacccatgtagaagaaactgaagaaaataaacgctagagtgaacaaatgatgagtaatgctccaaaatacaagaaaaagaaagaatgggatacagaatagaggttgagagattggacttgagcagagaaggaaccctcttcctccacatggaacatattgtgagggagggaagaataagatgagaaggaggagaaaaagaaacgaagaaaaaataaagggaaggaagaaaggaagaaagagagggggaaaaaagacataaaggaaggaaggaaaagtatagatattgactgttacggactgaattgtgtcctgtccccccaccaccaccactaccaaattttatgtcaaagccctaatgctccatgttactgtatttgcagattgggcctttaaagaggtattaaggttaaatgaggtcataaaggtggggctctaatccaatatgacttgtgtccttataagaagaagaagagacattaggaatgtgtacattcaaaaccaaaggccagggctgggcacagtagcttatgcctgtaatcccagcactttgggaggccaaggcaggcagatcactggagcccaggagtttgagaacagcctgggcaacgtagcgacagcccgtctctacaaaatatacaacaattagccaggcatggtggtgtgcacctgtagtcccagctactcaggaggctgaggtggaaggatcatttgagctcaggaggtcgcggctgcagtgagctgtgatcacaccatgacattccagactgggagacagagcaagaccctgcctcaaacaaaaacaaaaacccaaaggccatgtgagaacacacagagaaggcagccatctgcaagccagagggagacctcagaagaaaccagacctgccaacaccttgatcttggaagtccagactccagaactgtaagaaaataaactgttgttgtttaaatcacccagtctttagcattttgttatagcagcaggaacagactaatacattaagttagacggagggacagaaacagtgaactgctaatagtctccagtttttctttggaccagaaagcaagtctgacaaaaccaaggagagatggggtaaagaaattttgcaacagacccagaagagaatgaggtggtaggcgtaggggaacatgtgaaaggattgccaactgtccatttcagattagaaatcaatcttttgggggcatcagtcttcacagttacataattgcagttaagcagcctggttacgaggaacacagcaaaatgggaaaggtaaaaacctttgaggttttttaagtctgagtgataacctagctctatcagtgtagctgtgtcttgggttgttatctagagttataataatgatagttacatagagtgtgccaataataatatctactccttttagagttgttttagagttatgtaaaactttatcatagagttggtcagatagtagacaataaataatagctactatacttattactatgggattagtgtagtattggtacattgttaggaagatacagcaaaaaagagaaggaaaaaaaggaattaaaagaaagtggttcagccgggtgcggtagttcatgactgtaatcccagcactttgggagaccaaggcgggtgggatcacttgaggtcaggagttcgagactagcctgggcaacatggtgaaaccccatctctactaaaaatacaaaaaatgagccgggtatggtggcagatacctgtaatcccagctactcgggaagctgaggcaggagaatcacttgaacctgggaggtggaggttgcagtgagttgagatcgtgccactgcactcaagcctgggcaaaaagagtggaactctgtctcaaaaaagaaaaaaaaaagaaagtggttcaagtgacagagtagagtcttggctagatagaggagtaaagtgaatgcctgaggatactgacaagctggaaaacaggaggaaaaataagttaaatggcctgaggatgaagtccagttgaattttaaacccaagaaaatgagaaagatcgaaagattggtaattaaaataaaatcctccagagaagactgctgagtgtgaatcagcagctacttcttatatgtaacaccacagagaaacataacaaaaaaagaaagccagctaaatggtcgtggccttgtcattagctagcagtgtatcttgaaagaaggcgcttaaactgtgagccttactgctatttgaggattactgacaaattacctctggtttctcctttattccacttccactgtaccctctctccgacaacacacacatacacacatacacactcatcattatagtaaagatcaagaaaggcagtaaacaagagcaaagatctggaaagaaggcacattttcaaaactgacatttgtcttgtgcatcctcccacttcccttttccctctcccagtcccacctctacaagcccaaaaaccccagctctcactgctggctctgctcccagaaaaagcccaaagtgccatgtttctctttgacctttcttccctccctcccacctattaaaacttccactgagtctatctcagtttaacaagggaaaaggcaaactgattatgccttttcataatgatgccaggatgaacagtaactcatctgtgcttaaacctcccaagtgtgtttggcttaaaaattgaaacgaatctatttggcaaaatttcaggcagaatggaaaggggataatttggggcaaggagattttctttcttccctgttttaaagttgtgaggaagaaaaagaagtgtttgtcgtaactgacaacagacaaccaccacagaaaaaacatccacagcagctcagaatgctagactgctacacttaagggtactttttaggtgtacaggcctgcataggatgctgaagtggggggcttatgatagcaaacatgaggaagcaatctaccctactataaccctgaaaaaagtggttcagaaccatctaccacgtcatggtaatgactctcttttctcttccctttattacagaggctgcccctcaccctgccccccagatgctcccctgataaaaggaggtggggaaaaaggaggcagccataaaggcagcagcaggagtgaactctccatcttagttatttcctgttagaagtggggaaagaatctgcagcatagaagccttaacagaagcctgagtataaagcaagaaaatagctgtagatagaatcacatgaaaaagtgactatacaggaaaaggtgccattcaatgagaaaagggggaaaagtatcactgaagaaaagaaacactctcttcccaaaaaaggtagaaatacaatcaaatgtttcagagcagggatcagaaaacttcggcccacatgccaaatctaaccagtctcctgttttggtaaataaagttttatgggaacacagccacactcattcatttatgtgctgtctatatggctactttcacattataatggaagagctgaatgactgcagcagagaccatataacttgtaaagactaaaatatttactatctggccctttacagaaaaaaggccctgctttaggaggtcaggggtaagaaggggactgagatgaggccatcggatttgataataagtgatctctggcaaatatgaagaaataatttaaaagaagtttaaaagaaactaaatgtattctaataaagtagagacaatgaggataaggtattctttcaaacagcctctaggaacaaaggaagactacatgcaagtctgcatggggaaataagaaattttcttgatctcaccaatcttcctcctcttggagtcactctctttaatcaccaaccaaacagcttcccaaactagaaactgcagaattttggtaagtgattctagctccacactgctttctgtatcctcagttccaggtgcaatgcttagtatacaaaagataatgtttgttgagtaaaacaatttaagagtacagaatgtagagagaaaagattgagaagagagaaaaaaattctgtccccacttcatacctggaaaaacattccatgccacctctaatggctatgtggcttggactcaagtcttaagagtcatcataggccaggcgcagtggctcatgcttgtaatctcaacactttgggaggccaagcccagcagatcacttgaactcaggggttcaagaccagcctggccaacatggtaaaaccccgtctctactaaaaatataaaaattagccgggcacagcagtacatgcctataatcccagcactttgggagactgagacaggtgtatcacttgaggtcaggagttcaagatcagcctggccaacatggtgaaaccctgtctctactaaaaacataaaaattagccaagcgtggtggcatgtgcctgtaatcccagctacttgggaggctgagacaggaaaatcgcttgaacccaggaggcagaggttgcagtgagccgagatcgtgccactgcactaaaaaaagaaaaaagaaaaaaaaaaaaaaaaaggtctggttatttaaaagagcctgagactcctcccctttcttttgctcctgctatcaccatgtgacatactcatgcccccactgcctcaggaagtaaaagcttcctgaagcctcaccagaagccaagcagatgctggcatcatgcttgtatgacctgtagaactgtaggccaattaaacctcttttatttataaattacccagcttcaggtatttatttatagcaatgcaaaaacaagctaacacacacacagcaaagcctaagatttacatctatgtttactaccaaaaattttatagatttagctgttaaatttaggtctttggtgcattttgaattaacatttttacagggtatgaggttggagtctaatttcatttttgtacatgtgggtatctaattgtgccagcacactatgttgttttaacatcaaatgagaaaatatataagataatttgatactacaaatatttgtggttgttaaaattcaggtactaagcaaacagctcagtagaatactacaacaaacatgtaacctaattctcctgtctctagtttctcctttaatatctgttttatatctgtgtaaaacacagtccagtaatgcaacaactctacataaaactaaagatacctactgctgacagaattagaatttctggaaattctgagacagaacttgcccctgatttttccagtttatacaagctatccacaatccttcgctcatggcctccttcctctcttttcaattttccaggctcatctcttaccattgttcccaaccacttggtctggctacacaatgttactagacacatctgatgtgaagtactcttgaaagactctgtagattactcatgctagacttttggctttccttaacctgggggttccctgaagcagaaagaattttatttatccctatattcaagagtccaggagagtgcccaacacaaagcaggtgtttcataaacacttgctaagttaaaggaatacacaggcaggcatggtggctcacacctgtaatcccagcactttggaaggcagaggtgggaggatcacttgaggccaagagttagaaactagcctgggcaaaatagcgcaaccctatctctacaaaagtaaaattttaaaaatcagccagtcctagtggtatgtgcctatgttcccagctactcaggaggctgaggcagaagaacagcttgaggccaggagttcaagacagcagtgagctatgatcacaccactgcactctatcccaggcaatagaggaatatcctgtctccactcccctccacactccaaaaaaaaaaaaaaaaaaaaaaaggaatgtgcctataaatggaagacagtgacgaaggtaaaggaataaagtagacgaaggcaacaggtttggaaaacattaaatcatcttgtttggcaggaaaaattgtctatatagggggatgttgagagaagcctggaaacctggatgggacagcaagagtaaaggccaagtgaggaatttgtacagtgatagttttttagggtaacttgatggatttttagacacagattataccaattctcttttcccccaataagagatttgtgactttggctaaattatttgactcagaaaagactcaagtacttcatacacaaaattagactaatctctttagtatgataggctcagctggtaggcccatcaccctagacacagaagaaaaaaataatcatgctataataaggaagcttgacagtcatttacgagagtttaccaacttttgagcagtgaaatctactttccaaataaactcatacatggaaccctagtacagaaaccttttttaaacccacaataattgaaaggggcatgaaaaaaactggagaccccacacacccaccttccttcctctcacaaacattggttcatataatcaagtggacttcaaatcaaatatggggaaccctaaacactactttagaacatggtcaaaagtttactaatctagagggatccaggtaaagtcatacaaccaagattcccctttgtggctactgattcgaaaataaatgctagggaggaaacaaagataaaaactaaagatggaaaggaaggtcctactgtaattttcctgaccagaccaatggagggcataaactaggatggtagtattaaaaagacagaagccaagcaaatataacatacagaaactgttttcactttgttttccgtattcttgatgggaaccatgctgacccaggagagactgcccctcccaaggctagctacttcttagacagcaaactacccctccttgagtgcttttcgcatgcaaaccactcaatctaaaactacctcccatccatccccagtattcagctctcacagaactcttatattctgggactattagaatagtcccctgttctaataatcacgccagggccaggtatcaaacaacttgggggctgctcttatatgtgactatgccgacattattaaaaccagccaattctaagcctccttaccctgcctcgcctgttccttctcactaaaatcatgataaaggctctcccccatgatttccctagctatttctgcctcctaaacaaccctggtgcttccctatgagcactatgtggcgtggcatatatgccaccctgtctgatgtgccatgccctctccacttagaaactgtatcaatcttttcaatggcagttgtctcctgacgtgttagtttcaccatatttgaataataatataaaccacattttaaaaatagttcaggaccaagcaccaaacaaacagcacgtacttagagaataaaatgtgaagtattaagaatcagtattaaggctgggcatggtgggtcatgcctgtaatcccagcactttgggaggctaaggcgagaggactgcttgagcccacgtgttcgagaccagcctgggcaacacaatgagaccccatctccacaaaaaaattttaaaaattagcaggggtggtggcacacgcctgaagttgcagctacttgggaggccaaggtgggagaatcacttgagcctgggaggtcagggctactgtgaaccctaatggcaccagtgtactccagcctgggtgacagagaggaacagaagaagaaggagaaggagaaggagaaggagaaggaggagaaggaggagaaggagaagaaggaggagaaggaggagaaggaggagaaggaggagaagaaggagaagaaggataaggagaaggagaagaacaagaagaagaagaggaagaggaagaggaagaagaggaagaggaagaagaagaagaagaaagaaagaaacagtataaagatgagattttctagttatgagagatgccaaagcagaatgttttaagagataaacctgacatatagtaaacatttctttttttttattaaaacacattaactataaatatgtttaacatcatttcttatcttcatcattcaagatatctgagccaaaaacctaggccaaaaatcctgactctcatttacattccacatttagataatcagaaaatacaaatatccagaatctggccacatctcaacaactttacctttactaccctggttcaggccgccattatctcttacctggactactgaagaagtaacctcctcactattcacctggcttccattcttgtcctgctacaatcccttctcaatgaagaacgagccgtttaaatcacacatcagaccataccattcctctgctcaaaaccctgcaatggtttcctgtttcactcagggtaaaagctaaaggtcctgccgtggtttatgaaggctctaagtgatctggttccctgccatccctctgatctcatctcctacttctttcaccatcttatccagctccagccacttaaacctccttactgtttctaaaacatcaaacacagtcacacatcagtttactctgactagaacgttctttccccagaaatctgcattgctcatttacttagctccttcacatctctactataagtcaccttattagacaggcctttcttgaccatcctacatataatatcacaaacatatctgtcattctgtatccctcttatcctgctttttcttcatagctgttatcagtacctgatatgctatagttttcgtttttttgtgtgtttttttcccgagacagtgtctcactctgtctcccaggctagagggcagtggcacgacctcggctcactgcaacctccgcctcctgggttcaagcaattctcctgcctcagcctccaaagtagctgggactacaggcatacgccactatgcccacctactttttgtatttttaatagaaaatgcgtttcactatgttggtcaggctggtcttgaactcctgactttgggtgatccacccgcctcagcctcccaaagtgctgggattacaggcgtgggccactgtgcccagctttttgtgtgtaatttactgtctttccccactacaaataggtacctaagagattggaactttgtttcattcactgttatgtatgagtgcctaaaacagtgtctgagcaggcactcaataaatatgaaataaattaatataccaaagcctttctgagggatttacacttgtactgctcaaaaatccataaacctcgcaaagagacaaaactggatcactagtggtaatatataaaaatgtaaaaataaaaatgtagtcttctaagaaagatagaaggcttgacagtaaatgattaactaccaaaagaataaagtataaatgagagattggcgaccatgtgaactcacctcaagagaataatagatacctacaaatgaacatgtgaaaaactttataataaaactatataattaagcacagagaataagactatcttgccaagatttgctaacttggcaaacatccatattaaactcagcttccccaattccagatacaaatgaaattgtgaatttggcaattcactggagagaaagactgcattacaatctaggttcacattaaagttacctcattcttctcaacttagatctgacgcagaggaaaatttttaacagattctattggacatatgccatactatagtcagtaaagttcaacattaacattttagatgttaacctaaatgatttgttttcctaaaactaaactgcactaaaaaaatatgcattatgagtataaaatgaattattttaaataatattttgtcaaagaaaaagcaatttataacaccagtccttccctcgtattttgatttcattcatgtagtgcctcacccacagctgaacacatggtagcactcaagctgttcactgataagagagagaatattctttccttcaaggtttattaaatatagatatgtccacctcaaccttcccagttattaaaaaatgcaaatgaaaattatgtaccccaaatttgtatataaatgtattaatcatttatttaataattagtatgtcataaagcgtagtattagatactgaagacacaaaataaaaattacacatgctgctatcaataacttcataatgtggtagagaagtcatataaactataacagaagatgataacttgtatggtcttggggcacacaagatgcaaaggaagcccagaagaaaagttcccaagatagaatgtgtagaaaaaagatgggagaaaatgcaggcataaagtaacacttagaagaaggcagaggtaaacctaacactacctacaaatgatagtatggctaaaggaaaggaaatatcacatgaataaagatgtatgcagagcccaaggtcttacatgacacccttaaaaatttggctattaatggggaggatcttaagtaagacagtaatatgagttgtgtttcatttaagatgatcaatctagcagcatcatgaagtttactttagagaggagattgagactgcagattattaaatcagttggtactgatccagaagaaggtagaacgatggcggtggcgttggctttgccagctcaggactgagtgcaagtaacagagaatcagccagattctccagaggctcttcaggttctcctctgtctttcagtcagcagtctcagtccatttgcggaggaacattggtgttacagcagtggcgtttaataaggaacttgatcctgtacagaaactctttatgtacaaggttagagaatacaaatctaagtgacagacatctggaggatctgttgatactgatccagagtaccagcaagagccagagaagaagctttttaagctcaagcaagtgtatggtaaagcagacatgaatacattccctaacttcaaatttgaagatcccaaacttgaagtcatcaaaaaaccccaggcctgaagaaataaagtaaaattaacctggtaagttgtcaagggttagctgtacaactagctagaagtttcagaataaacatacattcacaactgtcaaatgttcttttaatctcgattccaaataaattagttggtgatgtggagtattaaaaaaatctggaaggaaaaataaagatgtggacgaaaagaaggggatattacttgagagatattaagaaagttacagagatgggaactggtgaataatgaaaacttgaatcagcacagtggcagtggagctggacaggaaggagggaaggaaacatcaacaggacctggtgactgattaaaggcagaagattgggccaggcacagtggcctgtaatgccagcactttgggaggccaaggcaggcggatcacttgagtccaggagtttgagaacagcctgggcaacatggtgaaaccctgtctctaaaagaaaaaatatatatatatacaaaaattaaccaggggtggtggtgcatgcctgtagtcccagctactcgggaggctgaggtgggaggatcacttgaacccaggaagcggaggttccagtgagcggagatcgtgccactgcactctagtctgggtgacagagtgagaccctgtctcaaaataaaataaaaaataaaggcggaagattggacagagggaggatactcttggttaatggcaccaccatctaaccagttgtttcaaatacatagttggttcaaatataaagggagaaacaagcctgatgaaaaaacagtgaaaacaacttggagatattggatttgaattatctcaaaatagtaaagaaaattatataagcagattactagaaatatgtctagaattcaagacagagataaaagctggaggaaagccagggaatggagacagcagtgttctctactgctgtcttaaccctttctttcagagccacatataaaagcagttcactggcacctctgcttcctgggtccaagtgattctcccacctcagcctcccaagtagctgggactacaggcatgcgtttttatactattttgagagaattcaaatgcaatatccccaggttattttcactgttttttcattctcccaaaggaaaactgtttgtctcctaaatcaaggagcacgtgagcctgtaaagttccatagcagagaggaaataagtgatgggtaggagaaaaaaaaacaagaagaaagaggcatacccttctataatactacagccagaaaagggtaaaatgaggccccaaagttcaggcatatgtatatggccatttaactaggactttttaagcaataagcatgctgtgcttaggctgtctcagcactattgttaaatgctttaattatgtaacttttgatacattcatgttatcatatgttgtaattattgttgttactattacattttctctatatagcacttattatgtatggggcaatgtactaagtagctttacaaaaattatttcttttaatcctcaccaaaaccctatgaggaagtatttctccattttatatatgagaaaactgagggatagaaaggttaaataacttgccctcaaatactcagcaaataaaggacagagttgaaaatggaacccaggcagtctagctccaaagtccatgatcttaatcatcaagttatactacctcttttcaggtggataaagaatacttttggttactaacttaatctgaagacaactattttctagtaggaaatatttctaattttacaatacatgtaggagaaaattgagtttactgatcagaaacttgctagactacattattaagtaaaaaaacacacagaattaaaatattatttaaaacatctgtacatttttaatctgtataaacatgtatatataacaatagttctcatctatataaatatgtacatataataattgttcttaaattttactatgcatcagaatttcttggtgggcttgttaaatgcagattgctgaacccctacttcaaaccccaatctttcccctattacttacgaaataaagtacaacttcttttcagcatggcttacctttggccatgaggcatcgtctaaccatctttcaataagtttttagtacattacctatttttttatgctttccctaatacaacccttcctaataaagccatacattccttctatgattccaaagcacctctaaaatagtaaaaaacagaacaatgataataatatcaattaactctgtggggcattcccaaggaaacatgaattacctcattcaatcctcataacaactcctcaggataaagattataattattctcactgtacatatgggaaaaaagtgagacatggagaggttaaattgggcatggtaatacaatcagcaagtagaaaagctaggattctaccactgcaattatactatataagcaattactagattgttcagtacttggatactatttagatactagatttttctaagtactaatgtaaataatttccttattcatttttacacttatttaactgacatttactgactgcctatcatatgccaggcattgtgttaggcacgaaagactatcatgttaaaatacaagggaagacccagtacctgctctcttgagacatggaatccagtggaaaaaccaaacattaaattaaaaatcagagaaatatttcaagaaatatgtgttaaagacaaaaagtacaaggcactccaagattataataggaagatctaagctgtttatagttattgtactggcagtgtcctattacaagagtataagttacacagaatttgcatttcaggatgccaaataattccatttcaaaatgacgctttcaaaatcaaattaattaattataagaccaaagtcatatagttaaaatttaaaacatattatttaaaatgaaatttaaatatgtcagctctttatttttccccttagcaaatggagctattacgcatctgacacagaatgtaataaatataaactatccaaaactaataaaatagcatttgaaaatgtccttgcaatattggtcatgataaaggtaaaataatatgccaagttcctgacaatcctagtagtgcataaagtacttccattttggacaatgctaactttcttatgattgaattagatccatgacttaatatacatcatttgtaagattttttttttttttttttacaaaaagcagacttctttcataataaatttcaaaatgaaaaccaatgtttttttacagaggaaaaatgcctaaaagtccaaatactgatcttacaaagagacatgaaaggtaaaatcaagtatgaaccaggcctggattcccacatcttcagtttctatttatcaaacagaaaaatctttccaactttctcctttcctgtataagaccaaaactatgcaatattctgtttgtattacaattacactaattcaatgcaggtcacttgctttttactgagtccagatgacattcagtaaactaaacatgggccaattagtttaaaaaaaagaggaagaaaagaaaaaaggaagaaacgagtgagttctgattgcctttgggtaggtcatacagtggctacagagcatcacagcctgaacttcattttggctaacaccaaccatacggctaacattaaggactagcattttttattcctttcagatttctcacatttggaaattccaatttaaataattttctggtgaaagtgaggacagcactcctgcataatatcagttttcccctaattcaactccaatgtcttattttggagctactaaaatggaatctgcacaatgtctaaaaaagtataataatcctttttaaccaatttttttatgtattacagttttaaatgagcaaatgaaactgataatttagctgacacaaacccacacaaaaaaagatggtctaaagctatgaagtttcaacatcaatgtttgtaatctcaaatcaacctgaaccaccatacaattaggtatatgacaaactaagtaatagaaatattcataactaaaagcaatattatttttaaatatcttattaggtgttggcacccaacattttcttataatctatcatgtaaagaaatctgttttactattccttttaaactctctactcatgctactttaggtgtgtttctagaaataaatactaaactctctgctaattttttttggctaagaaattttttgaaagttataatgtaactaagttaaaatgtacatataatcataatttgatatcaagactgctttcatacaaaaaacctacattaattaattccttaagtaaatttacactttatcaattgttggtattttaaaaagtactcaaaagaaactcttcattcaccattattacaaaaatggaagtctccaaatatgtaaactagcttgatttttaaatttgttacttatttagcctaatttttttaaacttgcctaaatttaactgaagaatattatgttcctgcaagtgttcatgaatacaaagatacagtaatgaagatggaaattatttactctaacaattctgactgcatgactgttaaatcacttacatacggccaaatgatctacaaggaagcagggaggtcctgaaattgtgtactcatatccattttcaactactgcacaggtgacacaaccaatcaaggcattactgaaacagaatgggaatagaaaggacttagtgaataaaagtgacttctttagacaaaaatgtagaggttagcttgtgaccaaggtggaagaaacagcagcaccattcctcccattgcttgttcatattaagagaaaactgagaccactaagaggcaaaggacagaggacagcaacaccagcaaagagacaggcagcagtggggtcagagcatgagaacagtattaagagttaaacatagagcacagagggggtggtttaaaatgtcagttttactcaattatttataggacagttcttggaaataatgttacaatgaaatgttggttatataaaaatcttatttaatgtagtaattactatttagacaagggcaaatatagtaaatattaagtaaaaattaacaataattaaaatgggcttatggtctgaaatagacatattatgggaaaggattactgttctaacaactacgcataaagctgtgaaaaggcaatagttatactagtctgtagaaacagtactctaaaagttacaataaggagatacacttttttttttttttttttgagcaaggtcttattctgtcacccacactggaacacagtggcatgatcacagctcactgcagtctcaacctcctgggctcaaccgatcctctcacctcaggttcctgagtagctgggactacaggcgcatgccaccacacccagctaattgtttttgtatgttttgtagagacagggttttgtcatgttgcccaggctggtatgaaattcctgggctcaagcaatccacccacctcagcctcccaaagtgctgggattataggcatgaggcaccatgcctggtccaatatggatattaatcctcctgaaatagatgggattttaaaatgcaatactcagtttcaatgttgaaatgtgctcttctttcactgaaaatgacatgacactgtgaaagctttcttctaacacaggaatttttagaccttcacacaagttttcataatgtttaatactttcaataagcttcatgactattaatgctttggggaaaacttactttttgtttctttatttgcttttcaaaaccaaaggcatatagtaataattcattatgcttttacaatcaggtttcatctgatgtcaatgttacctttcatatctttttaagtgtttttccatgttaacgtgaaggtgtgtttcttaacttcacatagcaagaaacaaagacacgcctttgttcaatttaaatattttggttcctggccaggcgcggtggctcacgcctgtaatcccagcactttggaaggcttaggcagatggatcacctgaggtcaggagttcaagactagcctggccaacatggtgaaaccccatctttactaaaaatacaaaaattagttgggagtggtggtgtatgcctgcaatcccagctgcttgagaggctgttatttgttatatgttattccatattccctattctattctattctattctactcattcagagacaggatctcaccccatcacccaggctggagtgcagtggcgcgatcacggctcactgcagtcttgacctcctggactcaagtgattctcccacctcagtctcccaagtagctgggactacaggcacaagccactatgccaggctaatttttgtactgtagacacggggtttcaccatgttgtccaggctggtctagaactcctgagctcaagtgatctgcctgccttggcctcccaaagtgctgggaatacaggcttgagcaactgtgcctgacctccatattcattttattcaaaagaattttatacacaaaattgtggcaaaacttcaaggaagaatatattcttttgtagttctgtaatctagtggaaaaatgtgatataaaaaaacataaaagttaatgatatactagtgaagggttcctaatattcaattaactttgattttattctcaatctattttatactaccattcttcttatgaaaatatcttcaacactttcattgtaccaataaacaacaatacaataattaacaatttgcatttattattaaagtattaaatttaaaactccaaagcacctacttgaaaggaacattccaatataatttaattattcttggtcatttgctcatgtttccttaaatataaatacagtatacctaacaaataataagcataattataaatattatcacattttacaattttttattctaataaagaaaacatatgctcaaataatggaatttaactataaaatctaatttttagctcattgaaaaaacataaaaaaggatgatcaaactatttaccagtcttaaatatttaagagtataatatgtttatactactatatttatatgttataaatacagactatatattaacacatttataactatagtaatatgtatttatatagtataaaaatatactactatatataatactggctttttaaatacatttcctaatttcctttatttactactttaactttgtagtttataatttacaaatttcccagcactatatcttccccacaagaagatttccctttctagtggctactaacatacaatgtttaaggattaattaatgatagattggttaatgaatctgcaaaatatttagctcttttatttccatttttctctcctgctaattgacttttgaccatgttagtgtttattaagctcaagatccaaattagctaaattcttgccctcccaaacaggaggcagtctaaagcaaaggtgttggttgactgcaagttctggtggaatttacctattaatcagttctacaccattttgtcaaatctgaaccaatatagtgccaaaagaacattcttaaatattaagacttttatctttggcatacaggattcattcatccaacaaatacatactgagtaactactatgggccaagcactgttctagtgcttaacatatattagtgaacaaaagaaataagaaattcctgccctcatgttgccaatttaccaaccctgtgctgtgctccacactaaaaatacaaaattgaagatactaccccttacttaaagaagatttaatctaatcaaaggcaagaaaaatgtcctcaatgcaacttatcatataatgctaaaatatgcatatgtaaatggtagcagaagcatatataaagtgccatgaagagtagaggggaagaagcctctgtgcagatgttactgagtacaacatcacaaggagtataattctctctgcctataacaatcaaacacaggcattccaacctgagaacagatatgcccaatacagctttatatctaactctatgttgtctttcttagaggtaaatcaaggtgctgctttacagaccttcataattaatgtccccttagcatcttcaagagttaatggaaaaggagggaaaattctaatcactacatgttgacactttttagtagccaagaaaagttctcaaagaatgacaatttaaaaaattaacttgtatacactttctaggttaaccgtgggcctcaataatccctaccattccaatacacaaatgtcacaagttctcattcatatgtgagagctcaaaccagtggatctcatgacatatggagtacacttgccatcaccagaggccaggaaggggagcggggagggaggagtgaaatggagggaaaagggaaataaatgtatttattggcactgagctgtacacttaacaatggtaaagatggttaatttttaaaatattttcaataataatattaataattatccttaccatccttatctcttattcacatgaagacattagttaccatttattaagtgcctccagcaggagaggcactgtgtacaccctttatataacattatttctaaggcttaaacctttagaagattagtatttttattacccagtttttcacatgtgaagactgagagtgggagagattgtataatttgcccaaggttgtacaccatttggcctggaatgtaaaagaaatccatacgaacacaaagtcaaggatcttttcactctacctgatagctgcccactcccataaagaatctaatattgagggatattaattcctcttctatgattatttttaaccatcctatatgtagataaatatgtaaactgatctaaaacagtttacatccttgttgaaaacaggatcacatatgattacctagcctgctaacccagacaggcagatggatggacaggcagatggaagaatgaacaaaatctcaagtataatgacatccaaactgtttaaatctactgcacagtgttcttataaatcttcaatggcaagtccatttgactgacactatttctaaaagaacaattaggctaggcacagtggcccatgtctgtaatctcagcattttgggagggcaaggcagaaagatcacttgagcccaggagtttgggaccagcttgagcaacatagtgagaccctcacctctacaaaaatatttaaaaattagctgggtgtggtggcacacacacctgtcgtctcagctactccagaggctgaggtggaaggatcacttgagcctgggagatcaaggctgcagtgagacatgattgctctccactgccctccagcctgggcgacagagagctcaaaaaataaaatacaataaatgaaagcacaattaaacaaaaaataaacttaccttgagatctttgtaacacctttattatccctattattacctcatcttctattaatgtccttctggctcactccagccacactggcctctggttaagaatcaaagagccaagcatgttcccatctcacacagactttgtactgtctgttccctccaatcaaggcagtcttaccccagatggctcactcccttgtgtgcttcagtctttagcttagatatctccttcttaacaaggcatccttgactaccatttaaaagtacaatcagaccttcatactccctaatcaccatccaatgatatattttatgtatgtgttatatttattatgtctaacccaaccagaatataaacacaatgaaggcaggaatttttgttttactcaaggctatatatcctgcccatagaaaagtggctgatgcacaacaaatatttgttgaatgaataaatgaactttgtgaccaggcacagtggctcatgtgtataatctcagcactctgggaggccaaaggaaggatagcttgtgcctagaagtttgagaccagcctgggcaacatactgagacttcacctctacaaaaaacttaaaaattagctgggtgtgatggcatgcacctgtagtcccagctactcaggtcaatgtgggctgaagtgggaaaatctcctgagctcagatatttgaggctgtagttactatgatcacaccactgcactccagcataggcaacagacaaagaccccaactcaacaataataataacaaccacaataataataatactaaatgaacttcattatttggaacctaaagaggaattgtataagttcaatttcatcactgataaataattcaattaaagacttcttttaaagccaagttttatattatttagcactactgaacttccccttcttataaaatgtttgcctccttactctggccaaaaatcttcttttcattgctctttagaagtttaacatgatgaaaatcagtgtttgactttaaaagtcaaagtatgaatgaaaccgaacttgtatagacacatcttttagctctcatttcaataaactgttattaaatccataatcttttgagagagcaactcacagattaaaaattaaaattaatattttatctgatgctttacggcatccattgtattgaatgcatttgtttaatatttctaagtctttagaaaagcttctgagaaaattgatttccttatgttgtttacagtctgtgaccaaatatttttaggacattcacatgaataaagggtcccaaatgcaacagaaattataatcacatcataacttaagctttaaattattcatgtcttttatgtttaacaaaaaaactattatccaaaactatttattatattaaaatatttttactcaacaatctttttctcctaaggtcaatgaaggcatatgactcctccccaattatataactttttattattttaattaaattaactgataccagcatgttttaatatcatccctacacatttagaagaagtaaataacctagagatcaaaatacacagtaaacccatacaaacagcagtttttcattgccatctctctatatataaacattgaatgcaattctatgaaagtatggctccacgtattcagatgaggaatatgtctgtttacatgtgtctctttcccggtccacattacagggggacctgtgtgtgcctccgtggttaagatttactgcatgttcacattaaagtctcatttccaacatttaaacatgcagccacaaagaccaattagaacagttattagtacaacccttggtgtaccaaagatttgggagttcataaagttgaaattgattgtttatggacaattacaggtaccaaaatgatttaaaacatttcaatttttgctctgctgaacgagactcatttaaacagcagaactagaagcagagacttaaatatcaacttgtaatcaaaaatcaccagtaatgtcttagcagcgtgttcatcctcctactcagtagagtccttaaacatacagggactccaatattagcttcaaaacattttcagaatgtctagcaaaaatatgtcaaacctggatctctgacttaaaggaacacacaaggcctaagaaataattgctgtctcaaatactgtggagttaataaggttttaaagtatataaagttgctataggctaaacggcacattttatattagacaccctttcttgctaaacactgtattatatattaaactgtagcaaaagtgaatgaatctatgaggaaaatcaaaatgaaattttcaagtactcacataatgacatacctctaaactgtgaggtactttatgacagagtgtgtgattcattcatcttttaattcctagtgcttgaatacaaagttgatattcagtaaacactgattgaatagaaaaatgagtaaatacaacttgaagaataactatgtaatgagatttctgattttacaaaacactttcactacttttctaattatatatatatacatatatagatatagatacagatatagatagatatagatacagatatagatatcgagtagagacagggttttgccatgttgctggtctagaattcctgagctcaagcaatccacccacctcgaactcccaaagtgttgggattacaggcgtgagctatcatgcccagtcgtgcttcaccacttttcaatgtcaacttcaagaaaatgaaaattgcacctttctgaacaaactttaagtctaccctaaactgctaagaatcaacactaagagcagatgacataatgtgtgggaaaataaaaagtcagccagccagctggacatcagtctcttctctgactgctatgactaaactcttcaaggttataacttttcaaatgctaccactgtaatgaactatttcattgctagtgttacctcctttccttggtcttcccctttctagacaagaattcctgttattatctcattcccttcttgactgcactttacacactggtttcaatttgtacttgacctagttcccagaaaacacccagttttccttttctcacttagtatcttaatatttgtaatattaataacccacttatctattcaattgtttaattgtattttatctattatctattcaattgtttatttctatttaattgtagtaactctattcagagctagcctatgcaaaagagaagacagcagtcttcagatgtgacttacttagtacagaaagatcccaaccctaatatatacaaacacatacacatgcaaacacacacacctgctataaaccaaaattagagatacatttctttgtgttaaactcctgcttcttgaggttcttattctccctctgtccctctcaattgttctgtcactctttacctcctgcttttttctgttttacagtaattctctccagctaacttcactcttctttcttctacatacaacatccaatgtgtccaaaaaaattctgtgggtttttgtttcaaaatatatccaaaacctgattaggtcttaccacctccactgttaccaacctaacacatgccacgatcatctctcacttggattactgcagaggcctcccaactggcctctttccttctatctttgcccaccccgcccccacaatctgttctcaacaaaacctaagtaatcctttaaaaatgtaaatcagatcttatcactctgctgctcaaggcctgccaggggtctgtctacaaggcactactgatctcacctacctccatcacctcccttacttcctgtctttctctgacattatctcctacttctttgtccctagatcactctgctcccttctgcctctccaaacacaaaagggctttccattgaccattccatctgcccaaaatgatctccccaggtatatgtgtggtttactcccacaatacctgcaagcctctactcaaatatcaccttcccaaggaggctctgaacaccatatttaaaatcacaaatttgtccaccaaaactccctgtatccttcttagtgtacactctagttttctttaatcatttccaaaacacttatggctttctcatattctatataaattacttattatatattgttttatatctattgcctccttctaggatgtaatctctgatatatcccaaatgcctagaaaggtatctggcagagtagacaccgaataaaaatttgaatacatgaaaatatactagactatcttaaaatacaataaatatatagtatgttctttttgtttgttttttgagacagggtctcattctgttactcaggctggactgcagtggcacgatctcggctcactgcaacctcagcctctcagggtccacaggcaggtgccaccacgcccagataatttctgtatttctttgtagagacacagtatgccatgtttccaaggctggtgttgaattccttgatacaagcaatcctcccacctaggcctcctgagtagctgggattgtaggcatgagccattgcacccagccttgatgtcattatctaatgtctcctccttaataaattgttaataacccttaataaattgtggctaacataccttttacaatacaactctagaccattaatgtgtcccataaatcctgtgtgcatcaggaggtatcttttttgcctcaatgccttttattaatgcactgtcagtattctacttgggctttattcaaatacaagcctataaaactactgaatctttttccatccctcctactttcccattcttgatttttcccctacctttctctacaactccaggtgaccagcaatgacaacctaatatgtatcactccataccttcttctccatccttaaataaccacgtacaaacatatgtagagatttaaaattctattttgtttctttgggaatgaagttgtccccatatatgctccttcacatcttatttttctcatctcatagcaaacagtggaatataactacattaattggtatacacagaactccattctttttaatggccgcatgttacaaggccaaaatgtatcaaatgtattcaacttttcccaccttgtttccagttttttaccactaataaaaatactgcaaaaagatccttgctttgaaaaatgcatatatccttacatatttatgcttttatttttatgagataaattctaggggtaaaactgccaaaactgctttccaagaaaagaagtaaatgtcacatttctaccacaaatgccttttgctctaatttgccaccaatattgagtggagccataacatttttaattttggatatatgatgatatctcagccaggcacagtggctcaagcctgtaatccctgtacttcgggaagccaaggcagatgaatcacttgagatcaggagttcaagccagtctggccaatatggtgaaaccccatctctactaaaaatacaaaaataagccggctgtggtggcacccacctgtagtcccagctactcgggaggctgaggcaggagaatcacttgaacctggaggcggaagttgcagtgagccaagattgtgccacagcactccagcctgggtgacagagcaagactccgtctcaaaaaaaaaaaaaaaattagcccgggcatggtggcgggcacctgtaatcccagctacttgggaggctgaggaaggaaaatcacttgaagccaggaggcagatgttgcagtgagccaagattgtgcactgcactccagcctgggcaacaagagcaagactctgtctcaaaaaaaaaaaaaaaaactcaatgttactttaatctgcatatcctaaagtactattaatcatcttcctatgtgtcattagtctattgggatttgcatttctgtcaactattcatctctctccctgttttttatactggattgtcttttgacactaatttgtagttttttttaatatcgtagatatcaaccatttatctgtaatttgaagtataaatatttttcccaacctaccgcttatctattgagtttgctgccaatgagatcccacatataagttacaaaaaaaatcattatatgattagatttatttttctttcatagctcctgcatttcctatgttggttagaaacttctcccaagtttctaattcatgcatatagtccagaattcatattcttccatgtaagtctctagtatacttagaatttatttaggtattgtaagagaccaaagattcaattttctttcagatgaacagataattccaaatgcatgattatcattttcccattgagctcaaattttcacatttatcatattaaattcccaacagactattgtaattacagtagctttagaatttattttaatatctggtaaagctattcatttctcacttttttctccataattttcttagtcaacaagtatgaacattatgttacccaattccaatgtaaaccataaaggaattttaactagaactgcaattaacttttaaacaatttttggtaaaagattattatgatatagtttttgcatggcaacacaatattataagaattgggaacatatttttaaagccagcatgctctttccttcatttcaattccagtgtaatgtctttcaattagatttttacgaatttcttcctacagaagtgtacttcttttgttaactttattcctaaggattttctagtttttgaaactacttttaattgattactttttccaatttttctttaataacattattatcagcactgagaaaggctaccaatttctgtgtattttatatacaactattcaccaaattatgttattaagtctgataatattttactggtaccttttggatatcataagcatacaatcatatcagcaaaataaaatgtatttttcctcttcttttctaatgttcatacagattatttcattttttacctcattcaacatgctagaacaaaactaaataacgataatgataataatgataatagaggacatacttgttattagaaataacattagcattccactgtttaaaatgtttacttttgaagaatggcccggagggcagccaagatgaccgaataggaacaactctggtctacagctctcagcgtgagcgacacagaagatgggtgatttctacatttccatctgaggtaccgggttcacctcactagggagtgccagacagtgggcgcaggacagggggtgcagcgcaccatgcgcgagccaaagcagggagaggtattgcctcactcgggaagcgcaaggggtcagggagtccctttcctagtcaaagaaaggggtgacagagggcacctggaaaagcgggtcactcccaccctaatactgtgcttttccgacgggcttaaaaaacagcgcaccaggagattatatcccgcccatggctcggagggtcctacgcccacggagtctcgctgattgctaggacagcagtctgagatcaaactgcaaggtggcagcgaggctgggggaggggcgcctgccattgcccaggcttgcttaggtaaacaaagcagccaggaagctccaactgggtagcacccaccacagctcaaggaggcctgcctgcctctgtaggctgcacctctggaggaagggcacagacaaacaaaaagacagcagtaacctctgcagacttaaatgtccctgtctgaacagctttgaagacagcagtggttctcccagcacgcagctggagatctgagaacgggcagactgcctcctcaagtgggtccctgacccctggccctggagccgcctaactgggaggcacccccaagtaggggcagactgacacctcacacggccgggtactcctctgagacaaaacttccagaggaacgatcagacagcagcattcgcggtcacgaaaatctgctgttctgcagccaccgctgctggtacccaggcaaaccgagtctggagtggacctctagcaaactccaacacacctgcagctgagggtcctgtctgtaggaaggaaaactaacaaacagaaaggacatccacaccaaaaacccatctctacatcaccatcatcaaagaccaaaagtagataaaaccacaaagatgggggaaaacagagcagaaaaactggaaactctaaaaagcagagtgcctatcctcctccaaaggaatgcagctcctcaccagcaacggaacaaagctggacggagaatgactttgacgagttgagagaagaaggcttcagacgatcaaactactctgagctacaggaggaaattcaaaccaaaggcaaagaagttgaaaactttcaaaaaaatttagacgaatgtataactagaataaccaatatagagaagtgcttaaaggagctgatggagctgaaagccaaggctcgagaactacgtgaagaatgcagaagcctcaggagctgatgtgatcaactggaagaaagggtatcagtgatggaagatgaaatgaagcgagaagggaagtttagagaaaaaagaatgaaaagaaatgaacaaagcctccaagaaatatgggactatgtgaaaagaccagatctacgtctgattggtgtacctgaaagtgacagggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcaagttacccacaaagggaagcccctcagaccaacagcggatctctcggcaaaactctacaagccagaagacagtgggggccaatattcaagattattaaagaaaagaattttcaaaccagaatttcatatccagccaaactaagcttcataagtgaaggagaaataaaatcctttacagaaaagcaaatgctgagagattttgtcaccaccaggcctgccctaaaagagctcctgaaggaagcactaaacatggaaaggaacaaccggtaccagccactacaaaatcatgccgaattgtaaagaccaccaatgctaggaagaaactgcatcaactaacgagcaaaataaccagctaacatcatcatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagattaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacactccactgtcaacattagacagatcaaccagacagaaagttaataagcatacccaggaactgaactcagctctgcaccaagcggaactaatagacatctacagaactctccaccccaaatcaacagaatatacatttctttcagcaccacaccacacctattccaaaactgaccacatagctggaagtaaagctctcctcagcaaatgtaaaagaacacaaattataacaaactgtctctcagaccacagtgcaatcaaactagaactcaggattaagacactcactcaaaaccgctcaactacatggaaactgaacaacctgctcctgaatgactactgggtacataacgaaatgaaggcagaaataaagacgtgctttgaaaccaatgagaacaaagacacaacataccagattctttgggacacattcaaagcagtgtgtagagggaaatttatagcactaaatacccaaaagagaaagcaggaaagatccaaaattgacaccctaatatcacaattaaaagaactagaaaagcaagagcaaacacattcaaaagctagcagaagggaagaaataactaaaatcagagcagaactgaaggaaatagagacacaaaaaacccttcaaaaaattaatgaattcaggagctggttttttgaaaggatcaacaaaattgatagaccactagcaagactaataaagaagaaaagagagaagaatcaaatagaagcaataaaaaatgataaaggggatatcacgaccgatcccacagaaatacaaactaccatcagagaatactataaacacctctgtgcaaataaactagaaaatctagaagaaatggataaattcctcgacacatacaccctcccaagactaaaccaggaagaagttgaatctctgaatagaacaataacaggctctgaaattgaggcaataattaatagcttaccaaccaaaaaaactccaggaccagaaggattcacagcctaattctaccagaggtacaaggaggaactggtaccattccttctgaaactattccaatcaatagaaaaagagggaatcctccctaactcattttatgaggccagcatcatcctgataccaaagcctgacagagacacaaccaaaaaagagaattttagaccaatatccttgatgaacattgatgcaaaaatcctcaataaaatactgacaaaccgcatccagcagcacatcaaaaagcttatccaccatgatcaagttggattcatccctgggatgcaaggctggttcgatatacagaaatcaataaatgtaatccagcacagaaacagaaccaaagacaaaaaccacatgattatctcaatagatgcagaaaaggcctttgacaaaattcaacaatccttcatgctaaaaactctcaataagttaggtattgatgggacgtatgtcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaatcaagggtattcaattaggaaaagaggaaggcaaattgtccctgtttgcagatgacatgattggatatctagaaaaccccattgtgttagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaaattaaaagggacgtgaaggacctcttcaaggagaactacaaaccactgctcaatgaaataaaagaggatacaaacaaatgcaagaacattccatgctcatgggtaggaagaatcaatatcgtgaaaatggccatactgcccaaggtagtttatagattcaatgccatccccatcaagctaccagtgactttcttcacagaattggaaaaaagtactttaaagttcatatggaaaaaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgacaaaaacaagcaatggggaaaggatcccctatttaataaacggtgctgggaaaactggctagcgacatgtagaaagctgaaactggatcccttccttacaccttatacaaaaattaattcaagatggattaaagacttacatgttagacctaaaaccagaaaaaccctagaagaaaacctaggcattaccattcaggacataggcatgggcaaggacttcatgtctaaaatgccaaaagcaatggcaacgaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctataatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagacaccatctcacaccagttagaatggcgatcattaaaaagtcaggaaacaacaggtgctggagaggatgtggagaaataggaacacttttgcactgttggtgggaatgtaaatgagttcaaccattgtggaagtcagtgtggcgattcctcagggatctagaactagaaataccattgacccagctatcccattactgggtatatacccaaaggactataaatcatgttgctataaagacacatgcacacgtatgtttattgtggcactattcacaatagcaaagacttggaaccaacctaaatgtccaacaatgatagactggattaagaaaatgtggcacatatacaccatggaatgatatgcagccataaaaaatgatgagttcatgtcctttgtagggacatggatgaaattggaaatcatcattctcagtaaactatcgcaaggacaaaaaaccaaacactgcatgttctcactcataggtgggaattgaacaatgagaacacatggacacaggaaggggaacatcacactctggggactgttgtggggtgggaggtggggggagggatagcattaggagatatacctaatgctaaatgacgagttaatgggtgcagcacaccagcatggcacgtgtatacatatgtaactaacctgcacattgtgcacatgtaccctaaaacttaaagtataataaaaaaaaaagtttccttttttatatactttatatttatgtactcaagaaaggctgttgaattttattcaattttttcagcatccattatcatcatctaattttccttcttcaatttgatacaccctacttgatattctttaatttatgcagaattattttcagttaaaggctattaattagtgcgtcctttttatttcaaaaattcttatttagtatgcttccagtcactctatcattatccattgggatttggtaatatatatagaaagatttattgtttataactgtttcttcttcataatctttcaaggcctcaattctgattcatttgctgtttggttatagttagttcaagtattttcctcaaatgaagcaaatgagagttatattctgtcaatctctgaatatctaaacatatctttactctgaaaggtggatgaaatactggttgagtcactcattcatttattatttaataagaattactctacgtaatacagatggatacaaaatgacaaaaaactccctgcctttaaagaatacatatattccagcagacaaagacagacaataagcacataaatgaatcaattaattaaatataaaatggttagaagagctaagaaaaaataaggcaaggaaaggaaaatcttctataatatatacataacagtcaagaccgacctctgattttgacaataatggccattcacccatatatagtgctttctaagtgccaggtactgtggtaagtactggacacacatcaaatcattcaatcacaaacaacccttcgagatagttactatgaaaataaaaatgctataactggtgaaactgaggcacaaacaagttgatttaccaaaggtaaaacagcaaataagtagtagaaccaagctgtccagctcttaaccattatgttttcttgcttctctgataatatgccatttcagtagataatgaaaggaaatgagggcaggagagagacccatagggttatatggaagaatagaattcctagcgaaaagaaaagccaccacaaatcttataaacgccatgaaaaatagatataaatacattaaaatatttgtattataatcttagactcaaccttaaaatatgtggctgaaacaattcctcacatgtatagagaaatgtttaggttatattaccttatcactcaagaattgatcagataaagtactcaggattaaaatgcaaaaaagcaaaaaaaagagtattaagagtatcttaatgtgatttcttaaaatttatttctaaaactaaatgctagaattatataaagtgaagaaacacagacacattctcaataaaaatggaaataaaactagaataacagtctacctaccacccctatgtaccaatactgtaatggatcctttacacacaatttctcatttagtccttacaataagcctgtgattccaataaatctattgtgtccatttaatatataaagaaagtaaaatttaggagaatcagtatattgccctaaagtcacataataggaaaagtgggaagaaataaaatacaaatttgtaaaacatcactgtataccttaaacatataaaatctttatatgtcagtatatctcaataaagctgctgaacatatgaatttgtatgatggcatgagcacagactattagatccaagaaaatcaattgtctatggtaaataagttcagcaaaattataggatatatggtaaatccaaaaaagtaattccctattgaagctggactgtgcggtagagaaaaaaaatgagctttggagcaaaatatgcttgattcaggtcaggcagagaaggctatggagttaactgaagagggagtgctgctgagattagtacctgcagggtcatgcttgcaataaccctagtggatgcaccagtgacaaagttgctcagcaacaacagcaaactaaagcaaacatatctgttcctagttctgagagatcaaaaggcaaccaacccaaactatgtaagaagttaagaaccttactccctttcagccctcattctcttctcttctcaatactactacttttacctcctgttaactacctcatttttctttctttccttgctctttgactctttcttgctgacgcttcccttctaggtctcttttttcctttcaatcaccccctattgaactgctttcttccctctcaccaccagtttggtttcaagaggattcttaaataacttcattacctccaaatacattttgatctcaaaggtcatagctcttcttccaatattagtaatttaagaattactaatgagacaaatccacaggttaacatgaaacaattccacatgtcacagagttaaaaaatgggtcaaacacactgacctgtttatgttaaaatattatatggctttagaaaaaaattatgccctaaatacaacatgcgctgcattaacaactgcattaacaacattttagtcctttagatatgcaaatacttattgtgttacaattgcctacagtattcagtacagtaacatgctgtaaaggtttgtaatctaggagcaataggctataccatataccctaggtgtacagacagctatattatctaggtttgtataagttcactctatgatattcttcacagatttctcagaatgtatttccatcattaagcaatgcatgactgtattaaaaattctttcatacaatttttcattatttttgcaaaattcaaggagtaatatatcacttatttaacaaatgttaacaggatatttcagaagattggtgtcaaaaagaaactcagttattgctttaatgtctctcagcaccaaatttcttttccatttggacttaataacaccttacatatacaaatgattcacaaaagacaagtcctctacagtttactatcatgagactcagaaaccagtatcacacaatgcttttaattcttatcatattactaaaattttatcagaaacagatgtcagcaatacaattttgatggaattacttaactttttttttttttactttcataacaaattaagcattgctcagttgaaaagttataatgtcacaagccttgaggcagcattaggtgctataatttgaaccgatgcagtgtagagtttgcatgctagtagaaaagaatttattagctacattgttgataattatttaactagcaaactccaagttttcttaaaaacacttccaatcaattaaatatctaagaaaactaataaaataactcaaagttttctagatgtataattaacatagcaatacataagttagcaatatagctgcaaaacaggtggaaaatataaccattaaaatgacttccatcctttcggtaggaagtagcttaaaaaaacaaataaaaataaaaacaaaaacaaaaaataaaatgacttccaaagaacaaaccaggcaaatggtttatgtccctaaataagctgaagcctagagataaagaaatttagtgggtaaaaaggaaagataatctatactaaaaacaaaaccaaaaaatgaacgaagacgatgaatggataaacaaaacgtggtataaacatataattgaatattatttagccttaaaaaggaagaaaatcacatgctaaatacagatgaagcttaaggacattatgctaagtgaaataagcccattgcaaaaagaaaaatactctatgattacacttacaggaagtatctaaagtagttaaattatcatagagacagaaagtagaatggtagttaccaagggctggagggaggaagcaatggggagtggttacttaatgggtaagagttgcagttgtgctagatgaaaaaatcctgcagatctgctgtacaacaatctgaatacatttaacgctactgaactgtgcactgaaaaacagttaagatggtaaatttttttaaccacaattaaaaataagagctttttaaaagaatgtaaagtaaaaatggaagatctgtgcacaatttttcttacgggcaaagaaatggtacatcttacaggtaaaacatgtatgttatgtgttacaactttagggaagccaaaggttttaatatctgatgccccatgaatgtgatatagcagctctctccatatcaattctgacaaacactatcaactttatttcttaaaactgtcccttagccatattcattcacccctctcccaccaatgttgtaggattccaagccaagactttctgctttgaagccctttaccaatgcaatcagtacccaacatacaactttccatccagtatttgtcagtcaagatatcacattaggttttcccttccctcttctcttcactttcccatcatcactgtagaagcctctgctacctgggacttcctctccctcctcaaaaatgaagaagaaattaagacattcccagataaacaaaaactgagagaattcactgctagcagacctgccctgcaaaaaacaaaaaggaagttcttcaggtagaaatgaaaggacactagatactaacttaaatccacacaatgaaatcaagagtacagcaaaggtaactacagaggtaaatgtaaaagacagtataaatgtatttttttcttttctttgtaactctttagagcactcctaccataagtataaattacaatttttaaaatgtcacgctacaattcaataggtaaatactgaacctgttttaagaagtacgttttatatttcacttctagaatagagataactaaaggaaatacagcctctttgaaaataaggaaatgcttcaaaacaaatctgtggtagatgaactatccctcacatgtcataggcatatagtactcttataacttgattatttagctcaatgaagttttaaaatactaaccacatcttattttacctcttttatatctctgggacctgtccctttttctctatcaccgcagctaataccttaatccagggtatcatcatttctcccctggattattggcagcctcctaatgggtattcctaatattagtcctgctccactttaatctgtttcctatactgatgccattagtgacataacaacaacaacaaaaatcagatcccaccattctgctcaaaattttcaagtggcctcccataatcttcggggaggaaaaatttaaattcccaaataatatacaggtcaggacatgaccactacctctgtctccagtattagaatcaccacatacataaataatctacacccacattctctgctacagcccttaagagttatttaggatcccagaataccacacatctacttttatacatgcttaccttctctgattagaaaaaccttactttgtctacccccatctctacttctttagtcttcaggactcagtgcctatacctaccacccaccctaactcccaataatgctgagttatatcatctcatagattctagtcacaattaccacagtacttaccaaaatgtactataaacacctgcttgctatgtatttatcccacagactgtaagcttcttaagcataaagattgtttccttactcctattttttgtccctagtatacgcaaaaaatgtctgccatggagtaagtgtttaatcaatgtttgaaaaaaatgaatgaaaggatgaagcaggttgtacattgagagacccatggagaagctgttcaatttttactatctataacaaagacaaacatcaaaattaataatctgataaaactgaaataccaaaattaatctttactttgtaatcagtaaaaataagtaaatcgatatactaatgtaattcttaatttttgtagttcattcttcaaaatattttattcaagcaagtgggatccagcaaaaaaatggagaccctccccaaaacttttacaaccagaaaatgagcttctttcaaattctgatgtggaattcccaagtaatcttgcagcaaattaaacaatatgatctatgatccatatgtaggccttgactattaaacttattttgtcttattaacagtattggagggatttttttaacaccatggattaaaaagtgaaaatgagttttttaaaagtaaagcttaaataacactctatctactgttttgcaaatgtgttatgaaggctttgaaaccacaaaatttccaacagacctaaaaatgtataatgtgctatatgtcaagctgtatttctttttttttttttaaactttaagttttagggtacatgtgcacaacgtgcaggtttgttacatatgtatacatgtgccacattgttgtgctgcacccattaactcgtcatttaacattaggtatatctcctaatgctatccctcacccctcccccaaccccacaacaggccccggtgtgtgatgttccccttcctgttaattcaagatggattaaagacttaaatgttagacctaaaaccataaaaaccctagaagaaaacctaggcaataccattcaggacataggcatgggcaaggacttcacgtctaaaacaccaaaagcaatggcaacaaaagccaaaattgataaatgggatctaattaaattaaagagcttctgcacagcaaaagaaactaccaccagagtgaagaggcaacctacagaacgggaaaaatttttgcaatctactcatctgacaaagggctaatatccagaatctacaatgaactcaaattcacaagaaaaaaacaaccccaacaaaaagtgggtgaaggatatgaacagacacttctcaaaagaagacatctatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctagagaggatgtggagaaataggaacacttttacagtgttggtgggactgaaaactaattcaaccactgtggaagtcagtgtggtgattcctcagggatctagaactagaaataccatttgacccagccatcccattgctgggtatatacccaaaagattataaatcatgctgctataaagacacatgcacacgtatgtttactgcagcactattcacaatagcaaagacttggaaccaacccaaatgtctaaaaatgatagagtggattaagaaaatgtggcacatatacaccatggaatactatgcagccataaaaaatgatgagttcatgtcctttgtagggacatggatgaagctggaaaccatcattctcagcaaactattgcaagaagaaaaaagcaaccaccacattttctcactcataggtgggaactgaacaatgagaacacaagttgtatttctaaggtaggagaaaggttacatagtctttaatactttctcctttacaacaaacttttccttatatataaaatacagcaaaaatagtaccttttgttcaaaggattgttgagaagactagaattcacgtaccacacttttgcctcatgcacaataaaaactttttacatgtttaggtgttattattactataattattatgacatatccaagtcccaaaaagttatcagcagtatactctgcaaaggaaaagaaaacacaccactcagataagtctatattcattaatgaatatatctacataccaaacctgcccccatttctttctactgattcccatctaattgaagaaagattttagtagtattctgctgtggattgactcttaaatcacttcactaataaagtcctatgaaaatttaaccaccaccaaaaaaaaggggatcagcacttaatcgcaatcctggattgcaatatgagtgatcagatgctaccccggtctgggtcttcatttcttcatctgtccaatggcaatcacagttcctatcggatctcatagggttaactatctgtgagaatttaaagattataatttatgtagaattgtttgctaagcttgaaaatacttcataaatacagactaataatactattgctgtacaatgccaaataataaatattctacgttttaagcagattgtctttgcttccttcagaaccaggtcttgactctttagcccaacttcgtttggtttggatatataaaacgacatcttataaggtgttcccttcaagggtactttatattactatgcataagaaatgctttccatattaactgaaaaggagatgaactaataagttcaccgaaagcataaatgactaagaggagagagaatgatctctggctttgagaattctcttagaagtactgcctataatcccagctacttgggaggctgaggcaggagaattgcttgaacccgggaggcggaggttgcagtgagccaagatcacaccattgcactccagcctgggcaacaagagcaaaactccgtctcaattaaaaaaaaaaaaagtatctaggtatagtaagtagtttaactaaaaacagtcttagaaacatggatcccaattcctaccctaaattccactaggacacaacattcttataattgtatgtactgttctttcttgccaaggtactcagcactaagaaggcaaattcccagaaagaatgaaaagtgtaagaatgtatgtgcactaactttaacttcctactgtgtgtcaaacactatctttacctactttctcatttaactctcaaaacaaacttgaaaggtattacatcttttttacagatgattacgttacgtaattcacagagatcgtattagagagaacaaaatgctgaaactaaaggtctgactacaaaggcagttctttctatttcaccacactattgatcctatgaagcagaagtcaaaattttaaaatgtcatcagagggttgtatccccattgaagtagctggttacataaaccaccaaggtttctttttgtttgtttgttttttgagatggggtcttgccctgctgcctaggctggagtgcagtggcacaatcatgactcactgtagcctcagtcttcccaggctcaagcaatcctcccacatcagcctccggagcagctgggactacaggtatgtgcaactgcgcccacctaattttattttttgtagagacaaggtctcactatgttgcccaaactggtctcaaactcctagactcaaggaatcctcctacctcagcctcccaaagtgctgtgattacaggcatgagccacaaccacacccagtacccatcctgattttttttttttttgagaccgagtcttgctctgtcgcccaggctggagtgcagtagcgcgatctcggctcactgcaagctccgcctcctgggttcacgccattctcctgcctcagcctccagagtagctgggactacatgtgcccgccaccacgcccggctaattttttgtatttttagtagagacagggtttcaccatgttagccaggatggtctcgatctcctgacctcgtgatccacctgcctcagcctgccaaagtgctgggattacaggcgtgagccaccgcacctggccccatcctgatttttaaggaaacttcaacacgagttcttccagtcccttttaaatgatggacactgtcaagaagtaaatttcacctaataactggtttatccagaaagaaaactgactcctcattcaaatggcattatattaaaccagaataatctccttaccttgacacaatggtttttgtaaatgtaaaaaaaaaaaaaaatcacacagaggtattctgattcatccaaggacattttctatattagcctagtaacatatagaataaagtaatatacaagaaaacttaggggtagacaggtatatattcagccacatgcttctcaataagaaaaatgatttatctactgtaagaaaaagtaaccttatagtaaaaaacagcagcagaatattacttgtaatagatgttaaatatttagtgtctctgttagttctatatacagttatacctaatcatgttaagtgtagagatttagcctcataaatatttctataacagaatataacctatatttcttaatacacaaggcaaatgtaaataaaacaaagatttgctggtctaaatacccaattctttaaaagtaaaccaaaattttcccatataaattttcctttggagaacacaggaataaatcccatctgatgaaggaaattatcaaaagaatacacattgatctaacatgtctggctcagtttgcctattataaacaattctggtctctggacatgaaaaactaataattttcagccacttgttttattacatctaagtctcaattattcacaactaaaaaagatagaataatgacattttacaatgtcccaaacacatgaatcaatcatacagcaggtggaaaaaatgctagaaaagataacatttgtgtcagctttacctctctctcacaggagtctcaacagtgtaaaccttaattcgtatatcttgactgcccagagccttccagagaaaaggatcatattgtctttttaaaaaatctcaattgtcaataactgaaggaaagcaagcatagctttccaaaacaactgagtccagatattttttccattgttgctgtcaattacttttctaatttctaattataattctaataaaaacttcagcataactaagaaagacaaactaaaactactcaggaattttcatgcaaaacttccaattatgtgtcctaaactcttttactccaacatgagttcacaaactctgacagatgttttataaccctgtttaaatatttagtcagtaaaaggataaaatttttaaaaaacagaatgatttcattcttttcaaaaaccagggtggtctatgggcaattttggtactagcagtgttgccgggggaacaaaatgaaaacaggtgtcatcaaattcaaattaaagatttacttctattttaaaccaccttaaacaatgtttccataaactttctaactgatactactataaatttgacaatattttataacaagaaaaggattataaattgtctgtagaccatcaaattttaactgtaacaaattttgactgattggcaacacttccttttaaaaaacttttttcattaaatatgcagcatcattttaaaaattgaatgtataaaaggcaagtcaaaataagaaaagagagcaagtatagactctgatagtcttttctgaaagattttactttgttttgagcctatgctgttttaaaaataaaaaacgaagtacaaaacaaatgttaaattcacaacatataaggaaaaagtgatacaattagtaacatgacaatcataacttttcctcataaacttaattgaactacaatcttcaatgttaaaaaaatccattaatttttgtgtcttattttggtaatgaaaagagtataaatacttggtttctaccattaaatagcacttatttttactcttaaaagagatgatgaagcaagtgactcaccatataaaagttaatcaatgcttaaaaatacattagagtattagacactttctcagttgtttaatacagtttcagtgacaaaatacacttacttttgttaaaagctttaattaagaaatgaacatataagaaatttttaaataggtaatattgcagattggttatgttcttcttaataaaactgtttaagattctttcagaatggattaaatacttacccagtgaggattctagatacaggtaagatgaggtgtacattcttcagtattattaatttaaacagaattaatttctctttgtattagttttgacaggtgaaaacttcttaaacttttaggggcatttaatcttgcactgaggagagtccttttatcttgactgtgaataatcaaattccattgtcatttcaaatctttcagacagttcaaagttttatttttagcagtgcttcagggaggcacaagttggttcactagtgtggaatcataacttacagtcagctccaccagttggattatttccaatatttattagtttcatcaactagttttcaaaaaagcttaaagtttcagtattaatagataaatgtctttgaaactaatatttctagcttaaagtttccattaaattgtatttataaaaataatacaaaatcttttttcagattactacatgtattttaatagtaaaagaaaaatatacagcattatataatgttgaacaatataaaacttcctttacagttagtttaaaataatctcacttgcatataattataaaattactatactcatctattgcttactttgaaagtgattaatcaaagtcagagaaagccaaccatcaactgaagtgtgttacaaatttccttctcagaggcacatcaaaaaaagatgagtcaattctactttaattaaaaccttgtttaagaatatgaaataagtgttttctgtataattccaattatatttcaattgtgttcagctttcaaactgcctctgctacttgattacacgtgccaaattaatcttgtcttttttttttttttttttttgagatggagtcttgctctcgctctgttgcccaggttggagtgcaatggtgtaatctcagctcactgcaacctccgtctcctggctccaagcaattctcctgcctcagcctcctgagtagctgggattacaggcacgcaccaccacacctggctaatttttgtattcttactagagatgtggtttcatcatattgatcaggctggtctcgaactcctgacatcatgatccacccacctcggcctcccaaagtgctgggattacaggcgtgagccactgcgcccggcccattaatcttatcttttaaatcatatcaacagttctaaaaaaagacttggattttttattgttctagtgggtattgttctagaagcaagactcctctaattgatcataacaccaagcctaccccttagctgacagttcagatgtgtgtttttggttggttcaaatacaggaagacaccctttgtatacatttgactaattagtcaaagaataagaaggcaggggaaagaaatttatctaaaatattttttgactaatacatagcagtcttccaaaaattcaaagtggaatttttagagaaactacatgttctaacatgttctcttagggtgcttcatacagatcgtcaaggaagtatcccaaaaaaaatcaatgaacacccggaatacagggtcttcaacagaatcaagcaacatgttacacaactgagggtaacaaagtatcagtccctacaacacttgtgtcaaacaaatctgtttctcctttcaccttacttacctcctttctcctaccctgttctatgtatggcctagcccttcgaagatacccaaacacaggaaagattaaagatccctttcaaacgatagaagatctctttcacacgatagatgataaaatgaagagatgttcagaaggctgtagctgctagcattcttccaccataagcttctccacctatatctgtagtagataactgtacttttagataacttttcaacccttttgaagggtttcaggttaacaaatatttgaaaattagtactcacaacactgtatataaaaatgaatagaggccaggtgcagtagctcatgcctgtaaatcccagcactttgggaggccaaggcaagtggattgcttgagtccaagagttcgagaccagcctgggcaacatggtgaaaccccatctctacaaaaaatagaaatattagctaggcgtggtggtgtgtgcctatagtaccagctactccagaggctgaggcgagcaggtgcccaggctcgaggggttgcagtgaaccgtgatcgcaccactgctctccagcctgggttacagagtggggcctcatctcaaaaaaagaaaaaaaatgaaagaagtatggactcaggaaagaagtactgacacatgataagcaataatctagatgcaaataaaaatcattagatttaatataacatctttaggctcaaatggaagctcactaaatattaagtcaatcaacactgatagaggcaggaagcagaaaaatcctagtcagacagggtgaaaccccaccttcaagtcaaaaacagcctgaaacccatgacccagagagagaacttctatttctgtttgcctgctctttcccaactggttctttctgaataatgctttttaaccaatcaaatgttgccttttccaatactacctgtggcccatgggcccccccgatcctgtgcccataaaaaccccagatccagccacactgagggagatgacccaacttcgagtgagagaccaccttcctgtcccctctctagactgagagctgcttcatcactcaataaaattctctgtcctcatcacccttcaattgtcagtgagacctcattcttcttggacatgggacaagaactcgggacccactgaatgtgggggctgagtgtgcagttgtggcagctgtgggatccacactggagtgcaagccagatgcggcctggcaggctgagtaaatggggcacctgctcctgcgagcccagcaaaggggccaagaaaaatcctgcatcaacactatttaaatgttaaaggaaaagtcaatataagtaacatgtataacacactaaaaatatattaatgataaggcaaaatgaaattagagaatgtataataaagctctgtgggataagaaccttctcttataacattctgtcaatggctgaacttccagaaacattacctatgaaattaaggacagcctttgtaaatagaagggctaactccttacatggagacttaccacccagaactattgtctgaatccatctgagggggaaaaaacccatttccatggtaaggaacaaagcagagacaaagttcattacagctacatacaaatggaaatgccataaattacataaaagctcatacaacaaagaaactagcaacttggttatttgtatacatagaaagacagcaggaaataaaatattttatattatatgaaaacaaaatgcttaagaactcactgacacagttatttgacaaatatgctgaggtttttgtatataaattttttagtttggggtttttttttgttttttgtttttttgggacagggtctctcgctctgtcacccaggctagagtgcagtggtgtaatcatggctcactgcagcctcgacctcctgagctcaaaagttcttcccacctcagcttccagagtagctgggaccataggcacataccaccacacttggctactttttaaaaaatcttttgtagataacagtgatatggtttggttctgtatccccacccaaatcttaccttgaattgtaataatcctcaggtatcaagggtgggaccaggtggagataactgaatcacaggggcagtttccccctgctgttctcatgatagtaagtgagtcctcatgagatgtgatggttttataaagggcttccccctttgcttgccactcattctctctcctgccaccctgtgaagaggtgccttccaccatgattataagtttcctcaggccttctcagccatgtggaactgtgcatcaattaaacctcttttctttacaaattactcagtctcgggtatttcttcatagcaccatgagaatgaactaacacagacagggtctctcaaacttgcccaggctggtcttgaactcctgggctcaagtgatcccccaacctcagcctcccaaatatgtagacccagcactttggaaggctgagacatggtgggcggtgggtgtggggggttagggggttagggggtgtgattggtgggggtgttgtgccaaggggcttgaggtctcaaagagctacgatcccgccactgcactccagcctgggcaacagagagaaaccttgtatgggaaagaaagaatttttgttttgttttgttttacagctttgggaaagatcttttctatagaatcatatatctgatattacaataaaattatgactcaaaaatttgttttacataaaatctctcatctacatgtcctcaagctaattacttaaacaacatcaccatctcttccacaggcactagcacatttagaaaagaaagaggtttgggttttgtttttttcctgtactcaaagttcagctaagtaaagaaacaattatttcccaaaggtttcaaagcaattgcctcagtaaatcaaaagaatgctttcctattagcaaagccatataatttaagagtaaagggttaagatgatttaattttctcaaagaaaaaagtgaaaagttaggtggctatacagttaatgaccagaattctggaaaactgccaaattcaggcacattctaaccatcaagttattactatttagtggaggtcgggggcagtcactaagaactttttatgcaggtttaaattttacatacagagaagccatataattattgtgaaatacttcaagggattcaagaagaagctatgacagtttgctgtgtttctttaaaaaaaaatgcacatttactgactttgagtggtatttagttccaaaaatatcaaaaatatcagaaagataatgtctatatttaatatttggtattacatattttggttatggcttctaaactttctcatagcccaggcactcagctattcaacctaaatttttccagttgcctcaatgttatataattcccttttcaattttgttcagtcatacttaggatctactttatacaaggatgaataaaacactattttacatctaggtcataagaccaggatataaagtccagtgtctgggttctaatcctggttctaccaattactagttctttattctctctataccttactttgatcatctgtaagctgtagatatagtactaacacccacaaaatagggtttgatgtgagaatcaaataagttagtatacaaaaaatactcagaacacaaccatataaaggaataaaatgcgtgctacaacataaatgaacctcaaaaacattaagctaagtgaaagaagccagacacaaaagtcacatattgcatgattccatttagataaaatatataaatccataaagacagaatgcaaactggtggttgccaggatcggaggggtggggaggggcaggtgggatggtggagaatggggataaaatgcttaacaagtaccgggttgtattttggagtgaaagaaatgttttagaactagataagagttctgaaggccactgaactgttcactttagaatggttaattatatgttatatgaaattcatctcaataatttcaaattttaaaaaaagaaataaaaaacaatttattaacaccatccaaaaaaatacttagaacaatagcagtgatacaaaatgagttcagtaaatgtacactgtaataattatcaatgccacataaactggtaaatatgtagaatactatgctacattccaaagattaaaataaatatacataggtttggagtttatgttttcttttaagtactcattttaacaatttatttctcctaaattcagcatgaaattatgtaattcatctacaaggaactctcgcttcctccaaaagagacactcagagagaaaatacatatgaaaaatggaaactaaaaatttattttgtacatttactgctatatgtcatccaagttatgttattttaacatacagtgcttatgtgttaaactatctgggaaataaagagatgacatgcatgaagaaaatatacacaaaaggacaaccaaagaattattttgtaaatttaaccccacaaattataaatattatattgttacattcagttgtttaaacaatatataaaataccactaaaagactcatacacatatttataaactcaatgaaatgttcaatttgtgatgaatcagaaaaaaatgagaaaacatcttcataatgggatacaaaaatggaatttagaactggatcagcctggggaaagcaaattttaaaaagacaaaatcatagggctagatttgtggatatgagaaatcaatgaattcatttttgaggcaaaaaaaggtcaaagtaaaaaagcattctatatatcaaacttaacacatttatactatagtttaaagaatatgtcaacaaatgaagagatcacagttcccaaataattatagcagccaaaaggtcaagtctaaaaacccttcacttcaaataaaaagctactaggagagactatgaggtactttctactaatatctcagaagaaaactcatgaaatattcaaaagcaagagaataattcgtatcttccgtttctttgcctcacatatttgttttactattagaagaaggctgtttttttgttttctttgtcatgactaatgtttatcttataaatttctattaaatgtgttaccaaaagttcctgtcgggaatggtaactacatttcacatacacatttataaacaacaaaagagaaaactgtcattaattttaatatggaattaaattattagaataaactttcaaacatatgttgaccagtcaaagaattgtggcatgatgcatgtagccttcactgtttcaaaagcacagagtttaggtcaagctccttaaaacagccaaatgttttaacaagtaaagaaaaatatacataaagtgcttcatgaataaaagtagttcaaatgaacaaggcttgtggaaaataaagcactgtacagattttatatcaaacatgccaagaatgttaataacactacactacactatatatgagaaagaactctccaactacaagaattgttatattaaaaatatacatgttatctttttctgttaacatctttaaacaaataagtcagctagcttcctgaaatgatgtaaatgtgattcaacctaaagatgtgattttcttgcacgtcatgagttccataaatctttgaatacaaatattatgcattttatatgccatcttatctgtatgtctataaaaaaaatggctgagctatggaaaaacagtatggtggttcctcaaaaaagtaagcatgaaattatcatatgatccagcaattccacttctgggtatatacctaaaagaattaaaagcagggactcgggctgggcgtggtggctcatgcctgtaatctcagcactttgggaggccgaggtgggtggatcacgaggtcaggagatcgagaccatcctggccaacacggtgaaaccccctctctactaaaaataacaaaaaactagccagacgtggtggcgggcagcctgtagtcccagctactcgggaggctgaggcaggagaatggtgtgaacccgggaggcggagcttgcagtgagccgatattgcaccactgcattccagcttgggtgacagagcgagactctgtctcaaaaaagaaaaaaaaaagcagggactcaaacagaatatttgtgtgtccacattcatagcacgattcacaagagccaaaaggtggaaacaatcgaagtttccatcaatagatgcacagataaacaaaatgatgtgtacgcataaatgaaatactattcagccataaaaaggatatgaaattctgacagttactacaagatgaatgaaccttgaatacattgtgctatatgaaagcagccagacagaaaaggacaaatatttcttgattccacttacatgaggtacccagaatagtcagatttatagaaacagaaaatacaatagttctaacttgaagctagaggagaaagtagtaggaagtaactgttttaacaggcatggagtttcagtttgggatgatgaaaagttctagagatgaatagtggtgatgttgcagagtaatacgaaagtatttaatgccacttaaaaacagttaaatggggcggggcgcggtggctcacgcctgtagtcccagcaccttgggatcacccgaggtcaggagttagagaccatccagcccaatcaacatggtgaaacccagtctctactacatatacaaaaattagccaggagtggtggcacatgactgtaatcccagctacctgggaggctgaggcaggagaatcgcttgaacctgagaggcagaggttgcagtgagctaagatcatgccattgcactccagcctggggaacaagagtgaaactctatctttaaaaaaaaaaaaaaagttaaacggtaaattttgttaagtgtattttgccacaataaaaaagtaaaaaaaaataagttctgtgtatggatggtagtgacggctgtacaacagtgtaaatgtgtatataacatctctgaattgtacacttaaaaatgttaaaatggtgaatttatgcttatttccacaatatttttaaaagctggttaaggtctttcagtaattagcttcactctaaattatttttaaggcagatcagaatatagttgctcagaggcttctaaatactttgtaagcaactgaaccaccactacagctaaccagcacccctaaaccaattattgcctagcaaagtattactgcctttcaacccactggccctgcctaagtctggcaaccatataaaatgcttgatactgcttctgcattaataagcagtgagctcttcaaatgtaacacttgatgtccagggcaggagcaggttatagacatagtatgcttaaatctactttccccatggttgatgactagacttaaatcctcagtcacattccctgctacctgactggggccttgtttcattatctgtcgcccttggccctactccttacatctttaatcctctcctctgggtcctacatctcattctaaaatcagactaagtctcctcatgccattaaaatcttccctggactctcaaaccttcaaatctcaccgcacccccaccccccgcccccaccgccacccaacttactcctcttcttggctaccgaacttcatttctggatcccccaggaattgacttcagcctgctacttgactgaattacactcctgaaagttaaccatgacctccaatctgataacctattattcatactacccaaactaaaggcaaaaaagaagaaagaagaagaaagacaaaggaggaagaggaaggaagaaggaagaaggaaggagaaggagacggagatggagatggagacagagaagaggacaaacatttgtaaaaggtcatcaatcacaacctccttaaaactattttctcccttggctgaaactctcctaattcttctcttactctctggtctcttttatctccttccaccaaatctccaaatatgggtacttgtcattctgccttcaccctttttcttccctctcctaggaatttttcagaacttttcttctcaaaacttcgcaaaacatttgaaaatgttttttacattttatatgaataccatcagcacaagaggttgcagaaggagtcaggtagttggagaacaattctgcctaccccagtaactaagaagctggcaacagaagtatgcttccctactgcacatgtatatatcagtgtccaaggttaagaaaaccacatttgtattttttggcaggtacaatacattttaaatgaaaaaaacatttagaatgttttcttttcaaaatgattgtactgatagaaggaagtatctaacaatctgttcattattaattgcatgttttctgatatggttaattatttaggcttgatgtaatcactcagctggttaagactgcttactgatacaaagttaaagataggatgtacaaatgcaattaaatatcagtttcttaaggttaaaaaaaataataatttcctccaatagagagttcttaacattctatgtggaaataaaatttgtagaaaagaaacagaaaaatgaaatccatagagaattgatatgctacaccttaaattaaaacttatcatcagaatacttaaattcttaaaaagtataatttatgatatttaataaataatttatgagtatgaaaaattaaaaccatggacttttttaaactttaggattaatgactagtaatggcttctttgcataagttgcttcctttcgccttaaacaaagaaaccatacattttaaagttttatcataaaaacagaatgtatatgaaattatttcactttagcaatttttaaagtattttaaggctcaaaaacttaaggatatgggaaagtgatcaagatgtagtgatagaggaaaaaaagaaagttataaaacaatgtaatctcatgattccaattttggttaaaaaccagtatgtactaatgggcacagtagatacacaaagtacacagaagcccatatatcaaaatgttaatggtaaatcttgaggtagtacaagtatttttattttcttccttatactttgttttcttcctttatacctttattcctttctatagcaaacatgcatcacatttacagttgagttttgtggaagaataaactctatatttcattccatttctgccttcctgcttatattttgatagactaggaaaggaccatctttcaaagctgtgcagagtaactctttagcattgtcagtgctctcatatacctaatccatcagcaaatcctgttaatccacttacaaaatataacagaattcaactactcactattttcactgcttcttcaagagaagtcaccgtcatctctcggtttatgcaaaagtctcctaactagtctatgtaattccacccttaccacctttctggctctaatgtcactcctctacttagaaattctgtgacttctcatctcattcagaataaaagtctaagcactgattgtgaccttctaggctctatgatctggaccaggaatcaccatgcacactcccacttcagcaccacagaacttgcagtaagttggctctgcctagatattctacatccagataccctcattttcttcagctttttattccagtatcatcttctcaatgaggccttcactggcaatccaacacaacacatcaaccactccaccctacccttgaaatttcctatcttgtttccctgttttattttttctactctagcacttatgactatctaagacacatgatgtatttatttatttttgatattatctccctccctcagtagaatataaactcaataaagagaaatttttacctttgtttttcctgctgctgcatccctagtacctagaatagtcccaagcacatggtaggtactcaatatatatctactgaataaatggataaatgcattccagtgaatccacaagcttaaacccacagcttctcagttacagtaatagttggctcaatgaatgtcatgaaatgatagcaacacatttattcatattctgagaatcaatgactttctaagtgactttgcatagggcaagagagctgaagaacagctatagtaaacaataatgtagacatattttctcaagcctaaaagggagcatctaggatcttagcttcaaaatttatgaataaaattatgacttgatttggtataacaaaggtaaggtaccctgagatcatattgctgttattgttggtactaaaaagtaagcaaaactgtctaaaatcatattgttactcttctaacttttccattagaatattcaataccagtctgtgaaactggatatataactttccttatgcaaacaaaaaactagctgaatatcatactactatgcacctgagtatctgttatctgaaagatctttggatcttttataaacatcaatcaatgctgtgcagacagagctaagagggaaaggcaattagatactgtgaaaaaatggaggcaatcagaagaaatacagtccatggtggcagtgacagagctaagcaggaggtatggataatctgggtaagtgccatggaaaaataaatatcatgattgaacttgaggcaaatggaaacagttcaaattggcttcatacactactctgtggaacatatgatgtccatatgtccattaccaacaaactgaaacatggaaaataacaaaagccgatgctatgatggctataagaacacacccaatgccagtctctaccacaccgcagcagcataacttactacagctgccaggtaagttggctaagaagtcagaagcaataagaaaaaaaggagaaagaactaactataaactgttctctttccctacagaagacaaagttgggatctatactagaaagtagaatgtagcaacgataaaggctgaaagtaaagcacaattttttctctgtagacagtttctaaaagtataaactactttggaattaaagaaggcaacattttatccaaaactacaaacgatttaagatccagagaactaaataaaataacagaggaataagatggaataacttccaaataaaaaattataaatatgacctttcaagttttgaaatacataatagagtataaaaagaaactgaacaaaagatgtggtgggaatccattatgttttacatcagttttaattagtctaccaaattttccttctatagtttctaaccccacctttcttttttttttttttttttggtgttgttgttgttttgagatggagtctcactctgtcacccagggtggagtgcagtggcatgatctcggctcactgcaacctccgccttctgggttcaagcaactctcctgcctcagcctcccaagtagctgggactacaggcgcgtgccaccacacacggctaatttttgtatttttagtggagacagggtttcaccatgttggtcaggctggtctcgaactcctgaccttgtgatccaaccacctcgacctcccaaagtgctgggattacaggcgtgagccactgcacccggcctctaacctccacctttctatactctctaacccccaaagcgattcatcttcaagatacaataagagttgacataaaagaagtagagcttaacttaggcaagtatcatgaaggaccaatttacacagcaaagccaaaactgtaaaaaaaaataaaaatataaattttttaataatgtttaagtgttaaagcctatctggtggtcctgaccttttcaaccaatcaaaaccaggccagtcagatgaactgtataaaaataatatgtacaactactacatatccataatacttaaaatgaatgtttaagaaaataatctcagcacttattcagaaatatactagtgtcactcaaactatacagtaatgaaattcagcagctaaaaatatataactattttacagtaaatatcaatgtcattcctgtttcaacctgacttcccattctacccctaaactcccaaacttgaaaccaactacaatttcttgagtagctggagtgtggtttaggaaaggaagctatgcttgtttgtatggaatctgccatttcctccctgccaaaacacttgtttaaaaagtcatgtaatatttctattaaattgtaaatgcagtcgacaaggaaatggcctactagcagtgtattacctttgtggcagtgccaacgggcctacagcaaaatagtgcacatgataatttcaacatgcattcccaagtaacaaaattgtgctttacataaataccacagaacctgagcaagatccagaaaaagcaatgaaaatctgcccaagctttcatgcttgcctatatcaattgtatgtcataagtaaagcaaaatagaaaagcatctacatatgttcaagaagcttgtgaagttagatcatataaccctgggaaaactattgcagcttaaatctgtgtatttcttgttaaccactgtaacaactcactaataaaaatgaagaaaaaccatggatatcaaatgaaccaaaatgtactaactacatacaagtccttaaagatcatgatgcaacttattaacaggaacatattttcagtgtaagccacaattgttatgttaaattacttctttctttgatatcattcatttgattacagaatgtaagagattcacgagcattccaattaaaatggtgaccttcagtttataagtcacttaccgaaatgcttacaaagtcaccgctaatcatttatttcttaccttgcattgcatagcacaactacatttaattatgcaaattaaatgatcccagatgtaataaagatggttctattcatgtgaaagttatacttaaaaccaagttaacaaaattaaataattaatctgtaattaatatagtcttctaggacagctgaattctattctacagcaatttaactaaaatgcatatttattttataagtcaggtatgacttgtctttctttttaaaaatatcaatcgacacataatttcaaaatttaaacctgatagagacaccatttcctccaaaaatgtaaatttttaagtgttatacacatgaaattagagtaaatacctgccctcagtatacctccttccaccttcctaccctatgcacacctagctatttatgtctcctaaaataaatgctagcttaaatctctggcacaaatagttactattactggcttagaataaaataaaacttactatgaccaacagagtaagtccacacaattgcttttaagatatatatcttcaataatgcttaatggttgtctgttaaaacagttttcatccccaattagcaaaccaaagctactatatcctgaggccaaaattaagggtgcccactactgatttttctgatctctaataaggaacaggaactaaagtgccaaaaaataaataaataatataaattatatcaatttaaaatttaaatgttaaataaataaattgtgctaagtaaaagtttgaaaggcaagctgtgagggatgacagctctttcaagttggatttgattagcatttaattactttcactttttaatttatttcattgattcttatgctaagttgtaagtacaacacttattattttaagaaagaaaaatctgagcttaccagatttcagtattaacaccacagaagtatctttgagataggaaaggaaataagcacatattcaacaaaaatatttattggatattcttatgttagaatctgctagattcatttagacacacaaagatgaaacatacttgaatttaaaacttagatttagtagggaaatacgacaactatatcaaaataactatgataatacacagtaagtttaaaagtgccataagaaaattatagataaggtgatatgagaattcaaagaaagaaaagattttttaaatcagtgggatgaggaacttctaacaataattagacttatctaaaactaagctttccagaagtagaaagattacgggaggaagacatcataatctacatttggttccaggttgaaatgcagaactgtaatatgctatgataaagaaaatagtaaacaaaacactaccctaaatacacaatgtaacaagatacactcttgagggtcactgatattaagaaccacagttctcagttattttcgatcaaggaatccttgtttcaaggagttattattttcatttgatggaaaactatgaactatcttaccagaaaaatacatatctgcacaaacatcaatatttaagtgcaatttcataagatgtgctgactgaattctctgccccagaaacagctcattctaccctcttgtgaatcatggtttccattactgggctagtatgcagtataggggaaaatgaagaagtaaaaaataactgtttttcatcattagaaaagataaaatgtatcacagtcctaataggctcattattttcatattgcttccagtagaggctgcagaagacatctcagcagccataagcaagaacttaaaagttttcagcaatctcccctggctagcaataaactgtcaataagcaggttcaggcacagaaacagtaattcctttgggtactgtgtaacgtcccaatacctcccatcctactgaatgtcctacaacaaaatcaggtgatgaaaaacaactgctcgatccttccacagctcaaagttccttaagtaacaatagtaaatattaaacgggcatcctctgtaagaacctgaactaatttatagtctcaatatgttacttcaaaagcaacttcataaagctagttcatatttctacagtacttagtattttacatgtattgttcatatacactatcccttttgatcttcaaaaagaactctgtgaagtagatggatgagggtccattataactaattcagagataacaaaattgattcaagcctcacaagtctcaaacatcaggtcacaccattattacgtagcaacaatagaagcattcggactttgttagaatttggatttccaacacctggttcagtaattattgctctatagattcaagttgcaaatcattactgggtcataaaatcaatgtaatggatttggaccacacattttttaacgaaaagatgaaacagaatagaatactgtgatagaacagaagtcagagtgaatcacaaataaggaaaataagtatggtttcatgtatattttgtttcacttatgtgtgtgtgtgtgtctgtacacatgtgcataatggatcacactgtgaaaatatttctaccatggaccacaattttaaaagtctgaaatgtaaatgtcatctttcaatcattaataaatcaatttaactcatctcctttaaattctcccacacaaatacagagaaatattgcatttgtcagtatcccacattaaaatcctaaaaagatgaaatgtagtataattctttctcagtaagtattactctaagcaatacttaatggaaacacgtctccaaaactataattcatatttatataatttgtatgtcagtaggaaaatgataattatttcctcaatattaccaaactaatcatgtgtacagagcacttggcaataccaacagcaaggttagaatacagacgaagagtaggaatgcctctttcctgtgtaagtatcaggggtgaccccagcaggcttaatctagagaagttgagacctgtttattctcttcacttgttcatgtcttaaagaataataactctgacaagacaaaaatatgttgaaactgtcactgtaataaaccttaatccccagtttagggtctaggatgccttataccaccaccacccttcaatgtgtatcaggaccacaaagcagagaactcttaactttcaaatggagtaaaaatccatgtcttggaagcagtactgaaattccctgatgatcccatttctcccactcctctggatccttggatgatgtgaaagtacggttaatagaatcaaggtatcacctaaaataggcaaaaaaatagggaagagaaaggaaaggaaaccaaaggtagagaggggggtgaggggagagtattcacctacacaccctgtcaggaaacaaaaaaatgaaaagacaacagtaggaagaaaagaaaaaaaggaagataagggcaggttcaagggagaaatgcaagtaaagtatgtaatgacaaaataataaaatttttatctacaaccatatgatcttatgtaatttgagataatatatacatataactgaataaacgttttacagtgtatagcttcctattctaatcaacaaaactcttatctaccctttcctattaaataaaacagaaatctaaatgattctaacattaaaatgctagttatcactgaactataaattccaaaagaacagtgaacatgtctgctgtgcttactactacttcctaacagctcaagtggtacctgataagtgtgcaccaagtatctacagaaggaaataaaggaaagggaaagggagtaaaagaatacagaaggcactctagatgacatttaatttctctgacacaaaacaaccaatttgggagagaagagatactgtccaactggtcccaaagccaaatttattgcctttatgttagaatatgcatttcttgcattaacaatattaaatcaaaaataatttaatattaatgattaaatttagtattgacgaaaacatgggactgtcccatcatgagaagatacacatttacatggcagaaaatttcaagagtgtcattctcgttgctaaaagattcattaaaaattatttgtactccaaaaggtcccactagctcccaagcaattactcctaaccagaatgaaatgtatgaaataacagatacagaattcagaatatggatggcaaagaaactcaacaagatccaagagaaagttgaaatccaacacaaaggaaacagaaaaataatctaagatttgaaagacggcacagttattttaaggaagaaccaaacagaacctctggaactgaaaaatttactagaggaatctcaaaatacagttggaagccttaacaacagactaaaccaagcaaaagaaagaatttcagagattgaagatcagttcttcaaatcaacccagtcagataaaaataaaaataatttttaaaaatgaaaaaagccttcaagaaatatgagattatataaaatgaccaaatatgtgacttactggcattcctgagagagaagagaaagtgagcaacttggaaaacatatttgaagatagatataattcagaaaaaattccacaatcttgctagagggatcaacatgcagatacaagaaatccagataactcctacaagatactacacaaaatgactattcccagggtacacagtcatcagaccatccaaggtcacccaaaagaaaaaaccttaaaggcagctagagaaaagtgtcatatgacctgtaaagcagcagtctccaaactttttggcgcaaggaaccggtttcgtggacgacaagttttccatagatagggttggagggggtggtttagggatgaaactgttccacctcagttcatcaggcattagttagagtctcatgaggactacacaacctagatcccttgcacgtgcagttcacaaaagggttcacgctcctaagagaatccaatgtcagtgctgatctgacaggaggcggagcttaggctgtaattcttgatcgcccaccgcccacctccagctgtgtgacccggttcctaacagttcatggaccggtaccagtctgtggcccaggagttgggggacccctgttctaaagggaaacccatcagactaacagtagacttctcagcacaaatcctacaaaccagacaagattaggggccaattttgagcattcttaaaagaaatgccagccaagaatttcatatcttgccaaactaagcttcataaatgaaggaaaaataatgtatttcccagacaagcaattactaagcaaattcatcactgccagaccagccctacaagagatgcttaagggaggtctaaacatggaaacaaaagaatgacatttactaacacaaaagcacacgtaaagcacataacccacagactctataaagcaactatacaatcgagactacaaagcaactagctaacaaccctgtgatgggaacaaaacctcacatatcaatattaaccttgaatataaagggcctaaatggcccacttaaaagacatagagtggcaaactggaaaaaacaaacaaaatccctctttctcttatctgcaaaagaaccatctcacaagtaacaacacccatagactcatagtaaatgaatggagaaagatcagttaaacagaaaacaaagaaaagcagaggtcttatattagataaaatagactttaaacaaacgactgtaaaaaaggacaaaaaagagcattatataatttttaaagggttcagttatacaagaagacttaactatccttaaatatatacacactcaacactggagcacccagatttatgaaaacaattacttttagacctaagaaaagatgttgacagccacacaataacagtgggagacttcaacaacccactgacagcattagactgattatcaaggcagaaaactaacaaagaaattctggacttaaatttaatgcttgaccaactgaacctgatagacatctacagaatactctaccaaacaaccacagaatatacattcttctcatatgtacatagaacatactcaaagactgaccacctgctcagtcataaaggaagtctcaataaattcaaaaaaatcaaaatcataccaagcatcttttcagaccacaatggaataaaaatagaaaccaacaccaagaggaactctcaaaaccacataaatacatgaaaactaaacaacgtgctcctgaatgacttttgggtaaacaatgaaattaaggcataaataaaaaagttctttgaaaaaaatgaaaacagagacacaacataccaaaacctctgggatacggcaaaagcagtgttaagaggaaagtttagaatgctaaatgcctacatcaagaaaatggatctcaaattaacaatctaacctcacacctaaaggaacaagaaaaaactaaacccaaagctaggagaagaaaataaataagtaaagtcagagtagaactaaatgaaattgagaacaaaaaaccatacaaaagatcaatgaaacaaaaaattggttttttgaaaggatgaatgaaactgacagactgctagctagattaaaaaaggaaagagagaagatccaaataggcacaatcagaaataacaaaggtgacatcacaacgaagcccacagaaatacagcagatgttcagaggctactatgaacatttcagtacatacaaagtagaaaatctagaggaaattgattaattcctgaaaacacaaaacctccaagattgaactaggaagaaacagaaatcctgaacagaccaacaagtaacaagattcaatcagaaattacacacctaccaatgaacaaaatcccccaaagagagagattcacagctgaattctaccagtcctaataaaactattacaaaaaatcgaagaggagggcctcctccctaactcattccacaaaaccagtatcatcctgatatcaaaatctggcaaagacataacaaaaaaagaaaattacaggccaatatccctaatgaacataagacccaaaattcctccacaaaatattagcacactgagctaggtggaatggctcacatctataatcccagcacttggggaggctgaggcagaaggatcactggagctcaggagtttgacaccagcctgggacatatattgagatcccatctctccaaaaaaaattttttaattagccaggtacagtggcacatgcttatagtcctagctactcaggaggctgagatgggaagatcacctgagcctgtgaggtcaaggctgcagtgagccatgactgcaccactgcaccccagcctggatgacaaagtaagcctgtctcaagaaaaaaaaatttatatatatgagcaaaccaaatccagcagcacatcaaaaaattaattcaccaccatcaagtgggctttattcctaggatgcaaggatgattcaacatatgcaagtcagtaaatgtgatttaccacataaggagaattaaaaacaaaaaccatataatcatctcaatagacacagaaaaggcttttgacaaaatcctatactccttcattataaaaatccacaacaaacttgacatcaaaggaacataccttaacataataagaggtatctattacaaactcacggccaacatcatactgaatgggcaaaagccagatgcattcccttaagaactggaccaagacaaagatgtccactcttaccattcctatccattatgtcactggaagccctagccagagcaataaggcaagagaaagaagtaaaagacatataaataggaaaaaaagaagtcaaattatctctcttcactgacaatataattgtatactagaaaatcctaaagattctgtcaagactcctaggcctgataaatgatttcagcaaagtctcaggatataaagtcaatgtacaaaaatcagtagcacttctatacgctaataatgttcaagctgagagccaagtcaagaatgcaatgccatttacaattcctaccaaaaaaaaaaaaaaaacaacctaggaatacacctaaccaaggaggtgaaggatctccacaaggagaactacaaaagactactaaaagatagcagagacgacacaaacaaatagaagagcattccacgttcccaggttggaagaatcaatattgttaaaatggtcatactgcccaaagcaatctacagattcaatgctattcctatcaaactaccatcatcatttttcacagaattagaaaaaaactattccaaaatttatatggaaccaaaaaggagcctaaatagccaaggcaattctaagcaaaaagaacaaagccagagacatcaatttacctgacttcaaactatactacatggtactgtaaccaaaacagcaaggtactggtacaaaaatagacacacagaccaatggaacagaatagaggcataaaaaaataatgggatcatgtcctttgcaggaatgtggatgcagctggaggccatagtcctaagcaaactaacacagaaacagaaaaccaaacactgcatgttcttacttataagtgggggctgactactgggttcacacagacataaagatggaaacaacagacgctaggaactctaaaaggaaggaaggagtggagaggacaagggctgaaaaacttcctatcggatactatgttcactatctgggtgacaggatcagcagaagcccaaacctcagtaccatgcaatatacccttgtaacaaacctgcacatgtaccctaaaataaaaatggaaacttaaataatacaaactgtgaaaaaatatttttaaaaaataatttccaaagaatatgaaatgctgatttacaattattaaatatttacacaacttcttcagaacacacctattgcataatgcaaagtacatatatatgatttaataaaaataatcctctacttggtagacaactaagtcatttgcatagaaacagtgaaaagcattctgattgaaagatctctcaatatagtgattacaaagaagacatacaaagggactcagactgtgtattataattggggtggagaaagtgatatggggacaactggaaagacaataaacaggcagtaaaaagttaaaggagtaggacaccttcaccagcatagaaacaacaagcaggtcagtactagagagaggttaaacaaaaagcccaatttaaaaatgggcaaagcagcaccgggcgcagtggctcaaaacctgtaatcccaacactttgggaagccaaggtgggtgaatcaaaaggtcaagagatcgagaccatcctggcaaacatggtgaaaccccgtctctactaaaaatacaaaaattagctgggcgtggtggcgcgcatctgtaatcccagctactcgggaggctgaggcaggagaatcgcttgaacctgggaggtggaggttgcagtgagccgagatcatgccactacactctagcctgggtgacagagcaaaactccgcctcaaaaaaaaaaaaaaaatgggcaaatgaattgaatagacagttcccaaaagatatacataatggataatggacaataagcatatgaaaagatgttcaatatcactagtcatcagagaaatgcagatcaaaatcacaatgagatgccacttcactcccattactatggccattagcaaagaaaaacaacagaaaataacaagtgctagcaggaacgtgaagaaactggaactcttgtacattggtggtaggaatgtaaaatggtacagctgctgtggaaaacagtatggaggttcctcaaaaaataaaacactcttgaattgatgattgtggatccagttcatggtagcattattcacaaaagccaaaaggaggaagaaacccaagtacccatcaacaaatgaatgaataaacaaaatatgctatatacatacaaagaaatattattcaggctttaaaaggaagcaaattctgacacattctatgacttgtataaattattgaaaacattaggctacataaaacacacacacacacaaaagaacaaatattgtttgattctacttatatgaaatatttagaacagtcaaactcatagagacaggaagtagaatactggttgcgaggggttggagcaagaggatatggagaattattgtttaatgggtacagggtttcagtttgagataattaaaaaatttctagaaatagtggtaatgattgcacaataatgtaaatgtactttatggcaatgaattgtatagagtactttaaaatggttaaaatgataaattttatgttatatattactcattaatcctaattataatcttaaattatgtaattatacttatactatataaatgttaatcttaaattatacataattattaatcttaaattttctttctctatttgaaagaagagaacatattatggggagtgtagtgagttgaaaaatggccatcctcagaagatatgtccacatcctaatctctgaaacctctaaatgttacacaatttgggggggaaaaatacaatttatgcagatataattaagttaagaatcttgaaagcagaagatcatcctggatcatctgagtgggccctaaatccaatgacaagtgcccttataagagaaaggcagagagaaatttgaggtagatagacaaaaaagaagacacagggctgggtgcagtggctcacacctgtaatcccagcactttgggaggccaaggcagacagactgcttaagctcaggagttcgagaccagactgggcaacatggtgaaccccatctccacaaaaaaaatataagatttagccagccatggtagcttgtgcctgtagtcccagctacttgcggggctgaggcgggaggattgcttgagcccaggaattcgaggctgcaatgagccatgttcacgccactccagcctgggtgacaaagcaagaccctgtgaaagaagaaagaagatgatgatgatgacacagacactcagaggaaaatgcaatatggagatgtaggcagagattagagtaagacaactacaatctaaggaaaacaggattgcaggcagccaccaagagctggaaaaagtgaaaaatagattatcctgtagagccccttgagggagtacagtcctgccaacactttgatttcagacttctggtttcccaggctaaatgaagatactcctctatgccattcaccactgtgttaaatccttgcaaggaatcttccaacaggtggtgtcagacaaacacaggtgcacatacactaagacatccaaggtatctacaaatacctacacagcagggactgggagatggaaggtgtgttaagtgtgttgggtgtggtattactcaagtctcaccactacagagaatcagttttccagaatttctcaagcaaattttattattaattgagcaggaaaggaggacatggatgcttttctcttttttggtgttgggtttttttaaatattaaaaaacggttaactaagtgttcactcttcacatgtggacataaccacattttttgtctctttttttaaaatcctttctttgtgaaaaaagtagtgccatgggatttccaatgggagagagctactgtgttttactttttgatatgcactataaagaatgatcttctaacccatgtctgtttttacgctgcctatactaaagcatttgttgcatctatttaaatgctatgtttctccaaaaagggaggtggaagccagttggaaaatatggtgggttaaggaaaagactcttcaggaaaggatagcattatttttgaaaacatcattcatcaaaaatgactccttatgtttgaaaatatctgcagggctcctttatttgtaagtaggtagtgtaaggacacagagatagagacctttttttaggctaaaataattctttttttttcatactttaagttttagggtacatgtgcacaatgtgcaggttagttacatatgtatacatgtgccatgcgggtgtgctgcacccattaactcgtcatttagcattaagtatatctcctaatgctatccctccccactccccgcaccccagaacagtccccagagtgtgatgttccccttcctttgtccatatgttctcattgttcaattcccatctatgagtgagaacatgtggtgtttggtttcttgttcttgcgatagtttactgagaatcatgatttccaacttcatccatgtccctacaaagaacatgaactcatcattttttatggctgcatatcattccatggtgtatatgtgccacattttcttaatccagtctatcattgttggacatttgggttggttccaagtctttgctattgtgaatagtgccacaataaacatacgtgtgcatgtgtctttatagtagcatgatttatagtcctttgggtatatacccagtaatgggatggctgggtcaaatggtatttctagtcctagatccctgaagaatcgccacactgacttccacaatggttgaactagtttacagtcccatcaacagtgcaaaagtgttcctatttctccacatcctctccagcacctgttgtttcctgactttttaatgattgccattctaactggtgtgagatggtgtctcattgtggttttggtttgcatttctctgatggccagtgatggtgagcattttttcatgtgttctttggttgcataaatgtcttctctgagaagtgtctgttcatgtccttcgcccactttttgatggggttgtttttttcttgtaaatttgtttgagttcattgtagattctggatattagccctttgtcagatgagtagattgcaaaaatttcctcccattgtgtaggctgcctgttcactctgatggtagtttcttctgctgtgcagaagctctttagtttaattagatcccatttgtcaattttggcttttgttgccattgcttttggtgttttagacatgaagtccttgcccatgcctatgtcctgaatggtaatgcctaggttttcttctaggatttttatggttttaggtctaacgtttaagtctttaatccatcttgaattaatttttgtataagttgtaaggaagggatacagtttcagctttctacatatggctagccagttttcccagcaccatttattaaatagggaatcctttccccattgcttgtttttctcaggtttctcaaagatcagatagttgtagatatgaagcattatttctgagggctctgctctgttccattgatctatatctctgttttggtaccagtaccatgctgttttggtaccagtaccatgctgttttggttactgtagccttgtagtttgaagtcaggtagtgtgatgcctccagctttgttcttttgggttaggattgactcggcaatgcgggctctttttgggttccatatgaactttaaaatagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcatgtcccttgtaagttggattcccaggtattttattctctttgaagcaattgtgaatgggagttcactcatgatttggctgtctgttattggtgtataagaatgcttgtgatttttgcacattgattttgtatcctgagactttgctgaagttgtttatcagctaagggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttatggagagtttttagcatgaagcattgttgaattttgtcaaaggccttttctgcatctattgagataatcatgtggtttttgtctttcgttctgtttacatgctggattacatttattgatttgcatatattgaaccagtcttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgtcaggctttggtatcaggatgacgctggcctcataaaatgagttagggaggattccctctttttctattgattggaatagtttcagaaggaatggtaccaattcctccttgtacctctggtagaattcggctgtgaatccatctggtcctggactctttttggttggtaagctattgactattgccacaatttcagagcctgctattggtctattcagagattcaacttcttcctggtttaatcttgggagggtgtatgtgtcgaggaatttatccatttcttctagattttctagtttatttgcatagaggtgtttgtagtattctctgatggtagtttgtatttctgtgggattggtggtgatttcacctttatcattttttattgtgtctatttgattcttctctcttttcttctttattagtcttgctagcggtctatcaattttgttgatcctttcagaaaaccagctcctggattcattaattttttgaagggttttttgtgtctctatttccttcagttctactctgattttagttacttcttgccttctgctagcttttgaatgtgtttgctcttgcttttctagttcttttaactgtgatgttagggtgtcaattttggatctttcctgctttctcttgtgggcatttaatgctataaatttcactctacacactgctttgaatgtgtcccagagattcttgtatattgtgtctttgctatcattggtttcaaagaacatccttatttctgccttcattttgttatgtacccagtagtcattcaggagcaggttgttcagtttccatgtagttgagtggttttgagtgagtttcttaatcctgagttctagtttgattgcactgtagtttgagagacagtttgttataatttctgttcttttacatttgctgaggagagctttacttcctgttccaaaatgtggtcaattttggaacaggtgtggtgcggtgctgaaaagaatgtatattctgttgatttggggtggagagttctgtagatgtctattaggtctgcttggtgcacagctgagttcaattcctggatatccttgctaactttctgtctggttgatctgtctaatgttgacagtggggtgttaaagtctcccattattattgtgtgggagtctaagtctctatgtaggtcactcaggacttgctttatgaatctgggtgctcctgtattgggtgcatatatatttaagacagttagctcttcttgttgaattgatcccttcaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattttgatgttagctggttattttgctcgttagttgatacagtttcttcctagcctcgatggtctttacaatttggcatgattttgcagtggctggtaccggttgttcctttccatgtttagtgcttccttcaggagctcttttagggcaggcctggtggtgacaaaatcactcagcatttgcttatctgcaaagtattttatttctccttcacttatgaagcttagtttggctggatatgaaattctgggttgaaaattcttttctttaagaatgttgaatattggcccccactgtcttctggcttgtagagtttctgctgagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccgtcactttcaggtacacagtgagatgaagatctggtcttttcacatagtcccatatttcttggaggctttgttcatttctttttgttctttttctctaaacttcccttctcgcttcatttcattcatttcgtcttccatcactgataccctttcttccagttgatcgcatcggctcctgaggcttctgcattcttcacgtagttctcgagccttggctttcagctccatcagctcctttaagcacttctctgtattggttattctagttatacattcttctaaatttttttcaaagttttcaacttctttgcctttggtttgaatttcctcctgtagcttggagtagtttgatcgtctgaagccttcttctctcaactcgtcaaagtcattctccgtccagctttgttccattgctggtgaggagctgcgttcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtgtgttggagtttgctagaggtccactccagactcggtttgcctgggtaccagcagcggtggctgcagaacagcggattttcatgaaccgcgaatgctgctgtctgatcgttcctctggaagttttgtctcagaggagtacccggccgtgtgaggtgtcagtctgcccctacttgggggtgcctcccagttaggctgctccggggtcaggggtcagggacccacttgaggaggcagtctgcccattctcagatctccagctgcgtgctgggagaaccactgctctcttcaaagctgtcagacagggacatttaagtctgcagaggttactgctgtctttttgtttgtctgtgccctgcctccagaggtgaagcctacagaggcaggcaggcctccttgagctgtggtgggctctacccagttggagcttcccggctgctttgtttacctaagcaagcttgggtaatggcgggcgcccctcccccagcctcgctgccgccttgcagtttgatctcagactgctgtcctagcaatcagcgagactccgtgggcgtaggaccctctgatccaagtgcgggatataatctcctggtgagccgttttttaagcccctcggaaaagcgcagtattagggtgggagcgacccgattttccaggtgccgtctgtcacccctttctttgactaggaaagggaactccctgaccctttgcacttcccgagtgaggcaatgcctcgccctgcttcggctcgcgcacggtgcactgcatccactgtcctgcgcccactgtctggcactccctagtgagatgaacccagtacctcagatggaaatgcagaaatcacccgtcttctgcgtcgctcacgctgggagctgtagaccagagctgttcctattcggccatcttggctgcttccccaataaaatcaataattcttaatttactcttaaacagagattgtcatgctttatgtgagttaaatttccagaaagttgacaagtgcctccaattatctccttaaatcacatttgacataaatcttccaaaatacactatttatttacacatctttttttaaagttataaacattcagtattgcattgcatagaagtaaaaattcttggtttgatttctattttctttcctttgcctgattcaagaaatcatcaggtacttctcctgctgtccacagagtgatccatacagttctttccttacccctttccctatgctgaacaacaggtaagcaaacacaaagggtttttacaggttacgcctgtactcccaactactcaggaggctgaggcaggataattgcttgacccagggaggcgaagattgcagtgagcctagatggcgccactgcactccagcctgggtgacacagcgagaatccatcaaggaaaaaaatacaaaaatttgctgggtgtagtggtgtgcacctgtagttccaggtattcgagaggctgaggtgggaggattgcttgagcctgggaggttgagggctgcagtgagctgtgattgtgccactgcactccttcctgcctgggtgacacagtgagaccctgtcacatggatggaaggaagggagggagggagggagggaaaagaaaggaaaggaaaaaagtaaagagaaaagaaaagaaagagggaaggaaggacggaaggaaggaaatgatactatttattcatctcctgatttaaaatatatacatatatatacatacttcctaaggctgagtgcactggcttacgcctataatcccagtactttgggagaccgaggcaggtggatcacttgaggtcaggagttcaagatcagtctggccaacatggtgaaaccccgtcactactaaaaatacaaaaaattagcttggcatggtggtgcgcacttgtaatcccagctacttgggagactgagctgagacaggagaatcgcttgaaaccgggaggcagaggttgcagcaagccaagactgccaccgtactccagcccagacaacagagcgagactttgtctcaaaaaaaaatatatatatatatatatctatacacacacatatatatacacacacacactcacacacacacactctctctctctcacactcacttcctaaaggcctgagaaaaagagaagactgatctcctcaaaagtatgtggttaactgaattcaaaactaaatttttttaactattctatttatctaactgatcaaaattaatttggtggtttcatatttaactttataaaataaactgagttttaatttaaaaaaatttgtttcacttaacattctgattagacttactcccatttgccactactcactaattttaatctcatagctgaatataaatttataagcacttttatccctctcctgtttaaaagctttatatgtttcaatgtgtacatcatcatttccctttactaaacagataatcattactgtctaccacagtgaagattcggtttacatatactacaagtttctttggggggaagaaaaagttgtatggaaactaacaaatttggttaactccttgccatcaaacaaatccagtgtttttaatagttcttcttattagaaaatttctccttgaacatctatattccaaatattccttattctgcccaggaatgataaaagaaataatcaatctctgacaaactgataaactaaagcatataaaacaaatgacctcagacttaacacctttgaaagacccattctcaaataactgcaaatttccaatttaaccactttcattttctaatttagtgccatctttaagttcttcgtatccctcagactatgacaccctaaatatatgtcctacaaaaaccttaatcagtgaaaaacagtattaatttgtggccacttaaggagaagcaactccattctaaattatccaagctcaaggcatctctttttgcccctaatttttgctggcctaagcaatactactttacaaacaggcctggtacctaaacacggtaaaaggctgagaaaatgactgggaaaccaaatcccagttcactcagtctacaaggcagcaccactgttctggagtgttcctaattatatacagctagtgggcaggcatagtggaaagggctagaactctgtgaggatgaatgcaaggcatttcagaaagactggctagaatcctcactccaattaggcaataccaccagtggctgggcaccccactatagatggaggctggggaaactcacccaccacatcctaactttgtctctaactttgttctagatagccatgtatatgtagtaaattgtatcatttacttatattaaaataactatcaggttttttgcctgttatcagctgtggggtcttcatgtcaatcacatctttgtctcattgtggcaactttgtagattattgattacctcattagcctatatgtctaccaaaacatggctggaaaacaaaactttaaaaattgaaatcttacctaggttaccatatttcctgctactctggaaaacttagagggttcagattttaaatcagtaattataatattgtgattacatggttttaaaatgtcttatttttgttagccgctcctccacttgcactgagttgggatattaacacagaggatatttctttggtgtctaggcaaaaacacagaacaaactgagttcatatctcagttctgccactgacaagttatgtcatcttaaataacataatcttatccatttcatccaatccacccaatggaggataaaatatttatttcacaaaattactacagtacaaaaaaaaatgttggtaaaaaacttcaatatttcactcacttaccatagtgtcatatcctaccagctttctcatatcttaactaccactttatctcctctctaacctcctgagattctgatttaatctgtttagggtagggctccccacatgacggctatgcagcaagcatggagaacactacctattctttgatcaccccatttccttacactctctcttttctttccagactgtgccctgttagtaaccccttgaactgtctctcagcagcatccttaaattccctatagccccatccttctaagacactcattcattaaaacccaaaccctccatatcaaggccataatgcattctactgcacagcagagcacactaccataggaaggcccacaaaccaggattaattacactatactttcccaattaccaattttagctgggccctcaacaatttttctctcttggacagctctttctttcattgccctcactataccccccacaaaactactgtaaaccttgatgaaacagtaaagtttattaattctattaaatttctacacttgaatatgtatttttaatattctacattgacaaaatggaaaatatgcataaagcacttccccacatatcaaagaacaacaataatctgaaaaaaagcagttgtgtgactgagctgcaagctaaataaactacaaggctcttttcaaagaacatcatttttacttgaagaataactaacagaaaactaaggttacacagacttgggtatttgacagacattttctcaaaaaggaaccaagtgaacctgtcatttcaaggaaaacaaaaggcagtacttgttaccagtgataaaactatctgttacatgatctcaacagcttccaatacttgcagttcaatactctactttgtaagacagctcacaaacacaagaaaagttaaataatgatattatttaaataggaaataaactatattatgtttggaaatgcacgaggcaacacttgattaactgtccaaagaactggactgtgaagaaattgcctatatacaaaatatgaggaaaaagagaaatttacttgggcgatagctgtcaagaatggctctacacaggcataaaatccaagttgggacttgaaaaactggtaggatttagatttaaaaaaaaaaaaacagtgagcaaggcatcctaggaagtttgcaatacaggtatatttttttctaaaagaaatattattttcaggtatatttttaataatgtataatgtattcattcaaactctcaggtaatattagaagatccttaaaggaagaggccacatattacaattctctgctatctgagcacaggatcaaatttaacatgttgaactatttggttggaaaaataagatttacacagggaagaagcagaatagtaataatggaagtcctaagttaaatcccagctcttgtacttacctaggttgccttgggtaatttagtaaacctcactgattcaaactcaaatacacctactttgaggatcaccctacaaacatcctaactaaaagaaccacagataactaatgatcagagatgaaataagactttgtgttcctgtttttatgctgaccttgttgtttttcaagttattttcaaacaattgatgcatttttatctttcatttaccaaaaggaatttatatacaccaggaagatgatacatattgtatacaattacattactcaaagaactctaggctgggcacactgctgtaatcccagcactttgggaagctgaggtgggcggatcgcttgagcccagaagttggagaccagcctgggcaacatggcgacaccttgtctctacaaaaaattagttgggcatggtggtgcatacctatagtcccagctactctgcaggctgaggtgggaggatcacctgagcccaggaggtcgaggctcgagtgagccatgatcgcactactacaatccaggctgggtgacagagtgagaccttatctcaaaagaaaaaaaaaaaaaactctctttaaaatgtttcaatacagcagacagatttttaaatattttctgtataatacactgttacctatattatcgaaatttaacccacaatggcattataatatcagatgtaattccaatttattcttcttcagatattctaaaatatctgaatttttatgcattcttcctctttctatctatttacttcacattcctccagccaccatgatattatcttctcttttctacaaatacacacatacatacactcctcccctcattcctacatccttattgagataactacagccactagagggcaataagtatacaaagatcagtgtacctatttatgatgatgaacttatctatatgattcacatagtaataaacctaaaaagtatatcatcacaaaccctgaaacacaggcaattagacttgaatatgcaaaatatatatttcaaactcaaaaattatcctgcagagttcacagaagcatataatgatgttcaaaaaaggaattccattttctcagcatgcattcattaaaaaaaattagccgaattcctttatatgtgcatagtaatattagaaattaggattgcttaataccatcctcagaccaaagaagagaaaaggcagaaaaaaaaaaacacacagtaaggtataaatcacagagtgggtaaaaaagtgagaaatgattacttccaactctttcactaccacaatcaagaaaacaataaactgaagagcaaagaggatttaccaaccctttcttctattgaaaagcaagcaaaaattttacaagtatatttttgggggaggagaacagtgatggtagagatatacaaagccttcagttcttttctcacaattaagaatgcagaaggaagagaagttaacagttactaatctttaagaggtaattttaccatttttaaaaagaatacatttaaatgaacttatttagtttatatttacttacattgacattacaaaacggcaacacttatataaggctaacattttcagcaaaccataattttcttaccctcattggatgtatatcagcataaggaggttttccttcagccatttctatagaagtaatgccaagggaccagatgtcggccacacagttatagcctatttcttgaatcacctcaggagccatccaaaatggagttcctattacagtattgcgttttgccattgtatcctgcaataatgttacatagccataaatgctactacaaaagcacaaaggaaatctgtatgccaaacatacttttaaaaaatgttaaaacctccaatgccacagattatatcagaaattgactattttgctaaaatttcaactagttatgacatacttaggaattccgaattctgaaaataaccaagagtccacaggtaacttatccacactaccatcattaaacacagtcattaaagatagtgctacaatgataaaagctacagaaatgagctacgtagcttcccttttagaacatttaagcattttgattataagatatattttcacattcaatcaccctaaattataaattaaataatactcaaatttggctcaattatggttccttctccacaaaaattaaaaaactacacatttctttccattccccctcaaaaagtaattgaagtttagttataatcaaatctgaacaaattagccaagtgtttagaaaaccattaaagttaacttactgttaactgaccagccactccaaaatctgccaattttgcatgtccttctgtattgaggagaatatttccagcttttatatctctgtgtatttttctcataaagtgcaaatattctagtcctttcaatgtagatttaagaatggttgcaatttcatcttctattaactggaaagaaatatttttaaaaccataattaaaatgccacgttagataaaatcttacgaaagagcactagtaacaagtatgtctttccgtgtgtgtgtgtgtgtttttttttaagagaccccactctgttgcccaggctacagtgcagtggtgtgatgatagctcactgcagcctaaaattcctgggctcaaggcatgctcccacctcagcttcccgagtagctagaactacaggcacatgccaacccaataggctaacttatttttatttttgtagagatggggatctcgctatgttgcccgggctggtcttgaactctttgcttcaaacaattctccttcctcagcttcccaaagtgttgggattataggtgtgagccaccatgcctagccacaagtacttctttctaatgaccgctaaacctccaggaaaatgctaaaggggtaaataatcgagaacctcttcttcccacaataagctttcttattacacattttactaatgaaaggatgatcaaatttctctctttaagattatcagtatcagcagggcgtggtggctcacacctgtaatcccagcactttgggaggctgaggcgagcagatcacttgaggtcaggagttcaaaaccagcctggcccacatggtgaaacctcgtctctactaaaaatacaaaaattagccaggcgtgatggcgtgcacttgtaatcccagctactcaggaggctgaggcaggagagtcacttgaacctgggaggcagaggttgcagtgagctgagatcacatcactgcatgccagcctgggcgacacagcgagactccatctcaaaaaaaaaaaaaaattatcagtatcattcctaaagcaaacaacatatctcaagaatcagcctgatataaggaatcataatagtgatttcccacatcttctaatactgggagggcactatcacagctaatatctgttctgaaaaagtaaattcagatacttcccctgagatatttcagattcttgatgaaaatgaaaccaacagctttacataaaggaaagtaaatgagggagggaggcttgcaatgaatcttctgcgagaagctcctacaccaatgccactcctaacccttccaagttctggacttctgacctaatattgagaactcagaagaaaaaacgtcagagaaagattaggaaaatggaaacacaagcaaagactatcagaggagggaaaaaggggagagtagagaaggccgaggaagagacggatgggaaagaaagaaaatcttcttaacagttgtagcagtagagccactgctatctgtaccaggcaatgtgctaagagttatgcatgcattctctcatttattcttaaaacaaccttgtaaggtagtgtgatattatgaaatcacaggaaatatttggtctttgtaggttcttggcacaaaatctcctaagaccctgtgaattgactgagtgagtgagaagttgaatcaagatattttatctttgttttctcaccctctcacaagagtgagaggggctgtcttttgtcattcataataagctcctttcaaccataccagaatttatactgatcaggtgactcttggtgggagcctagatagcttcaggatgggagctggttgccgaaaaaaccaaccaagtgattagatgtttggaaatttctgcctgacccctgacttacgggagggctgcaaggagagagggggtagagatttagttaagcacaaatgtccaaagacttaatcaatcatgcctatgtaacagaatcaaccataaaaattctaaatgattagggactgctctcaagcttatattctatctataagcaacgggataatttgatagaaaataggataacacaggaaaatgtctgtgaaaattgctatgaggacaacaatagagagctactgatagagaacgactgagaagctactttagattgacattcaagaaggcccaaaagacattttactgaagtctaaatgatataatggggccaaccatgtgaatggctatctgggaacatacactccacaaaaaggaaaaaaaaagattaaaatatcttgattcaacttctcaaattttctaaaacactgaagaaaagagaacacttccacactcattttaagaggcattattctgatatcaaagccagacaaagttaccacaaaacaactaagaccaatatcccttatgaacattgatacaaaaatcctcaacaaaatatagcacactcacttcaacaggattgtaacaggttatacactatgaccaactggaatgtattcctggaatgcaaggttgattcaacatacaaaatcgaacaatgcaatacaccaccttaacagaatggagaagaaaccacatgatcatttcaaatgaaaacagaaaaagcatttgattaaatttaacttcttttcataaaacacacaactaatatgaatagaaggaaactatctcaccatagtaaaagccatatacaaaaaacccaaagtaaatgtcatactcaaagcagtaagactgaaagcttttccacaaagatcaggaacaatgaaaggatgctattaggttggtgcaaaagtaatcgcagtttttgccattttttttttaaagtaatggcaaaaaccgaaattacttttgcaccagcctaatacttctgttacatatagtactggaggttctagacagagcaattagggaagaaaaacaaataaaggcatccaaactggaaaaaaagaagtaaaattatctctgttcacagatgatatgatcatatatgtagaaaattctaaagattccacaaaaaaaacctattagaactaataaatagggatggagacaagacggctgaataggaacagctccagtctaaagctcccagcgtgagcattgcagaagacacatgatttctgcatttccaactgaggtaccagattcatctcactggggagtatcggaaagtgggtgcaagacagtgggtacagtgcactgagcatgagctgaagcagggcggggcatcacctcacctgggaagtgcaaggggtcagggaattccctttcctagtcaaagaaaggggtgacagatggcacctggaaaatcaggtcactcccaccctaatactgtgcttttccaatggtcttagcaaacggcacaccaggagattatatcccgcgcctggcttggagggtcctacacccatggagcctcgctcactgctagcacaacagtgtgagatcaaactgcaatgcggcagcgaggctgggggaggggcgcctgccattgcccaggcttgagtaggtaaacaaagcagccaggaagctcaaactgggtgcagcccaccacagctcaaggaggctggcctacctctgtagactccacctctgggggcagggcatagccaaacaaggcagcagaaacgtctgcagacttaaatgtccctgtctgacatctttgaagagagtagtggttctcccagcacacagctggagatctgagaacagacagactgcctcctcaagtgggtcactgacccccaagtagcctaactgggaggcagccccaagtaggggcagactgacacctcacacagcccggtactcctctgagacaaaacttccagaggaacgatcaggcagcaacatttgctgttcaccaatatccactgttctgcagcctccattgctcatacccaggcaaacagagtctggagtggacctccagcaaactccaacagacctgcagctgagggtcctgacagaaggaaaactaacaaacagaaaggacatccacaccaaaaccccatctgtacatcaccatcatcaaagaccaaaggtagataaaaccacaaagatgcagaaaaaacagagcagaaaaactggaaactctaaaaataagagtgcctctcctcctccaaaggaacacagctcctcaccagcaatggaacaaagctagacagagagtgactttgacaagctgagagaagaaggcttctgatgatcgaactactccgagctaaaggagaagtacgaacccaggcaaagaagttaaaaaccttgaaaaaaaaattagacaaatggctaactagaataaccaatgcagagaagtccttaaaggacctgatggagctgaaaaccaaggcacgagaactacgtgacaaatgcacaagcctcagtagccgattcaatcaactggaagaaagggtatcagtgatggaagatcaaatgaatgaaatgaagtgagaagagaagtttagagaaaaaagaataaaaagaaatgaacaaagcctccaagaaatatgggactaggtgaaaagaccaaatctatgtctgattggtgtacctgaaagtgatggggagaatgaaaccaagttggaaaacactccgcaggatatcatccaggagaacttcctcaacctaccaaggcaggctaccattgaaattcaggaaatacagagaacgccacaaagatactcctcaagaagagcaactccaagacacataattgtcagattcaccaaagttgaaatgaaggaaaaaatgttaacagtagccagagagaaaggtcgggttacccacaaagggaagcccatcagactgacagctgatctctcggcagaaactctacaagccagaagacaggggggccaatagtcaagattcttaaagaaaagaattttcaacccagaatttcatatccagccaaactaagcttcataagtgaaggagaaataaaatactttacagacaagcaaaggctgagagattttgtcaccaccaggcctgccctaaaagagctcttgaaggaagcaataaacatggaaaggaacaaccagtaccagccactgcaaaaacatgccaaattgtaagaccatgaatgctaggaagaaactgtatcaactaacgagcaaaataaccagctaacatcataatgacaggatcaaattcacacataacaatattaaccttaaacgtaaatggactaaatgctccaattaaaagacacagactggcaaaattggatacagagtcaagacccatcagtgtgctgtattcaggaaacccatctcacgagcagagacacacataggctcaaaataaaaggatggaggaagatctaccaagcaaatggaaaacaaaaaaaggcaggggttgcaatcctagtctctgataaaacagacgttaaaccaacaaagatcaaaagagacaaagaaggccattacataatggtaaagggatcaattcaacaagaagagctaactatcctaaatatatatgcacccaatacaggagcacccagattcataaagcaagtcctgactgacctacaaagagacttagactcccacacaataataatgggagactttaacaccccactgtcaacattagacagatcaacaagacagaaagttaacaaggatatccaggaattgaactcagctgtgcaccaagcggacctaatagacatctacagaactctccaccccaaatcaacagaatatacattcttttcagcaccacaccacacctattacaaaattgaccacatagttggaagtaaagcactcctcagcaaatgtaaaagaacagaaattataacaaactgtctctcagactacagtgcaatcaaactagaactcaggattaagaaactcactcaaaaccgctcaactacatggaaactgaacaacctgctcctaaatgactactgggtacataacgaaatgaaggcagaaataaagatgttctttgaaaccaacaagaacaaagacacaacataccagaatctccgggacacattcaaagcagtgtgtagagggaaatttatagcactaaatacccaaaagagaaagcaggaaagatctaaaattgacaccctaacatcacaattaaaagaactagaaaagcaagagcaaacacattcaaaagctagcagaaggcaagaaataactaagatcagagcagaactgaaggagatagagacacaaaaaacccttcaaaaaattaatgaatctaggaactggttttttgaaaagagcaacaaaatagaccgctagcaagactaatagaaaagagagaagaatcaaatagaagcaataaaaaaatgataaaggtgatatcaccaccgatcccatagaaatacagactaccatcagagaatactataaacacctctacgcaaataaactagaaaatctagaagaaatggataaattccttgacacatacaccctcccaagactaaaccaggaagaagttgaatctctgaatagaacaataacaggctctgaaattgaggcaataattaatagcttaccaaccaaaaaaactccaggaccaaaaggattcacagctgaattctaccagaggtacaaggaggagctggtatcattccttctgaaactattccaatcaatagaaaaagagggaatcctccctaactcattttatgaggccagcatcatcctgataccaaagcctggcagagacacaacaaaaaaaaaagagaattttagaccaatatccctgatgaacatcgatgcaaaaatcctcaataaaatactgacaaaccgaatccagcagcacatcaaaaagcttatccaccatgatcaagttggattcatccctgggatgcaaggctggttcaacatacgcaaatgaataaacataatccagcatataaacagaaccaaagacaaaaaccacatgattatctcaatagatgcagaaaaggcctttgacaaaattcaacaacctacatgctacaaactctcaataaattaggtattgatgggatgtatctcaaaataataggagctatctatgacaaacccacagccagtatcatactgaatgggcaaaaactggaagcattccctttgaaaactggcacaagacagggatgccctctctcaccgctcctattcaacatagtgttgaaagttctggtcagggcaattaggcaggagaaggaaattaagggtattcaattaggaaaagaggaagtcaaattgcccctgtctgcagatgacatgattggatatctagaaaaccccatattgtctcagcccaaaatctccttaagccaacaggcaacttcagcaaagtctcaggatacaaagtcaatgtgcaaaaatcataagcatttttatacaccaataacagacaaacagagagacaaatcatgagtgaactaccattcacaattgcttcaaagagaataaaatgcctaggaatccaacttacaagggacatgaaggacctctttaaggagaactataaaccactgctcaatgaaataaaagaggatacaaacaaatgcaagaacattccatgctcatgggtaggaagaatcaatatcgtgaaaatggccatactgtccaaggtaatttatagattcaatgccatccccatcaagctaccaatgactttcttcacagaattggaaaaaactattttaaagttcatatggaacccaaaaagagcccgcactgccaagtcaatcctaagccaaaggaacaaagctggaggcatcacactacctgacttcaaatacactacaaggctatagtaaccaaaacagcatggtactggtaccaaaacagagaaacagaccaatggaacagaacagagccctcagaaataatgccgcatatctacaactacctgatctttgacaaacctgacaaaaacaacaaatggggaaaggattccctatttaataaatggtgctgggaaaactggccagccatatgaagaaagctgaaactggatcccttccttacaccttatacaaaaattaattcaagatggattaaagacttacatgttagacctaaaaccagaaaaaccctagaagaaaacctaggcaataccattcaggacataggcatgggtaaggacttcatgtctaaaacaccaaaagcaatggcaacgaaagccaaaattgacaaatgggatctaattaaactaaagagcttctgcacagcagaagaaactaccatcagagtgaacaggcaacctacagaatgggagaaaatttttgcaatctactcatctgacaaagggctaatatccagaatctacaatgaactcaaacaaatttacaagaaaaaaaaaacaaccccatcaaaaagtgggcaaaggatatgaacagacacttctcaaaagaagacacttatgcagccaaaagacccatgaaaacatgctcatcatcactgaccatcagagaaatgcaaatcaaaaccacaatgagataccatctcacaccagttagaatggcaatcattaaaaagtcaggaaacaacaagcgctggagaggatgtggagaaataggaacacttttacactgttgatgggactgtaaactagttcaaccattgtggaagtcggtgtggcgattcctcagggatctagaactagaaataccatttgacccagccatcccattactgggtatatacccaaaggattataaaacatactgctataaagacacatgcacacgtatgtttactgtggcactattcacaatagcaaagacttggaaccaacccaaatgtccaacaatgatagactggattaagaaaatgtggcgcatatacaccatggaatactatgcagccataaaaaatgatgagttcatgttctttgtagggacatggatgaagctggaaaccatcattctcagcaaactattgcaaggacaaaaaaaaacaaacaccgcatgttctcactcataggtggaaattgaacaatgagaacacatggacacaggaaggggaacatcacacaccggggcctgttgtggggtgtggggagtggggagcgatagcattaggagatatacttgacattaaatgatgagttaatgggtgcagtacactaacatggcacatgtatacatatgtaactaacctgcatgttgtgcacatgtaccctaaaacttaaagtataataaaaaaagaactaataaataaattcaacaaagtagcagtatacaaaatcaacccaagaaaatcagatatatttttatacattaccaatgagcaatctgaaaaggaaactacaaaaaaaattctatttacaatagaaatagaatttctttattttaaagaataaaatacttaggaattaatttcaccaaggaggtgaaatatctgtacaatgaaaactacaaaacactgctgaaaaaaaattttaggacattaataaataaaaacctatcatatcttcatagataagaaaatttaatgtttttaagatgcccatgctacccaaagcaacctacagattcaatgtaatccctatcaaaatcccaatgatgtttattgcagaaatagaaaaacttatcctaaaatttgtatgaaatctcaaggggccccaaaacaacactgaaaatagaagaacaaagctaaaattctcatagttcctgatttcaaaacttattacaaagctatagtaatcaaaacaatgtgatattggcataaacacagacagatagatgggaggaacagagtagaaaacccagaaataacccttgtatatataatcaaattattttcaacaagagtgtcaagaacattcaataggaaatgaacagtattttcaagaaacagtgctggcacaactggatatccgtgtgctaaagaataagtagaatccttacctagcaccatatacaaaaattaattgaaaatgaatcaaagacctaaacataagacctaaaactataccactcttgggaaaaaataaaacagggcaaaaacctcatgataccagatttggtaatgatttctcagatacgaccaaaaaggcacagagaacacaagaataaaacagacaaattggacttcatgaaaattaaaaaaaaaaacctgtgcatcccaagacaatatcaacagagtaaaaagacaacccacagaatgggagaaaacatttaaaaattacgtatctgataagacattaatatacagaatatatagagaactcctaaaacttaacaataaaaaaatcaaattcaaaaatgggtaaaggactcgtatggacatttctccaaaggtatacaaatggccaagaggcacgtggaaagatcctcaacatcaccaatcataagacaaatataaatcaaaaacataatgagataccacttcacacccattatgacggctattatcaaaagacagaaaagaacaaatgttggcaaagaagtagagaaattggaaactttgtgtatagctaatgggaatgtaaaatggtacagcctctgtggaaaatagtatgaagattcctttaaaagttaaacataaaattaccttttgacccagcaattccacttttgggtaaatactcaaaagaattaaatgcagggtctcaaagaggtgtttttgaacaagtttcacctcacgatgaacgtacacccatgttcatagtagcattattcacaatggctaaaaagtggaagcaacccaaatgtcattcgacagacaaatgaataagtaaaatgtggtagaaacatacaatggaattttattcagccttaaaagggaaggcaattctgcaatatgctacaacatggctgaaccttgagtacattatgctaaatgaagtaagtcggtcacaaaaaaaggcaactaatgtatgatcctgcttatatgaaatactcagagttaccaaaatcacacatctagatagacagtagaacagtggttgccaggggccgaggtagcacacaatggacagttagtgcttaatgggtacagagtttcagtcttacaagatgaaaagagttagggggatggataatggggatgcttacacaactttataaatgtatttaatgccactgaactgcacacttaaaaatggctaagatggcaaattttgtttatgtgtatcttggcacaataaaaataaaactgagggggggaaatgccttgattcaagaaaaagctcaccatatttgagttgaataaagaaggctgaagtttaatgcaccagaagactagctctagatgagatctgagagacaggcaaggaccagatcatgtaaggctttcctggccataggtaagcagtctggattatctgaaaattccggtacttccaggaatttattctctccttcagactagatggtctgacttgacagcgcagagaaagcaagcaccatactctaaagctgcaccatccaacagagtaaccactaaccacacatggctcctaaacatttgaaacgtgggtattctaatttcagttatgctataaatgtaaaatatacaccaaagatcaaggcttagtacaaaaagaatgcaagctattttgttaaaaattcacatactgattacccactaaatatttacatattatgttatgatattaatatattaatgttgaacatataaaatgttaatgtttaatatagtaagtattaaatatggtatttcatattatataatattgttatttattaatatgtgtgatacattatgaaagttaatttcactttttttaatgtggctactcaaaaatttaaaattacatgtggcttgtgtttcttttggacagtactgcactagaaagggtccacaagaatgttttgtgaacactttgttcactgatgtatccacaatgcttggaactatgcctggcgtacagatagcacttgataaataatgaatgaatgggtacagacttgtcgatacaaaaagaaaggagacaccttcatctgatgttcccaatctttctaagttagtggtgtgcagccaaatgtgggggagtgggaggtaggagtgtgtttagggccaccataatggaccactacagacggtgggcaaggtggtggtgctgtcatgtgcacctagcttttctcgtctgtcctcatcctccactctttgtataaagactaaaaagcttggggtgttaataaaggcagcatcagcccataaaattgtgtcttatttagttacttcagtacagacctttttagttacctagacttcaatttttatctcttaacattctatttccaaccaataagtcactaattttctattaactctgatttgttatctctgctcctgtaccctatatatcactgctctactaaagaatgttcagaattaaataaactgactgtacttcagggtcttaggatctgtctgattttaatgctataaagccactggacaaatccacagcaagtctaaaggaggattttccagggatattatactaattcatgaactgtctggctttgctcaatgacttgaaagggtcattccaactctatgattctatgttatcaaagtatcttcatgtagaggcaatcttcactaaataaaattctcactcatttgggcatcaatctatgtgttcatttagtaaatatattcttgactggctctaccacagcgctgatactcttcaaggtgctggatatacacggacagggaaactgataatcccagtcctaatgagcagacaagaatatctgagggcataacctgaatttggctctgaactgttaaaggtggagagtgcagatctgaagtttatacagcctctctttcattatgcttccctttggtaacaaatccctcccactacttcagagagtcaatgtcttcccattcgcttcatatcctccttaatcaaaaaatgatgcaatatccagtcattcatacaagtacatgaatagagcttaatttaaatttattttaacaacccaatttagtattaaggcttataagcagtatctgtactttaagacttttaaattcaattatgaaatgaaaggttcctatccctcaataaaatcactttaaacaacaataaacaggtggagaaatattttctagaacgtaaaggcatactgttgtcttaaatttttatatttatttacagtttataaaaagtattttatgtgatttctctacttaagtaagtaagcagaaacacttattattattccttttaacagacgaggaaacgaattcagagaaattaaatggactaccgaatgtcatacaactactaagtagcaaacctcacatttcttcaacaatcaatattacttccatcccaccactgccagatgtcacaaacataaatatatgaattagtctaatataagaaaaactggggccaggcacggtggctcacgcctgtaatcccagcactttggaaggccgaggcaggtggatcacaaggtcaggagatcgagaccatcctggctaacacagtgaaaccccgtctctaccaaaagtacaaaaaaattagccaggtgtggtggcaggcaccagtagtcccggctgctcgggaggctgaggcaggagaatggcatgaacccgggaggtggagcttgtagtgagcatagatcacaccactgcactccagcctgggtgacagagcgagactccgtctcaaaaaaaaaaaaaaaaaaagaaaaactgggggttttgagacttgttctaagtgtgatattcaaaatatctgacagtcattaaagcaaatgtctaattagaacagttgccaaccacaataccaaccaatcaaaacagctaccagtggtaaacaacagtaagaacagataccagccataaataggcagtaaaaaaaaatcatccctgaatatcagacagagtacctgccccagctcagcattcaaatttaaattattttcaatggtatgccagccaaacaaaacaaatatacctgttaatgaattgtagaagtaagcacactcacctggccaataatttttttgattcctttcaccctgagtacattaatgggtggctttatgagcattttattgaaaacagatgcttaattctgctaaaacaaatatataaatcaaagatttaaacattttaaaaatacttagaagaaaaccaaagtaagtttcaaatcactaagcaggaaagatagtttctaatcaaaaaaagcaaagaaagaattatgagaacttattagttttgtctacacaaaaacttaaaatacataagcttagaatacatacaaggttctacataaccttagaaaactcagaaaaatagccagttatggtggcacaggcctatagtctcagctacccagcagactgaggtgggaggatcacatgagcccaggagttcgttcaagtccaggctgggcaacatagtgaggcctcgtctctaaaaaaaactaaataaatttttaaaaagaaaaaaatagtcatagcaagatattaatatatataattatttatttagaacatagagctcatataaaaccttcagaaaaacaataaaatctcaataaataaacaggcctaagaaatgaatataaaattcacaaaactaaaaaaaagagctaattaacatacatggaaactactaaactgctctaattatcaaagaaaggcaaattaaaacaataaagtaccaaatataaaattaccccaggggttacaatattgctgtgaataacagcacatatataaccagaatgtaaaccagagtgtaaaagtgacataagaattcagaagtattttccaagaagcactaggaaacattgatccactgaaaaattatttattgagcacctactctagatttaatttttttttaaatctctaacctaacctcatggggctccaatctagcaggaaatacagacttagagactcataaatgatcataaaaagctctttcaaagtgaaacataaccaaaaaggagtgcaattaattaggaacagatagaggaagtggcattaaaatcaagctttaaataaaaaaagtagctcactatccagagaaaggaaagactactaatagagtaactcaaataatgaactaaagaatagaaatataacaattataaaatggcactcagaaaccaagtaaggcccagttttcttccttccactacaataagaaaaatgacaaaaagcgatagtccaaatttcagccttgtaccaaaacggagacaaatcttagcaaatttggaagataaatgtttacttggtctcttttaaatatcaatggtgccaaatgaactttggacaagagaaatatctgtatcaaggtttaaggtactctacaagtattgtgtgtcactaatggaaaaggaggagagtggaaggaaataagaacgtatacttagtggacaccatacagcaggttctgatctagatgtttatatcatgctcatttcatgtcatttggacatatgttaacctttttgttattaaaaaataaagaagttgacagtcattttcctagatagatggagttttgttttcaaataatctctagctgttttaacaaatttcattcacatataagcacagccaattaccaaaagtagctagatttttatttggcaacaaagagaactacttctttccattgtgacataaaatttaaagcagtacctttctcatatctgtaagacttttcatgaggctggataggtccatacccaactatttcaaaatggtcagatttatactgaaaacaccaagagggagaaaacacatgagagaggatctgcttcatatagaagaaggtaatgtaagaattcagctccaagatggaaaagcgttagatccattctcaaatcacagctagcacttccttcagtggtatctgttaagaatcccttaaaacaaacaaaaaaaaaattgtggacaccattgattggaatacaaaatattttatcaacagaatacttcatttgtggatttaattaggttatcctcaatacattacagatttcatttcatttaggtcactatacaaatggtgcgatgtcatttttaaatcctctgaatcacattttatagtctgttttgctgtatttttttaaagaagggtggtagagagataataaaccatgaatgaaatactcagcaatcagggataaaagtaagacatttatagctgagctaatacgttaaaagatggaagtctacatctggtttcaattggtatgaattcactggcaaatttaagaagaatttcattgtacgaaaacaaaaagatggttttgataggctttagtcctctggttacttttgtttctttagtcacatgattagtataataatatgatacatttaatatgtcactgtgtatatggttttgataaaaatacacccaccaacttgtctcaagggcacatgcacaaatggttttaaaatacatatactgccttaatgtttttagatcagtaaaaatgaattcaagtgaggttttaagttcacacaaaattaagaattttaattttctaataagtctttcgcaatgttagctaaacaccttttggacataattacttatgcatataaaatgacgcattaattctacatttaatacctattagatagtaaggatacaaaaaattagacatacgccccccttttcaaatgccataaatagataagtacaggtacttcatttaagttttactttcataggcacttgcataaggtcttaaaaattgatcgaaactcaccaatgtaatccttacacagtcttttaaggcctggatcaaactttgcctctttcaagaaatcaccctatattcctcgagtcaggattaatctatccagtgttaacaatggtgataacaataacagcttgcatttattgagttcttactagtcagccactccacaggtttcatttcatttaacacccaaacagaactgtagaaggtaggcactaacaaggatttactgaaagtctgttacatgatcactgtcttcatgacactcagaattttgtgggaagggaataggaacaattaattacaatactaagcgatgcctgcaacaacaggattagcaataggagcactccaggacagcagttcttaaagctgattatgcataagaaccagtactcttaaaatccaaaccatctaatacaacatttaaggccttgaatgatacaattcctgccagcctcgaccatctaccttaccattctaccactcaggaagggcttcacagagatgacttttgagctgactctaaaagagtgaacaaagtttatcaggtgaccaaagagggaaagatacataaggcatgtgcaaaggcactgagcataaaaatacataaagtgcattaccaatgaatagttctttgtgtttgaacatagtgtgtatggtaaaatagtgcaaaatgggaagtcagattagggccaaactgttttacacacccacatatttttaagtggaaagatgacatgatcatatctgaacttttaggaagaaaactctgacagcaggctctcagacaaagactaaaaggaggaaaacagaagtggagaatttaataataaaataattcgtaaaaataacagtagtagtagtaggagtaatagtaacaggtctataaccttgcttagaatcctaagagagacttgtgtggtagaattaatagtgaacaccttaagcaaaattattcagaagacgaagaagagtcagaccatgcagagaagccaaaaggtgccaaaagcaaaatccatctttcctaatttacgtaggtcttaaagactatctagagtcttttcccacaactgaaagtgccttagcactaaagaatcatatattgcttagttagcatcctctcagttctcccaaaaaattgttataaaaaatgaacatgtcctttgactcagtaattccatttcattaatacatccaatgaccacaacacaaatatgccaatacctatgtacaaaagttccctgcagctttgagtgtagcaataaaacattaaaaagttagaagtcactttcatccaggagactgaaaaaaatacattctgttacacacacataagacctatatgtactggtatgggaaggtatctaaaatatatcagaagttgaaaatgaaaaacggtaaggtataaaacatcacatatggtattaatcccttgtgtaaaacaagatatacatacatatgtggtgaaagaatccacaagaaattaactgacacaacctcaaggaagtaaaattgaagggtagatgtgaagacattaacttcctcttttgtacccttttgtattatttgaaatttttacaatgtgctcgtgttatgtttttctctataatttatataattaaaaggaatgaagcagttaaaagtacactctagttaaaagtacagataattatgcaacgcaattttagaagatctccatataatactgttaaaattagaaatttgccatccaaggaactaactttccatttcctggaatattaacttatatatatttcttgatttcctaagattaaacaaaagtaagataagacacaatgatcttttcatatgttttttctaatgctgaagaatatccactatttcaacaaacatcatacaattcttaaatcacttgtgatttaaaactaaataccactttttaaagtttttaccttaacagtaaaaagtggcaatttacatttgtatagaactttacaggttacagagtcctctgacacttaccatgtttttttcccacaagaaaacactgatgtaggtaaagcaagtaatatgatattagatcaatttcaggattaggaaactgaagctgagaggagttacacaatgtacccagggtcacagagctaataagtaacaacccaagcactgaagcttggtcttcctgctccacatccaaagggctttccactaaaccacatcactccaaataaccactgttacagcgtgctatggggtcaggcttctgacagggaagaagggctcactacagatctggcaatgacaggcagtctgcctgcagaggaatgtacaatacaaaaataaagtgtatgaaggtgggcctgactgacgaaagggaagtagaactgggagaaatgccaagaagaataacaaaggtgaaaactgggcaacttaccaataagggaagccaaggaaatacctttgtaaacttaatttacttagttaaggtagaagggatagtctatgtaggggactatatattataatgtggaaaaatcataaagtgtttataattcaatcaaaagatttagaaaagatgtaatgaagcgtgatgtgtatgctgtatttaatcagagattacaatgtggcagcacatgactgccatgaaaattttaatggtctaatcccacaatgcatatcctgttaatgttgtggcttagaactttaagaggcaagtgtgaagtacactcagaactcatactcactccatgggacacccgaaataaggagcaaaaagtatcactttctacacaaaagaactcattctcctaagattctagtacagcactgatcattagtacccactcagagtcagaaaatccttgtaagaacgggccagggacaccagaaataacaccaggatcaagccatcctggactaaagagaaccatgggtctttccactgagtactttccaggaaaatcctttagcaaacatttactgctgacctagcaggaacaggctccttgagaaacatcaaccttactgtcccttactgtgacagaaggaaaaaagagatgggacccaaaagctttgactcaatgtcaccagatgtatcttccacagtttaagattcattttgtgagctattttagagtttttaaattattgtcctttattcctggtgtgttttgaagtttagtaaatatatagaaacatctattattttttgccagtctagcactcatttgctcttctcctgctaaacatattctgatttccctctaggaaatcactacttctccattctcagaccatgtatttctggtagtcaagtctaccctagctccagattgaacatatgacctaggtctaagtcaattactaaatcacattgtaatggccacaatgatttgctcagagaagggcacatgacccacgcagaggcacaagattatcactcttttctgctggatttcaactagaaagatataacccagggaactgctggcagacatcttgtaactgagggaagagcttgtgtgagtgaggccaagaaagaggtatcagaacaaaaacatgaattcaagtaattcctctcaccctgaatcaagccatgcacaaactaactttgcaatgagcaagggttatgtgaacaaataaattccctctttggcttgagctggcttaggctgggttttctgtaacttataaccaaaagttgaaactgattcagtaaacttgaagtaaataccaaacaggagaagttcttggaaaagaggtttgtgtaaagcacaaaccactgactaactccagaaatgctagaggttattccagatgtataacagctttagatgtctgatctattttctactttctggcccatcaaaaaaagggatacaataattggcggaaagaaaagtagaataaacatattttttaaaaggaacatgcacagtcatttttttaaagtctcctgctgccttcattttcctactagcacctcccctagctagtttgtcattgtattcatttgcatttgatttctcattttacggaactctcagatgtttcagtttccattcatttttatggcataatcaactcacacaatagttaccaaaaccctttacagaaaaatcaatggtttcgagaaacttggtgaatatgtagcaatttctgaaatacttaaatctcaaaagtaatacttaagcttacatgtaagattttatctgatcattcatcaagcttcatattccaacttcttaacaaccaaaatttctccctgccccctcctcctctcctaggataaagaatacacacattaaattggggctcccaggtatcctggatgaggaaaatactctgggaaaaacagcacagctgttcagttaactcccttctaccctcacaaatctatttcattccacccccctaaagaagagacttgaaaatataaaatatccaaggttataaacaataaaaaaagttatggaatttgtccagaaaaacacaaatcttctgttcaacacaaagtacatacattaggaaaaataactagaatattttaaccattattcgagagggcagagagaggttgtctttcatgaaatctggattgcacatgtctggcaaggaaaaaaaagattaataatctatcacaaagccccacaactagtgattcaaaatgaaagctttcactacttacaccatatgtaaatatatatatatacaagctgcttataatcccttgatctgcagagaaagagaactgatactctactgtgaaaatggtcagtgggtacacattttaaaatcctttcccacatgaaaagattcctgaaaaagagatcagaagacaacagaaaagcactcaatatatatggagttgtaaatccagtatgaaccagtatctattacacaaaggaggaacatgcaacaaagtgattaggaaagtcaaacatgaattaatctaataacacaaaggtaaatataaaccccaaagagcactttattgaacagaaatccacacatatcaaaaagatgtctactattaacaatgacatatcaagcttttaaactccaaattaatcttaataatcaataatgcaaacttgatatgcccttaccaagaaaaaaaagtttgaagaagcacttaacatcaaggcagaacatatacatatttttaaaatataacaaaccaaatgtttaccataaaggctattacatgcaaggtattgattctaagggcacttggataaaatatgctagtatattttgaatagccactgcttgactcttttatttatttggttatttggttatttatgtatttatatgtttattgaggtggagtctcactctgtcacccatgctggagtgcagtggcgagatctaggctcactgcaacctctgcctcctgggttcaagtgattctcatgcctcagtctcccggcagctaggattacaggcgcatgccaacacaccaggccaatttttgtatttttagtagagacggggtttctctatgtcagccaggttggtctcaaactcctgagcccaagtgatctccccgcctcagcctcccaaagtgctgggattacaggtgtgagccacctcgcccagccaccaccgtttgattctattaaagaaactaacactgtacctaaaaatgtgaggtctatgttatggaatgtatactttcttcattaacaacaataattcaaagtaccaaagtaccaatggtgaatactaagattctatccttggttctatagttctctgcattcttctacccaaatacatctggtagatgatcatgtccaaaatgcaaagacacttttatctacctaagtgagatgataggataaggatgacaatgtcaaaagcaaatatatatagggccacttatgtgccaggtgttattctttaaatacatgtaatctttataacaactcatatcttgtcccatatatcagatgaagaaattaagtcacagagaagtttaaaaacttgcccaagttcagagaggtagtatgtagcagagccaggattcaaatcctggcagtctggctccacatttcatgttctcagctcaattctagtcttcagctataattccaatcctttctttccatatcactacttaacctccatatgtttccatttctcatctggaaaatgggtcattaatagttcttacctcatagagttctccaatcctcatgaggattaaatgccataatatacataatgtatttagaaaagtacctggcacataaaagtaatacatatttctgttgttattttatctaccaaatgtctgtcactggagttgagaaccattgttctaaaactgtaacagtgagaatttaccaagcagaatagtcttaatgtgcccttacactggtaactaaagaaaactggactttctcaattattttcaatataaaacaagtccaccaccagccttcaagaaaatatacaaatcatttaagagttgctatcttcagtctggaatttcttctccattattttgtgttccctcacacccacccaatattacagaaatagatctcatcctgataaaggtatatagtgaaaatgtctcttatatatcaaactgaatgtttatacaacttttaagacataaaggccaggtgtggtggctcatatctgtaatcccagcactttgcgaggccgaggtgggtggatcacctgaggtcaggagttcaagaccagcctggccacatggtgaaaccccatctctactaaaaatagaaaattagccaggcatagtggtgcatgcctgtaatcccagctacccgggaggctgaggcacgagaactgcttgaacatgggaagcagaggttgcagtgggccaagatagtgccactgcactccagcctgaacaacagggcaagactccgtctcaaaaaaaaaaaaaaaaaaaaaaacacctgtgtggtattttaatgtaattctcatctatacagctggatgctgggtactcttgaatcagaatactactcccagagtttggcttcacgaaagagctacaaagtgtgaagactgagggaactacaaccatcctttaacccagggactaacgctgatcgacatttaaatatgcttctattaatagttttctgttgtgacaacactcttgcacaggccccactatacaattgtgccaagatttctcaaaagtacagaaggaggaggaaaaccactggatagagcctagagtacatacatattcaacgacaggagattatcaaattactctttgaagtagttgtactaatttaaattcctaagagtatgatagcatatagagtatatataaggcacaagtgagtacaataaatttggaagcatttctatggagaaggtcataaccaagagcagacaaagaagtgatctaccaagtaaaccccagaaggactccaagcttagaaccatagggtagggagagcaagagggaaagggagttcactttttcacggaagctgtaaagaagaaaatggaacaagagttggctccttgaccccagtctgcccctgctcccatgtacatgcagattacatgaattctggcatttatccccagatcaaaaaaaaggggaaagggttcctctctaaagaaattcagggggccgggcgcagtggctcacgcctgcaatcctagcactttgggaggccgaggtgggaggatcacgaggtcaggagatcaagaccatcctggctaacatgatgaaactccgtctctactaaaaacaataccaaaaaattagccaggcgtggtggcagtagcctgtagtcccagctactcgggaggctgaggcaggagaatggtgtgaacccgggaggcagagcttgcagtaagccgagatggcgccactgcactccagcctgggcgacagagtgagactccgtctcaaaaaaaaaaaaaaaaaaaattcaataaaaacctgttgtaggccctttcccttaaaagctagctcccaacccattcaccctaatattatgcctgtcagtcaaaaggcattgtcccagtgcttacggtgagacctgagcagccttccagtcccaagggcaagaccagaataaataaaacaaggaaatccataaccctagaagaaacagaaatgattcaggaaacagacaatagcatttatttaaaaaacgtattattcttaaagcaatttcaaaagcttttctatccatgtcagcatcaatatgttatgaaaaaggaataatcaaaagagttcttgtaattaaaatataactgctaaaataaaaagttcagttagaaaagtcagaaaataaagcaaaataaagcaccccgcctcctccaaaaggcaaaaagacaaaaagagacggataatctaagaggaaaaacaaattcaggagattcaacctttcaataaagaaaatagaaattttccaaagctgaagacagacaattgtttatatattaaaaggaactactgaatgctgagcataactaataaaatggactcacatctaggcacattcttgtgaaatatcagaaacgtcaagataaaaagaaaactccagaaatttccagagggggaaaaaacctacaaataagtaagactctgacagccattagcaacactagatgttagaagataaatggaggaaagtctcaaagctctgagagaaaattattttcactgtaaaattctacgtaggctatcaaccaagcataaaagcaaaataaagacattttcagatatgcaaaggctcaaataataattgaccccttattcttgtatcatgaagaagacagtttaggaagaatacaaaacaaaggtaaaaaccaagaaaacaggaaatatcctttttttaatggtggcactaacccaagagtcaagtgaaaagaaattctaaggatacggctataaaacagacctcaaagcaataagtccacattagaacaagaaatcaggaagctccaaagaaatctcaaagaagaatcacatacatttcaggaaataaatacactgagtaagaagctcaaagatattaccaaagggataaaagatgcatacattgcttttttcaaaataacaaaaaaagaaaaaactcccagaaacagaaaattatataacaacatgatcctaacatagagccatcaacctaaaatgtggcaatgattttgagtaattaattgtgagaaaagtaaatccatttagaccacatgctgggaacattcttctttgggtaacctaggggtacaacactggatatttagagacagaaataaaatttgagcatatcattgtttcctcttccaagatgttctttgccctctcttctctgacttactcatttattcattcactctctcaatatttactgagcacccatcctaggagctaaagataaaacagtgaacgaaaaaagaaaaacacctgcccttttgaagcttatattcaataactcctattctttcaagaatctgctaaagcaggagtccccaacccctgggtactggtccatggcccgttgggaactgggccacatagcagcaggtgagtggcgggtgggcaagcattactgcctgagctccacctcctcctgtcagatcagcagcagcattagattctcataggagaataaaccctattgtgaactgcacatgcaaggaatctaggttatgcactccttatgagaatctaatacctgatgatctgaagtggaacagtttcatcctgaaactatcacccccatccgtagaaaaattgtcttccatgaaaccagtccctggtgccaaaaaggtcgaggaccactgtgctaacggattctctcaccaatgaaactttttctaaattgttaggctatgtgcatctccttttttcctcctaaagaactctaactctttgcaaaacagaatttggctttttacatacctattacctcatctagtgtgtgaagaatgcaagacagcaacatttattagttatttgtacttctagtgaacagcactgggcctaaatcaataaatgtgttttgaacctttccattcaaccaaaatgtaaataaaactgctgtattcatccactctcacactgctataaagaactacctgagactgggtaatttagaagaaaagagatttgattgactcacagttccacaggctgtacaggaggcatggctggggaggccatggagactcacaatcatgacggaagggcaaaggggaagcaaacaccgaattctcatggcacagcgggagagaggatgaagggggaagtgctacacactctcatgagaactcactatcacaagaacagccgggggaaatctgcacccatgatccaatcacctccaatccacctccatgatccaatcacctcccaccaggtccctccccgaacactggggattacaattcaacatgagatttgggtgggaacgtagagctaaaccatatcaactgacaagtaaaatgtaaagcactaggcaaatgttacttattacttaacagatgaggacactgaagtccttgtcagttgaatgatttgctacagaccacaagactagtctgtagaagaaccaaaactaaaacccatattgctgaaagcctgggttcatgccgtttctcctatactaggttgaatgaaaacaagtagtcaaatcaaaaaatgggcctaaatgggaaagaataaccttaggcattttcttagaatgtttttaagtatacaataaacatccaaaatatagactctatttcttccatatgtcaagacatagctttacaattatgtaaagatcatttggaaagcctctaatcaaaaatctaacctatcttttaagagcttcaatttcacagagttatgcatttctactctgcagtatatgtttgaaatgcataaatgtttcgagatgtttaacggcatttaatataatataaattggtttttaaaaaatttcttcatgggaaaccttcaaaacttactaccacaaatatactaaagtttttattcttttaaaacttgaaaacacttgactcctcaaaaaaaaaaagctcatattaccttacacaaacaacaacaaaaagctttttcatgagtcacagaaggcctatggttaaaattatcaagatacacatttttaaaattaagcaaaaaattaaacagacacatatataacttttgtaaaaatcagggaactaatgaaacattctggtatttcacacatgccaaggttactagtaagcatactttttatggcttgtctttggtatatgaccatatttgttcagcaatccacattattaataccgaatagtagccatgcaaattataacttatccacaaaaatataacactgaataaagaggtagggtaattttatattcacaggacaagaagccaaaaaattggctgtttcagctcaacatttatcaaaggcttgtaggtgccaaaagctattctaggcacttggaatatttcaagattaatatattaaaactcctgggcaactgcaactactcttctcccaaacactaaaagctgactaattaaatgtaactcccatatataggataccatgactgggttatctacaaagaagtttcatcaaacttaaaagatagtttaaaatactgtgaaaaaatcagttactgaatgtgaatgatacgaggacttgagctgtgtttgtgagtctgatcacaaaaatcagaaatttaagtcacatatactattttatagagccccaaatacttaaaaaccaaaaggactcaatgaatactaatcttacagtgatttttactcataatgtaaccagaagagtcagagaaacttttatcacccattagaatacaggagttttacctttttcctaattctagtaccactaccattaattaccacaattcgttaccagctcaagtgccaactctgtgatctggcccatgttgagtaagaatcagcacttaaatagacaaaatctctaccctttacaactcagactcagttacaatcactggaatatgtctaattaacccacaacttaattctatgccttcatcttttcctacatgtttcccaaaggaaaagtatagatcagattttgaaggtccttctttaatatctatgctgacaatcagataatttgttttatgacttttaaaatatgtgaagtactcatataactattagcaaactgtcaagcaataaaacataaaaaaaaggccaacagaaacaacaaacagcaaagaacaggcacaaaaagaacatgaaacagccaatacaaatatgaaaagatagcctacctaatagtcaaaataaacatcatcatcacagtaaaaatagcatttattgtgctttctttatgtaagagtgaatatgcaataaacacccaattaattaatcaatgaattactaaatagacaacaaactacctgagaaaataagcaaattttcaaataagaggtaacattttcagctgggccttcatggatgcaaatacactaggcaaagactgggggtagggataacactaaaagaagtgcagaggatgaggcaagggcatacatataatcaccaaaatatgaagccagttcttattctaggagccagttctcattgtaacactgaactggaaagtacctgataaaacagtgacaaggtatgaaactgtacaggaagaaaggaggtaatacataaactctgtttatacatcaggctaaaaaatttgaacttaaatgttttatttaaaagacatgtaacttaattggacttgctctttcctgtgccttttattttcaattttcaaggaaatatttgttcaaaaatagacaatagtcaataattcagaatcaagaacgctttacccctaataagatttctttcaaagacaagcacaattccacacacaaaataaatatgttacttaggtggttctccaagacttactactcttaaaacaaattaaaaatttagaatctattgtcaactccctaaatcatcacataattttgtttcttctctataataaatgaagctcactatatataaatatgtacaaatagaatatgcaaattatacatagacaatatccagaaagtttctaataatgtaatctaaactgtccattactctgagaaagcttactattaatgtggttaatatatgtagtatatacataatcaaatgaattataaagttaaggtctcacatcagaacaggattatgctgtcacaacaacatccatctgggtccacttgagcaccaatccaaccttgttctcaacctatattttatagtttttattaacaatttaaagataagcacaaaacaatttcagtaatcatgtttttatatctttttttagatttataaaggttaaagctgtcaataaagttttacatccacagatcatacatgaattcatttaagtgaatataataataagaaaagtcaattcaagggctctacctgacatacccaaatgaacaagagtaaaaagagatgcaagcaaatgagtaaaccagtatctgagatactcactccaaggaaaaggccccaaacataaagcatgagtttcaaggacaagataaaactcctaaaaagagattaagagaaataaatggggtactaggcaagaataatacaaaatgtcacacaggattattaactggattacaaaaaaggtacatgaatagaaaataaataagcaaatgactaattagtaaaatcaaggaacagggtcagaggagtaacaacggtaaaaactgctatggtgaataacaaaaatatatgagatacagcattcttagatactagcattagccgactagaaaatataacagcaacaaaagatcattcacattagcagtaaaaatgacaaagctcctagaagcaaatcaaatttaaaacgtatataattttctttttcttttttttttagatggagtttcactctttcgcctaggctagactgcagtggcgcaatctcagctcattgcaacctctgccccgcaggttcaagagattctcctgcctcagcctccagagtagctgggattataggcacctgccagcacacccagctaatttttttgtatttttagtagagacagagttttgccgtgttggccaggctggtctcaaactcctgacctcaggtgatccacctgccttggcctccagaagtgccaggattacaggcgtgagccaccgcacccggccgaatgattttcaagaggatttaaaaatgcatttaaatacaaaaaagaagaactgaacacaaagatattctatgatcatgcattggaaaatattagttaacacaaattatgagttaaatgtaattccaatcacaaacccagcaagactttttgtggagcttgacaacttattctaaaacttatgtgaggccagacacggtggctcatgcctctaatctcaacactttagatgaccgggtggatcaccccacgtcaggagttccagaccagcctggccaacgtggcgaaaccctatctctactaaaaatataaaaattagctgggtgtgatagtgggtgcttataatcccagctactagggaggatgaggcacaagaatcacttgaatctgggaggcggaagttgcagtgagccaagatcacgccattgcactccagcctggggaacaagaacgaaactccgactcaaaataaaataaaaaataaaataaataaataaataaaacttataagagagatcaaggaaaacaaagacaagggaattgcatcccaaacatcaagcacgccaccatataattaagaacatatttctggatccgggagccaagatggctgaataggaacagctctggtctacagctcccagcgtgagcgacgcagaagacgggtgatttctgcatttccatctgaggtaccaggttcatctcactagagagtgccagacagtgggcgcaggacagtgggtgcagcgcaccgtgtgcgagcctaagcagggcgaggcattgcctcactcgggaagcgcaaggggttcagggagttccctttcctagtcaaagaaaggggtgacagagggcacctggaaaatcgggtcactcccacccgaatactgcgcttttccgacgcgcttaaaaaacggttcaccaggagattatatcccacacctggctcggagggtcctacgcccaaggagtctcactgattgctagcacagcagtctgagatcaaactgcaaggcagcggcgaggctgggggaggggcgcccgccattgcccaagcttgcttaggtaaacaaagcagccgggaagctccaactgggtggagcccaccacagctcaaggaggcctgcctgcctctgtaggctccacctctgggggcagggcacagacaaacaaaaagacagcagtaacctctgcagacttaaatgtccctgtctgaacagctttgaagacagcagtggttctcccagcacgcagctggagatctgagaacgggcagactgcctcctcaagtgggtccctgacccctgaccctggagcagcctaactgggaggcacccccaagtaggggcagactgacacctcacacggccgggtactcctctgagacaaaacttccagaggaacgatcagacagcagcattcgcggttcatgaaaatccgctgttctgcagccaccgctgctggtacccaggcaaacagagtctgtagtggacctctagcaaactccaacacacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagtgcctctcctcctccaaaggaacgcagctcctcaccagcaacggaacaaagctggacggagaatgactttgacgagttgagagaagaaggcttcagacaatcaaactactccaagctacaggaggaaattcaaaccaaaggcaaagaagttgaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagacgaaataaatgaaatgaagcgagaagggaagtttagagaaaaagaacaaaaagaaatgaacaaagcctccaagaaatatgggactatgtgaaaagaccagatcttcgtctcactggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttaaaatgaaggaaaaaatgttaagggcagccagagagaaaggtcgggttacccacaaagggaagcccatcagactaacagctgatctctcagcagaaactctacaagccagaagacagtgggggccaatattcaagattattaaagaaaagaatttttaaaccagaatttcatatccagccaaactaagcttcataagtgaaggagaaataaaatacttaacagacaagcaaaggctgagagattttgtcaccaccaggcgtgccctaaaagagctcctgaaggaagcaataaacatggaaaggaacaaccggtaccagccactgcaaaatcatgccaaattgtaaagaccatcgaggctaggaagaaacggtatcaactaatgagcaaaataaccagctaacatcataatgacaggatcaaattcacatataacaatattaactttaaatgtaaatggactaaatgctccaattaaaagatacagactggcaaattggataaagagtcaagacccatcagtgtgctgtattcaggaaacccatctcacaagcagagacacacaaaggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtagagggatcaattcaacaagaagagctaactatcctaaacatatatgcacccaatacaggagcacccagattcataaagcaagtcctgactgacctacatagagacttagactcccacacaataataatgggagactttaacaccccactgtcaacattagacagatcaaccagacagaaagttaacaaggatatccaggaattgaactcagctgtgtaccaagtggacctaatagacatctacagaactctccaccccaaatcaacagaatatacatttttttcagcaccacaccacacctgttccaaaattgaccacatagttggaagtaaagctctcctcagcaaatgtaaaagatcagaaattataacaaactgtctctcagaccacagtacaatcaaactagaactcaggattaagacactcactcaaaaccactcaactacatggaaactgaacaacctgctcctgaatgactactgggtacataatgaaacgaaggcagaaataaagatggtctttaaaaccaatgagaacaaagacacaacataccagaatcgctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcgaaccagaactgaaggaaatagagacacaaaagactaatgaatccaggagctggttttttgaaaggatcatcaaaattgatagactgctagcaagactaatgaagaaaagagagaagaatcaaatagaagcaataaaaaatgataaaggggatatcacgaccgatcccacagaaatacaaactaccatcagagaatactacaaacacctctacgcaaataaactagaaaatctagaagaaatggataaattcctcgacacatacaccctcccaagactaaaccaggaagaagttgaatctctgaatagaacaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaattctcccaaactcattttatgaggccagcatcatcctgataccaaagccgggcagaaacacaaccaaaaaagagaattttagaccaatatccttgatgaacgttgatgcaaaaatgctcaataaaatactggcaaaacgaatccagcagcacatcaaaaagcttatccaccatgaccaagtgggattcatccctgggatgcaaggctggttcaacatacgcaaatcaataaacgtaatccatcacgtaaacagaaccaacgacaaaaaccatatgattatctcaatagatgcagaaaaggcctttgacaaaattcaacaacgcttcatgctaaaaactctcaataaattatgtatcgatgggacatatctcaaaataataagagctatctatgacaaacccacagccaatatcatactgaatgggcaaaaactggaagcattccctttgaaaactggcacaagacagggatgccctctcaccactcctattcaacacagtgttggaagttctggccagggcaattaggcaggagaaggaaatcaagggtattcaattaggaaaagaggaaggcaaattgtccctgtttgcagatgacatgattggatatctagaaaaccccattgtcttagcccaaaatctccttaagctgataagcaacttcagcaaagtctcaggatacaaaatcaatgtacaaaaatcacaagcattcttatacaccaataacagacaaacagagagccaaatcatgagtgaattcccattcacaattgcttcaaagagaataaaatacctaggaatccaacttacaagggacgtgaaggacctcttcaaggagaactacaaaccactgctcaatgaaataaaagaggatacaaagaaatggaagaacattccatgctcatgggtaggaagaatcaatatcgtgaaaatggccatactgcccaaggtattttatagattcaatgccatccccatcaagctaccaatgactttcttcacagaattggacaaaagtactttaaagttcatatggaaaaaaaaaaaaaagagcccgcatcgccaagtcaatcctaagccaaaagaacaaagctggaggcatcatactacctgacttcaaactatactacaaggctacagtaaccaaaacagcatggtactggtaccaaaacagagatatagatcaatggaacagaacagagccctcagaaataatgcttcatatctacaactatctgatctttgacaaacctgagaaaaacaagcaatggggaaaggattccctatttaataaatggtgctgggaaaactggctagcgacatgtagaaagctgaaactggatcccttccttacactttatacaaaaattaattcaagatggattaaagacttaaacgttagacctaaaaccataacaaccctagaagaaaacctaggcattaccattcaggacataggcatgggcaaggacttcatgtctaaaacaccaaaagcaatggcaacaaaagccaaaattgacaaatgggatctaattaaactaaagaacttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaagtgggcgaaggacatgaacagacacttctcaaaagaagacatttatgcagccaaaaaacacatgagaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttgatgggaatgtaaactagttcaaccattgtggaaggcagtgtggcgattcctcagggatctagaactagaaataccatttgacccagccatctcattactgggtatatacccaaaggactataaatcatgctgctataaagacacatgcacacgtatctttattgcagcactattcacagtagcaaagacttggaaccaacccaaatgtccaacaatgatagactggattaagaaaatgtggcacatatataccatggaatactatgcagccacaaaaaataatgagttcatgtcctttgtagggacatggatgaaattggaaatcatcattctcagtaaagtatcacaagaaccaaaaaaccaaacgctgcatattctcactcataggtgggaactgaacaatgagaacacatggacacaggaaggggaacatcgcactctggggactgttgtggggtggggggtggggggagggatagcattaggagatatacctaatgctaaatgacgagttaatgggtacagcacaccagcatggcacatgtatacatatgtaactaacctgcacattgtgcacatgtaccctaaaacttaaagtataataataattaaaaaaaacatatttctgttgcagaagcaggcaaataaatctctgctagaacagacagaccaaatatagagacaaatatatacataactttagtaggacaggcttataagccagttaaaaagggatagaaaattgtgttaggacaattagatttccacacagaaaaaaaaaaaagtgctgtatacccctatctcctatcatatacagaaataaactccagctagattaaagatgtaggtaaaaagccagcctattgcaagataagagtgacaccatttcaaagcaaaaccaccataatgacaggagtttggctccagcagcaaggtctttaaacaatgcctgtagcatagacaacccctcataaagatgtttatctaacctctccagtggtcatgagtagcaacaaagtctgaggtgtaaccagctgcatatgttttaccaaaaaagcttgctatataaaggatattttcgggagggtggatgtgggaatacaccacctcttggccacccaaaacattatttctgtttgttagtctgtaataaatgtttttttataagaaactggatttgtcagtgtctttcttcagctctcagctcccttagcctttgggggtagctttgcatatgtttgctcatagcagaacagaactgctaataacaaaacttgtactatttgaaagagttccacttctggtagtgataaactagataattcagaccactctcctgcttaaagaactaaaatgtctggagaaaatacatttaaaagtctatgttaaggctaatgaagacacacgagcagtgtattttgtctgaaaacaaaatattaaaaaaagaaaaaagaagaggtaagcctagcaataagggctgcttttccccaagaggcatctatcaattatggaacagaggccaagaggctaataagcagagcagaccttttgactgacttacaagatgagaaggtcaaagactggaaatcaaaacctaccgagaaactgagaagccctataatgccaaaggaccatatcctagatgtaaaggaggatcaaccctcaaaagtacagtcatgtgtcacctgacaacatggatacattctgaaagacatcattaggcaacttcatcattgtgtgaacatcacagagtgtgtttacacaaacctagatggtatagcctattgctcctaggctacaaacctgtgtagcatgttaccgtacagaatgctgtaggcagcagcaacacaatggtaagtattcgtgtatctaaacacatctaaacatagaaaaagtacagtaaaaatacgatactataatcttatgggaccacaattctacatgcagtccatcattgatagaaacatcattatgtagcacataactgtactgaagcccagattcaaattatctctaaccccaattgaattaagtgatccaggattgctagttctagccaccagatagaaacaaaaaccttaagtaaaatacgtcaacattcagaagttcaaataacctctatcacgttttacgcaatgtctagcactctatcaaagatcacaaggcacagacaaaaacaataaaaaacaagagaaacaatataaaatagaaagagacccacaggagattaacatttaaaagattagcagacagaattagactataattaatatgttctaggatatgagcctaggcagcgaagtgagaccctatctcttcaaaaaatcaaaaaaattagccaggcatggtaccacacgactgtggttccagctactcaggaggctgaagtgggaagatcacttgagcccaggaggccggggctatagtgagccatgatcacaccactgcactacagcctgagtgacagagcaagaccctgtctcaaaaataaaaataaaaaataaaaataaattatgttcttggatataaaatacaagatttctggataatatctttaaaaggctaaaaggaatcactaacctagaattctttacccagcaaatatactgttcagaagtgaagtgagggtcagacatggtggctcacatcagtaatcccagcactatgggaagccaaggcaggagaattgcttgagaccaggagttgaagaccagcctgggcaatatagccagaccccatctctacaaaataaaattgttttaattagccaggcatgatggcatgctcctgaagtcctagttactcaggaggctaaggctggaggatcgcttgagcccaggaattcaaggttgcagtgaactgtgatcacaccactgcattctagcctgggcaaaagagcgagaacctgtctcagaaaaaggaaaaaagaaaacatgaagtaaaataacaacattttcaccaaaaaaaaaaaaaaaaaagacattatcatcatacccaccacacataaggaaatactaacagatattcttcagacaactgagaaacacagaaagaaataaagaacaataaaaagcataaatatatgagtaaatataaacatttgcaatacaaaataagaataacaatataaaataacaagaattccatgtgctatttaaaatgtatacagaatttaaagaaacaaagcagatcacaaaaaaaacaacagaccatacaagctcttaaaaacaaattgccatattcttaggaaaagattgtttcatgaccatgaaaacaattactagagtgagttttacacctgtttaatcaaagacgactgttagactcgtcaaatttttgaaagccagtcagtcagtaatagtcatgcttctgaaattcagacaatcaagagttaacactctagtgaacaaaggcctacaacatccagatattttttaaataggatgttacgtatctttatattattaaccttaacaataatggtactctttttggataataaataaatgaagaaaaatgtccttgcactagaaaagaaagatacaaatattcttgagacttaataggagctgtcatcaaggcaacactcagaaacaatatacctacagctcctgatcaatctcttgtgcagctctgggttccttttcatatatggaaattagactcttaccatgccatcccagaacccagggtacctgttgtgtgagcgtaacaactatgttattccaagtgtacaactccccaacatgctcagtggactgtgtcttataacaaagaatatgaatggataaaatctttcctttgataactgacaaagagttttctgaagataatgatctgatccatacctatctttaagaactatagtatgtcttcacagttgtaattattggcaacaagcattaaacttcttggatcaaatacttcatatctactcaaaattgtaacattaacacttaaaactaagaaaatagagatgtttaaaattttccatttcacacactacttcatattcctacctgataactttaaataccaaatgcactgagtttagccctgaaatgagtttaaaacaattctctaactgggatataattactttccactgaagcatttttctgccactcaagaatcatctgatttacataaatgctagttaagcaccatagaaattctaaaatatatcattagcagaatgtcacagatcacttaatctactctgtcaaaacagggattatttcaacttctgtttcacttcccttaaaagaaatcctatttactttcttttctctaacagggaaaaaaaattagtaaaataaacttacagtgtacttcccaaatcaaactttaaaatgattctggttaactacaaattgactgaagtattttttctgaatgtattttactgaaacatggctgacaacatataataatgttactgctacagaattacaaattatttcactgattactcttcctattcaagaaaaaaaggtcactttggtccatacaaattgtccaaataaactagatgtattactagcttaaagtaaacaattttgtaaatagcacttctagttagagttaaaacataaccataaaaagcttttattaaacaatacatttcactaagctaaatttatagaaatatatatatttctatcactttcacacatcctgacaatatttgggaaaataaatacaaaaatgtttttttttaattcagaagtatataatttcttcaaatattccagccataaattataatacataaaatttaagatacgtaaataccatgaatattataaactttaaataaaattctagccataatttatgaaactcacattattaaacaacacacacacacgctgattccaaatgaagaagagaagtaccatggtagtttctctgtgacacaccaaaaattatcctaataaataaattaaacaatcatgtaattcctaaatttgttacagaaagatatgtggctggttctcacacctcctactagatatctttacaccacttaaaaccttttcttttttcatgctattattttctgtgtaacaaaataccaactagtcagattctaaaatatcaatctttagaaatgatattagcaaaacaattttaaaatacttactgtcttgtttcgtaatctaattatgtctgagacagagccagcgccacagtactccataacaatccagaggtctgtattcttaaaataactgccatagtactttacaacatatgggctaaaggaaaatacataaacaattaaatttagttaattcccaaagaaatttttttcttaatcccaatacaaagtattttcaacatttcatactgttccaataagttaaataagtaaatttctattgcacatcaaattctcaatatctggagttcaccaactatgcataattaggctttacttcatggacgaaatttaacaggattacaaaccagaagaggcccaaatgttttgagtgattctgaagaaaataagacttcattttggcaaagaacttactacttaacatgaggaacaaatgaaaatttttccctttaactaaagcattttaaatatgtcttctaaaggattttgcattcagtcaaatattaatcaactcgaaaataatctatatttccatgaggccaaaaagttattttaaattttctttcattctggcttttgaaaattctagagaaaaaaaattataaatttttctgcttaaatttatagaattaaaatattagcaatttaatttctaaactgaggtcttacgtcttccagagcagaataaactatgtttatagccaagctgtcttcaggaagatttagaaagggacaaatgaccatcagcaataatgtatattatggataaactacatatagtgatgtatgagaaatctaacctatctcaaagaggcagaatatcatattcaaaaaatgcatagagatagaaaatacaagacagcagaaactaaataggacacaactttaatgctacaagagctcaaatgaggaaataacattggaatcatccaaagagaactttgtggaagggagtgggatttgaatgagattttgaaagaaaagtttaaactccaaaatgtagatggagaagagggataagaaaattctagaaaagagaaagaccatgaataaaggtacacaaatagaaagggaaaaaccaagtatggcatgtaagaggacaacttgttcaaataaatacttctatctagtaatagctacaatcaaaaacagtagccattttgctgggcacaaatgtaagataaatatgacagaaaaacaaataagcaaaaaaaaaaaaaattgaaagtacaataaaagaacacgtagagactctatcaattgtggaggttaagagaagactgtcagggaagacttctcagtacagcctttaaaattttagctatgctctaacactgaggcagtaataaacagcctaccatccaaaaaaaaaaaccacccaggaccagatggacttagggccaaattctagcagatgtacaaagaagagctggtaccatccctgctgaaactatttcaaaaaattgaggagaaggaaatgctccctaactcatcctatgaagccagcatcattctgataccaaaacctggcagagatacaacaaaaaaagaaaactttaggccaatatccttgatgaacattgatgcaaaagtcgtcaacaaaacattagcaaaccaaatccagtggcacataaaaaacctaactcaccacagtcaagtaggctttctctttgggatgcaagattggttcaacatatacaaatcaataaatgtgattcatcatataaacagaactaaagacaaaaaccacatgattatctcaatagatacagaaaaggctttcgataaaatcagacatccattcatgttaaaaactctcaacaaactaggtattgaaggaacatacctcaaaataataagagccatatatgaaaaacccacagccaacaatcatactgaatgggcataagctggaagcattccccttgaaaagcggcattaagacaaggatggactctctcaccattcctgtttaacatagtattggaagtcctggcaagggcaatcaggcaagagaaagaaataaaggtcatccaaataggaagagaggaagtcaaactacccctgtttgcagatgacatgatcctgtatctagaaaaccccatagcctcagcccaaaagcttctcaggctgataagcaacttcagcaaagtctcaggatacaaaagcaatgtgcaaaaatccctagcattcctatataccaacaacagtcaagccgagagccaaatcgggaactaactcccattcacaactgccacaaaaagaataaactacataggaagacagcaaactagggaggtgaaagatctccacaaagagaactacaaaacactgctcaaagaaatcagagatgacataaagaaatgggaaaacattccatgctcagggatagaaataatcaatatcattaaaatgaggctgggcactgtggctcacgcctgtaaacccagcactttgagaggatcacttgaggtcaggagtttcagatcagcctggccaacacggtgaaacccccatctctactacaaatacaaaattagctgggcatggtggcgcatgcctgtaatcccagttacttaggagggtgaggcaggaaaatcacttgaactcaggaggcggaggttgcagtgagctgagattgtgtcactgcactccagcctgggcaacagagcaagactccatctcaaaaaaataataataaaaaataaaaaaataatatataaacacacacacacaaacacacatcattaaaatggccatactgcccaaagtaatttatagattcaatgctattcttactaaaactactatttgagattcggcacagaactagaaaaaactattttgaaattcatatggaaccaaaaaagagcccgaatagccaaggcaatcctaagcaaaaagaacaaagctggtggcatcacactacccgacttcaaaatacactacagggctacagtaaccaaaacagcatggttatgatacaaaaaaagacatacagacaaatgaaacagaataaagaactcagaaataagaccacacaactacaactatatgatctttgacaaacctgacaataacaggcaatggaaaggaaaaaggattccccattcaataaatggtgctgggataaccagctagccatatgcggaagattgaaactggacccctcccttattatcatgttcaaaaatttaactcaagatggattaaaggcctaaatgtaaaacccaaaaatataaaaaccctggaagacaacctaggcaataccatccaggacataggcaaagatttcacgacaaagacacccaaagcaatcacaacaaaagcaaaaattggcaaatgggatctagtaaaatcaaagagcttctgtacagcaaaagaaactatcaagagagtaaatagataacttacaaaatgaaagaacatttttgaacaaactatgcatccaataaaggtctaatatccagcagctataaggaacttaaacagatctacaagaaaaaaaaaacaaacaaccccattaaaaaatgggcaaaggacatgaacagatacttttcaaaagaagacctacatgtggccagcaagaatatgaaaaaaagttcaacatcactgatcattacagaaatgcaaatcaaaaccacaatgagataccatgttacaccagtcagaatgactattattaaaaagtcaaaaaaaaaaaaacagatgctggcaaggttgtgaagaaaaaggaatgcttatatactgttggtgggagtgtaaattagttcaaccattgtggaagatagtgtggcaattcctcaaagacctagagacctagagacagaaataccattcaacctagcaatctcattactggatatatacccaaaggaatataaattgttctattataaagacacatgcatgcttatgttctttgtaactagcactcttcataatagcaaagacatggcatcaacctaaatgcccatcaatgatagactggataatgaaaatgtggtacatatacacaatggaatactatgcagccacaaaaaagaacaaagtcatgtcctttgcagagacatggatggagctggaggctattgtccttagcaaactaacacaggaacagaaaaccaaatactgcatgttctcacttataactgggagctaaatgatgaggacacatggacacacagagtgaacaacacacactggggcctatcagaaggtggaaggtggaaggagggagaggatcaggaaaaataactaatgggtactaggcttaatacctgggtgataaaataatctgcacaacaaacccccatgacacaagtttacccatgtaacaaacctgcacatgtacctctgaacttaaaataaaagttaaaaataaataaataaataaataataaaaacatcagtcatctaaaaaacaaaagtttaaaattttcccattataattaaattttatattaaaaacaaaggcaataaatacaaaaaaaaataactatgtcttgaagtcaaaggtagaacagagtggttggagctgaagggcctgaattcaaacctgttttatccccactgctactccgttacctcttgcacagacttgctccccactggtctccttgtcttagttttctcccctgttctagtctatgctacatacagttgacaaggtaccttactttaaaacaaaagtaaaacaagctgatcatactgctctcctagttaaacaaaaatactctaacagctctccattacccaaaggaaaagctcttaactgcttcatatcgcatacaagttatttcagagtctaccttgttacccgtatctctgattactctccatctcataccttaaatttccagacacactcagctttgctaggtcttgggaattgaaagtatgtatttggagttcataaatgttcactgaaccatttaagaaaagtgcttgtttacaaacaaatgaaactaaatacagacttagaactgcaacatatgagaaacaaaaaaaaaaattctttacatgtactcctttaaggtatggcgcctatgtggaaacttttatagggagtagcgttcctacacctggctgtgcatgagagccacctgtgacccaagcccacactcctttgaggttctgattcagtaggtttttaaaagctctaccggtgactctgacatagacccagagttaagcttcactctaccagtgaatagactgtatatccttcaggggaaaaaaaaaaaactctctctctctctctttttttttctgaagcagaatctcattctgccacctaggctggagtgcagtggcaccatgtcggctcacagcaatgtctgcctcctgggttcgagtgattctcgtgcctcaacctcccaagtagctgggattacaggcctgtgtcaccacgcccagctaatttttgtagttttggtagagatggggttttgccatgttgaccaggcttgtcttgaactcctggcctcatgtgttctgcctgcctcagcttccaaaagtgctgagactataggtgtgaaccaccatgcccgccaaaaaaaaattctttaaatatgaatgttctcattcaaaattttgaaaagtgttaagtaacaatgaattgacgattatgttcactgaaaagcatacaaaaaaatgtacatttttcttgccatacacactaatcagcaatgctaagggtagaagtgacaactcatgaaaattaggaattctaacctgggcagccacctgaaaacacagccctatctctccataagagtaagtcaagagaaaactttggcaaaacgtaaaattctcttcaaaaaaataattcatggcccatctaacacccacgtaagtagatggatccaagtccaacacctctataacataaaacatggcctcactaactttaacccagcaaagtatttaagcaactagaactaaacagccacatgcattcactgaccctctactcgggccaggcatttcaccagatgttcagtatgcactagtgaaacacacattcacaatttggaccctcataccgaatacactagcatgaatatacaggaattaaggaagtaaactcacaaataaatatgattactaaccatggcaagaaaagaagaaagggtgctataagataaactggctgtgactttattttgtattcaccatttctgcaaataaaattgctcctagttcatatgaaggaatggaatgcattcatattccatggtagcctctgagacttggaaggcactggagtatgtgaaaaacctttgaaagcagataagtgagctttaacaataaaatgtcctttctccactgaactgctgtgaattacaaaatccacagattggaaaagaaagaaatgcttaaactccagagttcatatgtatacagtggccatcctctgacactttctaagtcagcaccttttatactgtaaagcacttattacatcctgcaaggactttgtcattgacttttatctgcctcccccagaagaacagaagctccataaagataggtaccaatctgtctcgctttccattttatcctcagtagctctcttctcctatatacaaactaaagaagcaggccgggcacggtggctcatgcctgtaatcccagcactttgggaggccgaggcaggcgaatcatgaggtcaagagatcgagaccatcctggccaacatggtgaaaccctgtctctactaaaaatacaaaaaaaattagctgggcgtggtggcaggggcctataatcccagctactcaggaggctggggcaggagaatcgcttgaacccgggaggcagaggttgcagagagacgagatcgtgccactgcactcctgcctggcagaagagtgaggctccgcctcaaaaaaaaaaagaaaaattaaaattaaaaaataaagaaagaaagaaaagaaccaacgaataaataaatcacacaaaaaactaagacaggacctaatttaggactctccaagggaataatatttaagctaagatgcaaaacttaacgagaagttagccagataactaagcactaagaactgccctgcaaaggccctgaaagacagaacaaatcacggtcaaagaactgaaagattagcgggcccaggataaagtgagtaaaggatacagtagaacataatggagttgcatatgtaggcagaagcctgaccatgaagggcctcaaaaccaaggtaaagagactgggctttatttgaaatacagaaaaaaaaatcagtgaagaattttaagcagacgaataacatgatgtaaagtttctgtggttgctgaatgaaagctagattgtagggaagcaaatgtgaatacagagagaccaattaaaaagtaatgttagtccatgcagagattatagtaagcatatctttttattttctgtattcttgatgctttggtatctgggaccttgctaaaactgaagcgactgcccctctcagggtaagctaattcctagagacagcaaactaactcccatggaaggatgtctttcatatgcacaccaacctatctaaagcccaaacctccaaccacctctatggttacactctagggtcaacttttcacctgcccaaattgccccagggccaggtaccagacaaccagagaaagccctatgccccagaacccactcaaaatactcaaagtagccaatcctaaacctgtttaccctatctcacctgtcccttcccagggaaaccacacaaacattcttgtccacttcttcccccctctttctctgcctcctaactgactctggtacttccccgtggagcccctgtgacacagcacgcctccttctcttgtgagctgtatatataacaatatatcttttccatagcaatagtctcttgatctgttggcctcatgatatgtgagtaataataaagcatactttttttttttgagacagagtctcgctctgtcgcccaggctagagtgcattggcgcgatctcggctcactgcaacctctgcctcccgggttcaagcgattcgcctgcctcagcctcctgagtagctgggattacaggcacccgccaccatgcccggctaatttttgtatttagtagagatggggtttcaccaggtcaggagttcgagaccagcctgaccaacatggtgaaaccctgtctctactaaagatataaaaaattagccgggcctggtggcatgcacctgtaatcccagctactcaggaggctgaggcaggagaatctcttgaacccgggaggcagaggttgcagtgagccgaggtcgcgccattgcattccagcctgggcaacagggcgagactccatctcaaagaaaaaaaaaaaaaaaaaagcctaccaataggctcagacagttcaagacctgagacttctaaactcaagtctatttccattaacacagatatgcattcaaattcacatttatttatctttttttttaagtaattcaaacaacaaatattcactgaacaagcctactagcagaagctagggagaaaaatggaaaaacattagactagtgacaaagaagaaagggcagtccaggcaatggggaacccctgaagaaatttatataaggaaataatacaatcaaactagcatttaaacattatcctgagcaggattgtcaaggatcaaacatgatgttgttcattctagccagcaagttaactaactacaattatttagatgttctaacatctgtttttaaaccagcatgttgattattaaaggttagggaagaaggggagagagtttcactcaaaacactgtaacactctagtgttatatacaggcaaatctataagatattgcaggtttgattccagaccacctggataaagcaaatatcacaatacagtgagtcacacaaatttttgttttccagaaagaaaccttggatcaggcagattcatagctgaattttgctaaacgtataaagatgagctggtaccaatcctactgaaactattgcaagaaagctgaggaagagagactcctccctaactcattctacgaggccagcatcattctgataccaaaatgtggcagagacaaaatgaaaaagaaaacttcagaccaatatctctgatggacataaatgcaaaaattctcaataaaagacctgcagaccaaatgcagcagtacatcaaaaaactaatccaccacgatcaagtaggctttattgctgggatgtaaggttggttcaatatacacaaatgaataaatgtgatttgccacataaacagaggagattttgcaaaattcttgagggtcctaagatttttggaatgggcaatgaacactggcttcaacttaaagtcatgagaggcatcagcccctaacaagagagtcagcctgtcctttgaagctaagcagtgacttctctctagctaggaaagtcctagatggcatctccttccagtagaaggctgtttcgtctacattgaaaatctgttgcttaatgtagccaccttcatcaattatctcagctacatcttctggataacttgctgcagcttctatttcagcacttgctgcttcatcttgcacttttatgttatggagacagcttctttgtttaagcctcatgaaccaacctctgctagcttcaaacttttgttgcttcctcacgtctctcaaccttcatagaattgaagacagtaagggcattgctcgagattaggctttggcttaagagaatgctgtggctggtttgaacttctatccagaccactcaaactgtctccatatcagcaatgaggctcttccactttcttaccactcatgtgctcactggagtagcacttctaatttccttcaacaacctgtcctttgcattcaagcttggctagctgtttggcacaagaaccctagctttcagcttatttcggctttcaacctgtcttcctcactaagctaaatcatttctagcttttttatttaaagtgagagttgtgtgactctccctttcacttgaacccttacggaccattgtagaattactaattggcctaatttcaatattgtgtctcaaggaataggaaagcctgaggaaaggaagggagatggggcccacggcctagcagtgggacagtcagaacacacacgacatttatcaatttagttcaccatcttacaaaggtgcagttcgtggcacctcaaaacaattacaacagtaacatcaaagatcactgatcacagatcaccataacagatataataataatgaaaacgtctgaaatatgggaaggattaccaaaacatgacatagagacatgaagcaagcacaaactattggaaaaatggtgctgacggacttgatttgctcagtacagttgccacaaaccttcaattaaaaaaaaaaaatgcagcatctgcaaagtgaagaagtacaacagagtaaggtatacctgtatataaattttaagcaatgcagaaagttttaattcagccatatgcctaagaattttgactaagccagtatatggacttgcaggttgtatcagaacccagcaattctatacacagtcatccctcaatatccatggcgaactggttccaggaaccccacagataccaaaatccatgaatgcacaagttccttatattaaatggcacagtatttgcatataactacatacatcctccagtatactttaaatcatgtctagattacttattacacctaatacaatgtaaatgctatccaaataattgttatactgcattggtttttttttttattgtttttttctattgctttttttctcccaatatttccaacatgcagttagctgaatctgtggatgcagaacaagcaggatacagagggctaactgtagttttgttacattttttatttttattttttaagagacagggtatcactctgtcacccacgctagagtgcagtggcacaatcatagctcactgtagcttcaaactcttgggctcaagtgatccttccacctcagcttcccaagtaaccgcaactataaacatgcacacacccggactaattttttttattttttgtacagacagggtctcactacgttatccaggctgctctcaaattcctggcttcaagtgaccctcctgctttggcctcccaaagcactggaattacaggcgtgagccactgtgcctggctagttttgtctcttttaaagaggagtaagcagctatgtctttgaaaatttcactgggtggaagaaccaggaaaacacaaaggaaattacagactacaccaggaagcagaggtgaaatatgatgccttaataactagcatgccaatcatgagccacattctatgcctttctcttatgcatcttctctccatttcatcctcctgtctcattaattttttccttcccctatttaacgccttcaatccaataaaatgacgtatcttgttctcgttttcttttttttgagggggtggggggcttctgggcttcctctcatctcatacctaatgatcacatcctttccatttccatcttcactttacagctccctacactctttatcctaatggtcctcctctagtatcacaactcaaaatagaaagagtattaaaaaaaaatgagaaaaaccaaaggggaaaaatggaaaaaggactacatactcctatctaattgtaccttacttaaacactatgcatgatacaaattatacggactgaatcattacgtttaagcttcttataaaaatccaaatgttctattcataacacccaaaatatggaatcaatctaagtgtccatcaacaacatcatataattaaataaagaaaatggaatactatttgaaaatactgcttgaaaggtgactttttctttttttttttttttgagacagggtctggctctatcacccaggctggagtgcagtggcatgatctcaggtcattgtaacctctgcttcctgggctcaagcaatcctcccaacctcagcctcccaagtagctgggactacaggcacgtgccaccatgcctggtgaatttttgtattttttttagagagagagttttgccatgttgttcaggctggtcttgaactcctgagttcaagcaatctgcccacctcggcctcccaaagtgcaaggattataggcatgagccaccacatacaatcaaaaggtgactttttaaatagtaacttgaatttcattctaattgaagaaaaccatatatagctaaaggtatactttttaaaagtcttcctaatatgagcatgtgataattaaaatactaaagaaatggctatttttaattacatcattttcatcaacatcttactataatcttagtagtgttctataacttagtatggtaatacagtgtttttacaaaggcaatgtggatattctattaaaactgagctgtttccagcataaatctcaatcacacagcaatttatttcttggcccacccaaaactgaatatacaaattgccaaagttcaaattgctgatacaaattgccaaagttcatcaataatcctccaacatggtgattttgaaacttttgattttttatttatttatttatttatttatttgcctcagaaacagtgttcaaatggaatcttatctagaaacatgaggaaatagaacaggtaagaatgtagaatactctggtagaagccaaggggtgctcagtgacaccctgaacaggccagctgaaaatgctctatttcaccataagagttatctcttctctttgcccagcaaatctaactcatcaatcaggactcagctgaggtatgacctccctgggaaaactttccctgaacctccaaacatgaggtgttagatatctcttccaacccacatacttccccatatctatcccatcacagctgttaccacactgtgtactgaaacagcctacccattcgtctgtttcttccagctgagtgaaagtctctctaaagcctcaaacccattcttttttgtttcttttttttgttttgttttgtttttgagatggagtctcactctgtcacccagactggagtgcaatggcacagtcttggctcactgcaacctctacctctcgggttcaagtgattctcctgcctcagcctccccagtagctgggattacaggtgcctgccaccacgctcagctaatttttgtatttttagtagagacggggtttcaccatgtttgccaggctggtctcaaacttctgaccttgtgatccacccgcctcagcctcccaaagtgctgggattacaggcgtgagccatggcacccggccgagacccattctttgttgtatctcttgtgagagcacatcaggcctacacttaggagtaggtggtactcaatacatactagttgaacaggtaaaaaggggataagtgtgtgccctgattcataacaacatatttatctttgtttagatatgaaaagttccttctctgcatataagcaccaggagggtagggactatgtcagttgtgattaccttgtgtacatattacctgccacatagtattgctaaccagctgttgcctctactcctaggaatgccttgagagtgcttcactttgaactgttggaatctttttacaggcattgctttcttcaacactggccctgaagtagggtaaatgtgggttcttattgcatctcagtcactaactagcagtgtgattttgggcaattcatgtaaaagctctaggtctcattttctgtatctgcaaaattgtttttaaatatgctttagcactagaagacttttcctcaaataaaaatttcaaaagagtcccatatataaaaaagataaaagcaataatgaggttctcattctactcaattcttcagtgaagaaaatgcccctagaagtaccttcttagagcagggtatgatttgaaaacactaaactagctgacccacagaagttgaatctagcactaatattctatgatttatccatttaataaatactcattaaatgtatactctgtacctggtactgaactaggcactgcacattcagcaataaacaaagcagatgggctccctgagatatttatgctaacatgtagtattcagcccattattaaatattcacttaaaatgaacaaaaaaagattaaaacaccacctctggtccttttatagagtatagaaaacaagacaatttaccaaattcacaaatagctgaatgtattaagaaaatagttaaatttcagaaatgcatatctcattttccctatcaaaatttcagtgtattatttgggaatttttcaattcatactgttttcttccaatcatttttatgctaatttcttaataacacatttacattaatactagttattggtagctaaaatctaagtttctccctgtcatttcctaattgtttttctttttcttttttttttctttttgagacagagtctcactctgtcacccaggctggagttcagtggtacaatctcagctcactgcaccttccgccttccaggttaaagtgattctcctgcctcagcctcccaagtagttagaattacagtcacctgccaccacgtccagctaatttttatatctatttagtagaaatggagttttgccatgttggccaggctggtgttgaactcctgacctcagatgatccacccacctccgcctcccaaagtgctgagattacaggcgtgagccaccatgcccggccctaatttattttttactagtcctatcttttagcattttaggatcttttaaccaactaattttttgatccttcgcaacttcatacttacaatatgaatttgacagtaaaatcttaaaaggcagaaaccatttttcatcaatatttgcctcagcatttatttcattcaacaaatatttgagaagtacctactatgtgcaaggcattctgctataaagtggtacaaaagttctagaattctataacatttccttctcattgtattctttacttttctttccctttaaaagcttaaagtgcataacaagaataagtacctgatttccctggggttccctcaatctgtaatgctcttccttgtactcctcatacataccacaccctttcattcattcatcaaaaagtatactgctaggcgctgaacaggtgctaataaagaaaaatatatggttcctttccttaaggaatgaagagaagaataaagatagtgatgacatttcagaaggaaaatctacaagactcagtatcatctgaagtatcataaaaaggaataaagatgattctcagccttgctaaaagactaagtagatgatgatgcctttgatacacaggaatttgaaaggcttgtctggaatgtttaaaactggttttagaatgttaaatgtgtaattccctctggatagtctagttgagttgcccaaacagaaattattaaatagaagtactcattagtatctgagtaaccattatgtggcaggatccaaggacactgagtaaaatacaatccccgaactcaaggaacttaagacttagatgatagagaatacaagtaaacaggcacttaaaagagaaactcaggtaagagactggaggtgtaagcactagatggaacatgaaggaccttgtatgccactcttaggagactggatttctcgaggcaatggggaaccatgggttttaaacagggaatgcttgattacatttgcattttggaaagaacgctctagcttcaaggaagataatgggttggaggaggcaaacaaagtgaacaaataagatgctgttgcagaaatctgaacaagatttgagggaagagatatgtaatagtaatatttgagaccctgactttcctagacaacactcaaagtacaatgctaatccttgaactatttttaaccataataacaaaataatactcgcatcaggcaagtataaagcatacctggtggccgagcactatgctatctcatctcttattctatatcaaattgtgggaaccacagttgaggaatgtatctttttttttcctataaccacttgaatttcacatgctatgggaaatatgtaacataatttaaatatacagcatattctaaagaaaagcaaaattgaacagatccaagcagcaaagttcctctaggattatgcaatcacttcattagccaaaaagcttacaatctatagatcctatgtattgttaggagtgaaagctttccataaatctctaattacagggccctgaattgataaggggagacaatgtgcccagactaccctgtgtcaccagctctaagtcacacgagacaatttttacaaataagactgaagttgaaggtttctgggaaagccccttccctgcttcttcttttcttcctcctgcctggaatgtagacataaagctggggctgtagcagccctgttgtagccatgagataataagcatgaggacaaagcacatgctaacgatgagagagtacaagaaaagaagactgagacatggctgttcctttgttgctgctgtactagcagactttttgttaagggagaataataaatccctctgtggttaagtaactttaggctaaacatagtcataatttatatactctgaatcccttatagaataaagcctaggctacttcacattgcataagatgcttctcaccatcagctccatttaactatccaacctcatttcattctgttctctgtcccatactttccattccaataattctaaatcttgtcagatgagcacaccccaatgagttgtttttacctttctacctgtcatccccttgactctcccttatcactccatttcttcacccaattaactcttcgtcagcattccagatttcctggctccactggctgaggaagatgccctgccttcttcttttcacattaccccatgcaccagtcactacaatgagtgtgctatattacagctatttatttatatatttgtcttcccaactacactactgacccctcaaaaagaaaaaagtatcttagttcttttggcattcttagatcctggcacagtaccgggtcaactggggatgctcagtgaatgttgaatgaattagatttacataaaacatgacttcttaattagtaaaagtgattacataatacagactgttaaatgacccctttaacatcaaaaactcattctcatccataaatttgtcctaaaaaagtccaggctatagtgcagtgctgcaatcatagctaactgtggccctgaactcctgggctcaaacaatcctcccgcctcagcttcccaagtagctagaactacaagtccaagctaccacctggataattttttcttttttggtagagaaagggtctcactatgttgctcagactggccttgaactcctgggctcctttaccctcgatgctctggcctctctaagggttgagattacaggcgtgatctaccacatccagcctcatttctgcttttaagcagaaaagctgcaaagagctgtaagtcctaaagacacttgacaaagccatcctcatctgccttaaaggattaatctcacttccaatgggaagtcagaaatgaaaactaggccaggcatggtagctcacgcctgtaatcccagcactttgggaggccaaggcgggtggatcacctgaggtcaggagttcgagatcagcctgaccaacatggagaaacccatctctactaaaaatacaaaattagccaggcatggtggcacatgactgtaatcccagatactcagggggctgaggcaggagaatcgcttgaacccagaaagcggaggttgtggtgagccgagatggcgccattgcactccagcctgggcaacaacggcaaaaccctgtctcaaaaaaaagaaaagaaaaagaaatgaaaactaaacagatgatcaaagaataaattttgttatattttattagcaaaactcgtcaaaacaagggtaagcaaagaaataaaatctcttcatacctgtcacattgctgcattatggaaatttctttgattatttcctgaagatctgattcaacaggtacttgtttaattgcgacaacttgaccggattccttgtgtattgctttaaatacacttccataagacctaaaagaaaccaagacattatttttttcctatcaaacatcgtaactataagattaaaagtctactatgagttttctgtggatagtcttttctagtttaaaacactatttaaatgattaaaaaatcaaagtaaacaagtaacaattttaaaaggtaatgaattatatcttagctttattgcttcaactacagacttaaaatagtcaagttaacatataatgagtagctatttttcttatgaatgaaagaaacagacttgcgtttggtcaactcaaacaaatgcagcattaagaagatataaatggaaattaaaagaatgaaatgtagattaaaaatagccaaagcctcaaattaggagaaaaggctgatctcaaggaaaatgacccccagaatatcaaaaagtcacacttctgttcagagtaccttaacagttaaaaccctcagctggggaccatattaacatcaaagttagagaagcaaggaatctgcagccatctgcttctacctgatttacagatccaaggtctctttttaaaaagttcctttcattaccttttcctcaagagaaaaactacaaactcacaggtaaataaaatgaggaacagggtctaatagtcacttgcccaaaacctgtctctgctacaactcctgaaactttgccaactgaatattcacgtgttttaaaaagcaaaaacaaagaaggaagaagccatttgtaccttagtatgaacttaaaaacgaggttaaacactactatgtactgagttcttactataaaccaggtcctatgctaggtgttttacatgcattatgaaattcaaccctcacaatcataaggaaaaacactattatcgtcattaaaagatgagaaacagaccagtagggccagaattcaaacacattcccaccccaaaaatcaggtttttctcaccatatttttctacagaagagaaacaagagcaagccaatggaaaacatcgaatgtttcctaatattagaaatctatgcagaagcccttccaaatttataatcttttaaaataagtgaaaaagagacaaataagtgataacgcggctacttcaataaaatacattttatcctctcctctgtttctttgggctctctgaagtcatttaatttggtttggtacccaaagtcacattgggctgggtgtgggggaatgtatgtgtgtgtatctccccttgaaagccatatgtgtgtatgtgtgtatattccctcaaaagctaacatagaattcagtgctagatcatctactgtcaattaggcaacaccatcactcctttctaaggactcctcagcactacgaaagagaagctgcaatccccacttcccagaatccccttccctgaatggttcctcattaaaagtctgccagtgagaaaaacacgtatgtgtgaatgacgaaaggagaaaccatttttctccagatacagttgtagcagatggactgacagatatgaagtgcacagcagcttcctgctgagcttccaacagccaccactgctgcagactgaggtagttggtgggagtttctcaagactgcaggattccagcagattcccagagagcttttgagaaacacccacttcagtgcttcaggctgagatcttcaatgctgacttcgaccttcaacctttggcaacagttttcatgaactttgcatccctggcccctccacaattcatttgagctcctaacttcattactaaattcttcatatctatagagtacatacagtagcttatcttttccttgatagcaatatagtttttggtagaagaagtgtttccaagggaaagaatcttaaagatgagaatcttgaattagttctttcttagatgttgatatggtttggctatgtcccacccgaatctcatcttgtagctcccataattcccacctgttgtggtagggactcagtgggagatgactgaatcatgggggcaggtctttcccatgctgttctcatgatagtgaatgggtctcacaagatctgatggttttaaaaatgggagtttgtctgcacaagctctctctttgcccgctgccatccatgtacgatgtgacctgatcttccttgccttccaccatgattgtgaggcctccctacccacgtggaactataagtcaattaaacctctttctttcgtaaattgcccagtcccaggtatgtctttaccaacagtgtgaaaacagactaatacagatgtgtagacagtaatgacttcaatacaagtaacaaatagtatactgatggtctatggcattcagtggcaaacagttatttaaattatcacccttagttgcctggagtctaagcaaagctttaaaagaccaagtagctgtatcaatacaatgtatggtgaaaataaagtataaggactatagaatgggctgctgcctctgcctgcactggaaaagttatagaacaaacacagcaagctaaaggcttaaatgtccagctcaagactgagagaaccagaaaacttctgaatttcttaattcttacagaaacagggttgagatttctgaaaaacaaactctaggtatagtcttactggaagttgaattacatttcaagttgaattcacatcagcaccaggtctgttatgttaaagttaaggtatctaacaataaagagaagtacctagagaactggtattaggacatttagatagattctcattaatctgagtaccttgaatccccaaatcctatcaagcctcccttgataccaaaagcaactctgccctcctgtctgagaaaattaaccttacaatgcctgaagactctatctacctcctgaggcagtcacttttcagcagcatgcagtggtcctccagaccactccaccaccacttattgcttccagacccaaagttatactcaactcccatagacaccagggagacaagtataaaatttaacccaagcagctactattcacactaaaaaagttgcaagattttgccaatttttatcagaaccctaaagaatatgtgtgagaacaaattctaagatttccagagaggaagaaatgtactgatatggatgcaagaccagaaattccagactcagcatgttagctcaaacagttgggggtgtccctaacagttgctcagccagttaactgaaacctggactcaaaagtggcccatattaagtgagatgctaagtgagcctcagtacacaccaaaggaagcatatcaaaggctcaaggaaatgggatactagaatggatatatattataagtgccatgctcacatactccctaactatgttgacaaaaagggtccagaggataccagcatcgaccaaagctctattagtgcaggggaaagatgacaaatatgccaacagtgaaactggctccttgagtttaatagataacaggatcccagcacaagagaagtggcaacagctattcacctgagacaaagtgggaacagttaccataatgagtaacaaagcaaggctgaattacagttttcttttattgtacatttaggtcttgatattaaagttacactagcttcatttaaaaaaaaactataattaactgtcctttaaacactgtataaaacagtgtttaatacagtggaacctttctggaggggaggaggtgaaatacacacaacataaaattcactgttttaaagtgtatgattcaatggcatttagtgcattcacaatgctgtacaaccattatctgtatgtagttccaaaatatatagaatctgctttctgtctctacagatttatctattctagatacttcatataaatgaaatcatacaatatgtgaccttttatatctggcttcttccttcacttagcataatattttgtaggtccaactacactgtaaaatgtaccagtacttcactactttttatggctaaaaggtcactgtacagacatatcacgttttgtttattcacctgggatagcagatggacatttgagttgtttccacattttggctattgtaaataatatgctatgagttggtacctttataattaacagttatttaatcatttctctatcactggctatatcttccttcttattccaaatcttctgtattttctattttctttagtcaacattgtaagaggtttaattattttactgatctcttcaaaagcttttatatatacaaacatatacgtatctttttttttttgagacagagtcatgctgtgtcacccaggccagagtgcaatggcacaatctcggctcactgcaacctccgcctcctgggttcaagcaattctcctgtctcagccttccaagtagctgggattacaggcacatgccaccacgcccggctaatttttgtatttttagtagagatggctactctactaaatgacaatatggtttcaccatattggtcaagctggtctcgaactcctgacctcaagtgatccacccacctcggcctcccaaaatgctgggattacagcgtgtaagccactgcacctggcccatatttatcatttctaattttttttctatctcattaatttcagctttttctttaattcaatcttcagtttcttttggtatgtttcataatttttctaagttctttaagtaagcactaagtttattttttgcctttctttgttagtctaatgaaagaatttagaactaaaacttttaattagttttgctatattccatagatactggcacaatgtgttctccttttcattgttttataatttataatatcctcttcaatcaatgggttacttcagattatgtttcctaatttctagttggtgtggattttgtcatattataattacttatttctaatttagtgagtataatcagtgatatggtttgcatatttgtcttctccaaatctcattttgaaatgtaatccctaatgttggagatggaacctgttaggagacgtttgggtcacaggggcagtttcctcatggcttggtgctgtccttgagatggtgagttttcacaggatgtgcttatttaaagcggtgtggcaggccgggtgcagtggctcgtgcctgtcatcccaacactttgggaggccgaggtgggaagatcacctgaggtcaggagttcaagaccagcctggccaacattgtgaaacctcatctctactaaaaatatgaaaattagctgggcgtggtggcaggcacctgtaatcccagctactcgggaggttgaggcaacagaatcccttgaacccgggagaaggatgcagtgagccacgatcacgccattgcactccaggctggatgacgagagtgaaactctgtctcaaaaaaattttaaaataaaaaaaaataaaactgcgtggcacctcccctgccctatcttgctcctgctctcaccatgtgagacatctgctccccctttgccttcttccatgactataaccttcctgaagccctcaccagaagcggatgccggcaccgtgctttttgcagtgtctgcagaaccgtgagccaattaaatttttctttataaattacccagcctaaggtatttttcttataacaacacaagaacagcttaatacaatcagaaaatgtgacctgtaaaaatctcttattttttagaatttgtaacttttcttttatcaatggtcctttgaacatacaccagaaaagcaggtctgcaagaatatatatgcatagttatatagacatacaggtactttatatatttttactttatatatatttacatttctataaaatcaagtgtattcatcataatgtttaatccctctatgtcctttctcttttttctattatatctgtccaattctaaaagagatacattgaaatctcccatgcaattatacttttattagatgcctctgacatcactaatagcttttctgtcataaatttagctgccatgttgtctgacatgttttgttataaattgtccttgatattgctacctaatatatctctttatttagttgaaaccttttaaactttaatgtatctaatataaatattgctactattactttctgtttttttatttgtatgtttatctataatatttttataagaaatatccttataggctatgcacagtggcccacacctataatcctaacaatttgggaggccaaggaaggaggatcacttgaggccaggagttgaagaccagcctgggtaacatagcaagatcccatctctattaataataaataaatagccttatatttccattatttgttttacttgcatctcctataaacagaatataggtagatttcgcatgttcatttactctaacagtttgtcttttaatgggaaaattaacatttactgaaaagtacacttgattttattccttccatcatgttcagcttatttttattttttatttatttatttatttatttatttattttttgagacggagcttcgcttgtgttgtccaggctagagtgcaatggcgtgatctcagctcaccacaaccttcaccttccgggttcaagcgattctcctgcctcagcttcccgaatagctgggattacaggcacccgctaccacgcccagctaatttagtatttttagtagacatggggtttctccatgttggtcaagctggtcttgaacttccgacctcaagtgatccacccacctcagcctcccaaagtgctggaattacaggcgtgagccaccgcgaccggcctagcttattattttaccttttcattttctctatttccttgtccttgttcttgctgatctataagcttcttttaattctgttttgtacctttattattttggaaattctcctatactttgccattccattaaatgctccctacctttctctctgctcaaaccggcacgtttctctactgttattttgaaatcatgtcaactattcttctgcctatataaactgtttccctcactaagatattcttgtcatatcaagacaaagactacttaccttttccaaaataaaatgagcctcaagatctaaaaggatggccttatggtcacttgcctaacaaagtcaaaaccttcaaacgtattaataagaatgccgtaagggatgaactaacaaaactcttaaacatcatttcacagcacatttcttgcttttcccttatatatatatatggcctactttctctgaaaaaacactattaccagatttagcacaaactaatctttaaaattcagtatcacctgccaagtttaattactattaaatactattcaattcatacgaatatactctagttgaaagattaacatcatataatattttttaaattgttctgaaattatttacatgctttcatactttttgtacttacccttctccaagcttctctaatacatcaaaaacttcttcaggctgcttagtcaaactgtcttcactcagcttttttagtttactgatttaaaaaagaaagaagaaagaaaatattttctttaaagaccttttacaaaatttttaatttttaaaattttaccaagtttttaattttattttaatatattcagaagactcaaacaatataaaaacatacatagtaaacattctcctttcaagccctgttcctcatgtgcccagcaacacctccaaaaataatcacttttattagttttttgtgaaacctttatataaatatgaatacatattcttaattcctcccctttgaatatataagaagcatatacacacccttctgtataaatattgtcatgttgtctactgttttctcttgacaaaactatgttagagatctttccatacaggttaatcatccataatccaaaaatctgaaatccaaaatgctccaagatctgaaattttttgagcaccaacatgatacccacaatggaaaatgccacacctgacctcatgtaatgagtcacagtcaaactgtaagcacataacacaatttaaggaaaaaagatcctccccagcccccttcagctctgacatatcttttccatgcatgcacagattctcccacccaagcacatccaaagaagggtaataaaatggcacaggtacacgccagacgcaccaatgataggttccccacgatgccccacacggagccaagactgtgcattactcactgtgggtttttttgcttattctctgctttgttggataaagacaatgttgaaaatctgagtaagtgacagaaaaagaggaagcatttatgcttatctctagccaaaaagtcaagctgctggataaactggaaagcagtatgggaaatgtcttacaaaagagcatggtgttggaatgaccaccatatacaacctgaagaaacagaaggataaattgttgaagttctatgctgaagtgtcaatgaacagaagttaatgaaaaatttttcttaattgcagaaaaccaaatgaagatctcaaatgtgtactgaaagagtaaatctgtcagcacggcagagaaaacatactacttaatggtatggtgctcatgaaacaagcaaagatatatcatgatgaactgaaaattgaagggaactatgaatattcaacaggctgattgcagaaatttaagaaaagacacattaatttttcaaagatttgtggtgaataaagcaactgctgatcatgaagaagcagaaaaattcattgacaagtctgccaaggccatcactgatgaaaatctgacaccagaacaagtctataatgctgatgaaacatcacagtttagtgttagttccccagaaagactctgactacagcccctacaggataagaatgccatggacagagtaactgtcctgggaggtgctaatgcagaaggcacactaagtgtaaacctgctgtgtgggaaagattgggttcattattagactaacaaaaaggcatgggtcactagggacatcttttctgattggtttcacaaacattttgtagcagtggttcaggtttgctgcagggaagctggactggatgatggctacaagattttgttattccttgacaactgttctgctcatcctccagctgaaaaatctcattaaatataatgtttattccatgtacttttccccaaatgtgacttcattaattcagcaagtgagcagggtatcctcagatcaataaagaataaaaataaaaacactttcttgaacagcctacttgcagcagtgaacagaaatatgagcgtggaaggttttcaaaagcagttcagcatttagaatgctgtatatgctattgtcgatgactggaacacagtatctaaagacacagttgtgcatacctggcacaatctctagcttgcaactatgttcagtaacgatgatgaacaaggcaatgactttgaaggattctgtatgtcaagataaaaaaaaaaaaaaataggccaggagcggtggctcacgcctgtaatcccagcactttggaaggccgaggcggtggatcacgaggtcaggagaccgagaccatcctggctaacacggtgaaaccccgtctctactaaaaatacgaaaaataagccaggcatggtggcgggtacctgtagtcccagctacttgcgaggctgaggcaggagaatggcgtgaacccaggaggcggagcttgccgtgagccgagatcgcgccgctgcactccagcctgggcgacagagcaagactccgtctcaaaaaaaaaaaattaattaaaaattttaaaaataaataaataaaaataaaaaggtgtttgacttccttacatatacaaaaaaataccttcagagtctgtcagtaagttggaagaaatggatatcaaataagtttttaacattgataatgagtctccagttgctcattcattgaccaatggtaaaatagcagaaatgggctgggcacggtggctcacgcctgtattccagcactttgggaggccgaggtaggcgtatcctttgagctcaggagttcgagaccagcccgggcaaacggcggaaccctgtctctattaaaaaatacaaaacgtttggtgggcatgatggcacatgcctgtggtcccagctacttgggagactgagcctgggagatggaggttgcagtgagccgagatcacgccactgcactccagcctgggtggcagagttagaccctatctcaaaaaaagaaaaaagaaatagcagaaatggttctgaatcaaggttatggtagtagtaatgacaatgaagatgatgttaacattgcagaaaaagtgccggaagacaacatggtgtgatgggcttattttaggactagagtgcattcttaacagaataggaaatcacgtcactttataacatcaaagagagacttctaagacaaaagccactgttaatgaggcagacgattctcgaggaaacattttaaaaagccatccaagcaatggggaaaggattccctatttaataaatggtgctgggaaaactggctagccatatgtagaaagctgaaactggatcccttccttacaccttatacaaaaattaattcaagatggattaaagatttacatgttagacctaaaaccagaaaaaccctagaagaaaacctaggcaataccattcaggacataggcatgggtaaggacttcatgtctaaaacactaaaagcaatggcaacgaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacgatgaactcaaacaaatttacaagaaaaaaacaaacaaccccatcaaaaagtgggcaaaggatatgaacacacacttctcaaaagaagacatttatgcagccaaaagacacatgaaaacatgctcatcatcactgaccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagacagtgtggcgattcctcagggatctagaactagaaataccgtttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggtacatatacaccatggaatactatgcagccataaaaaatgatgagttcatgtcctttgtagggacatggatgaagctggaaaccatcattctgagcaaactatcacaaggacaaaaaaccaaacaccgcatgttctcactcataggtgggaattgaacgatgagaacacatggacacaggaaggggaacatcgcacaccggggacggttgtggggtgggtggagcgggcagggatagcattaggagatatacctaatgctaaatgacgagttaatgggtgcagcacaccaacatggcacatgtatacatatgtaacaaacctgcacattgtgcacatgtaccctaaaacttaaagtataataataataaaataaaataaaataaaataaaaaagccatccagcagaatgtttccttatccctagcagacctatttcctggcccctcagctgcttctgatgtttcttctcaactaaaaaaaaaaccacacagtgtataatagtaacctttcaatcaaaaatcagcatcataggtgaaaactaaaagcctgccgttgtttgttgttcctgttgtttaaaagctgatagaggtattctggtaatgccactgtgctgcttcattaccctgaacatattttttttccactgtattaatgttatgccatattttttgcagttaagtacttatgcatgagcaagtataagaaaatgattgcttatcagtagcatgtaaattcagagtcagaaatgaaggtgatgccaaacaactccacagactgtccacatgggtggctgagatagtgacacctttcctttctgatggttcaatgtatgcaaactttgtttcatgcagaaaattacttaaaatattgtataacattacctacaggctatgtgtataaggtagatacaaaaatttcatgtttggccttgggtcccagccccaaaatatctcattatgtatatgcaaatactccaaaaaacaaaacaaaacaaaattcagaaatctgaaacatttatggtcccaagcatctcagataagggattctcaacctgaataaagcatcaatgttcttttttacagctgcatcctattcaattacagagatatagcatatcttacttgcccagtcttttgcttatggacatccaggttctcttttgatatgataaacaatgctgcactgagtaaccttatatataagtcaatgaatgaatgaatgaatgaatgaatgaatgaatatatataaacttatatataagtcaatgaatgaataagtcatgtgctagtatatatgtggaataaattcccagaaatgaaactgagaatacagacacattcacacacacataaatataaaagtagatatgctgacaaataagtatataatcatgtaataatataattttaataatgtagtataacataagatcactattgtcataactatatggtaattattaaaattattgattacattatggtatattttacctattataattatatgttatataaatatatatacatatacactgatttcagcaagttgtcctccatagagtttgtactaatttattctccaacaagtaatatatgagagcccttctttcccacagttccatcaatagggtatttaatgaaattatttggattttagccaatctgtgatgaaaacttattagctcagtgtagacttaacttgtattattatgagtgaagttgaccatcttttcatatgattaagaagctaaatcacctacttgttctttgctcatttttccactgggttttcggtccttttcttatgtgtatacaaaggaaactagcccttttttcgagattataaacattttcatttggattttgacttcacttataagcttttagttttgcagtctatttgattttttgccatataaaaaatgtcattattttatttttgcaaatgagtggatggtaatgccatttactaaggtaagaaacacaggggaaaaaaaaaacagtctggaggggaacaagatgggctcaattctagtcatctaaaagtagatttccggtaagcaactggatttacaaatctcaggagagatttgaactagaaatataatttttggtgtcatcagcacattgcttaaagctttcagaagagacaaaatcatcaagaaaatgtctaagaaaaaataagagtcaaacacaaaacacatatcaaggaaacaccaatatttaagaaatgaggtcatgaagcacaagaaggtaatatttggctacatcaaaagctaccaaaagtgcaagcagcttgaaagtttaagtatccattgtagaacttccacttctagccaccaggtttatgacaggaagcagaattatctgtcagctgcaaatagctacaaaactcaacaaaatgtaagaaactattttcagatgctggctatcaggcattccagaactggatatactgaggtccccaagagaaggagaagaaataagatgagccctgccatcgcccaggctttagatctagagactatgtcagactgtagcacaggaaaagaagaactcaaagagaaccaagtaattttgctgagttgaagaaatagagcttagagtttggtgaggaatcaaggcaaatggaaattccattacagagtatcgggagaagggagctatgcagggaaaaggttcagcaatctatctagaggtttccatgaaatgccaatctgtgcatgcttacaaaacactcctcaaagcccagcaaaaccagtttcttaaggcgaaaaaaaatgaccagggaggaataaaaagcaaaattcccagacaaggcaatttatcacaaaatatcacaaggcagggaatctttcccactatccagagttgaaagaactccacgaatacaaaggtcattcagaaaagaactcagaacagcattattttagaaaggagattatattaccaaaagataaaggatattccagattctccctagaggagcttaaaaactaacctcaaaagcatcaagccaaaccacaagacaacttgcttaactgcctaccagaacgagtctgtaacttcttaagcaaagcaaaattcaacattcacaaatgtaaaattaacaatgtcaaaaaaataaaaaaaaaaattattaaacctatgagtaatcaggaactataactcataaagagaaaaattagccaataaaacagacccagaaacgaggtggtgaaattgataaaaatcttaagaaaacctcttatgaatatactttcacatactcacagatgttaaaggaaatggaaggtagggggaaagataaatggaaatttaagagataaaaaataaaatatttgctttcgttgctgcagcagacgctgtgagtattttcaatgcttcagaagaggcttgcctctagtgtcctccgctgtggcaaaaagaagatctggctggacaccaatgagaccaatgaaattggccatgccaactcctgtcagcagatccagaagctgatcaaagatgggctgattatccataagcctgcgactgtccgttcctgggctcactgccaaaaaagcaccttggcctgccagaagggcaggtacatggtcataggtaaacaaaaagggtacagccaatactcaaatgccagagaaggtaacctgggtgaggagaataggaattctgcatcagctgctcaaagatactgtgaatctaaaaagactgatcgccacatgtatcacagcctgtacctgaaggtaaaggggagtgtgttcaaaaacaggtggattctcatggaacacatccacctgctgaaggcacacagacccacaagatgctcctggctgaccaggcagaggcctgctggtctaagaccaaggaagcatgcaagtaccatgaagagcgcctccaggccaagaaggaagagagcatcaagactttgtccaaggaggaagagacgaggaaataaagctccccttctcttgtctgtacatagtggtcttggtgattatacagatcaatcattaaaataaaacaagcctttatctgctaaaaaaaaaaaaaaatctgaaatataaattttgttgaataagattaaaaggagattagacagtgcagcacaaaagatgaaatcatttgaaaaggaaaaagtgttatttaaataaaggaagaaacaaaaagcctgagtcccacatgaaaaagaaacaaatgggatgggaagtaaggaaagaaaagtaaggaaaggaaggagggaaataaggagaaacattttccaaattttatgtaaaccataaacccacacagatgcatcaaattcaacaaatttgaaaagataaaacacacaaagagagaaagaaggagagggagagagagagagagagagagaaccaaaatatattatgatcaaattgctgaacatcagtgagaaagaatactaaaagtagtcacaggaaagacatataggcatatctcagagatactgcaggttcagttccataccgcaacaataaagcaaataccacaataaagcaaataacacaaaaatgtttgttttcccaggatatataaatgtttacactatactgtagtctattatgtgtacaatagcattatgtctgaaaaaacaacgtacataccttaatataaaaataatgtttgaggtgaaggatacccactatgccctgatgattgttatgcattatatgcctgtatcaaaatatctcatgtacccaatatatacacctactatgtacccataaaaattaaaaataaaaaagattttaaacactttattgctaaaaatgccaatgatcatctgagcctacaacgagtcaaaatctttttgctggtggagaatcttgcctctatgttgatagcttctgcctgatcagggtggtggttgcaaaaggttgggttagctgtggaaatttcttaaaataagacaacaatgaagtttgccacatcaattaattcttccttcccaaaagatttctctatagcatgtgatgctgtttgatgcatcttactcacaagtagaactttcaaaattggaatcaatcctctcaaaccctgccactgctttctcaattaagattatggaatattctaaatccttttttatttccaagatggcagattagaggcttttagtgggcctcattcacttggaaatagcaagatagtgtacaaaggccaactctgagagctttaattcacaaaggaaaacaggaatccactggaatcgtgacagacacctcagatccaaggaagacacacaaacacaaacagcccctattatggcatccaattgataaaagtgagggaagcccaagtatgcaagacagtcagaaagcctccctctgtgactcacttttccactggagatctgagcaacccaggtcaagaaagagcactttgtttcttctaagccctggatctaacttggggacaagctgatttggagatgctgtgagggacagacactcggaaaagctactggcatttcccagacccaggatggagagcaggacactattttaaatgtgggtgcatgcaagtcaaccattctttggcaacccagtagcatggccacataggcttctggctctggagcaggacagaggtcttcacagccacactgtagttagtgcctcagcagtaggtgctgggattgtgctctcctccactgcaggtcaaggatgagagaagagctgctacagctattgtttctcctggacaaccagacttcaagccagatccagcttagcaacctggaactggtctgcatgtgccatgattggttgccacagcctgttcccctgtggtgcagcagggccctctctgctctactccctggcaaaaatccaggcatttggagcaactgtttgcctggacaagcaggctgaaccacctcacccttcatggatatagatcatggcacagtggaggcctctctgctccacatgcaggcagatctagagctattcagagcaccccctcacctgcaaccgcagtctgagttgccttacccttcctgtgtgtgcatagattgtggtacagtggggccctctccactccacatggagacagatacccaggcatctaatgcacctgctcacatggactagcagattgagttgccccacttttcctgtgcagagattctgtgcaggggggccctctctgctccatgcccaggcaaatctccaggcattcagagcatctgctcacctgaatcagcagcctgacttgcctcacccttcctgtgcagagatcctagtgtagggaggccctctctgcttcacactcagacagatctcccaggcattcagagcacccactcacctggatcagcagcctgaactgctccatccttctatacatagattatggtgcagcaaggcccttccactccattgcccaagaagatctccagatattcaaagtacctatttgcccaaattggcatattgggccatgccactcttcctatgaagagatctgggtacaggcaggccctccctgcttcatgcccaggcataactccaggcattcagagcacctgcttgcctggttcagcagcctacatcaccccaaccctcctccgcagaaatcttagtggtggtggggtggcagggggaccctttccacttcatatccaggcagatgtccagccatctggagcacctactcttcaggattaggagtttaagctgccacccatccctgtgcagagaacttagggccaaggaggtctcccagcttcatacccaggtacacctctgggtgcttggtgactacccactggattctccctatgcgctgacacttgtgcttgccactggagggtctggcggtgagcctgcccagtccagccctgcatatctttccctctgccccctcagggctgagcaggaaactcagactactgtacactccacaaatcagcccactgcctgaggcaacggagagctgctcccagtaaacaaggatcaaatatatacccagtcacactggcaacacctggctcttacccataagcttataggccaaactacacagcccaatataaaacctgccaactgaagtgcataggactataaaaacaaagccaaaagactctacacagcattatttccactcacaacccctaaggagtaggggaaagggaaagaagaaaaaaacaacattgtaagacaagaaagaaaaaatcctaccagtacgaaaataattacacaaattagcagtgccagtgtctccagatgggaagaaaccagtacaagaatactggcaccatgaaaaaatctgaatgtagtgccaccacagaaggatcacactagctctccagcaatggtccccaaccaacaaggacactcagaaatgacaaagaactcaaagcatgggttgcaaggaagctcagagatccaagacaagattgaaaatcaatactaaaaaacttcaaaggaaatccaggaaataagaggtaaagatttttaaaagaaatcaatcagagcttctggaaatgaaaaaggtttacttaagaaatttcaaaatataactgaaagctttatcaatagactggaccaagcaaaagaaagaatttcaggccaggcatggtggctcatgcctataatcccaacacttgaggaggctgacgtaggaagaccatttgagccaagtagcttgagaccatcctggaaaacataaagagaccgtgtctttccaaagaaatttaaaaattagctgggcatgatggtttgcacctatcgttctagctacttgggaggctggggtgaaaggatcacctgagcctgggagttcaaggctgcagtgagccatgatcacatcactgcaaaacagatgaacaaaaggaaaaaagaagaaaggaatgaaagctgatcttttgaactaacccagtcaacaaaaatagaggaaaatgaacttttaaaattgaacaaagtctttaagaaatacaggattatgtaaagcgatcaaacctataaattattagcattcatgatacagaaagagaaaaagcaaacaacctggaaaatatatttgaggaactaactcaaaaaaatttccctaatcttgctagagtagtagacatccagatacaacaaatccagacaacaactgtgagataatatacaaatccagacaacacttgtgagataacatacaaaatgaacatcaccaaggcatatactcaccaggccgtccaaggtcaatgtggtgcggtggctcacgcctgtaatcccagcactttgagaggccaagacgggcagatcaagaggtcaggagatcgagaccttcctggccaacatggtgaaaccccgtctctactaaaaatacaaaaattagcttggtgtggtggtgcatgcctgtagtcccagctactcgggaggctgaggcagaagaatcacttgaacccaggagctggaggttgcagtgagctgaggtcgcaccactgcactccaatctggcaacagagcgagactccacctcaaaaaaaaaaaaaaaaaaaaaaaaaaacaagaactgaaggaagagatatttaatgaaatagatagcataaataaaaaaacttcaggaaacaatggacacatttacagaaatgcaaaatgctctggagagtctcagcaatagaatcaaacaagcagaagaacgaacttgagagctcaaagacaaggtttttgaattaacccaatccaacaaagacaaaggaaaaagaataagaaaatatggacaaagcctccaagaagtctgggattatgttaaacgaccaaacctaagaataatcagcattcctgagaaagaagataaatctaaaagtctggaaaatatatttgggggaataattgaggaaaacttcccagccttgatagagacccagacatccaaatacaagaagctcaaagaacacctggggaattcatcacaaaaagatcatcgcctagacacactgtcatcaaattatctaaagttaagacaaagaaaagagtcttaagagccatgaggaaaaagcaccaggtaacctttaaaggaaaacctatcagattagcagcagatttctcagcaaaaactttacaagctagaagggattgcagccctgtcttcagcctcctcaaacaaaacaattatcagccaagaattttgcacccagcgaaactaagctacataaatgtcggaaagatacagtctttttcagacaaacaaatgctgagagaatttgccactaccaagccagcattacaaaaactgctaaaaggagctctaaatcttgaaacaaagccagaaaacacatcaaaacagaacccctttaaagcataaatctcacaggacctacaaaacaaaaatacaatttaaaaaacaaaacaaaacaagaaaaccaaggtatacaggcaacaaatcgcataatgaatggaatgatacctcacatctcaataccaacgttgaatgtaaatagcctaaacattccacttaaaagatacagaactggccgggcatggtggctcacgggggtaatctcaatactgggaggccgaggcaggcagatcacaaggccaggagttcgagaccagcctggacaacatggtgaaaccctgtttctactaaaaatacaaaaattagccgggcgtggtggtgcgcgcctgtaatcccagctactcaggaggctgagacaggagaactgcttgaacccaggaggcggaagttgcagtgagccctgattataccactgcactccagcctgggtgatggagtaagactccatctcagaaaaaacaaacaaacaaacaaacaaaaaaaaaaatacatatataattgcagaacggataagaattcaccaaccatctgctgccttcaagaaacacacctaacacataaggactcacataaacttaagctaaaggggtggaaaaagacattccatgcaaatggacaccaaaagcgagtaggaatagctattcttataccagacaaaacaaactttaaagcaacagccattaaaaaagacaaagagagtcataaaaggccttgtccaacaggaaaatatcacaatcctaaatatatatgcacctaacactggagctcccaaatttataaaacaattactaatagacttaagaaatgagacagcaactataatagtgggggacatcaacactccactgacagcactagacaggtcatcaacacagaaagtcaacaaagaaacaatggatttaaactataccctggaacaaatggacttaacagattatacagaacattctactcaacaactgcagaatatacattctattcaacagcacatggaactttctccaagatagaccatatgagaggccacaaaacgagcctcaataaatttaagaaaactgaaataatatcaagtactctctcagaccacagtggaataaaatggaaaatcaactctaaaaggaaacttcaaaatcatgcaaatacatggaaattaaataacctgcttttaaatgatcattgggtcaaaaatgaaatcaagatggaaatttaaaaattcttcgaactgaacaacaatagtgacccaacctatcaaaacctctgggatacagcaaggcagtgcttagaggaaagtttataaccctaaatgcctacatcaaaaagtctgaaagagcacagacaatctaaggccacacctcaaggacctagagaaccaagaacaaaccaaacccaaacccagtataagaaaggaaataaccaagatcagagcagaaataaattaaattgaaacaaaaaaaatacaaaagataaatgaaacaaaaagctggttctttgaaaagataaaataaaattaatagaacattaacaagattaccaagaaaagaagaaagaaaatccaaataagctcaattagaaccgaaaagggagatattacaactgataccaaggaaatacaaaagatcattcaaggctactatgaacccctttatgtgcataaactagaaaacctagaggagatagataaattcctggaaagataaaaccttcctggcttaaatcaggaagaattagataccctgaacagatcgacagcaagcagcaagattgaaatgataatttaaaaattacaaacaaggcacctgggaggccgaggcaggtggatcacctgagatcaggagttcaagaccagcctgcccaacatggtgaaaccctgtctctacttaaaatagaaaaaagtagctgggcgtggtggtaagcagctgtagtcccagctactcgggaggctgaggcaggagaattgcttgaacccgggaggcagaggttgcaatgaggcgaaatcgcgccattgcactccagactgggggacaagaaggagacttcatctcaaaaaaaaaaaaaaaaaaagtccaggactagagagattcacagcagaagcagaagtctaccagacattcaaagaagaattggtgccaatcctactgaaactataccacaagacagaaaaagaaggaaccctcccgaaatcattctatgaagccagtatcaccctaataccaaaaccaggaaaggatgtaaccaaaaaagaaaactacagaccaatatccctgattaacatataagttaaaatccttaacaaaatactagctaaccaaatccgacaacatatcaaaaagataatccaccatgatcaagtgggtttcataccagggatgcagtgatggtttaacatacacaatgtgatgatacaccacgtaaacagaatcgaacacgaaaatcacatgatcgtctcaacagatgcagaaaagcattcaacaaactccaacatccctctatgattaaaactcagcaaaatcagcatacaagggacatacctcaatgtaataaaagacatctatgacaaacccacagccaatgtaatactgaataggaaaaagctgaaagcactccctctgagaactggaacaagacaaggatgcccactctcaccactcctcttcaacatagtactggaagtcctagacagaccacttagacaagagaaagaaataaagggcatctaagccgggtgtggtggctcacgcctgtaaccccagcactttgggaggctgaggcaggtggatcacgaggtcaggagttcgagatcagcctggccaacatagtgaaaccccgtctctactaaaaatacaaaaacttagttgggcatggtggcaggcgcctgtaatcccagctacttgggaggctgaggcaggagaatcacttgaaccccagaggcagaggttgcagtgagctgagatcgcgccattgcactccagcctgggggacagggtgagactccgtctcaaaaaaaaaaaaaaggcattcaaatcggttaagaggaagtcaagctgttgctgtttgctgatgatatgattgtttacctagaaaaccctaaagactcccacagaaagctcctagaactgataaaagaattcagcaaagtttccagatacaacattaatgtacacaatcagtatctcttctatacaccaacagcgaccaagctgagaatcaaatcaagaacttaactcctcttacaatagctgcaaaaataaataaaatacttaggaatacacctaaccaaggaggtaaaagacctctacaatgaaaactacaaaacactgctgaaagaaatcatagatgacacaaacaaatggaaacacatcccatgctcattgatgggtagaatcaatattgtgataatgaccatactgccaaaagcaatctacaaattcaatgcaattcccatcaaaataccaccatcattcttcacagaattagaaaaaacaatcctaaaactcatatggaaccaaaaaagagcccacatagccaaagcaagactaagcaaaaagaacaaatctggaggcatcgcattacctgatttcaaactatactctaaggccacagtcaccaaaacagcatggtactggtataaaaataggcacatggaccaatggaacagaaagaacccagaaataagcccaaatacttacagccaactgatattcgacaaagcaaacaaaaacaaagtggggaaaggtcaccctattcaacaaatggtgctaggacaactgacaagccacatgtaggagaatgaaactggatcctcatctctcaccttataaaaaatcagctcaagatggatcagggacttaaatctaagacctgaaactataaaaattctggaagataacattggaaaaactcttctagacattggcttagtcaatgatttcatgaccaagaacccaaaagcaaatgcaataaaaacaaagataaatagctgggacttaaactaaagagcttttgcacgacaaaagaacggtcagcagagtaaacagacaacccatagagtgggagaaaatcttcacaatctatacatctgacaaaggactaatatccagaatctaaaacaaacacaaacaaattaagaaaaaacaaacaatcccatcaaaaagtgggctaaggacatgaatagacaattctcaaaagaagatatacgaatggccaacaaacataggaaaaaatgctcaacatcactaatagatcaagaaatgcaaatcaaaaccaaaatgcgattccaccttacttctgcaacaatggccataatcaaaaaataattgatgttgtcggggatggagtgaacagggaacacttctgcactgctagtgggaatgtaactagtacaaccactatggaaaacagtgtggagattccttaaagaactaaaagtagggctgggagcagtggctcacgcctgtgatcccgacactttgggaggccgaggtgggcagatcacctgaggttgggagttcgagaccaggctgaccaacatggagaaaccccgcccctactaaaaaaaaatacaaaattagctgggcatggtggcgcatgcctgtaatcccagctacttggaagactgaggcaggagaaatcactttaacccaggaagtggatgttgcggtgagctgagattgcaccattgcactccagcctgggcaacaacagtaaaactccgtctcaaagaaaaaaaagaactaaaagtaaaactaccatttgctccagcaatcccactcctgggtatctacccagaggaaaagaagtcattataagaaaaagacacttgcacgcaagtttatagcagcacagttcgcaattgcaaaaatgtggaaccaacctaaatgcccatcaatcaacaactggataaagagactgtatgtgtgtgtgtgtgtgtgtgtgtgtgtgtattacatatgtgtgtacatatatgtgtatgtgtgtgtgtatgtatatatatgatggaatactactcagccataaaaaggaatgaattaatggcattcacagcaacctagaggagattggagactattattctaagtgaagtaactctggaatagaaaaccaaacatcatatgttctcactgatatgtgggagctaagctatgaggacgcaaaggcataagaatgacacaatggactttggagactcagggggaaagggtgggaagcggataagggataaaagacgacaaattgggtacagtgtatactgctcaggtgatgggtgcaacaaaatctcacaaatcaccactgaagaacttactcctgtaaccaaacaccacctgttccccaataacttatggaaattaaaaaaaaattttaataaaaaaatggagaaaccccatctctacaaaaaatacaaaaaattagccagatgtggcggcacaagcctgcagccccagctactcaggaagctgagatgggagaatcacctgaatctgggaggttggagccgaaattgtaccactgcactccagtctgggcaatcagagtgagacagtctcaaaacaaacaagcaaacaaatacttctagacctaggaaaagacttaaacaaccatacataataatgggagacttcaacagcccactgactaatgcattagcctgaccactgaggcagaaaactaacaaagaaattctggacttaaattcaacacatgatgaattggacctaacagacatctgcagactacttcatccatcaaccactgaagatacactgttctcgtctgcacatggaagatactacgagatcaaccacatgctcggccataaaacatgtctcaattaattcaaaaaaaaaacaaaatcataccaaccatactctcagaccacagtgtaataaaaataaaaatcaataccatgaagatctctcagaaccacataattacatggaaattaaacaacttactcctgaatgacttttgggtaaacaattaaattaaagcagaaatcaaaaagttctttgaaataaatgaaaacagagtatcaaaatctctgggaagcagcaaaaaagtataaacaggaaagtttacaacactaaacacctacctcaaaaaatcagaaaaatctcaaatcaacaatctattatatctagaggaactagaaacaaaagaacaaactaaccataaagacagcagaagaaataaaagcaaagaactaaatcaaattaagaccaaaaatacaaaggatcgatgaaacaaaaagttggttttctaagaggaaaaacaagaccgacagactgcaagctagattaacaaaagaaaaaagagagagaagatccaaataagcacaatcaaaatgacaaaggtgacaagcaaccaatgccacaaaaatacaaaagttccttagggacaattatgaacactcctatttacgcaaactagaaaacctagagaaaatggataaattcttggaaacccacaatctcccaagattgaatcaggaagaaatagaaaccctgagcagacatcagtattgaattctgaaattgaatcaataattaaaaacttatcaaccaaaaaaatccctggaccacatggatttacagccgaattctatcagatgtacaaagaagggctggtatcaatccttctgaaactattccaaaaatcaaggaggaactcactgcaactcattcgaaggatgcatcaccctgatacgaaaacctggcaaagacacaaagaaaaaagaaaactacaaaccaatatccctgatgaacataagacacaaaaatcctcagtaaaataactagtaaaccaaggctcggcacagtggctcacgcctgtaatcccagcactttgggagcctaaggcaggtgggtcacctgaggttgggagttcgagaccagcctgaccaacatggagaaaccccggctctactaaaaaacccaagttagccaggcgtggtggtgcatgcctgtaatcccagctactccagaggcttgaggcaggagaatggcttgaacccgggaggcaggggttgctgtgagacgagatcgcgccattgcactccagcctgcgcaacaagagccagacaagagcaaaactccgtcgcaaaaaaaaaaaaaaaaaaaaaaaaatatatatatatatatatatatatatacatactagtacaccaaatccagcagcacatcaaaaacttaattcactgtggtcaagtaagtttcattcctgggatgcaaggttggttcaacatatgcaaatcaataaatgtgatccaccacataaacagaatttaaaataaaagtcatatgaccatcccaacagacatggaaaaagctttcaataaaatccaacatcccttcatgataaaaaaaaaaaaaaaaaacctcttgaacaaactagacatcaaaggaacatacctcaaaacagtaagagccatctatgacaactccacagccaacatcatactgaataagcaaaaaatggaagcattccccttgagaactggaataagacaaggatgcccactcttagcacccctattgaacacagtactggaagtccttgccagaacaataaggcaaaagaaagaaataaaaggcatccaaatagaaaaaggagaaggcaaacaatatctcttcacggaaaatatggttctatacctagaaaacctgaaaggctccaccaaaggctcctggaactgataaactacttgagtaacgtttcaggatacaaaatgaacaaaaaccagtagcatttctatacaccagtaacgttccagctgagagccaagtcaagaacacgatcccatttacaatggccacaaaatacaatacaatacaatacaatacaatacaatacaatacaatacaatacaatacaatacaatacaatacctaggaatacatctaaccaaggggatgaaggatctctacaaggagaactataaaacactgctgaaagaaatcagagatgacacaaacaaatggaaaaacatttcatgttcatgaagtggaaaaatcaatatcattaaaaataaaaaacatttcatgttcatgaagtggaaaaatcaacatcattaaaatggccacacagcccaaaggaatacacagattcaacactattcctatcaagctaccaacatcattttggacaaaactagaaaaaaactattctaaaattcatatggaaccaaaaaagggcctgaacagccaaggcaactgtaagtaaaaaggacaaagtcagagatatcacattacccaacttcaaactatactataaggctactttaaccaaaaaatcatggtactggtaccaaaacagacacatagaccaatggaactgaaaagagaacccagaaataaagctgcacacctacagccatctgatcttcaacaaaattgacaaaagcaatagggaaaggactccttaattcaataaatggtgctgggatagctgactagccatacgcaaaagaatgaaactggacccctaactcaagatagattaaagatttaaacagaagacctcaaactgtaggaatcccagaagaaaaaagaggaaacaccattctggacatcagccttgggaaagaatttatgactaaaagcaattgcaaccaaaaaactgacaagtgggacctaattaacctaaagagctgcttttgtgcagcaaaagaaactctcaacagagtaaacagacaatctacagaataggagaaaatatttgcaaactatgcagccgtcaaaggtctaatatctagaatctgtaagaaacttaaatcaaaaagtaaaaagcaaataatcccattttaaaaatcggcaaaagacatgaacaaactttcatcaaaagaagacatacaagtagccaaacatatgaaaaaatgctcaacatgactaatcataagagaaatgcaaatcaaaaccacaataatataccatttgtaccagtcagaatgacaattattaaaaagtcaggcctcggatttctggactgatagtgagcactggcttcaacttaaagtcaccaacctcaccagtccctaacaagaaagtcagcctgtactttgaagttttgaagccagccactgacatcttttccctagctatgacagtcctagatgacaccatcttccagtagaaagctgtttcatctacattgaaactctgttgtttacagcagctacactcatcgattaccttaactagatcttctgataacttattgcagcttctatatcagcatttgctgctagtgggtggtttcttggcccacctgaagggcagacagcttttgcttctacttgcccatcagaaacatgattttttgcctggagtcagaatgaaaaatattcctatccttcccccatcagcagatggcttttccttctctctctctcccttaggacaagtatatcatgtgcaaggattggaagacaatatttttaaactcaatcctccccagtttgagcttagatcaaggcaataagaatcaaaatcccagaagcctttctggtatgtcattacacatcactttgaaaggtgcatgccaaaactgagagaaagtaagataactgactgcaaaggaacacaacacaactttttgaggtggtagaaatgttctaaatcttgatttgggtgagttacaggattatacacactttgtcaaaactcatcaaactgcacacttagagaacatgaactttattatataaaaatattaatgatcctatcttttaaaacttcagccagtttttctagtagaaattgacaagctggcaatcttagagtttgtgtattttcttcaatgctgctcagaactctgacagtagaatttgtccagagttagcattttccaggcagatgccacagaacaacaatgatataagggagttaaagatattagcaaaagaatggttgatgaaatagaccgagcagagaaagaaattttaaaagagggaggggaactaatgagcagggagaggaataaagtagaaacattttgtgaacgattaaagagcatattcctatagaaagagaagcaatcttttttaaaaattgacaattgtgccttagaaatcaaagagacttcaccttcatggctaagctcaagatgaagccatccacatgatacagcaatagaggcagcactatactaacaaatctcattaatattaaaccaaacaagtaatctaatggctacattattctccaggagtaaaaagtttgcttcaaggcagctcataatctggctcactttaaacaaataagtcaaagatcccccaaatgaatccagtaaacacgagaattttctatatttctatatttctatgtcaatataaaatacacatacaacacaattttctattttcctgacttggcaaacacaatataatgtacagagtttcatctgtctttgacatattgtgaattttaacacctcagaatatcatcataaaggtaatgtttttaatcaaaggcccccaaaaacgttattcttgactgagtggctttagagcatgtactcttctagttgcttgggaattttgtggagaacaagttacccacaaagtacctctcctggaagttaaaacagaggatttcttatatgcttaggcagacatactctagaatcatctttttaaaataagcaactagcaaatgcaatctggttttcctattgctatgttttggatatgtcccctccaaaattcaggtgctgaatctaaacggtcaatgtcatgtattaaaaggtggggtactttcagaagtttgaggttatagtgagctatgatcatgccaccacactccaacctaggcaacagagcaagaccctttaaaaaaaatcaggcctttaagaggtaattaggtcatgagggctcctcacctcgtgaatgggattaagaccctaatgaaagagatttcacccctgtcctttcacaatgtgaaaacacagcattcctcaccaccagaggatatagcaacaagacactatcttggaggcagagagcagcccttattggacaaccaaacctgctggcagcttgatcttggacttcccagtctttagaaccatgagtaaataaatttctcttctttataaattacccagtctatggcattttgttacagcagcacaaacagacttaagacatctatcatttgactatctcattaagtttaggcaagagcataatctcctattatactggcaatggaaatatactgaatcaaagataaaagcaatcatttttaaacattagtattacatgcagtgcaaaaacccaaagtgacggcagtcttacattgccaaagccatcaaaaggggaaggagagggaagaacagcagcataagctgctggcagaggcagggaaagacaagcagaaaggaaagagagaaagagacaaagtcagagagacacaggggaagagacagagagaaaaagagggagtcacagagaaagagagagacaacaaagaagtcaaaaagaaagggagatagaattagtaaagaaaaaagcagtgtaccctattcctttaaaagccagggtaaggttctgtctacccagccaaggtatattcttcttatgtggaatgtctacctatatctgcctccccactaactggaccggcacctgcaccttagtctttccaagttccaacattaacattgccccaggaaatcagaccctatcagtacccctcaaagctcaagtccatcagcacagagccatacaactaatacccctacttaatagggttaggaatggctactgctacaggaaccggaagagccagtttatctacttcattatcctactaccacacactctcaaaggatttttcagacagttttcaagaaataatgaaatctatccttactctacaatcccaaatagactctttagcagcagtgactctccaaaactgccgaggcctagacctcctcactgctgagaaaggaggactctgcaccttcctaggggaagagtgttgtttttacactaatcagccagggatagtacaagatgccacccagcgtttacaggaaaaggcttctgaaatcagacgcctttcaaattcttataccaacctctggagttgggcaacatggcttctcccctttctaggtcccgtggcagccatcttgccgctactcgcctttggaccctatatttttaacctccttgttttgtttcctctagaattgaggccaccaagctacagatggtcttacaaatggaacctcaaatgagttcaactaacaacttctaccgaggacccctggaccgacctgctggcactttcaatggcctagagagctcccctctggaggacactacaactgcagggccccttcaaagcccctatccagcaggaagtagttagagcggtcatcggccaaattcccaacagcagttggggtgtcctgtttagaggggggattgagaggtaacaacgtgctagcagccctcactcactctcagcacctcctcggcctcggtgtccactctggccacgcttgaggagcccttcagcctgccgctgcactgtgggagcccctctctgggctggccaaggccggagccggctccctctgcttgcgggaaggtgtggagggagaagcgtgggcaggaaccaggactgcgcgcagcactcatgggccagcacgagttccgggtgggtgtgggcttgatgggccccgcactcagagtggccagctgatgccgccagccctgggcagtgaagggcttagcacccgggccagcagctgcggaaggggcaccgggtaccccagcactgccggccctcccgcgctgagctcgaattcttgccaggcctcagccacctccccacagggcagggctcaggacctgcagccccccatgccagagccccccccaccaaggtgggctcccgtgcagccggagcctccccaacaggcgctggcccctgctccacggcgtccggtcccataaaccgcccaagggctgaggagtgcaggcgcacagtgcgggactggcaggcagctccacccgtggccctggcatgggattcactaggcgaagccagctgggttcctgtgttgggtggggacttggagaacttttatatctagccaaaggattgtatatgcaccaatcagcactctgtgtctagctcaaggtttgtaaacacaccaaccagcactctgtgtctagctagaggattgtaaatacaccaattagcactctgtctagctcagggattgtaaacgcaccaatcagcaccctatcaaaacagaccaatcagctctctataaaatggaccaatcagttctctgtgaaatgggccaatcagcaggatgtgggtggggtcagataagggaataaaagcaagctgcccaagccagcagtggtaacccgctcggtccccttccacactgtggaagctttgttctttcgctctttgcaataaatgttattgctgctcactctttgggtctgcactgcctttatgagctgtaacactcacctcgaaggtctgcagcttcactcctgaggccagcgagaccatgaacccaccgggaggaatgaacaactccagacacactgctttaagagctgtaacagtcaccgcaacggtctgtagcttcactcctgaagccagcaagaccacgaacccaccagaaggaagaaactccaaacgtgtccgaacatcagagggaacaaactccggacacaccatctttaagaactgtaacactcaccacaagggtccacagcttcattcttaagtcagtgagaccaagaacccaccaattccagacacattaggatatgccttttttttttcagtgacatccaaattctctagcacttcaaaacagtaagcttgttgtatctcatttttgttgtttcctgttcaatgtaagaatttccagccagaaacagtggctcatacctgcaattccagcactttggaaggtcgaggtgaaatgactgcttgaggccaggaattcaaaactagcctgggcaatgtagcaagatcctgtctctacaaaacattttaaaattagccaggcatagtaatgggtgcctgtagtcctagctattgaggaggctgaggcaggagaatcccttgagcccaggagtatgaggttatagtgagctatgactgtgccactgcactccagcctggactacagagcaagaccctgtctcttaaaaaaataaaaaaggaaaaaataattctgtcaaaatttttcctagctctcaatacaaagttttctaaatcttgaggggaggtgaagattctgtatagaatagtctccattttctccaaattcttcctaattttttataatttcaagaataagttacatttcaaattataccacagataatgctaatatggtgataaattatttaatattcttatcatttagagatgcatgctacaagttaagaacatatctaagattaacttcaaaataataaaggatgcagtatatataggggaatatattatgtaagattggccaaggaattaataattgttgaaactgggtgatgaatacatataggttcactttctcaactttgctaaactatgtttaaagttctccctaataaaaagatttttaaagagtaaacaataggtattaaatctaattaaattgttcttagaaataattagacacaaaaaacagtattaattgtaaattatttataacaaaatttagaaggaaattaaatgtccaaacataaaatattaattagttatagaacactcattccatgagataccaagtagccactaaaaatcatgttgcagaaaactcattgatataaaaagaattcacaatatacttctaagagaaaaaaaggcaggttacaaaataatatgtacagaattgaaccattttttaaatgtgagcatctgtgtgtgtatgtgcgtgtttgcatatgtgtgtatttctgccaaatactgacagactttgtttcattcactgctttatccccagcacaaaaaactgtacctggaacataataagaacaatacatacttgttgcaggtaaaggttttagaattccagacaacagggtttcccttggggtatgattctctctacgcttttgtttcatacggtttctcaaataaacattcagttttttctgttattgggggaaaacctttaaaattgtatctcacataacaaaattaaaatttatttgcctgattcaataattacttcatgaaatgcattcaataaaatcatcttatacactgaaaaaagaaaggcctcttctatactttgaatgaataaactggccacggcaatcagaaatagtaaaaacaggccaggcatggtggctcacgcctgtaatcccagcactttgggaggccaaagcaggcagatcacgaggtcaggagatggagaccagcatcctagctaacatggtgaaaccccgtctctactaaaaatacaaaaaattagccgggcatggtaggggacgcctgtagtcccagctactcgggaggctaaggtaggagaatgacatgaacccaggaggcggagcttgcagtgagccaagatcgcgccactgcactccagcctgggcaacagagtgagactctgtttcaaaaaaaaaaaaaaagaaaaaaaaagaaaagaaatagtaaaaacaataacctgttaatcagtcttatccctgtgagtgaattctgctgctgagcaataacataaccttactatctttaggaaactaatacttctaaaatgaatctttaaaacgggtacaaaaaattataaaatcagttttaaaaaattagtccattatattcattcaatacacacttactgaatttgtagacaataagttacctgctagggtaatccaaagaaaattaagttgtagcccttgataaccaagaggctcccaatctagtgggaaagatagatgaataaaagctaaatgaaacataataataaaggtagctgacatttattaggttctttttttggcattgtgctgacacttaacaagcattttctttcttttttttttgagacagagtctcactctgttgcctaggctggagtgcagtggtgcaatcttggctctctgcaacctccgcctcccaggttcaagcaatcctcccaactcagcctcccaagtagctgggattacaggtgtacaccaccacgcctggctaatttttgtatttttagtagagatggggtttcaacattttggtcaggctagtcttgaactcctggcctcaagtgatccgcccacctcggcctcccaaagtgctgggattacaggcgtgagccaccacacctggccaaacaagcattttcttatttaatccctataacaatctttttggtagttactacgatattctcagtttttagataagaaaacgttaagacttaaatgacttcctcagtcacttgagtaataaatggcaaaacagaatcaaaccaaataaaccctgtcccagatacaatatagtgtctctcattattaggatgctagtaaacaccaaagtggactctatcagttccatcagttactatcaagtataacacaatagtcaccttttttaaggtagatatccttttggaagtcttcccaagaatttcttatcttcaactcaactagttatctccactttgaaatacactattacaaccattaacctatgagcctctagagcacaggattcagtagtttctcttctcccagtgctatacaatgtatgcactcaagaaatattaaacagatgaacttttagcttcttttatgcttcctaaattccaaatcactatgccatattacataatagttggtctaggtcaatagcaatttcatttatgttattaggaaaatgtggtatgagagaatcagagaataaaattctgaagtgctaaattatggtggttatgctaatggcggaacactgctgactgtataagatgaaccaagatactcttcctccagggacttcttcctaatcttctaaatgtcctataagccaaattttataagagaactggaaatgtgcaaaactagggggtagttttgtttcttgcaaaaatctggtgataaagatctgagctaaaaatagcgagaatgatgggaaataattcaagagatatttcaaaagcagaatcatttctcactacatgcaagacaaaactcataactaactgcggaacctaagaccttctcagtcatctcatttctgtttcctacagcctagccagagtgaactacttcttaaaggtcctgaattctcacataacattttaaaactcccacaataactgtaatataggccgggcgcggtggctcacgcctgtaatcccagcactttgggaggccgaggcgggcagatcacttgaggtcaggagttccagcctggccaaaatggtgaaaccccgtctccactaaaaatacaaaaattagccaggcatggtggcgggtgcctgtaatcccagctactcgggaggctaaggcaggagaattgcttgaacccaggaggcagagttgcagtgagccaagatcatgccactgcactctagcctgggcgacaagagcaaaactccatctccaaaaaataataataataataataataataactgtaatataaaaagcagatagtgtgcagtcacttgtatgttacataagaaatagacagtagaacacaggaatgggaaaggcattcaaattttgtgttggaaaatgaatgaatgaagataatgcaggagaccttcataactgatttgagaagggactagcagctatctcttcatgatgagataatacaggccctacctctatatcaccattttctcttacaacatgatcttccccttctctctgcctgtcaaaattaaccacctccttaaagacacaatcaaaaattttctctgggaagtttaaagaaatcacctcctcacttctaccactgtccccacccatccacacaagcacacacacatacacaaagaactagtcccactgtctactatggtcccacagcacttggcacctgcctcattgtagtacttagtacagtgattcattattcctttcattattatgtactgtatgagaatatcactagagctagaatatgaattccataaagatatggatcatgtcttatctagcctatttccattaaatacctaccacagaacctcacacactactgtttaaataacatatctaataaataaatgaataaacaaatgaaaacaaatttgctaactcctggagacctaaaggaacctcaaaatgtctgtgacttaaaacatgcctttatgggaaaaaaaaaatatatcttcctatataaacgcttatggctaaccatgacctgcttcaacttaaatcagttttgctaccacagcaataaaaaatacacatatatggctagaagtcgatgcaaaggccaaaagcatccctaccagggctgaaatggccaatggggatattccaaattttatggttgcaaaatgacccaattaatcttagatttcagcaaagtatacatgctaactgaacaaagacaaaagtcactggagctcaagtcattattccaagtgactctaagctgttagtccctgtgttaatggagcctgttaaacaacccagtattagaaaacactggagctcagagggagcatgctaccccatgcacatttcccaagtatcctcacaataaacttctattactgaagataatctatgtacttctctaccttgagtcttaagagacctaagtaacagtaaataatataggaaaccaagcagaggaaagaatcacacaccaaatgtgaactggaaaaagtgacaacgccaattagtaaagattaggtgggctgaacacggtaagattaggtgggctgagcacggtggctcacgcctgtaatcccaacactttgggaggccaaggcaggcggatcacaaggtcaggagatcgaaaccatcctggctaacacagcgaaaccccgtctctactagaaatacaaaaatttagccaggcgtggtggcgggcacctgtagtcccagccacttgggaggctgaggcaggaaaatgccgcaaacccaggaggtagagcttgcagtgagccaagatcgtgccactgcactccagcctgggcgacaagcgagactccgtctcaaaaaaaaaaaaaaaaaaaggattaggtagaaggtgaggattcagttctgaacataatgcctttaaggagacagtaatcaaatatttgggtttttggttttgggggtttctgttttgttttggagacagagtctcattctgttgcccaggctggagtgcaatggcatgatcttggctcactgcaacatctgcctcctgagtccaaacaattcttgtgccccagcctcccgaggagctgggattacagaagcacactaccatgctcggttaattttttgtatttttagtagggatggggtttcgccatgttggccaggctggtctcaaactcctggcctcaagagatccagccacctctggctcccaaagtactgggattacaggtgtgagccactgtacccgaccagtaatcaaatgttatttaggagactggaaatagtgaataagactgagtacaaaaattccaagtctcaaaagtatttgtgggtcatttcaatcaaattgaagccattagagtagataaactcaccaaggaaataactatgcaaaataaataaataaaggaggaaaagatagaaaatgcaaagtcactgtcaattatgcactgtgaagatcagttcataaccgaacataaagcaggcagagaaacagaggcaacaggagaatcaaaatgccagagaaaacttcaagaaacagatatgaggaatgttaagaacagagaaaaagtttctggtcttgccaaaacaataactaatttgcaacctagagtagtttcattaataaacaaggcctgaccatgttggaaggctgaaacagaatacactcgtagaaacagatttttaaactggggggcaaaagtgtgattacaggaataaagtcctaagagctatgaaaagggacatgttcaaaggtcagataaaaggaagaagagaaaaaattgtcgtgtgacagaagcaaaaattatgtagaacaataatcaaatgaaattaagatgaaagtacataaggcagcacctcttcctaacagccactgtatttcaatcttctctaagaagtagcagaaagcatctgtgttaaattatatgaaaacatgagggcaggacaggaaagaaagtgtgaagtgagaggactggagctgtttctgaaaagtctgcaaacaccaaaacacatgaaacagctcagtcagtcataaaaggccttacggcagaaaaaatgaagggactatatttggtcctctttctttattttctctgtttccaaccttggaacagcagtttgcaagtttgtggacaggttgtaacttctgctaaggatgtctcttcagttttgaagagactcaggaaaagttcagaagaaaggagagagctgtttatgattggctaaaggcttttttttattattgtggcagaatatacacaacataaagtttactattttaacatgtacaattcagtgatccatacattcagctcttgtgcaacaattactgttatccatttcccaaactttttcatcatctataatatggtgatctagtaagaaattcctggcacactgcccctaaaacctttggaatttcccgaatgataagggtggaagaattatcttttgctattcataataagtccctttcaaacatatttgagcttatgctaaagagatgactcttggtaggcccctacaaagctgcaggggagtgggtagggaagctggtcacccaagaaatcaatcatgtgattacatagtcagaactttcagccccacctccagggaggggagaaggactagagactgacctaatcaccaatgaccaataatttaatcaatcatgcctacagggtgaagcctccataaaaaccctaaatgatgggactcagagaatttcttctggatcgatgaacacatccacgtgctgaaagagtgatgcaccccaactccatggagacataagctcctgcactggggacccttccagacctcaccctatgtgccttttcatctgtatatcctttataataaactggtaatagtaagtaaagtgtttccctgcattcaatgaatcattgtagccaatgactgaacttgatttgtagccaagtcagaagtaccagaggcctggggcttgcaactggcatctgaagtggtggaagtcttatacaactcagtccttaacctgtggtgtctgacactcactccagggagatagtatcaaaattgaattaaatgctaggacagagaactgagagctgtagggagaaaaccccatgtatttggtgtcagaagtcttataagtgtagaaaaagttttttatcatctccaaccaaaattctatacccattaaataactttccattttccacttccccatagtcccgtgtaaccactattctactttctgtttctatgactttgactattctagtggaatcatacaaatttgtccttttgtgtgtactttgcttcagttagcataatgttttcaaggttcatccatgttgtaacatgtatcagaattttatccctttttaaggctgaataatattccattgtatatatatataccacattttgtttatccattcatccgctggtggacacgtgagttgcttccacctttgggctgttgtacataatgctgctatgaatataggcacacaaatatcttgagaccctgctttcaattcttttgggtattgcattaatccgttctggcgctgctataaagaaatacctgagactcggtaatgcataaagaaaagaggtttaattggctcatggttctgcaggctatacaggaagcatagcagcttctgctctgcttttggggaagcctcaggaagcttccaaccatggtggaaggcaaagggggagtagcacttcacatggccacgtggccagagcaggaggaagagagagagatggggaggtgctacacacttagaaacaaccagatctcgtgagaaccctatcacaagaccagcactgtgggatggtgctaaaccattcatgagaaactgctctcatgatccaatcacctcccaccaggtcccacctccaacactggagattacaatttgacatgagatttgggcagggatacagatccaaagcatatcaggtatatacccagaagtggaattactgagtcacagggtaattctatgtttataatttcttgaggaattgctacactgtttcccacagtgggtgcactatttcactctcctaccagcaatgcacaagggctccaattgctccacatcctcaccaacacctgtgattttctgctgtttttttttttaataatagtcatcctaaagactatgaggtggcatctcattgtagtttccattgcatttccctgattactagtgatgtcaagcatcttttcatgtgcttattggccaatgtatacattttctttggagaaatctctaagttccttgcccactttttatttgggttatttgttttggagaaaagcttttaaagagagacacagaggaaagctttctgtacaatcagatctagctctctagtcaaaaataattggtgatatagtttgcatgtttgtcccctccaaatctcatgttgaaatgtgattcccaatgatggaggtggggcctagtaggaagtgtttgggtcatgggggaggatccttcatgaatggcttggtgttgtccctggcgatgagtgagttctcactctattaattcacaagaaagctggctgtttaaagagcctggcacctcctcttctctcttggtccctctctcttcccatgtgacacacctgctcccccatgccttctgccatgaataaaatcttcctgaagtgtcaccagaaactaagctgatgctgctgccatgcttgtacaacctgcagaaccatgggccaagtaaatctttcttcattaattacccagtctcaggcattcctttatactagcaacacaaaacagactaatacaattggtatctgccctctagatcttttaggaaactaatcatggagaagaggcactggcaagagtgctaacccagcagaagagaaaaaacttccacccctgagaacagagatttctttttcataaagtgccttctacctgatttcagctctgtaactgtcaatctctttttctcttctggcagatttccctatccactagagcataggttttaatgaccacactgctggtagctgtatcactactaatagtagctacttaatgagtcataagtgttactgctatgtgctaggcatgatccttcatctcatatgtgaaatctcatttaaaattaagtcctactaatgatgccgagaagattatcatggttcttacacaaggatgatatgcaaattcattaagtgttccatttaagaaaagaaaaaagaaaaaaaaaaaaaacctcttgtaccctagcagtttcatcttgaatactgttaaaaaaaaaaaaaaatacatctttaaaacacatgaaaggttttcatcctttagtccttcaatgtaacattattaaacgatgtcaaaaagtctcaaagttagcgttaaataacaagcattttctaaattatacattgaggagtctgatcttgaatccacaaaataaaacatcttttctacatcaactacaggaagtacatttttacctcaaactagtaaaatgaaaggttttgttgttgttttttgagacgaagtcttggtctgtcacccaggctggagtgcagtggcactgcagcctccgcctcccaagttcaagcaattctcctgcctcagcctcccaagtagctgggattataggtatgggacaccatacccagctaatttttgtatttgtagtagagacagggtttcaccatgttggccaggctgttctcgaacttctgatctcaagtgatctggccacctcaacctaccaaagtggtgggattacaggggtgagccaccatgcctggccattttttttttcaatcctgctcccttttgccttttaaaagctcaacattttataaatatttagcaaatgtttagctctgaagtaataaagttgatttttcttaaaaaattcaactagaactagaagtgaacatcgtctttttatactcttagaaagttatgtgtttctcatgaaaaaatgttcaccatcactggccatcagagaaatgcaaatcaaaaccacaatgtgataccatctcacaccagtttgaatggcaatcattaaaaagtcaggaaacaacaggtgctggagaggaagtggagaaataagaaaacttttacactgttggtgggactataaactagttcaaccattgtggaagactgtgtggcaattcctcaaggatctagaactagaagtaccatttgacccagccatcccattactgggtatatacccaaaggtttataaatcatgctgctataaagacatgcacacatatgtttactgtggcacaattcacaatagcgaagacttggaaccaacccagatgtccatcaatgacagactggattaagaaaatgtggcacatatacaccatggaatactatgcagccataaaaaagggtgagtttatgtcctttgtagggacatggatgaagctggaaaacaccattctgagcaaactatcacaaggacagaaaagcaaacaccgcatgttctcactcataggtgggaattgaacaatgagaacacttggacactgggtggggaacatcacacaccagggcctgttgtagggtggggggagtgaggagggatagcattaggagatatacctaatgtaaatgacaagttaatgggtgcagcataccaacatggcacatgtatacatatgtaacaaacctgcacgttgtgcacatgtaccctagaacttaaagcacaataaaaaaaaaaaaaagaaagtgatgtgtttcttcaaaagatgctgacgacgtcagacacactttttaaacagtttggaagctgtcttcagagacaaatgctttacaatcaatatttcatttaatcttcacaaaactcaaggagaaggtagtatataacttccattttacgagtaaattcagacagaaaagctaaataacttgcccaccactgcatttcagtaaatggcagagctgagattagagccaacatctatcggactctaaagcaccagctcttaattgcttcactttctatcattgttttgatagcaaaatagatgtaatctgatgatctcatagtgtatttacttttataaaacagtattaaatttatgggggtttaattaattattggcaccataaagacctgaaaccacctaagaaaataaatgctctgcaatagacagaagagcttttttaattatatgaaagtcttgtttttcaactctatcataccatttcctcttaagttgggctctttgcccaaaagtactctaaaattataattttctggcaaggagttttaaaagaagctgaaattttctcttcttccttcacccttggactctaatttttattatctaagaattttctccacttatcataaactggaaagtgatatgatttctttacatttcttgtaacaaacctatacaaaattaacaaacactgcaacatactccctatccctaagacatgttattacattcgctttcttaattactaattactcaaaaatcacaaattcagaaaatatagacaaatttgaaaatgctctaacatattcacgtcctattaaaataaatttgaaaattccctaacatattcatgttctagtaaaataaaaattaaaaataattttattagaaatatggacacctataaggctcatacattttaatccagttcgttgtaagtattctgaaataaccatacctagatttgagaactaaaaaaggcaactgaatctttaattgatttttttcttctttttgagacggagtctcactctgtcgcccaggcaggagtgcagtggcatgatctcagttcactgcaacctccacctcctgggttgaagcaattctgcctcagcctcccgagtagctgggactacaggtatctgccaccatacctggctaattttttttgtatttttagtagagacagggtttcaccatgttggtcaggctggtctcgaactcctgacctcaggtgatccacctgcctcaacctcccaaagttctgggattacagccgtgagccaccgcgcccagcattttttttttttttttttgtcacccaagcgcagtccaagctggaatgaagtggtataattacaagtcactgcagcacaacctcctaggctcaagcaatcctccaacctcagcctcccaagtcactgggacaaaggcatgcgccaccacgcccagctaattttttgtttgttgtagagacagggtctcaccaggtcacccaagctggagtgcagtggtacaatcacagcctgctgcagccacaaccccccaggctcaggcaatccttccacatcagcctcccatgtagatgggactacaagcgtgaaacaccacacctggcaaattttttttatttttagtttactttagtttgagacagggtctcactctgtagcccaggctggggtgcggtggcatgatcatcgctcactggaacctcaacgtcccaggctcaggtgatgctcccacctcagcctcctggctgtgaccacaggtgtgcaccaccatgcccagctaatttttgtatttttttgtagaaaccaggttttgccatgttgcccaggctggtcttgaactcctagactaaagcaatctgcctgcctcggcctcccaggtgctgggattagtgcatgagctactgcacccagcctaaaatctgctcttatcaacagtggtgttatttgtcttggattattttattttctatctttttcatttaaaatgacactaggtcatctgaaatatttagtggtgagaaaaaagtaagactgggtattaggattatagtgggtcaaagagcaaccagagcaaataggaagaacataaagataaaagtctgctctgaatagtctatatcacgtaatttgaatttatatatgcccaatttctgactcaaacttagaaaataaatgtgtagtggagagactatccagagaaaagagctcaaaaccaccagtgtcatcacttttggcagaatatccatagtttgaaagaaaaaatcagttatcctatctatgaataaaatgctattaaaaataacaggatattagttattaggatattagtctccaggttaggatcttgaaatatcatttcttactaagagaaaccacggctttttggagaaatggatgattccagatctaggacaagaagtatacaagatgggccccaaatatcacagcagacaacaaggaaactatcaaaaaccactagggtcatgttatctcctgaagagactcccactaaccaaaggtgagacaatttgcgcttcagtgaaagtgattccaatggattaaatccatcaagtatgtttaaatccatcttctcataatggcatttaaaagaaaaaaaaatggccacctttggagaaagacagggaactaattcgttatcttgaaaacttgtaaataaaaggaaagaatcaaacatttatcctgtctttcctttatcaacagtaccactgggtaactaaacagaagatgaggggaagttactttttataaaaacattccaattaataaatgaaagcaaaatgatgtatttagaatttcattatattgcaacacccactaaccatccacagccgctaacatcacaaaaaagaaagacaattagacattatgatattcccatggtcttgccaaaccccatctatatatatatatatatcacaatgcctaagggatcgaacttgagtctgctccatctctggatccagctgcacgtttgcagaaaatacagaagacaaaggaacatgttgaactgacctatattaagcaatcagcaaaatccaactctgggaaactagtacaaacaacctgggttctccaacaggaaaaggaaaaggatggaggactaaactaaagattaaaagtgacaactcatatcaaaactgctttttgggctgggtgctgtagctcatgcctataatcccaacacttggggaggccaaggcaagaccacttgagcccaggagttcaagaccagcctaagcaacatggcaagaccccatgtctacaaatacacaaattacctgggcatggtggccaatgcctatagtcccagctcctcagaaggctgaggcaggaggatcccttgagcccaggagggtcaggctgtagtgagctgagattgcactactgcactccagcctcagtgacagggcaagatcctgtctcaaaaaacaaacaaacaaacaaacaaacaaaacacaacctagagacagtgtttccctcttgttgcccaggctagagtgcaatggtgcaatctcagctcactgcaacctccacctcctgggttcaagggattctcctgcctcagcctcccgagtagctgggattacaggtgcctgccaccatgcctagctaatttttgtatttttagtagagatggggttttgccatgttggtcaggctggtcttgatctcctgacctcaggtgatctacccacctcggcctcccacagtgctgggattacaggtgtgagccaccgtgtctggccaaaacttactatttcttaatcatcaagactaacctacagtatctagcaatgcacatttgggttattactacacaagtcaggaaaatgattacttatagggaaaggccactgtgatctatttctcaacctgaggggtgattacaaaggtatctgccttataataattcaccaagccatacatgtgttctgtactaatgttttattttgcaataaaaagattttttttaaaatagcaggttaccagcacacctgaacatgtcaacacctaaaaacggctagatatgttttccattctctactctaactgagtgaaaacaataggataaaaatagaaatcaggccgggcatggcggctcatgcctttaatcccagcactttgggaagccgaggtgggtggatcacctgaggtcagtagttcgagaccagacaggccaatatggtgaaaccccatctctactaaaaatacaaaaattagctgggtgtggtggcacacgcccgtagtcccagcggcttgggaggctgaggcaggagaattgcttgaacctataaggcggaggttgcagtgagccaagattgcaccattgcattccagcctgggcgacagagcaagactccatctcaaaaaaaaaaaaaaaatagaaatcagtgtgcatcatttcctccctacccacttcctcttctaaaggaaccacttaatatcacattttaggccaatcagattcactttcttgggattatgaaattccaagaaagagactatagatatccaaacctgttctcccggtctttcctcattccccaagttgtttcaattcaaaacataggagccaggattgattctttttttcccctcattccccacatctagtctatcagcaagtccttcatttataactccaaaatatcgcaaatctctcaacttctatctccactgactctaccatctcaaatcacaaactattcaaatagtttcctaacttgtttctcttttattcttaaccctctacaatctactctacccaaagcagccaaaaggatgttttaaaaacataaactgcttaaaaacctttaatgacagcacacagagctctgacttaaatccaaattcctttccatggccggcatcattgaatccgtgcccatctctctgagctcatctctagccactgtcctcttctccaatccaggcacactggtgtcatttcaattcctcccacacattaagctctttcccacctccaggccttctcatagctttcccccctgcctggaatacttttcccttgctactcacatggataacttctcaatgtcaggttacaacttaaatatcaccttctcagagaagcctctgccaactgccctattaagcaggtttcaccatctttctctacacactacttatatctttcatagctcaagctacaacaagagtgtatgttatatgagggcaaagaacccacctgtttcattcaccaatgagcatctggaatgtggaaaacaattaataattactgaatgtatgaataaatgaggaaatgaatgaagtaaaggccgaatgccaattttgccatgagtagtgatcagtaagtaaagaaagccagttttcagaaagaacagagcaacacaacagagaacaggagactatgtggcttggttccataaacagagtcaagaaaattagctgccaattataaattataaatgtgtgtgtgtgtgtgtgtgtgtgtgtgtgtgtgtatcaagatagcagaaacatctgaaaaatttactcaattcacctctatactaagatgtctggtattatataaatctataaactaattcagaactcaaaataatactacctaaactaattatcattaatgttaacactttgtaattctcattttgctatgagtcatttttcaagatatactcctatgatgtactttcagaaattcaaggtaatcttcatgtcgatattcacggtatgtatgcaaacaatgaattttttttgttgtttttttgagacggagtctctgtcgcccaggctggagttcggtggcgcaatctcggctcactgcaagctccgcctcccaagttcacacgattctcctgcctcagcctcccaagtagctgggactacagatgcccgccaccatgcccggctaattttttgtattttgtttagtagagacagggtttcaccatgttagccaggatggtctcgatctcctgacctcatgatctgcccacctcagcctcccaaagtgctgggattacaggcgtgagccaccgtgcccagcccaatgaacgtttttgagacagggtcttgctctgttgcccaggatggaatgcatccacacaatcatggctcattgcagcctcaatctcctgagctcaagcaattgtcccacctctacctcccatttatgtaaatgtgtgggtctgtactgagtctcagtatcaatgaatttttttttttaaatgttgaaagccagtaatatatgatggcctgaagtgttcctagagtcaactaaagactgagtttctctagttgacatgcaacagaagtttgtttaccggaagtattgcaaattttattgtcgcactccctctctccaagaaggaagagccaactgactattcccatcagcacggcctaaagcaatcctaatcaagttaatgccaccctaaattaaccaagaaaagccaaagggaagacagcagatgctttagggaccaagttgttaattcagagatgctcctgtttggttggttcttttccccttggactaactactttgaatattttgtccacttgcctacctctagaattggaaattttccctagggccttcctctgagtctgctggggtttttttaagagttcttagagttcatcttctcaaagacaactccagctctctatttagtcaatctctctgatatacacacaattttactttccaacattccaaggaaacataaattagaaatatacacataaaatgacatccacccctcttctccctgcaataatatctttgtgatattcctactatctacttaactggtgtgttgctttctctcacccacttccattcataagcgctgagagttatctgctatctctctccattcctaattcctggcctgagatccgggctacagatgctacaagttgatgtgggctcttcatgctgaagaattcatgagtactttctgcttaactcctctatattctcaacccgatccctttgctttttctttccataataatctgttttctgatgggtaatccatccaaacactcatttgcccttatgaaattagtgttttctagctttccatttgcgtgaaggacccctaacatatgacttcaaccttcaattttatttcccccaaactaccctttcacactattaaaaataataataaaaaattgccacagaatccaactatagcttaaattaaagaactcacctgtcttgagagtaagtatgcttcaatagcttattcttttactatccttttagtgttttcattgttcaatgctaacctgccctccaaccataccttaatcaacgaattacacattttaaataactactaacactataacctatttgaggaacaagcctatctggtaaagtgtctcactccagcagtgatattctgtcctctctttgacaagtattaaatatattttcatgctgcccacctgtctatcatagagacccacctcccttctatgaaggttccacctggtgaagagcccatgttttctggtcatttacctttctacctatcaaagctggactattatgtggtcatttttctctcagctagcagttcccctataaaaaatccaataaattcggctgcgcggtaactcaagcctgtaatcccagcactttgggaggccaaggcgggtggatcacgaggtcatgagatcgagaccatcctggctaacacggtaaaaccccatctctactaaaaatacaaaaaagttaacctggtgtggtggcaggcgcctgcagtcccagctactcaggagggtgaggcaggataatggcgtgaacctgggaggcggagctcgcagtgagccgagattgtgccactgcactccagcctgggcaacagagcaagattccacctcaaaaaaaataataaaataataaaataaatccaacaaattccatctaaccaaaatgctaattaatgatcatttaataaaggagtccccaactcctttacagcacaatacagtggaccagtactggtccatggcctgttaggaaccaggcaacacagcaggaggtgagctatacgcgagcattaccgcccttgctctgggctccagctcctgtcagatcatcagtagcattagattctcataggagtgcgaaccctattgtgctgtgcatgcaaggaatctaggttgcacgctccttatgataatctaactattgcctgatgatctgaggtggaagtttcatcctgaaaccatttcgcccccaaccaaaccatctgtgcaaaaattgtttcccacgagactggtccctggtgccaaaatggttggggatctatgatttaatgaatttcccttcccagagggaaatccttttaataacgactttggccagcttgggcaacatggcaagacctcatctctacaaattaaaaaaaaaaaaaattaggtatggtggtgcgtgcttgtggtcccagctaatcagggaggctgaggtgagaggatcacctgagcacagggaggtcaaggctgcagtgagccatgattgtgccactgcactccagccagggcgatagagtaagacccaatctcaaaaaaaaaaaaaaagttaaaaagaaaaaaaaggacttctgaagacctcagtgacaagtatgttaacgaaatctaaggaatctaaaaactactctggtacctcaagttggtgacatgggtgaccacatctattgcctatgtttaacacaaaccttgttaaggagaccaaatcaatgaatatgagggtgagaggtgccttaaaaatcatctaggtctctgagtcatgattcttgaactgggctacacactggaatctccaactcccagaggagaagaagatgcccaaagaagcaaatttcaaagtcagtgacaaggccaggcctaatacccatgcctaacattatgtgttgatatgtgtacatacatacatatatatatacacacacatacatacacacacacacatacacacacacatatatatgtaacatactaaaaatataaaggcatgtatgggaaggacaaatatccaattcatgtcagtgattaccttttgggggatgggaagggagtgtaattgagaagaaatacacatggtggcttcaaatgtattggtaatatttttattaatatttcttaaactggatggtaatacctaagtatctattaaattaggctctgttcttttttctttttgttttgtttttatttttatttttgtttctttgagacagggtctcactttgtcatccaggatagagtgcagtggcacaatcatagctcactgaaacctcccactgctgggctcaagcaatcctcccacctcagccccacaaagtgctgagattacaaggcgtgcaccatcgcagtaggccctcattatcttctggatatctaaaattttgtaataaaatagaataaaaagatggtatataatcaaatgtatatcacattaggaattcagtgaaatatctcaggctagaaagtactcagaaaacatacttgatgaggtaggctttgatggaagaataaaacatagattattcttcaggcaaaaagtaacacaaacttttctaaaggaaaaatgtgaataaaggtaaagctgggagtacccacagcctataacataaataaagaacaacgggggccaggcacggtggttcatgcctgtaatcccagcactttaggtggccgaggcaggtggatcatctgaggtctggagttggagaccagcctggccaacatggcgaaacgttgtctctactaaaacacaaaaatgagctgggcgtggtggcgcccgcctgtaatcccagcctctcaggaggctgagggacgagaatcgcttgaatcaggatgccagaggttgcagtgagccgagattgtacccctccatctcaaaacaaaacaaaatagttttgaaaaccactggactaaagcgtccagctagaaggtactgctgcaattcaaaagtgagggtcataaaaccatggaatgggttttatggggtagtactcttgagaaagaaaacagaaaaaattaatccaccaactttttaatagaaaatttgataggctatagtgacaaactagatgggataatgaaagagtaagacctacctgaaaaaataaaaaatgccaactgagcagcagcttctagtcatacttgaacatcaacgacatcgataaggccatgtaaaagtcagcactaaggaagtgttattcaaggcagaaaagcaaaatggcacttttataaggattaagagcagaataagcaacagagaccaggagattacagaaaaagaggaccactacatcatggaatgataagaaagagagtttcaaaaagagccatcactgtatacaacaagagggtgcacagcctttgtagccaatcagatgcagaattctggcactttctccacttgaccaagttatttaacgtctttgagcctcatataataaggaaaacataagttaacaactaacactgttgaacacataggggcttcaaatatatttgtcaaattttatttcttaagctcagtcgtgatacataaatatttattaaattagtccccattatcttttgttgtttttgttttgtttttgtttttttgagacagggtctcgctctgtcccaagtgctttacatatcacctcatttaatccccacaatacatttcacagatgaagaaattaaacttagaactagcataataagtagcagagccaggattactatttcttaggatttaaataatgtatacttaaatttcctggcaaacaggatgacctcaaaacgagtagctatatttcattattaggagataataatcaataggggcaaaactgccagtaattcctgtcatagccttccatgtggcaaactctctcaacatcctcatctataaattaggattaatgcctataatccaatctactccatagggttgctgtgaggattaaatattatgaatatgaaaattctataaaaaatgttgagacattcaaatatcagggattgctgtcacatatctttcgccttcaaaaatgcttttgcggcatttttgttcactacttcaaaataagactctgaataagctaaaaataagtctgttaaaagtgcaaccaccactttgaaaagtataaatcaccacagaattgctgcctacacctgcccctgactcctccaggttctctaatgtctccacaagggcaaggattctcttacacctataatgaaactctgataacttacagtacagctaatcaatagagagctgcacttcaattcagagttgttcaaactggactactgtgttttctcagaggtgctccttccagttcttccagaaaagaaaaaagtgcccaattctcttatattgtattaaaacggtgcccaatgagtagaatgcaggtaacttacaaaatgctagaaaagaatctatcaattgacttgctcaagtgctctgacagcaggtcccttttggaaactccttcacgaccccccctttttttcacctgaacagatggcttccaggcttcaaggctcacatgtctagtcacacaattcacaatagctcccaaagttcctaacttttcaattatcccatgttcttgaacacacctttcatctaaagatctctagctgtcaaagcatacgaactctttaatcttcacaacagcactatctgagagattactatccttattttataagttaaaaatgaaagactgaggttaaatattttagcaacatcaaacaattcgttaattcattcttggggagagaggaatacatattatgaacttctgtcaatggacaacctagatttggcttcctaagatcattgcaaatattagctcaaacacatcccactcttgtatgcatacatttccaacacaggtgtcaaagattaaatataaactattaataacagtaaataccataccaaagcagcactatttttacacgcaaaactatattgggggagggggttctaatttaaacttcccactgtcttgcatccataaatacttttgaacttgagggggaagggggaagaacacctgtcagagcagcacatccacaatgttttacagactgtgtagctattaatatttaattcctcccgccccgggaggtcaggccgcagggagcccggcgctgcccacccgactttccacgcgccaggcctgccggccgcaggggaggctccggctcccgctcccctcaggtcccctcgcccgtggacagacgcggcgggacactcggacccgcctcccgacctcagcgcgcccggctcggggcccggcgggcggggagaggctcgcagcagggcctggcctagccacccccgccccgcggccgccggcgccgcttccctccttcttcccgctccccgattcgttacctcttaggcgccggcggctgctccatggcggccggggacagagagagggacctggtggacggcgaaggccgaaaggaggaaaggagccggggcaccggccggccgagcctagggcaccacagagggaaactctgggaactcggaccaactttcccgtaactccgcgg

SEQ ID NO: 253 - DNA, 487941 bp, Homo sapiens
  source 1..487941: mol_type = genomic DNA
tatgctgggtggcacagtgaaatttatttgtctttatgatttacacataataattaaacacacaaaagaaaaaacactgtcaagatggccatatgtagcttaggaaatgactggtcccaatgcaatcatataaatgttcattcagcgtaaaaatgagtttctttttaatggttttaatcttttttttttcagtccccaaggcttgtaccactcagtacaaatgtttttgctactgggttatcatcaggaacatgatgtttaccaattcccaggaaatgaataaaatcaacagaaacatcctgtgacaacagagcacattttcatagaaatgaaattgatgagcttattacagtttgaatcagttcagctattagatctacacataaaacatgaaacaatattaacaaattacatttgtattaagtttttatttaaaaatatttatcacacttttttgtgcaagggttccattgatttctttggttttaaacacgatagatctattttacctaaatatatatagttctatttgtaccaaacatcaaaaatcaaaaaaacaaaatttcaaagggtaaaaatggaattattgcttcaatataaaaaaggcctagcccatttgagaactactgccattattgctttcctatttgaaaaactatcctggaaatcaaggaatgtaccccatagctccctgcagaaagtataaattggttgcacattatcatcatattaatatgaccctaccttcaccaaagctatcctgatcttgtccttaaaaaatgaaacaaagcaaaatagcataaataaataagtttacctaaggggatacaataaatagcctagtatactagataggaataaagaatattgtaacataaagcccttcagtgctgtacaatgcaacaatagctttggattttcaaggtttagagaccttgaaaatccatttcataacagttttattactggtatgcagctgacagaacaagagaatacacttcttttgttctcctcatcttagagtgaatgcacagcagatacaactgtcaattctgccttttgggaatttacctgggcatgtaccattgtcactttttgacctctgcctaattgtagggcaaaatcttaggattaaaaatatccaaatattccttcaattcctagtggtttcttggtctccagaatagttaaaaacagagaggaaattagactcaaaagttttgctgccttcttttctttgcatccatcgcatccagaatgggctgtcttttcgcagtgtatctctgacgaagttcttctatctcccgttccatcatggggtccagtgcttttaaccgcatctgtagttcttctaaacttagatttttcaactagatacagaaagaaagataccaatacaatgaaattatccacattatccacaatcaatacaatgaaattagactttaatgtctaatgagttttaacataaatatttcagcaaattctttacatcatctttgaagtatagttcaacaattaaaacaggaatttcttccttgaagaactcagaggtcatatcttgcaagaacctccagtaatctgcaatgaagcaatccgatcctctgcctttaataaagggcaaatgagaaaaatacgctgatggaatttgtaaaaaggtacaaagacaaatccaccactgccaacaaacagattttcagaatatgttccaggtatattcactctaactttttacatctttgccagctactgagtgctacaataatcatgaacacttgcagagatcactcaagaatgtgacaagactgaataaaggttaaattaaccattctatcctccattttactaaatgcttaataaagaagatgactgtggtagggggcgggaagtaaggctgaataggcctggtggggccccaaaagcaggaagccatgatcaattctggagtaggacagttatgtaagagtaatccagatttggttttcttttcttcttcttcttcttcttattttttttgacacaaggtctcaaacttctgggctcaagagatcctcctgccttgacctcctcagtagctgggatgtgccactgcacccagctcaggcttggttttaaaatgataaaacttgcaacttactttttgttttaagaagataattgcctttggttattttatgagtcaagctaggaaaaatactcattacttatagtcatccaaagtagcatttctcagcagatccttttactcgccatccctggccctatcgtgacttctgcttccaaaaaccaaattcactcttagctgaaaaagactctgaggatactgaaaagaatgagtcatagactctctgaaggaaattcaaaaaaggagttccaaaaatattttgagaaatgacagtgttatggagaagagtatgcaggcttccatgatgatgactttgaaggtgaatgccactcacttcggtgcataagaagttctggtatgtatattaataatcagccctgttattttgtagtcatatgtcatgaaagaacctagcttttaatattatgccataaaacatacatttatatatcatatgtagtattatacactttcttcattgatttttaatccaagtagtgatcttgcatctgttacatgctcagtgctgttcaaatcactgtggagatacagaataagacaaacagggaaactccaaactttgaactgtacacatcggtaatggccacattgaaaggccaatgtataccacacaaccacatttcccaagaaagacatgcccaactatgtctatgtaggatccagttccacttctgtgttcttcaacatcatctctatttcagcccatgttaatctttcccatttctaaatttctatgtaacactcataatttaaacaacacaatttagtatttgattctaaatcatgtactattttataattgatttttatgcatgagtttcatgtccctagatattccaaaaaatacttagactttagagactgtacatacaccaagaaactatcctactatactgcaaataacatgacgtaaacgtagatagataaatatgaataagaatatatgacccaaaggagtgggttactctaagatcagaagaactaacatattatataaagcaaacaattatcattactttaattctgaattaagatattcctgtaaatatcttgtactacttttactggggcaaactgccaataggtttataaatattgtattgcagtaatagactgaactcagaaaaagaagctacttagaagaaaaattttcttcctttaacagatttttatattatcaatgcgtaaaatttgtgaaaaacaggtctgtgatattagagaaacattatctaacattattaaggaattaggtgttcatgtaagtaaattaatgaagtacctaaatcttagttctttaagtgataaaactttgtctcaatatcacatacacacacatatacacacacacacacacacacatgtgcacacacacatgtatttacatatgctcttttttggttctatgtgacttttaggatttttttctaattttgtgaaaaatgatgttggtattttgataggaaatgcactgaatctgtagactgctttgggcagtaaggtctttttcataatattgattcttccaatccatgagcatgggatgtatttccatttgtgtcatgcatgatttctttcaacagtgttttgtagttctccctgtagggatcttttaccttcttggctaagtatattcctaggtaatttattgctattactattattattattaattattttacagctattgtaaaaggggttgagttcttgatttgattctcagcttggtcactgttggtatataatagtgctactgatttgtaccactgattttgtaacctaagactttactgatatggtttggctgtgtccccacccaaatctcatcatgaattgtaatcctcataatccccatgtgtctagggagacacctggtgggaggtgattggatcatgggggcagtttccctccatgctgttctagtgatagtgagtgagttctcacaatatctgatggttttataaggggcccttccttcttcaatctcactctgctctcccctctcaccacgtgagaaggtccaggcttgcttcaccttcaccttccaccatgattgtaaatttcctgaggcctccccagtcacatggaactgtgaatcaatacacctctttcctttgtaaattacccagtcttgggtatttctttatagtagtgtgaaaatggactaacacagttaactggcactgaggtagtggggcgctgctataaagatacttgaaatgtggaagcaactttggaactgggtaatgggcagaggttggaatagtttggagggctcagaagaagttaagaagatgtgggaaagtttggaacttcctagagacttgttgaatggttttggccaaaatgctgttagtgatatggacaatgaagccgtggctgaagtggtctcagacgaacatgagaaactcactggcaactggagcaaagatcactcttgctatgctttagcaaagggactggtggcattttgcccctgccctagagatctgtgaaactttgaacttgaaagagatgatagggtatctgggggaataaatttctaagcagcaaagtgttcaagatgtgacatgggtgctcttaaaagcattcagttttatggattcacaaatagatggtttgaaattggaacttatgtttaaaagggaagcagagcataaaagtttggaaaatttgcagcctgatgatgtgatggaaaagaaaaacctgttttctgggggagaaattcgagcctgcagcagaaatctgcgttaagtaataaggagccgagacaatggggaaaatgtctccagggcatgtcagagatcttgccagcagccccatttcatcacaggcatggaggcctaggaggaaaattagtttcatgggccaggcccaggggccctgctactctgtgcagccttgagacatggcaccctgcatcccagccatttcagttccagtcatggctaaaaggggccaaggtacagctcgggccatggcttcagctcaagccttggtggcttccacatggtgttgggcctgcgagtgcacagaagtcaagaattgaggcttgggaacctctacctagacttcagaggatgtaatggaaatgactggatgtccagtcagaagtttgctgcaggagcagagccctcaaagagaacttctggtagggcagtgtggaagggaaatgtggggttggagaccccataaagagtccccactggggtgctccctagtggagctgtgagaagacagccactctcctccagaacacagaatggtagatccattgacagcttgcaccatatgcctggaaaagctgcagacactcaataccagcctgtgaaagcagctgagaggagggctgtaacctgcaaagccacaggggtagtgctacccaagaccatgggagcccacctcttgcatcaatgtgacccggatgtgagacatggagtcaaaggagatcattttggaactttaaaatttaatggctaccctgctgggtttcagatttgcatggggcctttagcccctttgttttggccaatttctcccatttggaataagagcatttatccaatgcctgtacccccattgtgtcttggaagtcactaacttgcttttgattttataggctcttaggtggaagggacttgccttgtctcagattagactttggacttggacttttgggttaatgctggaatgagttaacacgttggggaactattgaaaaggcatgattgtattttgaaacgtaaggacatgagatttgggaggagccaggggcagaatgatatggtttggctgtgtccccactcaaatctcatcttgaagtgtaatctccataatcttggtttgtaatccccatgtgtctagagagagacctggtgggaggtgactggatcatgggggcagtttcctccatgctgttctcatgataatgagtgaattctcacaagatctgatgggtttatgaggggctctttctccttcactctctactctctcctgccaccatgtaagaaggtccaagcttgcttcaccttcaccatctgccatgattataagtttcctgaggcctccccaggcacgcagaactatgaatcaactcgatttttaaaaacatattgagacttgttttaggcctatcatatggtttatcttggagaatgtttaattttggataagaagaatgtatattctgcaattcttgggtagaatgttctgtaaatatttgttatgtccatttgttctacagtgaagtttaagtcctgtcttcattgactttctgcctcgatgatctgtctagtgctgccagtggagtggtgaagtcccccactattactgggttgcacctatctcttttcttagatttaagagtaattgttttatgaatctcagagctcaagagttaggtgcatatttatttaggactatatcttcttgttggattgatccttttatcattacataatgtcattctttgtcttttttttttactgatgttgctttaaattctgttttatctgaaataagaatagctacccctgctcacttttactttccatttgcatagaatatcttcttctacccctttgagtctatacaaatccttatgtgttgggtaagtctcttgaagacagcagatatgtggtttgtaattttttatcaattctgccaaccagtatcttttaagtggagcatttagaccatttacattcaacattaatactgaaatgtgaggtactgttccagtcatcacgttggttgttttctagatactctgttttcttcattgtgttattgtattacaggccttgtgagttttacgctttcaagaggttctattctggtgcatatctacctttcgtttcatgattcagaactccttttagcatttctcgtagggatgctctggtagtgacaaattctctcagcatttgcttgtctgaaaaagaatttatttctccttcatttatggaacagttttgctggatacaaaattcttagttaacggttttctgtttaaggaggttaaagataggaccccagtcccttctggcttgtaaggtttgtgctgagaaatctgctgttagtctgataggttttcctttacaggttacataacgcttttgtctcactgctcttggtgacatcttttttgcaacgaatctcctagaagttcttttttaattaaaacactttttttttttgtgggtgcataccgggtacctgaaatgttttgatactggcatgcaattgtgaaataagcacctcattgagaatggggtatccatcccctcaagcatttatcctttgaatacgatccaataacactcttcaagttattttaaaatgtacaattaagttattattaactatagtaaccctgttgtgctatcaaatagtaggtcttattcattctttttattttttattttttttgacagagtctactctgtcacgcaagctggagtgcagtggtgtgatctcggctcaccgcaactgatgagaaagcaaaaaatgtccatcaaaatatgaatggataaagaaaatatggtacatatacacaatggagtacattcgtgtgccatatctgtttctactcatgctgttttccttctctatcctatttcccattttatcatcttactcatccttcagtgagttagctgtgcatgggcctatcttgccagctagattgcaatcttgttgtgggagatagagtgttttactcatctccgaacctactatgctgtatttattttaaaaatatctgatttcagttttgtggttgtatgaggttgagtttacaggaaatctgacttctgcataagctacatatatcgctaggtcttcaggtgggctgtcagagaacttcaaagtactcactgacatatttattgagatttttctatggaccaagcatagtagaatgaattttcattcacatcttgaatagtttttcaaacttctttatgttgtttttcacctttctctcgtatctcctttggtagcttaataatcaaccttttgaattctttataaaaagatatttcaaagatttcatcttggtttagatcaattgctggagagctaatgtgatcttttcaggggtgttatagaaccctgttatgtcatattgccagaattgtttttctggttccttctcatttaggtagaaatatatggaatgcttcacgaatttgcatgtgagccttgcacaggggccatgctaatcttcactgtatcattccaattttagtatatgtgctgctgaagtgagcaccgtctcaattgttttgaacagaaaatctttataaagtgttccacagaatatactgccttctaagcagaggacatagaacctaaaacagtttccttgatatgagttatcattatttttattatggatggatgaatattgtttttagttaaattaaaaagtcaaaactactttttaatatgagtcaacactttgtttgtaaattgatatggtttggtacatgagtgacagcttaaataagaaattcattttgttagtgatagcccttgataattacatttcattcaggagatgaaagatcaatatacaaaactatgacatttctcagtatttctaaaaaaaaaaccaagtaaaagatacgcaaattaataactcagttactagctcttgtataaaacaggagcataaaaaactcagtgatatgagaagttagggtggaaaataagattaaatcaattcactgataattctgacatttcaaacctttaataattagaattatttctgaactctacaagaagtattgaaagtctgcttattactgatcagaaagagttgtcagtaaaattagaacttcctttaagtttacatatctagtctactataaaaacctaaaatatcacagtcaagtgataaaacttacttcataaaataattcatcttaaaatctctggggaaaaacactaagatttctatataattttgttttgtcaaaaatagtcgtaattacatgagcgatttttaagaagtcaaatctcaaatagcagaaacgggaatatgaaggttttgaatacatcaatgtaataacatttcaagacctaatgattctatgagttgctggaacaatcagtctgtcaaaataaatgagacactactacaatgaagcaaatggtcttacatgttaatgttaacacatttagtcaaacagtcaatcaagagaatcctaaggtttgctgtgtttactgggaaaacaaactcttcctagcaactgtttaaataaatcttgcagatgctacagaccttattagtggcctttgattaaaaaaatatgggttgctaatactgtatcctgactcatctattttcccatctgctagcaattctaacaatatgaactatcaacagaatggctaacaacaagaattttctatggcagttttgatgctgaattgcctatagcatttttaagatttaccagtgcatgtctcagactgttttgagtttcttgtggcctggagcaacatactcttttttcccttaatattccattttagctgaaatttttactgtgttgaacagaatcttgtttggttttagaaaacactgttgatggaggctgccacacatttaactaacaatgagaacaggaaacacaacaaagcactagtaaaaatccagtcaggtccactgattggtttagatatacataaacaggcaaggggccttttgcccataaggctgagccacagggataacaggtagtacttaaagttaaaaaaaaaaaaaaaaaaaaaaaagaaagaaagaaagaaaaaaaaagaaaagaaaacattcatatattaaggcattttcctgatttaattcctggcactgagaagcatacaaaaaaggagcattctagtcaatccaaactactatgaagcctgtttaaagaaaaccctacatatacatttaaaatatgcatttacaaaaataagatagtgataatttcaggcacttgataacactatagaagaaaagctgaattcctcactgtaaaaatgtgatcttaaaagctgcattaacatcaaatctactggcagaccccccttccccaaacagacattatttatcctgttctgagctgagaggcccaggtcttcagctgactgaataactaaaaatattctgggattacaattggaaactaccatgaatcattctgttttggctgtttaacttcagagcacctagaagaaacttaggattctagattttcattcccaaagaaaaggaagaatacggtttctcatgaatatcaatgaaggagtaggagaaagtgccaattactgattatttacaatgtgctgaatactatcctaaggtcctgtacactaagtcattgaagcctagcaatcaccttagggggcagatattaccaaccccgtttgacaggtgaggatgcttagagagatcaaatgatccaccctaggtctctcagctagaggtgcttatgtaggccctcaaaggcaacatctaacccacataaatttgaactgcagtctactgatagctgtttcatgggtttcccatgaactacaaaagcactacaaaatccaatgatcatgtgaaacagttttttcacaaattgtttataggttaaaaatagaaaaaattacttaaaaatcccaactttcctgtcagattgtacctggtgaagcattttacttataagctattcatgtattttagccatcactggccatatgaaataagtgcatatgtgttaattaagcatttttctatttaaccagctctttagccaaagaaacacatttctacatagccctttgggatagatttcctaatgttatcaataaatgtaacagagataccctgacaaaaccaataaaacatgtctccttcacattccagtgagactttgcctatgtctgttcagactgttccacagttggtttggtgctgtgtttaccttgaatctagtgcaggagttacaaactgatgagcattactataattatcttgtcttagagaaatctcggccacccatttaaaaaaggaatgatgaaattttcgttgcattcctcaatggcagctgagcacccatttcttatgtgcattttccgtttctggtaagtagctttgcttattaaaaatatcaggaaatacttaatttgggcacacttctgatatattgtaagcagctctaacattctaggcccaggacaacaaaatttaagtaactcaaaagcaaccagtaattaaatctttctggatctattaagggcagatgaaaaattgtattacctttgatttcttatctcagcgattctgattagcactttgaatagtttaaaacaccaatgaagccgtaaataagaggttaacaaattaagtgattaattttctttttatacttcaatttaagaaaaacattatatgagaaatatttgttatggaagatcacaaacattacaaaaacaacagtggttaaagtatatctgtaactagcttactgggtagtcaaacctctgtggagcaataatataaacttaaagtaatttaatttttctccaattacactctttcggctatgcaaagtcaaatttccttgacatatcccacagtaaatcttgggatgatttcactgatttctggtcacttttacttattaaaagtccagaccaaatataaacttcaatctcttattaagtgcaaattttgtcccttcccttagcatgagcttgcaccaatttacagtggggaaggatgatgtctatatctagaaccttctcgccgtctctttctaaggtctggttcctctagtgctgggagcaggaaggagaccggatgttattatgtaaatggtgacttgtcagtgaggtatgtttccctggtcttgctctggtttgtttgattactagtggtttgtgcacagaaagcgtgtgtatgtatttcctgatgttgtggttagtattatcctagtgcccaccccttttatagaggggctgcccaacatcttttctgagttagatattgtctcctctgacctgaaagccacctgggcagcattatgacttctgacctcctcttttggagtaaagagatcatggaagttctctacactctccagggactagtgggacccaaggaaggtaagggtcactactccaatggcccttagttatcccgcaggcctcggctctacctacagaagtctcctacctacaaaaatctttgggagagaagcagatatcagtgtctatgctaatataccttccaaacttccaggaactaaaggctctgcctttagtggcacaccagtgggtctacagattcagctagctcagtaagcaccttgctggggtaccaggtaaccgtatccctttcctgcaggcaccaccattctctgtgaatggatctctggaaggctccttatttgactttaggtaaggagagaactattttcttcccctcccaccaggttataaattccatttggatagggcctttgtctagtaaacagctacatctctagtgcctagaacactgcttgaaacatagtaggtgcttaatcaatatttattgaatgaatgaaaaatggtgggtctcttagtaatcgctggagggaggcggctggcttcagttgttggtggcatgctttagaatatcgggtacttaacacctgctgttttcagctgtggactctactaacaattttgtggtaacagaaagtcccttttgatgtcatagtacacatctattaactctatttaaaaaatgtgtgtgtgtgtgtgtgtgtgtgtgtggcatcaagttggtaaatttgcagttgaagtaaagcaaaaagagtatctgtgaagatgagggtattttttcagcatgtttaattaatattactacaggatagtttcatgctccactacatgtttattctgcatgtctgatgatacatttatttcaataataaggggctcatccttttcttagaataatggcttctctcaaaaaattctccaaaacaataataaataccatagttgactctttgaggaaacatgcatggagtgaagtgtgctggaagagcatcattcttactaatgtcacaattttctgcttcactgacatcacaatacttagtctaacaatttaaattatactatcttcatatcataaaaatgtaaatatttgtttcttgaaaatctataaagtagttttaaaatgaaagaggttagctaaaacccacaaatcatgcaatttagattgtaatagataatttttaatagtgaagcaacatctagaaataaacaagagtctcatattttagtttcgaagcatctaaatccacagttcatttaaaacagttcagaataagaatcgtggtctgttaactatttttaaaacaataaaactcaaaatatgccaaaatgtttctaaaacacttcaaaagaaaaaataaattcgatcatagttctgcattctcacttgccacatgggccttagaagataaaatgtaccaaaaaggaaacattttagcattctcaattttagaatggcatggtttgtggctgaaacaatatttaattttcccagctactgacagacaaatgtacaaattaaactaaaacacccatgaagagattcagatatttgtaaggacacaagaaaaaaggataggaggctcttatgaaaatgtttaaaaagcaaaattgattttgtctaccttaataataaataagctgtcttgtgcaaacttaaaagcaaaatcgtcgcctgaatgaaactgagattctattgttttttcattaatatttgttttaaaatatgctcacaaatgctatgaatttaaggtaaaagaaggtagagaatgagaataaatgaacataagtcctgctagttattaacttagatgtgtctcatgggggaagaatcaactttcaaatgtaaatgtttcaaatcttcaactttctgaattggggaaaggacaacagtgtttgtgggttatgtcagcattttagactgcgcaactaatatgcagaaatcacagaaaataaagatgagagccgggcatggtggctaacgcctgtaatcccagcactttgggaggctgaggcaggcggatcacgaggtcaagagatcgagaccatcctggacaacatggtgaaaccctgtctctactaaaaatacaaaaattagctgggcgaggtggcgggtgcctgtagtcccagctactcgggaggctgaggcagcagaatcgcttgaacctgggaggcgggggttgcagtgagctaggatcgtgccactgcacttcagcctggtgacagagtgagactccatctttaaaaaaaaaaagaaagaaaagaaagatgagaaagtaatatgccaccattacttccaaaaggctgagtaaacattgattacaaactaaaattttcacacttagatgattataatacacgaatggtccaaaaaggcttttctttgcgggggcgggggggcggtctgagaatggcgccaaattagatttttagaaactgtttttcggtatcaactaatttaatagagaacatggcatcaaaattttatctctaataataccttgcaaaatgagtgtgttcccaaatgttcctgcaagtcttcagcgctggggctggaccaagctgcacctcttgcaaaggcagcaaggctttggttttatcctcccttgagccagacacctgccttctgagtggcctcactactaatgtggacatggaagcagaggcagagaactgaggttgggggacagcacaaagaatggctgatcttactttacatctactgggaagccgggagactgtggtcatgagtggaaatttggggatcagaatttcagctctggtttgaataatatacattaatatggagtagttttgctagtaaatcttcacatttttattttacaagatgaaatttcagttcagtcttaaaaagtccattttaataaggataaaaggaaaaatgcatctttaattattgaccatatgaaagacatattgttggtttacctcctgtggaaaaagtaataacacagctatgtggctgctgaattcaatgtgctcttgaggaactttccaaaaaatattagtaactgactgacatacactgttattcaaggaagagcttatccactggataattattctgaaactggtttatattcacatacaatatatgtaactctcaatctgaaataaatgacccagcagacctagtgctgagctgctagtacctggtactaacagatcctagaattctccaaagcattcttagacaagaacaccgtgagtgaactttccattattagagtcagagtagcggtgcaataccagaaatgatcaactaattttgaaaaataccacatgcaaagaaattaccttcaaactgccaaaaacactgcaagctggtccacacaacactgcccatttctggatacccatgatttacctaagttcttctagcctattttcagttaggaatgcccatttgaatgaacctcctcctgctacagttctcttaaccacagtgcatgatcttgtgactctgtcaggtccaccctagccctgccaccgccaacccacagatctcttctaattaccccagttgtgagagacagtcatagtcttaatcattttcttttcacaggggtgttcactgcctcatctcacccgtactcagtacaaggccttttaagtaggccaccctcactctcacagttgtttctatagtcagaatagtcagctgtgctggaccaagctgtcaaaagaagggagagataactcttaaatactgaggaaattgcagattctgctagctattttttaatttttcaatgaccagaaactgtctttcattggtctttagtgagtgtcatccttaattatatcaactaattttaaagatgacatttttcctagacaattttgctagggtgacagcataagcttccccaacccttggtaaatctctgctctaagtataaaaaacaagacactgtttactgactcttaagaggtgtgggtttttaatcttgcagggtgaccaagtgttgaatatttggtaacaatttcgtaaaatcttttatatcccacttagaaattaactgatagaacacctgagggagagtggtaaaagtggaagcagtacaacagaataaaattaaatgatcctaaatcaactgcaatgtaccaaagccttctgaataggcaggtggcttctgaaaagggtaagggtgaatgaagttacagcttgactggctcagagagtttataggtttgtagaggatgagtggcttacagctcgatcactggctcctgaaaagttaggaagctgggccactatcagatcaatggtatcggaaactgagaaacatgaagtcactgagctctacagatatgaatagtggcatccactgaacccgctcataagggcaagatttcaacctctaagagagggctaagtcgctggctatacagtaccctctggtggccagatttgacactgcagatttttctgccttttaagaaaagaggcctggtttttttccttttcttttttttttttttttaatgcatagacttaccattgggttacgtcttgataaagccatcataaactaaaaatatctgcatttagtacagctaacctaccaaacatcatggcttaacctagcctaccttaaacatgctcagaataattaacattagccttcagttgggcaaaatcatctaacgcaaagcctattttataataaagtgttgaatatttcatgtaatttattgaatactgtactgaacgtgaaaaagagtggctatacgactactccaagtaccgtttctactgaatgtgtatcactttcatatcaccaaaaaactttaagtggaaccatcatatacctgggactgtctgtaattcaaaatctttctagacaaggaaggaatcaccagtagcactgctgggctatgggtaggtgggcaactacctactaggtgtaaatctgtcaaccaaaaaagtaaattatggtggctttaagggagaaaatgttcctctgaatgtgtttaaaatcccatgggtgtagctacttaaatgaagaaatctggtgagtacttagctatttaaaatttaattctttgcaggtacttactttacaagaagtattcttatatagagagattcatattgctataaatatgtacataatagctaacatgcgcttaccactggcagacactatgctgttatttaataggcaataatcctatgaattagtattattagtatcaccatttttcagaatttaagttttcagaggcaccaagagtttgaactttaagacatttagctaataaaaaaatgtggccaggatttgaatccaagggaactgaattttggagctggcactcttaaacactatacaatgcagttaaatatatgtagtttactgcccataataaatttttccaaaaaagagatggcttcttaaaaattttaaattagattcagattagtatagacacttgcaagtcaatgatgcttaaaaactaaactaaaaccctatgccagttgagtgtttatttcctggaatgtttactcacatacaccttatggtggagaggggagtttataattggccacagagcctgagacctaatatttttgaaatcataatatattttacagtacttcacaatttacaaagcatatttacatacattgtatcacatgaacctcaaaataatgctgtgaaatggggcagataattctgtaaacaggcattattcttaactttatagatgattaatgaggcttacaatgataagtcatttccttaaataacacaattctctcaaaatctaagatgttccaaatgactgaatgcattatgaattagcctatcataggctttatcatctgtcacataacatttaaaaaaagatttctcacaataaaccaaaataaaattttactttattttatttctgctttatctacaataaatattataattcaacagtaattactattgttgaactagcaaaacccacataacaaaataaaaatcagaacatgaaaagctatagtaaggagaatgagaacaagtatggatcataaaatccagaattaggagcgaaatggtccaaaaattatgagattaagatcaatgattacataaagcactcagcatttttgtaattacttaaatttgtaaagtgccttcaaaaatttgttactcttttataatccctaagagatcactgagagacaataatagcctttacacagcagatgaagaacattttgaaagtactatgaaattcagttattatttttgtttaaaagaaaacatcttgtgattctaaatcacaagagcccgaaattctttctgaatataagcaatgccatttacaaacattcctgctgcacccatcttctacaccccctgttgtaatgaattcgcatacctgcctccgattacaggctggattgccccaaagtagtcttctcagaaacctatctacacagttagcttctttctcttgtgcatcttcaaactctctttgtctttagcatcaacatgatatactttctgatatttcccatcttaaacttttattgttttttcttatctcaagaaaaccctgccttgactcacggccattcctccagttgtcacaattccatccctcttctcctttagaaagtcaaacttctcaaagtatggagaaaacaataaccatattttaaattggcaatcaaacttcaacttgctccatactggcttctgatcccctaatgctctccaaattcctcttgttaggtcgccaaagttaaatgaattctttttagtttctatcttatttggcccctccagctgtacttgatactttgtccacacctttccttcttgaaacctccctctcttggctcctacaacaccatgctctcttttctcctaaatttatggccatttctcaatctcctttattggcttcttctcaactactaaatgttagaactactcaggactctgggcttttactatatactccatttcctaggcagtctcatacatgccctgggctttaaataccatctatctgatagtatctctaatatagatctgtcttctgagttccagaacttagcaattctattagatgtctcctgggtattgcaatactcagtaagttcatatctgacagagaccttctaaactgtttatcttttaacctttcctatttcactaaatggctcttccaccatccaactagttgcaaatgctaagaacctaccatattcaaatgttgccatgccttgtggtgttcatactacttaccaagatatgtcaaatcgatgtcctcctcttcatctgctgtcatctccccagtcaaagccctcttatcttgagcacactgtttcaatagcttcctaactagtttccttctatctttgctcccctccaattcactctccatacagcagccagaattattgtttaaaaatgtatactgggtcatgtcctgcccctaagatacggaaatggctctttcttgcatatgaaatccaaatgcggccttgcctgaatctaatcctgcctaggtctgcagcttcagcttgtgctactctagccattactcctatgtttccatcatgactgattctctttcagtttctcagattcaccaagctctttgcatgtgaattgggagtaaaatcgtccaaaaattaagaggttaggattaaatgattacatgcctttcctttgcttagaatgttgttccacactccccactttggcttcaagactttgttaacacagttctgtctactgagagtgtcctttccctcatctctgcctgatgaagttctattcatctttaggactgatcttaaatgtcatcttcataaagtcttcctggtcaaattttccctgtaagcatactgagttacttttttctccatatacctaaagataattttgcatatgtctctgttataacatttatcaccgtactgcaatcattttttaaatttctgccacattagaactgtacaatatgagatacgtgaatataggactgggccttctttagatccccaaatttagcaggtgcctaacatcatccaatctgtcacccattaatattgctttaagaataagagccatcttacatggcaacaaccactagtgaagattgtatttattaacttgttagtgtttgtcatcacggtgacatacacatattcagaaaaatgagtcaatattaataattaaagacgttactgtgatgaagtttcctgaaatctgagctcatctgtatacccatatccaatgacttgaatgtctcaatcaattcattggctagcacaattctcaagccttattagggaccataatttctatggttgacatcttaatgctgagtaggagccggaagctttgtggactctcaggttcatgcacctgaaagtcctgtgcttaagtgtgtgcatgatcttgctcagaagcaccaagaacaggggtgagaagagagaatgtagaacatccattgttatacaagaggcagtgacaacagagatggcctatttaacttacttcaaaagcctttaattctcaagcaccaggaaaacaattttagagctgactacaatagatcttttgctagactgttctgaagactagttttttagaaagtaaaaccatattaccagaatattaatccacaataaggttgaatacaatttgttaaagaacagactccatgtactattacaaaaatgaggtctgacctgaaacaccatccatttgaaatatttaaaaataaaaatagacaactctcttaaggaggttttttaaagcatcatctgatatctacgctatgataaaagtcagcatcaagtttaaagaagtgaaacaaaacactgtcaccatgcccctatgagctaaaactttgagaattataaatggcggatttaacaatgataacctttccattcttttgccagacgcgaaacaaattatgctagttcctcctctagaatttcttgctttttctgcctatgaccttctcagctcacccacaagcagcaccattcattgactgaactgttatttgacagtttgtcataatcaaatacggtaagcagagtatcacgatgttctagttcactttaaagcaaactatttaggactataaattccatctaggccttagatacacttcaaggcaaaggtagggatactgggcagagaaaacaccaagatttgacttttactccaacatgtacctaagtgtagactggaagtttgtattcaaaacattgggggagaaaagtttaatgttacctgtgtattcaacatataatatcctctgttttatccagataattcatcaaaatcagaggcatgcaaggaaggtgagaatcaggctgtgatttgcttacagatatgaaatcttgggagcaactcagtccagtgaagagacttttattgccccacaaactctaatattgggcagacttgggtttttactggttaggtgatgaaaagtccaaggtaattatcaggactaattagaattacaaaggacactgacacggggtcactgtaataaagttatactttatatttaccagcagtcttagacggctatgggtaaatgttctggctctgcggccccctgaaaagcaggattttcattccaacagaaaaaggaaaaaaactgattccaggtggaaccaatgttgcttccccacccttttttcagttcagagttgacaatcatgttataaaatgaaaaaggcaaatgcatgaacagattttagtgttgcataaaacaaaacttaccacaaaactaatgtggctttgttaatgatatgaataatagattctgggtaaatggtaattattcataattaatttcatttcaaaaacagccatagccaaaattatttttacacagtcaactcaaaatgtttccaaattctctaacatctataaattaaatcactcttgatgatttccactacaaccatgcaaggcttaatacttttacaacaaaggaatttagaatatgtcaccccaaaatacattactctggcatactgactattttgagtaaaaggtacttgaaaaacagcaactgcaagaactctctgacctttcttcttcataaaagcaggaaatgaaattcccgtgtgaaagacagcctccctctaccagaaggaaagcatcattcttatcatcaaggacgggaagctgagaccgaggaaaatctgtacaaacaaaccttgttaagctaacccttatcttcctcgttacttctctgcccaattacctactctgcccaagctcctctgccttgtcacagtttcacaatttactactctttcgccaaaagagtagtaaattcagtatataagttttcaattctaactgcatctgtgggtcttcatttccttacaaaggctccttgccatgtaaaattcataagaaataaatttctatgtttttctcctgttgatctatctatgtcaatctaattcttaggcctagctgaaataccccaaaaactggtaaaggtacaatttcacctcacctacaacacatacatatcctttaaaaacatctttctcaaccccaactccctagcagccatggtgcaccctcaatgtccgtgtttgagaattaagggttcctgagcttttctcctctgcaaatcccactcatgggtccttcaccaaatgtccattagcaattcattcagccatttcctatctcagtctccaccagaaagggccacccctgcagctctgaaatgcttgaggggcttgggaagctgaaattctgtggtataaggtttcaatggctagcctcgcataatcatcacacttggcggggggggggggggtgggcgggggggggccctaatgaaggcaagggagagggaagggaaaggacacagagaaaagccttcaggagtctgtttcagggcatctcagtcttggcactaatgaacgtttggtggggtcaggggtaattcttggttgtgaggggctgtcctgtgctttgtaggatgtttagcagcatccccagcgtctattcacaagatgccagtagctttccccaagtttggacaacccaaataaatcacccctggttgagaaccagcagtctactctagagtcttgagcatagagaggtataggaagaaaattaaacagaggaaagaacctgaattcagacagacccctgggctatgtgtagaagaagcaagtggctcttggtcacatgctgctctttgtgaacatgactcaatgtagcggaaatttgagagtgagcacaaggacaagaggaatggaagtcaggaaatgagaggaatctgtaaggaagaattccaacccaaatactctgcccctcactcacaaggtgatccctatgtatctactgaagagtactcaaactctttttcttaaggcgctggtttataaaggccatcaggaagcagactgagatttgggggtggggtggaagaaggggagttgggaggtagagaagggtttcccctacctaaactaagcttgggcttaagatccatcgagttcgcctcccgagcagagcaaagaactgaaacatgcgagagggttgctgtgaagcattttagccaacttttccaagccagatgcctggagttctcactgaggaagctggcagaacctagaaaaatccttattactccctcaaatttgcagagggacttcagatgactaaaactagctgcaggaaagaaaaaagacattttcttttctgcctagccatttataaagttttttaacttgcagaaaatcactgaagttctttcagtttcggagcctctaaaataaagtggaaatactataaacacatgtcacagagatgttctgaagattacatgagaccacagatgttaaagggcctagcacaaaggtggcataggtggctccctaccctctgtctctccttcatttttagttttctttgggctcatgcaccacatgcccacatctgtgccaccagagctttctctatctgctcttatacactatatttacgagcttctgtcgttatcttgttctgcgattttcctctctccctatgttcctgatgaggtggcagtggtacttgctgctaaatacatctaagtcctttcatcactggtgacaagagttcatgtgagaggtagcagtggagaagatgcaggaaaaagaatgccatagtgaggatgacatacttcatcactgttttacccttggcagctctcactccacctgcatgaagacatgaaaaaatctctttctgcgtgatagtgcaggtgtgtagtttagcaggaaacttgacaggcagttaaaagacaaagaagcggccgggtgcggtggctcacacctgcaatcccagcactttgggaggccaaggtggggcggatcatgaggtcaggagttagagaccagcctggccaacatggtgaaaccctgtctctactaaaaatacaaaaattagctgggtgtggcagtgggtgcctgtaatcccagtgactcgggaggctgaggcagcagaattgcttgagtccgggaggtggaggttgccgtgagccaagatcctgccactgcactccagcctgggtgacagagcaacactccgtctcggggggggggggggggcgggaaaggtgaagaagcatatcaggagttcagcttttgctaggtcagagaaagttcttaacagactaactcttttgcagataataaactgtggacaaaacacaaaaaccaactactgaagtctctaaagaatgaacaaaaacacattcttccccctccacaagaaaacatttacaatgtctgggatgtaatccaaaattacttgacatatgaagaatctggaaaatgcaatccacccccaatggaaaagacaatcaacagaagccaaccttgatacgacccagatatcagaaataacaagactttaaagcagctataattactgctgaggtaagagaagacatgctcattatggatgaaaagaatgggaaatctcagcagagaaactagaaatataacaacaacaaaaacaaataggagctttaaaacttgaaaaattcaatatctgaaataaaaagcttactggataggcttaatagcagaatgaagatgacaaaaaattgattggaaaaaggtcagtgaaaattacccaatctgaagaggagagagaaaaaaatttaaaaagaaagtgtttcaggaccctctgaagtcccagaaggtggggaatgagagaaagtggtgggaaaaaacatcagcataaattatagctaaaaacagtcctaaatttggcaagagataaatttataaattcaagaagctcatgaactgtaaagaagattaaaaacaacatcaatcacaaaaataaatgcctaggttgatagaaaccaaaaataaaaaagttgtgaaaggagacagagagaaaaaaacatatacagggcaacaattggaatcatcggacttctctttagaaaatatgaagtccagaagacacctggaacaatattttaaactttctgagataggagaagcacacttcactttaaatataaaggcacagacaggttaaagtaaatggatgtaaaaagagcatgcaaacagtgaatgattatcgtactaatattggagggggaagcatatcacctgcctagctgccacagtatgatttcaaaaaaaacaagaacattcaccaagaacaaacaaaaaaacctcttcaaatagaccatggaactgaattcaaacttgtatctgataacagcgatgacaatatctctctataacaatcctgaccagcatatatcacaattactacagaggctactgacaagaaatccaaccttggtatgctgtacacgactgtcctcccaccctcccagtgaaatcaaacaaaattaataatagtctactacatcagagggactccatttgggggaaagtttcaggctatgctcttgcctcaaaattggtggggaaaacacatagacatatacatacacacaaagcaaatacagcaaaatgttcaaaattgttgaatctaagtagtaaatgttaagtgtttattgtactatttttcagctttttgaatatattaaaattttttatactgaaaaaagagaaaaattagccagaagagctttattcaaaataccttcccctctctttccttcacattttgatatattcttgttggggaggtgtatcaggatattaactgtatcttttgatacgaaaaaaagtcacatgattctggtatatttcaaccactgctagaaaatccacatggataaatgctagaatgagggctaggactttttctagtttgtccattactgcatctagtatattttcaaggaaaaaatgttcaatgaataaatgaaaaatagctaccctagatgtttaataaaaaagacatctgcacttgtatgtttactgtggcacaattcacagtcgcaaagatatggaattaacctaagtgctcatctacagatgagtggataaagaaaatgtgttatatctatatcatggaatactactcagccataaaaagtaacatcttttgtagcaacttggatggaactggaggccattatcctaagtgaagtaactcaggaaaggaaaaccaaatactgcatgtttttacttataagtgggagctaagctacggatatgcaaaggcatgcagagtggtataatggacattggagactcagaatggggatgtgggactgaaaaaatcacctactgggtacactattcgggtgatgggtacactagcagcccagcttcactattatacaacttgcccatgcaaccaaaaaccactagtatccctaaagctattgaaaaaaaaaaaaaaaacttagtaagcctcctagactttataatctcaagacacgactttttaacataaattctgaacattatctggaaaaactgttgactggaatacgtttgtttggtattttttcaaggatagaatgatgttttgataatcagacttctcctttacttgtcacttagtaaccttctatactaaaaaaatttagtcattgaagtgtaacatgtattcaactgaagctagttgaattctcacgtttctcacactccccttgagctggcatcaaagattaacttaaaaggtcatgaaggaattcaaattcaaggaattcaaatttccagcatgcccatcttgacactttgaaataaatataaacacatcctgatgtcacttcattacagcattcccttcccaaggagctctaaaaagaaaataacctgcaggtgaatttttgacatgcaagtcttgaagataaaacaatatagcattcttccagatcagttatatgctttaaaagcattatttctccctgaataaaaatgaatccaaaggctgtgattcctaagaacaactgaagttaaagctaaatgttctcaaaacaattttacatagctcattctaaatgttctttaccaacttttaaataagaatgacaaataagagacagtcaaatgtttttatggatcttctgaataaactacgtaaagataaaaaatacatgtaagtataaaatacaatttgtaaatgagggccgggattagcaatgccaggatggataaagacatgttttctcgcatttaggtaactttgtcccctatgagatgaccctcagaagttgtctcgacgtttgctcagcagtgatttgattcaatgaccaatattcaaacagcactcccttagagactctacgcatgacctctgactgcttggtgcctaactctccacatatgtcaaacagagggaagaataattgctagctacctcccagcaattctagaagatttaatgaggcagggagccagacctccatggtgagtcaattattccctgggtagaagttatgttatttgtgaggtgccgtatttctaaggataacagagtattgtacaagcattacaaataggtatttctcgattcctcaaagtgttgacattaaatctttcagaataatatactcacctagtaacaaatagtctaatattttataaaacagtttgaatttgatggaatgaaagcatacggattttataatgttgtttcttttctgattattagtgagagagaacaatcttttaggacaaatgggtttaaaggaatagacagataagggagaagctctctaactgaatccagacctattaaaatggcgaccaggtaccatgacctatgtatttcattgagctggggccaagtccagagtccactaatttcagcttgctcaagtcaaggctaggatgctgccgtgatagaaaagatatggaactgctgaagaaatgtaattcaattcttataaagaaatggggcccaatattaacttacatgattaatataacacacataaataaaggcagtaacaaacacttaattttggattagtgatgtcacaggatctttaaatagttcatacaggatggtcatgctctcataagttaaaatggagaaaattgattttttacaccagattagccacacaatattaatcatataaaatgtttccctgaaagtcttggcataaaaatgggccaatgtgctctgttttgcctttttccccaaagtaaatttagatgggggtgaggagggaaaactttagaaagcaatcacaaatttcaaaatcaataaattcaaattgtttttaaggcagtaaatacatagtcctgccaaatgctgcaggaaattgatgtacaatctgtctggcagttggaccatgtgaaaaaattttaaaaagaccttaaaataaccaagattctgaaggctcaacaaactttgttttagtaagacaattttcctggtccataaaaaagataaggaagtaaaaggtgggataaccaatttaacttagggtgtggtgaattatcttgggtatcttaaattggtacttaatttggtctgggctcagaagaaatggtttaccatggtgattaagaccagctgctaggtgtcatagatttaaattatacaacagaacacaggagtgtgtttgaacacagacgggtaggacagtctccaaaaagctaagagtgccacctctgttcagtgaaaattaagtcagttttttactaccctttaagagctgcctccactgatttggccttgaacatagactgaatgagaagatttagtttcccaacacatgtgccaccatgacttaaagacttaatactaagtctttaagtattaaagacttaatactaagtccactaagtagacttagactaaagtccactttagtctaagtcccacaatttttcagaaagaccaggaggccatttaaacaaagaaaataatttctttcctacaaaaatcaggggaaatactaacctttgtcattcaaaatagttttagtttgataccaaagtatccttattaacactttgagcagggacaccaacatattttattttattgttcacttagaagttataaaagtagtctacattaaatgaaaaaattcaaacaataccaatataaaaatgtactaaatagtgtaagttcacttttgactctgaacccccagctaccaaactcaccagggaaaactactgtgatttgttgaagtgaagggagcgaagagtccacattaaattagaatataacagtacaagtttatggactttttacatcaatatatgtactttcaatgtgactaaacgatttcaccatttactatgctttttctttttcaaagtaactataaagacaggtacctttggggaagaaaaaagaaaagaaaaaaagtaaatataaagaaaacactggaactagattttcaatggtgcagttaataaggattagaaaatactatatataatagaaaatataagatttaaaattttaagatcttcttgttatgacaaataatatctatatgcataatacacatatgtacatgtgtatacatacatatacacaaactacatattacagcatacaaaatactgagtaacacaatgaatatgatctttttggatattcttgaaaaaagtaaacttcatcatttgatttatctagaagaattttattggccgggtacggtggctcacgcctgtaatctcagcactttgggaggctgaggtgggccgatcacctgagatcaggagttcaagatcagcctagccaacatggtgaaaccccatctctactaaaaatacaaaaaattagccaggcgtggtggcacacacctataatcccagccacttgggaggctgaggcaggagaatcacttgaacccaggaggcagaggttgcagtgagccgagattgtgccattgcactccagcctgggcaaaatgagggaaactgcgtctcaaaaaaaaaaaatgtatttataaatctaatgctttagtggcagaccaggagacaacccacatacaagtggtcaatttgaattttatctagaaccattactgttgccctgaaagccagattcactttagtcagctaaattttatggagtgtgttttataaacaaagcattgtatgaagctctagaaaatagtcagcagaagacagtccttcttctcaaaggctttccaacacattatcaagaacatacacagtcacaagcaattacaatttgaaagtagcacacagataaagaaattaattaccactggtggggctggagaccgtttaacagaacagataggtttaagctgggtaagatttcaactagcaacacaggaatgaagggtgcttgaaaacagcacagaaaggcacaaggaaatagtacagacaattgtacaagtaaagacaaagaagtaggaggctgccatgtacatgtgaaggataatgaagtggcagggcaagactagagttcgggggcacagagaaggcaggaatagaagatgagcctggagaagtagatgggggcagattttggagcctattagctataaaccaaaaaatttagcatttatattacagaagtagggggccatgaaagtctcaaagtgaatgacatgatcagaataatgatgcatgagttaaaatggaaaagaacagttaggcagagtacgacccatgacaaagctccaaagaagaggtaatgttgcgtagattaaggacagtagcaatgaaaactggataaaggaaacagaccgaaagacacattctgaaggcaagttgacataaggaaaagatcttaggccccaggctaaagatttgaattctggctcctccaactatttgccttttggcgttgggcatgtttcttagctcctttaacatatagtttccttatctataaaacaggaataatgcacttgcctgtgtgtgggggaaaaaaaactgtgagaaaaatacagaaagttgtctagataattcatgtcaacacacttatttattcaacatcatataatgataaaaagaataaaacgtagccccaatctggttggggaaacagacatacaaacaactaaagtgacaatgatctgatgtaactggacctatattaggagtaagatccaacagaaacacagaggataaggtgtgtgtaaagccactaaagaccgtgtaaaagtgctgaaaaggttcaatgaagttccacagaggtgatgtgtgaaccaggctactcacaacttttaatgtttcttattttcacatcaaatcaccaggtccttcaccacataaattatagtacacaaccccctaggacccagtggtatcatttgaattctggagtgtgaaagtccaaaggaaatggtggaggaaaaaaggggaggtgaggggagaggaagaaagattagaggagtatgaatgaattttaggcaaataacttctcaggaaacaatacttgaaagaaagccagataatacttagattctcagtgtgatacaatattaaggcagcaaaactcaaatgaaagaatgtaatgagttccaggtgtcgtttagtagatttttttcagtaggtgaagttgagttgaggtggctactgtcagtgtcaatgccctgtctgaacaagttttaatttaacttcaagcaatacataggcttttgtttagactgtttgcatatatttgtctactgctgctaagaggcaaaataacctctttctcgagaaagtgagataaaactatgattgcaaaaatgtttattttttaatcttttcatgaatcaagtaattttatctaatttattcaacaaatatttattgaatagttactgtgcataaggcccagtggggaatatgagagaatataatatgatatagattttatcaccaagaaggtctgagtctcataagttcactataaagtagaaggtaataaattcaatgagaagtatacagataaagtgccacacagtataaaggaaggagattactttgagctgggaggataaggatttggcactggcactaggacagaggggactatgttgtgttactcatgcaacaaacatttactgagcacatacaatgtgcatgcacttacctaaatgcaatgagactttgaggtgatttagtccaattccttcacttaattcactagaaaatgaaaactcggaaacctaaatagctaattcaaggccaagatacaatttgaattgatatctccagtctgcaagtccaataatttctactacttaccctgtcacctccaaaactcagtctaaattttttgtcaggtacaatcattatttcaaaaggcattccattccacttataaattaatttgttataaaatgtgttttctaacatttagttaaaagttgccttcatttttaactaaaaatgaagtggctctagtggctccccctgtagttacacagaacaaatagaatcctgtggccatgtgatcatccttcacatatatgaagacaatcctcacgtcccccactctagtaggcactcagtaatcactatagttggggaataagctccggaattagatgggcctggatgtgaatctcagcttcaacattcacttggtgtgtgatcatgagccaagttacttaatttagataatctgtgtgtttatttagacaatgggaatgtttatgtccttcatgccttccattcaacgtaatggccaataactatgatcaagaattggcacaacttttggtgtaactgtcagaacactagagtttctctatacacattaagctggcactgaatcataagaggaaaagttgcaaaactgaaaaagatggcagcacctgtctttctctcccacttctcttcctctctggcataactagtctgtgagtgacagctgtgaaatactaaagactgggcgacatggcttttccagataacctgtgaagaatggtgaagcatggcttcatcaaatgacctgtgctaatagagctgctggcaaaagtgcagtcattttattgagataaaacattgaaaataattttcataaaataaggcacagatgctttaattagaaaaaaatgtccttgagggtgggattcagatgcagttttataacttgtacggtgccttaaatgcattaaaagatagacaatggtacaaggactattctccctagtggtaacaaaactgtttcctagttactagggtagggtagggaggaaatgaaaggaagaagagaaaatctagagtttattcttttcctgcttctaatgttataagccaatgctaatgtttagtagtcacaacctcgtctgctaggcactgcaactaatttcccgtatttgggtagaaaaaaatgcatcatgtctcaaagaatgaactactgacagaaatttagtgactgatactaaaggtagatacgtagctgcagggtatgagaaagaggagacacagtcctaaaaataacagcaaaactaagatgaaaatgcagagaagtggtatggtacattggtagctatcccctaatatctattctacctttcttccatagaaatatcgttttagccaggcatacagtcattcggaataaaagcaacactttcggtctctattgcaactacatgtagccctatgaccaagtactgacccgcattatatggacgtttctgggcacctttctcaaaagatggctggggcatgcccatttcacccctttctccaaccagctgcctgaagtggagatgcctccacctttgaccatgaaactgagagcctcaccctaggcatggtgagtggtgagctggaaggagtggggctctcgatgcagaaactgatttttccatttttgttaaacaatgctgtcaaaaaggccctaaaaactatcttttgcacatatctatttccttagattacattcctagaagtgagtgagaggatatgaaaacataatctgtcatggaactagagttaaaaaaaaaaagaatatgaaaacattctaaagctcccaacacatatggtgaaattgttcttctgaaagtttaaatttacatgttctctacatgccttcccagcccaatgtcaggagttaattttatcattaattggtaagagctctcttatattaagggtgtgaataccatgttataaatacctcttcccaattaatttacctttcaatttagttactatttttgttgttgtgcagtaacttaaaatctttatgtaataaacctttttaaaaagtggtttctgcccttactattatatagtaaaaagtcttcccacgtatcaagattatgtacatatccacctatattttttctattacctttttgctttcacttaacctttaatccacatgaaatttatttttccacacatttagccgattgtaccaacaccaagattccacacattcaataatagatgctattgaatataactattcctaataactgaaaattccacttttatttattctgatatcttgaattagtattattagactgttttaattattgtggctttagaaaaaaattttatactcacttatgcaattaattcacattatttcttttttttacaaaagtgtgtttggtttacacctctaagtgaactttagaaacacattgtcaggtttggcaaaaagaaaaaaacacctgaaattttaactggaattgtattaatgatcaatagagagcaattggggtagggaatgcataactttaaaacattaactctccccattattcccacaaatatgagatgtttccccatttcttaaactgtttttatgtcccttatgttctatagtttatttcttatagttagtcgtagagtttacttgcttaaacttgaggcaagtttccttagttacagatcttttatttatatttgtgctattataagtaggatctttaaacacatacttgtctgtgctggtatagaggaaacactaatttctgaatttattttgtaattgaccatcatcttactggtatgtttttaataatgctcataagtgttagttgattatcttgggttttctagttagataactgtattttcaatttcaaataatgatgacacttctcacttcctttgcaatatttaaacttcattttcttgtcttattgcattagacaaaactttcaaaacaatattaaataatagaggtaatagctgacactcttttttccacccctgactttacttcttaggacattttcctattttaacccataaaacagctgcatcgtatcagtctttcatctgtttttacactggtcccaacccccaatccctaactatactgtaagttccttgaaggcaaaaactgtgttttgctaattttttaaatcactgtagcatccagcacagtgtctggcacagagaaaataaatcattaaacggatggttctcaaaactggtgagtcactggaattacatgggagcctttgaaaaaaaccaactgcaagtttcacaaaccatttacaagtcagaaattccctgttcgtgggggtgcgaatctagacgtgtcaaaagcttcttagatgatttctgacggcccacaggtttgagaaccactagtctagtatttttatcactcccggagattctgtttcagagtcaggggcctgatttttagtaaatcttcctgagatgattcagatagaagcaggtttggaaactactgggttagacagtaattcaaagaagggatcagagttttatttttttcctttatgttgtctgtatatttttcacatacaaaagtggaaaagatagcaagatatataaagaaaaggccaatctctcctacctctatcttctaaaagtagccatttattactgtgtagtggcatccttccatccctcttttcttgcttacacaaaataaacacgagagagagagagagagagagagagagagagagagagacagagagagagagagaagtactctttctgtttttattaaaacaatcagacacttattttgtaatttggtagtatttaaaaaaatgttatttcaaataaatgatgatgaaaccaatatctgttctcttgtctatatagatttaaatttagcgatgagtataaaaacattttcatttcatttttaattctttagcaggtataggaacaatttgggaagattcacctaggaaattttttttttttttgcgggggtggggcagggacgaagtctcactctgtagcccaagttagagtgcagtggcacgatctcagctcactgcaacctccacctcccgggttcaagcaattctcctgcctcagcctcctgagtagctggaattacaagcgtgtgccactgcacccggctaatttttatagtagagatggggtttcaccatgttggccaggctggtcttgaacgcccaacctcatcacctaggaaattctaaaactatcagttaatatactaaaggatatgggttcataggtcaaacagcatcttaaaaaccaggaggacagtattaatacaggaaggctaaaaatggcatataaagccttcttttctatacttataataaagtaattaaaagctacaaaaagaaaaccttttatgttacttatgcttagctattactcattttttagataaaagatatttttaatacaaaagcaaaactaaggcacaactgatctccacttacatgctttaacaaaacataaaaggcagcactcaaatgtacaccagaaataaaaattctaaaatagaactactaataaaaggaatgtaaattactggctaagacagaaacatcatattttagaagactaagccatgattttggtgaaatcagtacatcattcgtttgttattattaaattttcataaagcatctccaaaaagctcaatgacacacactaataattgttaaataatgcaaatgaatacttctaaattctccagtactgtaaattagcagacagtgtgggagttgcagagaacaatgagagagagaagtaaaaacaaagcaagcagtaatatgatatcttaaattaagttgcaatttctgatttactccaaaaggatctttctgggcaggcaggatttaaagagttttaagaaatgatgtctttctgcctgtcaggagtgtgttagaagtatatttaattctgtgaagttggaataggaaagagaacatgggggagaactaagttaatctagaagaggtgtgaaattggagaaaggcctaaaaatcaaatgcaaatatgctgaagatagtaataattttaaaaaggaaatagtttaaagaaagggaacaacattcagtgtggtaaagaagtggtattaaaaatagtgttttgtatttttttttggcaggaatggaatggattttatggttagataaatcaagaagacctacaatggcagttaagatttgaaattgctagatatttggcaagagaactgataaaaagagaggggagtaattatcaggtgtcacccacaccctgaaggctgcacccactcttatcctctaattcctttgacccagagtaacacttctccctcttcctgtccagatgtggtttctctactagtgctctaggtcccatcccctcctctttccttaggaacttcattccattgactatcttcagtcaatcctccaattcctgccattagctctttcagcatataaaaatcatcaagtatgccaggcatggtggctcacacctgtaatcccagcactttgggaggccaaggcgggaggattgcctgagcccaggagtttgagaccggcctgggtaacatagtgagacccaactctacatttttttttttttaatttgccaggcatggtagtgtgcacctgtagtcccagctacttgggaggatgaggcaggagaattgcttgagcccaggaggtcgaagctgcagtgaactgtgtctgtgccactgcatttccatcctgggcaatagagcaagaccctgtctcaaaaaaaaaaaaaaaaatcatcaagcgtttcatatctaaaagcaatataaaataaaataaaaagtttctttaatcttatgttctcctttaactattatatctcttcttttcacaagcaacttctaggaagaagtctacttcttccctccttgattcacttcccgctctgaagcagtctggctttaggcgtcaccatctcatggaggctgcttcacttaaaagcaacattgatctccttaacaccttatccaatcttcgggttttagctctcctatgattcgatcttgctgaagctttttacacattcatttcctctttcttgaaatgttctcctccctcagtatctaagatgtcacattcctttctctgttgttgctccacagggacccatctcagtctaatattattctccctctatactgatgacttgaactataccaattaaaagatgactcacaatccagaaatctctagcccagatctctgtggaactccaattctggttatgtctaagaagcatctctttctgaatgtctgatggtacttatataaccaaaatgaattcatcatattccaccttaaaaagtcactattccttaaattgaatggatccaccaacccctcttctctccttcacctagttattcaggtaatctgggacttatctgagatcttccttttctcttacttcccagatctaatcactaaggactagagattctctcaaaactgtcccctaatatcaatttcattgcttttgttcatttctcatttggactatgtcatattgcaacaatccccttaatgatttctctacttccaatctcaattttttgcaattctgtttcaagaggtcagcttgctgtaatttttcaatggctttcagttatccataagcccaactcccaacctccttgtaaggtataaacgctgctgcctactctccagcctcatttctaccactttccaactcaatttcatgctctagcaacactgaacatgctttcttatggctagtccttctgtaaatactgcagcaccattttttccacttgtctatctggtacattcttactcattcttaggtatctgtttaaatgctaacttctctaacagcatcccttttctctcaggtgaactttggtgttccttatatattcctaactgtagttttgaagactcttccattaaacaatgatcttattgcattataattgtttgcatgggcatcttaacttcttaactggcttagattagggaattaaaatagacattggctgggcacagtggctcacacctgtaatcccagcactttgggaggctaaggtgggtggatcacttaagaccaggagttcaaggctgcagtgagctataatggtgccactgcacactagtctaggtgacagagtgagaccctgtctcaaaaaaaaaaaaaaaaaaaaaaaaaagagagagagagattatgaaaacatttactgggagacctaacccattttttgcttcaggaaaccaatcttaaacagtgccaagaaaggcaagccaaagacagtggatgaagacagtggtggtgatgctggaaaagcccaggcaaactgaagcacagctactgtggaagagagaacagcaggaaaaaactggagagacaccaggagcccaactgtgaagggactgctaagagaaggttcagctttgtgcttccagtcactgattcaaactttcttcatgaatccaaccactaaattaaacaccagctttctaaaagctgcacattctcatactataaaagaaaatatatttcaaataaaatactttccaggctttccagaagaaaaaatccatcccatgtcacccactgtgactaagcacggaggaaacagattaaattagggatattttgcccgtacatctccaggctgcatgaaatgaaaacaaatgagagtcaggactctcaaaagtttcacagttctaaccatcaacgcaatgtgccaagcaacatagtaaatgttcacgtttcaaacaggaggaatacattttaccttttctatctgggatagaagattagattctaatcttttttggttttccactcagatgagcaccttaagtgggatcatatttctatattacaggtacttttttttttcctgaaagtctgtgaatacttaattcaaaggccatggacagcaacctagaggagctctgaccatgaaaaatgttttataaatagttccatgtgcactgttcatctggagtctcactagagatggataatgaccttgtattttgtactcatttactctgaattagccaaaccttctgtttttaattacatacttaattcacctagcatggtctaattacataaaacaaaacatcatttaaacaaaaggtggccttgaacttaatctatcaaaacaccagttagtttttaaagtttttagttcttaacaaactgccaagacatgcaatagcaattttccaaatgtgatcatatgcttttatagcaacagatttactacataatcaaacatctgtatatacttttgtctcactattaatgcaaatatgcttaagttttgatagacttaaaaatcttaaagctgaagttcatactacacaataatttttaaatatccatagtcattttggccttgaaatgacaagttatcataaccatggctacttatttacaaaatggtccagaactttgtaaaaactcatgttcagaattttccttaattcttcacagtgtaaattagtagcccttctctgtgttatcatagcaccttatatattttcaatcacagtatttataatgctgaatagttattggtttaaagatctgacccccaactagattgcaaacttcatgaaagcagagtttatgccttttatctctatcttgccaacatggagcacagtgcctagcacagagcaggtcctcaatatatatttgctgaattaatgtattaaaatacaatgttgtaaaactatctcaatttatgaatatgatcttatatgtagaaaatcataaggaattcaccaaaaaattattagaactaataaacaagttccaaaaggttgcaggatacaagatcaatatataaatatcaattgtatttctatgcagcagcaatgagcaaacaaaaatgaaattaagaaaaccaattccatttacaatcaaaaccgttaaaatattttgtaataaatttaacaaaagaaatatacaacctatactctgaaaaccataatcctcaaattgatctacagaatctagagatccaatgcaatccctatggaatcccagctgacttctttgcagaaattgacaagctaaacctaaaattcatatggaaattaaaggaattcaaaatagtaaaagcatataatggaatcctattcggccttaaaaaaggaacaaaatttgtcacactacaatattgatgaaccttgaggatattatgctaagtagaataaaccagtcacaaaagataatactgtattactccatttatatgaggtatctaaaatggttaaattcatagaaacagaaagtataatggtggttgccaggggctgatgggaaaggggagctgttatttagtgggtttaaagtttcagatttgtaagatgaaaaagttctggagatctgtctcataacaatgtgaatatacttactatttaactgtacacttaaaaatgatgaaaatggcaaattttatggttttttttaaccaaaataaaaaaaatttttaaagccaaaacagtcttgaaaaagaacaaagttggtggacacacacttttcaacttcaaaacttactacggagctacagcaatcaagacagtgtggtagtggcatgaagatagacatatagatcagtggaacacaattgagggtccaaaaataaatcttcatatttagagtcaattgattttctagcagggtaccaagataactcaatgagggaaagaataatcttcaacaaatggtgttggaacaactgaatattgacatgcaacagaacaaagttacttctatctaacaccatatacaaatattaactcaaaatagatcaaagacctatatgtaacagctaaaactataagactcttggacgaacatgtaagtgtaaagctttgtgacctggagctacacaataattttcttagctatgataccaaaagcactagtaaaaaaaaagaaaaaaggaaactggactttatcaaaatttaaaaatgtgcttcaaaggacaccatcaagacagtgaaaatacagcccacagaatgggagaaaatagttgcaaataaaatatctgataaggaacttgtatgtagagtatatacagagctcttacaactcaataataaaaagactaataaccaatttaaaaatgagcaaagggtctgaatagacatttctccaaagacaatgtgcaaatggacaataagcacacaaaaagatgctcaacatcatcagctattaggtaaatgcaaatcaaaaccagaacgagataccacttcatactcactaggatgactataatcaagaagatagacaatagcaagtgttgcgaggatgtagagaaattggaaccctcatacactgctgacaggaatgtaaaatggtgcagtcactttgaaaaacaacctgacagttcctcaacagagcatttccatattattcagcaattcttctcctaggtatactcaagaaaaaggaaaacgatgtccacacaaaaacttgtacaaaattgttcacaacagcattattcataatagtgaaaggaataaagtgttatctgcacttcatccttacacggcctcatagtattccatattatgtatgaacacaccacattttgtttatctgttcatcaattgatggatatctgggttgtttctacctttttttttttaaaagctattatgaataatgctgcaaacttttctgtctttaaatcctgacatgaagatctgggctgaggcaggggtagaggggtagagaaaatgcctatcatcaagttcttccctatgtctatggcctagatggggtgggtgtcggatggtgctgaggcaggaagaggagaggagaactctcagtaagttgctaatgagaagagatcccagaagctagttcctgtgttccattctgcagtaacatgtcctctctaccatgagtgatacaataggagaatgggtgaacactcccactgtggtagatcctaagcaaagcatgacatggccctgccctccaagaaattttgtccataagataagtcactatttcatgttactgtaataatttttgtcattatctggagcaaaaaggaggatcttttgcaacaaaagagtttatgaacctaaattgctcttgtcaagatcaccaatgacctccttgttgctaaatatccaatagtaaattataagtcctcatctttcttgggcattaacaaaatctgaaccagctgatccctctttttagaacactttcttctcttggcttccagaatatcacactctactagttattttcctacttcgctgatttgttccttatctgtcccctttgctgattcctcgtcttctccccaatctctcaatgttagagtgccctggggatcagtccttaaaccatgcagtgagctgaataatggtcccttgagataccatgtcctaatccctagaatctctgaatgttacctcatatggcaaagactttgcaaatgtgattaaattaagtctcttatgatcctaagaatggggagataattctgaataacttggatgggccctaaatgcaatcataaatgttcttttaagagggcaggataggaattcaaacagaaaaagacaaccttggaagcagaatcagagggaaaagatgctacactgctggctttgaaaatggagaaaagggctatgaaccaaggaatgcaaggaatacagatctagatactaaaaagggcaagaaactctagattctcccttaacagtctccagagcaagtgtggccctgctgaaaccctgatttagccccataagacttagtttggatttctggtccacataactataaaagaataaatttctgttgttttaagccaccaagtaagtctgtcataatttgttatagcagccataggaaactaatacagattttggagcctggaagtggggtggtacaaaaacaaaaacctaaaactatgaaagtggctttggacttgacagtaggcagaggctagaaggagtgggaggtgcatgatagaaaatactcagattgcctaaaacagatttttggtagaaatttgaacattaaaggcactgctggtaacagctcagaagaaagtgaggagcatggtagagaaatcctaattcatcttggagaacacatatatcatcataagcagaatgttggtagaaatataaacacagtaaagatggtactggtgagggctcagaaggagatgagcaacattttattagaaactgtaggaaaggagatttgtcatatagtggcagaaagcttagctgatgtgtgtcctacaattatatacaatgatgaacttagatttagatgatttggatgagatcttggacttttgagctgattatatttaggtgagattttgggttgaaactgaaatgggttgaggcttctggagatactgggatggggtgaatattttgcatgtgagatagatgtaaatccttggagacaagagggcagactgtggtaagctcctcaagatattcatgccctgatgcctggaacctgaaaatgctacctcatatggcaaagactttgcaagtgtgattaacttaagcatcttgagatatggagattatcttggattatctcagtgggccctcaatacagtcacaagtgtccttagaagaggggaggcagagaggttttacacaaaagaaaaaggtcatgtgaccaaaaaaaaagaaaacaaaaagaaacagataagagagaaaagatgctatatcactggctttgaaaatggaaaaagaaggctggtgtggtggcttttacctgtaatcccagcactttgggaggccgaggcaggtggatcatccgaggtcaggggtttgagaccagcctggccaacttggtgaaaccccatctctactattttttttatactttaagttctagggtacatgtgcacaacgtgcaggtttgttacataggtatacatgtgccatgttggtttgctgctcccattaacttgtcatttacattaggtatttctcctaatgctatctctacccctgccccctaccccatgacaggcccccatgtgtgatgttccccgccctgtgtccaagtgttctcactgttcaattccaacctatggtggtttttgttgccactgcttttggtgctttagtcataacctatgagtgagaacatgtggtgtttgattttccgtccttgtgacagtttgctcagaatgatggtttccagcttcatccatgtccctacaaaggacatgaactcatcccttttttatggctgcatagtattccatggtgtatacgtgccacatctttgtaatccagtctatcagtgatggacgtttgggttggttccaagcttttgctattgtgaatagtgccacaataaacatacgtgtacatgtgtctttatagtagcatgatttataatcctttgggtatatatccagtaatgggatctctgggtcaaatggtatttctagttctagatccttgaggaatcgccacactgtcttccacaatggttgaactagtttacactcccagcaacagtgtaaaagcgttcctatttctctacatcctctccagcatctgttgtttcctgactttttaatgatcgccattctaaccggcatgagatggtatctcattgtggctttgatttgcgtttctctaatgaccagcaatgatgagtattttttcatgtgtctgctggctgcataaatgtcttcttttgagaagtgtctgttcatatcctttgcccactttttgatggttttttttttcttgtcaatttgtttaagttctttgcagattctgggtatcagccctttgtcagatgggtagattgtaaaaattttcttccactctgtagattgcctgttcactctgatagtattttcttttgctgtgcagaagctctttaatttaattagatcccatttgtctattttggtttttgttgccattgcttttggtgttttagtcataaagttcttgcccatgcctatgtcctgaatggtattgcctaggttttcttctagggtttttatggttttaggtctaacatttaagtctttaatccatcttgaattaacttttgtataaggtgtaaggaagggatccagtttcagctttctacatatggctagccagttttcctagcaccatttattaaatagggaatcctttcccgatttcttgttttcatcaggtttgccaaagatcagatggttgtagatgtgtgttgttatttctgaggcctctgttctgttccattggtctatttctctgttttggtactggtaccatgctgtttcagttactgtagccttgtagtatagtttgaagtcaggtagcgtgatgcctccagctttgttctttttgcttaggattgtattgcctatgcaggcttttttttggttccatatgaaccttaaggtagttttttccaattctgtgaagaaaggcattggtagcttgacggcgatggcattgaatctataaattactttgagcagtatggccattttcacaatattgatgcctcctatccatgagcaaggaatgttcttccatttgtttgtgtcctcttttatttcgttgagcagtggtttgtaattctccttgaaaaggtccttcatatcccttgtaagttggattcctaggtattttattctcttagtagcaattgtgaatgggagttcactcatgatttggctctctgtttgtctgttattggtgtataggaatgcttgtgatttttgcacattgattttgtatcctgagattttgctgaagttgcttatcagcttaaggagattttgggctgagacaatggggttttctaaatatacaatcatgtcgtctgcaaacagggacaatttgacttcctcttttcctacttgaataccctttatttctttctcttgcctgattgccctgaccagaacttccaacactatgttgaataggagtggtaagagagggcatccctgtcttgtgcaagttttcaaagggaatgcttccagtttttgcccattcagtatgatattggctgtaggtttgtcataaatagcttattattttgagatacgtcccatcaatacctagtttattgagagtttttagcatgaagcgctgttgaactttgtcaaacgccttttctgcatctattgagataatcatgtggtttttgtcattgattctgtttatatactggattacgtttattgatttgcatatgttgaaccagccttgcatcccagggatgaagctgacttgatcatggtggataagctttttgatgtgttgctggattcggtttcccagtattttattgagaattttcgcattgatgttcataaggaatattggtctaaaattctctttttttgtgtgtctctgccaggctttggtatcaggatgatgctggcctcataaaattagttacggagaattccctctttttctattgattacaatagtttcagaaggaatggtaccagctcttctttgtacctctggtagaattaggctgtgaatctgtctggtcctggactttttttggttggtaggctattaattattgcctcaatttcagagcgtgttattggtctattcagagattcaacttcttcctggttttttggtcttgggagcatgtatgtgtccagtaatttatccatttcttctagattttctagtttgtttgcgtagaggtgtttatagtattctctgatggtagtttgtatttctatgggatcggtggtgatatctcctttatcatttttttactgagtctatttgtttcttctttttcttctttactagtcttgctagcagtctattttattgatcttttcagaaaaaccagcttggggattcactgattttttgaagggttttttgtgtctctatctccttcagttctgctctcatcttagttatttcttgccttctgctagcttttgaatttgtttgctcttgcttctctagttcttttaattgtgatgttagggtgttgattttagatcgttcctgctttctcttgtgggcatttagtgctataaatttccctctacaaactgctttaaatgtgccccagagaatctggtacgttgtgtctttgttctcattggtttcaaagaacatctttatttctgccttcatttcgttatgtacccagtactcattcaggagcaggttgttccgtttctgtgtagttgtgcagttttgagtgagtttcttaatcctgagttctagtctgattgcactgtggtctgagagacagtttgttgtgatttctgttcttttacatttgctgaggaatggtttacttccaactatgtggtcaattttggaataagtgtgatgtggtgctgagaagaatgtatattctgttgatttgggatggagagttctgtagatgtctattaggtctgcttggtgcagagctgagttcaagtcctggatatcctgtcttgttgatctaatattgacagtggggtgctaaagtctcccattattactgtgtgggagtctaagtctctttgtaggtctctaaggacttgctttatgaatctaggtgcccctgcattgggtggtacatacatatttaggatagttagctcttcttgttgaattgatccctttaccattatgtaatggccttctttgtctcttttgatctttgttggtttaaagtctgttttatcagagactaggattgcaacccctgcttttttttgctttccatttgcttggtagatcttcctccatccttttattttgagcctatgtgtgtctctgcatgtgagatgggtctcctgaatacagcacattgatgggtcttgacgctttatccaatttgctagtctgtgtcttttaattggggcatttagcccatttacatttaaggttactattgttacgtgtgaatttgatcctgtcattatgatgttagctggtcattttgcccgttagttgatgcagtttcttcctagcattgacagtctttacaatttggcatgtttttgcagtggctggtaccagttgttcctttccatgtttagtgctttctttaggagctcttgtaaggcaggcctggtggtgacaaaatctctcagcatttgcttgtttgtaatggattttatttctccttcacttatgaagcttagtttggctagataggaaattctgggttgaaaattcatttctttaagaatgttgaatactggcccccactgtctactggcttgtagagtttctgcccagagttccactgttggtctgatgggcttccctttgtgggtaactcgatctttctctctggctgccctgaatattttttccttcatttcaaccttggtgaatctgacaattatgtgtcttggggttgctcctcttgaggaatatctttgtggtgttctctatatttcctgaatttgaatgttggtccaccttgctaggttggggaagttctcctggataatatcctgaaaagtgttttccaatttggttccattctccccatcactttcaggcacaccaatcaaatgtagatttggtcttttcacatagtcccatgtttcttggaggttttgttcatttatttttactcttttttctctaaccttgtcctctcactttatttcattaatttgatcttcagtcactgataccctttcttccacttgatcgaataggctattgaagcttgtgcatgtgtcacgtagttctcctgccatggttttcagttccatcaggtcatttaaggtcttctctacatgtttattctagttagccattagtctaatcttttttcaacgcttttagcttccttgcaatgggttcgaacatcctcctttagctcagagaagtttgttattaccaaccttctgaagcctacttctgtcagctcatcaaagtcattctctgtccagttttgttccattgctggtgaggagctgccatccttttggggagaagaggtgctcttgtttttaggattttcagctttctgctctggtttctccttatctttgtggtttttatctaccttttgtctttgatgctggtgacctaccgatggggttttggtgtagatgacctttatgttgatgttgatgctattcctttctgtttgttagttttccttctaagaatcaggtccctcagctgcaggtctgttggagtctgctggaggaccactccagactctgtttgcctgggtatcaccagtggaggctgcagaacagcaaatattgctgcctgatccttcctctagaagcttcatcccagaggggcatctggctgtgtgaggtgtcagttggcccctactgggaggtgtctcccagttaggctacacaggggtcagggacccacttgaggaggcagtctgtctgttctcagagctcgaacaccatgctgggagaaccactactctcttcagagctgtcagacaaggacgtttaagtctgcagaagtttctgctgccttttgttcagctatgccctgcccccagaggtggggtctatagagtcagcaggccttgcagagctgcagtgggctccacccagtttgagcttcccaggctgctttgtttacctactcaagcctcagcaatggcggatgcccctccccctgccaggttgctgccttgcaggttgatctcagactgctgcactagcagtgagcaaggctccgtgggcatgagacccgccaagccaggcatgggatataatctcctggtgtgccttctgctaagaccactggaaaatcacagtatttaggtggaggcatcccgtttttccaggtacagtctgtcacggcttcccttggctaggaaagggaaatcccctgaccccttgtgcttcctgggtgaggtgatgccctgccctgcttcagcttgccctccgtgggctgcacccactgtccaaccagtcccagtgagatgaaccaggtacctcaattggaaatgcagaaatcaccgtcttctgcgtcaatcacactgggagctgcagaccggagctgttcctatttggccatcttggaatggaatccatgtctctactaataataaaattagccaggtgaagtggcagatgcccataatcccagctacttgggaggctgaggcaagagaactgcttgaacccaggaggcagaggttgcagtgagctgagattgcaccacactgcactccagcctaggcgacagagcaagactccatcaaaagaaaaaaaaaagaaagaaaatggagaaagaaccaaagactcaacgaatgcagctccagatactgaaaagtaaaagagattctctgctagagtatttggagggattgtagccctgctgatagcatgatttagcctcataacacttagttcaaatttccccagagaaggtgtggccctgctacaactcaggtttagccccgttaagatttagtttggattcctggctccagaactgtaaaacaacacatttctactgttttaagccactcaatttgtggtaatttgttacagcagccatgggaaatgaatacagaccccttcccttctctacatatactcatttctttgttacagcagccatgggaaatgaatacagaccccttttcttctctatatatactcatttctttggagagtcctttgaagatcccattcagtctcatggttttaaataccatctatatactgattaccacaaattccagcctagaactctcccttgaactcccaatttggacacacaatcgtatatttggtatgcccacctggatgcagaagaacttcccagccaacaagttccacccacagtcttccccagttcagttataggcaacaccatcctggctgttcaaacaaaaaaccttggaattatcccggatctttcattctcatattcagtcagttatacaattttgttgcctatatattaaaaagttatcaggaacctgaccagttcttactgtctctggtgctctttgcccggatgactgcttctacccttgccccactcaatcaattctgaaatgtggtcagagtaaactttttaaagtcagtcagttagagatcaagttatttctctatggctacatatttcttttagaacaaatgcccaaatctttacaataccttcagaagcctaccatctggtgcaccctaccacttccctatcctgctctccaacttcatcttcttatgttctggccctcactcattcagctgcccaaaatcaatgtatcactttagtgttcccccaacacaccaaaggaagcttccacttcagagtctttgctggtccctctacttggaatgttcttccttcagatatccggatggctcactccctgcttggtcctttacctccttcaagtctttattcaattgtcactttctcaatgaagccttctccaaccattctactcaatattgcaagccctttaccccaacaccggcctcattaccttacgtggttcttttttctctccaaagtacttatcgtcttttagcaaactgtatactttactaatttattatggttattgactgttttctccattacagtatatgctttgtgaaggtagagatttttgtctggtttatttgttgctatatcatgaatatctagaacagtgccaggcatgtattacatataactgatttctagtatataggaagtagactgcactaccctagtatttaaggtcctgatgaatccattacaaatattttatttcagacttcaagtttttatctatactgcttcaggaaacactttatgttaactattatcataggtggcaaattcctaagttacagcaatattacagtcaccctgctgtaataatcacctatctactagaaaggtagaaggaatagttgtggctcatattgtatgattctacttacacaaaatgtcaagacaggcaaatccacagagacaagaagtagaccagtggctgcctaggactagaaaaagaaaagggtgttgggaggaaatgggaagtgactactagtgggtacagggtttctttttgggataatgatgaaaatattctgaaatggattatagtgccagctacaaaactgtatatgtactaaacaaccattgaattacatactttaaatgggtgagttatatggtgtgtgaattatatctcaataaagtttttattaaaaatttttatgtggctgtggctggttatgttttggattgcttaagaaataaaacaattttggggaaaattatgggaaaacaaatttaaaataaagttcttaacaatttaggactaacaattactatcacaatttgacagtaattaattaaagtaagcaaaattattaggattctaaaaactttcaaataaatattttaactgcatagccttgttctatttaatgacacaaaagatttaggaaaggtcaaggtaagaactaatgatgtattcttacataccttataaattgagtaaacaaaaactcagggaaactcatctaaaaaaataaaaaggttttcaaaactcgacccacatttgcccaatcaggtactaactagtctttccccaaccatctttttttttcatctgaaaagtttaatgatctaacctgctagagattcagcatatgatgaaagggagcttgcagaaggcaaaataattatacgaacaaaatatctttccttttcttaacttggacaaaatatatttagacagaattaaatggcagtttcttgggtggttctttaaagttttcctaggcactcttaagattggtataacaatataaattttattatatctttaagcatctcagaaattacacttataatttatgctcataattataaatagatgtgtctatgtaaaatgtacagtgtactcatttaaaaatctagattcacagcattaaaatacttaggctgttttatataaactacaaacaaaaatacaagttttacttagatgactattgtgcagattattaagagactggtaagtttaatgaaaacatcctaatggaattattttattaaggagaattactttgacatttaaatttttacttgaaagaatcctacctagtaatcgaatagctttttaagaacagtgtataaaataaactataccataaacttaagcctagagttcatcacagattaaaacttttaaactttaaactaatcataaattaaagtatacactgaggaataagacatatacagaaagagaagtactatggccaacagctttttaacaagactgtaaataaaccttattttaccaatattaaaggattcacctaccatattctattaaaaattctatttttctactcataagttacctcaataacaaagatgtgaaaatctaatacttttctaaaacttactaacattttatttaaagtataatatctaatgcttattgacatttattcaaatcacttctttttaaataaaaacaagttctctattttgaaattttgtaggactcaatatcaggtattttgttaaatggtaacttagaataaattcaaaagaaaggtttaaaaaagaaaagttctaagcttttaaatgatcctatcaatattggtgtccgggttacacacaactataaatcaaagcagaaactggcaaaataaaagaatgatgttgacatacattattctaatacgtaatggatttctgtaaagaagaattactagagacaatagatgccccttttgttatgctgctattaagtattattgaacagtcacatttagtttaatgcctaatccagaggcatgccacaaatatgcaagtcctatttttgtctatgtctgaagacggttatgtgtgttctttttctccttccaatttcctaatcagttttgcaaatagttacaaaatttttaccaggccaaacagccccctgctccctaccctcacccatatatttgccttcattttcagcccctgtaacatcagagggtttttttttaaaactgtaaataaatcctgactaattatgatttattcacagctgctctcaatgatattatgaactagtatccttttccactattaataatttctataaaatatttaaatgcagtttttttttacaactagaattctcatttgaacaaacaagaaaatgtcatactgaaggtaaatacatcaatttaaaaatttctcttataaataagtatgttttaagtttaataaagtagctagcacagctgggaacaggaaaaatgctgtttgcttcaattttgcaagcatttgatttgattggatggcaaaatcagcttgactgtgttagaccttaaagcctaacggtgacataaaataggtaaaataggataccctgtgagtaaggtgggtgaagtaattgataatacagagatattttgcaagtggctcccttgactgcattactttctaaagggaggtgaaaggcacatagaagtcactgaaaatacttttgttgaacaaacgaacattaaaaactaaaaaggagttttgttagtgtgttattctagaaaaaaatataaaattagaacattaaatattaatttatacttaaaccaagtaatcctaaatcggtctcaaaaaatatgaataataacatattctaacctcaatgtgtataccttattaatattttctcatgttctggaaaattaattaaaacaaaagtggttcttattaaataaatgaataaaatctattgagacaaatgcttattcatattttttgaatttgaatcacttcaaatggaatatctaataattcagtatttacatatcccataactttaaaaatataacaatgtaagatactgaatcttaaacatacaagtagctactacatgttttgcacacctataatttgcatctattaaggattaaaaatattaaatttctttttattctaaaattcaaaaaaagactatattttaaatatagtcatacctaagtattttagaacattttcgcttaaaggagagctaattgatgctaccctaaatacaagaagctaaatatattaagtacatcaatatgaaatggagtatgaactggtatgtttcctgaatgccttctcttacattgttactaattcattttataatttaccatgaattaaaataatagtttcctaaaaatgactcatggaaatatatgggtgtataaataccatccactttctcctggaaatgtattatcaatctgaacacagaacacagaacctgaagagagaagctcaagtgttttaaaaatatttcgcctctcctcagcagctgatttttccatgcttgttttaaatattaatataaaacaggttttccttaaattacaaaataaaggtaactttaaagaaatattcatttaagttagaggttatgtattaaattgttgccagtgatactgttttaatgttttagttacgaaacagaaactgaagtgaaaaaaatcccacttgcataattttttttttaaattttttaattattattacactttaagttttagggtacatgtgcacaatgtgcaggtttgttacatatgtatacatgtgtcatgttggtgtgctgcacccattaactcgtcatttaacattaggtatatctcctaatgctatccctccctcctccccccaccacacaacaggctccggattgtgatgttccccctcctgtgtccatgtgttctcattgttcaattcccacctatgagtgagaacattgcataatgttttaaaacaacctttagcttgtaatctagatgtaatttgtttttaactttcagaacaataaaacaataaatagagactatagtaattgattggtctgaattgttctaagttccttagtatgaattctgtttcacagttaagccttagactcaacttgtttaaggcaaatagacaaagtataaaatattactttggagatacaagataagtataatttttgaagaagtctcagtttagaattttagatgacataaagaattaatacataaacaatatgtgccacatgtgagcagtatgcacttaataaaatatttgtatgaagctaaaaatttcttaccaaaaagttagtaaaaatagacattattattattccttccttgaaaaaacctaaaactaaatctttaagtaaatgatctataagaattcttagtctggtccatgtgattacatggtcctatgtacccagggccactggaaattctgtaagcttagatagcatgaattctgaatgttagacattgctgttcaataaaaaataacttgtattaaaatttcgtattttcactttcatggttttatttccaagtctggttattttcactacaacctgattttccagatcagtggtgtctggtcaatttatctatgggtaaaataattaagtgttcatatgtctatacccaaatgctcctccagagcagcaatttgcttaagttggcagtgcctaccgcttggcatgcaacaaggctgtcacaaaaaaatgtttactgaataaatgatgaatgaaggaaaaaataaactaaaatatttctgtagagaaagaaacatgaaatgctctaaaatgtcagtcatgtcagtaatgtttatttttacagaagaatgctgactgaaagtgtttaactgtcccctgaattgtgagactaaggctcacaacaaagacaaaaataatgtacaagcaccacctatcttgaagacagccaccaaccaaatggggccaaatcgccaaccttgagtttactcagaggttgaatgagccccaccactcccaaatcatcacccagcctacataagagggcaagggtacatcaggagcactggggtgcagtttttgtcataggagcttcctcactcaagccaagttgcacagcaccaagatattacatcaaagacacgttgtggtttcctgcaagaagaggagactggcatctcactttccagctggactgaatactgaataaagaacctgcaaacttgccctggtgctgccagtggagtagaatttagcctgctgaagtgttcatagatgacctggcatatgtccctagaagttggggaaaatatattggcctagaaacttgtctacttcttatctagagatttctgaagatgggaggcttgggtagagcagcctgcagcagcagacctaatagggccacagaaatagtatacctgggtggggcgggggagaagtggagagtacctctcacatttcccctatctacccactaattctctgagaccctagaaaaagaacaccactgactcccatggctcatatgagagaaccaggactggggaagaagcaagggctgctggtcaaacacatcaatgccccatctagagagaggggaggagtttgaacttatgaaacagaaaggagatatagctacccatctctgaggaagagctcagtgataaaggaagccaagataaagctatcatcccaagaaaaccacatattccaaccacatgaacatcatattgtcagagacattttgcagcacttagaaccagattatgccagagtgagacccactatcttcagataaccacgttcactcagatgatgacctctgcctctcttgtccttcctccatgctgcctccttcccctctctctccaagaattagacctaggaggggagaaagcatgccaacagtcttaggccacttaggtggtcttctctaagatgtagggtggggaaggatcaagtgagacttaaatcaaatttgagattaaaatcttaaactacccagacttttactaaatgaaagtgaccaaaaagttgtagcatttgtccaaaggcatagttaagagtcagaaaagggagattagaaagagcatgcttcaaagtatgttttttaaaaaaagtaatttcagatatattgccaatgagttgtaactgtttaaaagttatttacaccctgtggtaggatgaatgctcaaaaaactgctaacaaaaaacttgatagctaaaactattctttaagttcaagcatagactgatacctgcccccacactccccctacctccccacaaaaaaaaaaaacagtgaaatcctactcatggtaaattctcaggtgacagctgtaatcggcctacatttaagcttggttcaatatatccatgggtagatagagccagcctctgctcactgttcctgccccactcaccttacatttgggataccctagaaatccatttttggtaatcatctctcttcaagggtctctctggttgatctcatatacttttttccatgccaaatagtcccaaattcatggttccattctgtactttcaactatctaatagatttatatgtcctccagacactgaaaactctatacatccataacatatcttgttagcttatcctccacacacacccagtctctaaaatctgttcttccctttttctattctttatctcaaacaatagcaaaaccatcaatctaattatctaaatcagaaaccttcttcttcaccctaatcctctatataaaactgatgatcagatccagatgattctaaatgatctaatctagatgatttcttgaatgtagactctcttctctaattccactatctttgccttaatccacttttaacaatttcaacagtctttaatccagttatcctaggtctccagggtctccagttcctctctatgcttcactttgacaccaaaaaacaagtttgataagagttttcccctcataaaaattttttattagctatccattactcataggattacggctaaacctagaagcctcagcttggcagttaaagcctttaccacctaggttactactgcatcatatccaatactagtctgttcagcagacatggttgcctttaggacctgttctctgacccagctgaaatgtgcaaaaaagcattctgtgttgctggctaagccaactcagtctgcaccccgcacctcggcctgctccatgtctgtattcctactttattcgaatgggcttcagttttgctactacccagagtttggattcagtgctatgatttatgcatctcctctttctcttgactgatggctttacttctggctcaggctaacctcttcactaaaggcttagtgatagtatcattgttaaatagtacaaagtaaactcttaagtcagatttcctgggttcaaatttttgctctaccacctacaagctatgagattttgaccactgaacttaatctctccaggcattagtttcttcagtttttttttttattcttgcagcttttatgaaagttttcttttttaaaattttattattattatactttaagttttagggtacatgtgcacaatgtgcaggtttgttacatatgtatacatgtgccatgtttaaaggataataatagtaccttctgtaaaggatctcctgcattgtcaggaaagtgctttaaaaagtactcactacatactaagatctcaatatgtgtcagctgctgtttttcccaatacttattagtttattagccaaaacaaaaggacaggacaccctctgagccataaaattatatatgtagataaacttcacacaccattttcaatataaagactggctacttagaaaaacaatttcagatgctgaagtttccaacttaaaacagcctcctatcatgagtcatagcaaaatgtggcatagttgcccaaattaatagaagcctaatagtttaaatatggcgtcaagaggaaaaaaaagtataaatgaccatagacaaggaagaaattcttacaggtgagagtaactgatatacaatatggaaagacaccacaggttgactaattctggaaaattctttaaaaaatgacaacaaaaaagatgaatttccacatatcgaaagagctgctactaaatgatgactactagacacccaagggttacagatacttaataatcttcttcagttatttgaagaatattttttctagaagaatatacctctaattttataataaaagatggaagatagaatttatttgcagacttgagctataattcactgttccacaaagcaaggggaaattatctgcactttatttctattgtgccttatacagatatgctaaggggaaagtattttaatgttcataatcaaaacaaaaatgattaaatggtcaaaaccaaaagcaacgcaatttcaggaattctgtactatcactgaagttctaatgaattagtatatttcttttcatcaaagaatataggcattaaaatgacaattttagatctttcattagcaaagataatccagaactcgctagtcgttccactggactagttagtacaagaatatggccgataattaactttttatatatttatatatttgtagccttggctattaggtagtttcatttgcattctcaaattaagatagagagttaaaaactaaactgaaggtctgtgagaatgaaacttgatactctaacccaggttactgagccttttataagatgccttaataattaataatactatactgcatatcaaatttcaacatgcaccattactgaattcatgaagaaaaaaaggtctgttgagaaccatgtaaatgtgtcttcaaaataaatcagtaaggtatcttttttccaaaatactttcatctgctatgagaaacaacattagtttgaatgcccctatcactcatttatctccttaaggtctgtctatcgttctggaaaggtgtttcaacaactgatgaacacaattacaaaacaagactactttggttttgaatcaagacaactagattctggatttttaaaaaaagtctattatttactgaaaagtcttccaacatgaagaaaccaacctaatgagggctttctatttttatgaatgagaggtactatggaaaaggctaccaacctaatggcaggaaggaggaaaaggtgtcagcattaattcaagtaggccaacaaatatgataggcccccaaacaatgatgtgcatacttctaactgtggaagatagacatgagaagtatgatggaagtcagttatagaaagatttctgatagtgaactactatgcatactcagaaaacctgaattaagtataaaattacaaaaataattttagatttaaagaaatttcatgacagttcaagtacaaaactattccatcatcaaaacacaacctgatatatgcattactagtttcctcaatcaatttttaaaacttttttgaaatcgaatgctttatttatttcaaaaggtaaacactgttgggctatcagtcttaaattagaagatcataaattacattgtccactctttgatcctaaattccactattggttaacatctcttttgatgtaatcaccccaatagtccccagtgcttactgactaaacatccaaaattgggttatgaatagaaagcccacatagtcaaaataacttccttagacatcaacattagccacaacatatgcttggagtacaatatcttgttttaaaatgtagagtagtcaatttttcaatgtaatcttctaaataaatgacattttaaaaagagcaaactactatgaggagagtttgtgcttcttggagctctttttgtaagtcatttttcttttgccatgtgctttaaacatcttaataaattataacatgttgacaagaaaccacatactgcacctgtgctttctatcttaattaatccaataagtacaggcctgctcacttaaatttgtaagggaaatgatgatataatgagttttaacttaaggtattaattacctaaataagcagaattagcttaatgtttcagtagactttgcctagacacaaccaccaaataaaaatttcagaaattatggaagccttaaacagcaccattaggaataagaaagtgaaacgctcattctacctcagatagccaagtggattaaattctactaaagaaaaaaattttaaaaaccagtgcagcagttcagagacactaaaatctttgttgcttttaccgaagaatcaattaaatctagtttagctgcccagtgactaaattattattttctacttgtacataaacacttttctttgaagcaggtcactttcctttcaaaacaaaggttatgactatcttaaatgcctcagcagacggatggtcaaaacctcataaaaattctacatggacctagacaatcacatgacacaactgtgcacacgccacaccatctgttggatatgactgccagcacagatttcgtgagctggcaaaggactgaaatagtcaagaattctgcaactatttcaaagtgcaggcttctcattaattttaatttcctgttggctctacaaggaatgactgagtagtgaaagcacaatatgccacatacacttgagttcatgccacatgtacacctgtaatcataaactcttatccaaagctatccactggaacatttgggattttgtgtgtttatttcttctttaccctagaagaaataaatctgaaatatctatagttgtcttttcatactttgttaatactcttgcaaacatctggaaatacttgacaataatcatttaattaatgcaaaggtaatcgatgacaatatgcttaaatacttcactcaactgaagtggtttcctcagtccacagaactaaggactgtagagaacaagcagttctttgactaaggagtacactacaaggaaaactatagccaatatctcttttaaaaccagaaacattacctgcatttaaacaaagcagataacatgctgctatactggtaaaacaaacaaacaaacaaacaaacaaaaaactggtagatgctgctggcttaagtttttaccttaagctgtctacagggtctgtgttgctgagggcttactaaaggggtggccctgctcctctttttcggggctactctagtttctttatcactccttcacagttgctggctatagaggagggtgaaaagaccctgagaaagaaacatttctccagaacaagtgaagattcctaaaatgtccatgggcagctccagcagcagggttggtactttctctgccaaccctttactgttttctgcattttgcaacagtgacttttgttttgtttccctgtaatcatactcacttgctaatgcaggcaacaaaggtaggactgcggaaaaactaggaaagccccaggcaactttatacttggggagcaaagttagtttttttcccttctctgccacaatttttgggactttttcttcagtgtggccctggaggattcttgtgtcccttagctcaaaagaacaccaccaactgaataaatatttaagaatcagagtaattaagaaatgttaacttactattcagtatgagtcacaaccaaaaatggttgatttacctaatttctcttatactagtaattactgtcaatccaatttctttcttttttaaaatttggaaccaatgtagtgggttaacagatggcttttgaagtttttgttcttattccaaaatctttacattacccaaaatatatctatttaaatatgatactgtaatttctgcaaaacattatctacatgctctctatttaacactaaacaatctggatgttaaggctgtttggaaataattctaacaaaaactgaaacattagactagtgctataataaacagacttgccttttacatttgttttagaaatcttcataagcacatcctaaacataacttttttccggtagggttaaaaataattcaattagcccaaatatattttatctcctatctttttatgataatccccaatttggtgacatcataaattcttttatcatctccttacattcaggaacataacataagaaaatccatagaaaatcccaaagacaaatgctaacgatttaaaaggaagtacacaaattctattgcatacaggctttaagacaaggaatgcttcctaccctgcacatctgtctagcaggtgcctttccgaataagttttgtcctttaggaatctgctctgagtacctcaaaagacaataaagtgttctctttcatttttttttcttagaacccattttcctcaaggcagaaggatgaagccttctctgtcctgaaaatatggtcaaaacaactttggcttattttaagcaacttctatcaaatagacttaggaattatataaaatacagttctcttctagaaggcggcctcgagatgcatcatgaagagggaagataaacacataaaccttagtatgctttatactttaatgagtcatattttttaacattctgtaactaatagatgagggaatgaataagaccagatttccctcattaacagctggtatctttgcttttagtccacttccccattttgtgagcaaagcagtccaccaaatcacttacgctgtgctccacctatgcttcttcttttaaccattctctctttgcccctcttacacccttttccttgtcttttgccatactcactactactcttggcaattatttgttcatcttctggcaatgcttcctttattcatctcttatttatttccatttccattccgctcagtggcgattacaaacattttccactttcctcaaagtgatgagagggttgagcagttccagttgacaggtgtaataaatgttgagaaaggaagaactgttctagtcactccgtccctcctgcaattccctttttaaggctatctgccctatataagtcaaaaataaataactctgcaaaaattggatccagtcatatgatctcttgatatccctttccaactgtgagaacatcttcctttattatttttttttggtactgtcaccatttatcatttggttcctcaccttaactaatcaaaatagtactcttcaatctagtatttcagctatttctgttaatctttcctcctcattcttgtttttcttttcaattttattcctatattattttaagcttgtgccacataaccgatttcccctaccctgagtctcttcctatcaatccttcatgctatcttcaatattaatattcttaagatacttttcatcatgtcatcctccaacttaaaaccttcagtggctttccactgtctattaaataaatattcagactctgtaaccttgcaagctttcaccctctgatctggatctacttttccattttatctctcgtatttttccagattaactaccacagacttgaaggtctctatttcattgccacccaacacagattatgctttcctactgctaagctttttattacacatcattccttgtagttcctgccttctctctttctgctatccatttatcaatgcttagacaaagtcctcttccacattataatttcatatacaactccagccttcatcaaatctccctcttattcaaaaccacatggcaatgtctgagttattgttctggattacaatttaccacttcattaactcataccttgtcctcttaataaatcagtataatttatttttacccacagtgcctagcacaatccaaagtaaaatatttgttaaattagcttaatgttttctaacaaattttggaatttccagatagaatgactacaaaatctatgaggggctaaaaatgtttccaaaagttactttcaggagttagccattggaaaaatagattcacaaaactaaaatgagtctaagacagacagtagaaggctacatgtcaaaaattgtgtgtatgtgaaaaatctgaaagtagagtactgcaatggtcattatcaaaatcattaatgaactctgatttcctaaattcaacattctaatttctgttgaattttaattaacaccctttctattagattgtctgcaaagtatactgtaataattccttccatctcatagcaccctttgccatgtaactttgctgttccttccatcatgaggtgaaatttatttccatatcttatgaattaggactagacttctgacatattttgacaacagactatgacaacagtgacactgtgcaaattctttcccctcttctcttatgcattttttatgcaaaaaaatgcataacacaaaattaaccattttcaagtgttcagttaagtggcattatttacattcacactctcatacaagcatcactaccatccacttctggaacgtttttcatcttgcaaaacggaaactctgtacccatcaaacaataactccctatttctcacccgtgagaaccaacattttattttccatctcgatgaatttgactattataggtaactcatataagtagaatcatatagcatttgtccttttgtgacctggcttatttcacttagcataatgtcttcagtgcttatccatgttgtagcatattgcacaatttctttcctaaggctgaacaatattccattttatgtattacaacatttttttaatccattcatccatcaatggacacttgggttgcttctacctttttgtcattgtgaataatgctgccatgaaaaagggtgtacaactacctctttgagaccctgctttcacttctttggtacatacccagaggtagaattgctggattatatgataatgctatgttagtttttttgaggaaccaccatactgcttcccatagtgactacaacatacttccaccagcaggtgcacaaggaaaggttccaatttctctacgtcttcagaaacacttgttattttatgtgtttgtgttttgataatagtcatttgaatgggtgtgtagtatcttattgtagttttgatatgcatttctctaatgattaatgataattattgaatcttttcatgtgtttattagccatgcttatcttctttggaggaatatctatttaagtcctttgccctttttttttttttttttgagacagagtctcgctctgtcacccaggctggagtgcaatggcacgatctcggctcactgcaacctccatctcctgggttcaagtgattctcctgcctcagcctcccaagtagctggaattacaagcatgcaccaccacaccccagctaattttgtatttttagtacaggtggggtttcgccttgttggtcaggctggtctcaaactcctgacctcaggtgatccacccgcctcagcctcccaaagtgctgggattacaggcatgagccaccatgcccagcccctttgcccatttctgaaatggactgtttgggttttttttttgttgctgttgagttgtaggagttcattatacattatgaatattaacctcttatcagatatatgatttacaaatgttttctctcattccattggttgccctccactctgttgatagtgtcttgtgatgcacacaagttttccattttgatgtagtccaatttatctattttttgttacttgtttttagtgtcatagcctagaaatcactgctaaatccaatgtcacgaagtttttctcatatgtatttcctactaattttttagttttatttcttactgtaagatctttggcccattttgaattaatttttgtatatggtgtaaagtaagactccaacttcattcttttgcatgtggatatccagttttcccagcacgatttgctgaaatgcctcttctttgcccccactgaatggtcttggcatccttgccgaaaatcatttgaccatagatgtgaaaagtttacttctcagctctctattccattggtctacatgtctgtctttctgacagtaccacactgttttgatttcagtagcttggtagtaagttttgaaatcaggaaacatgagatcttcaattttgtttttctttttcaagattgttttgactaattagggtcccttgagaatccatatgaattttaggatgagtttttttctagttttgtaaaaaatatcattaggattttgacagagatgacaatgactctgtagattgctttaggcaatattaacatcctaacaatattaaagcttataatctatgaatatgtcttttcatgtattgatatctaatttctttcacccatatttttgcagttttcagtgtacaagtcttttacctacttggttaagattattcctaagtatctcattctttttgatgctattatcaatggacactgtgcagatcctacgctgatgtcaagaggccttacaaccttgttttcaccttcttggaaggctactactgccacatacaaactccaggcttgcctgatgagatcatatgacctagccaatagttagcacaattgccaacacatttgggaagtaattttagagagagtgttcagccccattcaagtcagcagatgactgcagtcacttaagaaaccccaggtaagcccagcagaagaaacacttagataaacctagacaaactattaacctacaaaattgtggttttgatgaaagtaaaatagttgttattttaagccattaaattttggggtggtagaaagattaactgaagcaaagttaaatcattttatttgccatttcttaaccatgataatttattcattactttgtagctcatttcaaagtgtttctcagagcccattaagatgtattccatactactcagccataaaaaagaataaaatcttatcttttgaagcaacatggatggaactggtagctattatcttaagtgaaacaactcagaaacagcaaagtcaaatactgcatgttctcacgtataagtaggagctaaacaatgtgtacacacggacacagagtgcggaataatagactatggaaacttggaagggtgagaggggaagaagggagtcagggatgagaaattacctaaagggtacaatgcacattatttgggtaatggttatactaaaagtccagacttcaccatgatgcaatatatccatgtaaatttaaaaaacagcaatcgtacccttaaatttatgccaaaaaaaaaaaaaagatttattccaactgacacaagacaactctttgaggctaaatactctacattattcattatattcatgaataatttaaagcttaaatgtcagcattctaaataatttataattttaaaaaagtagataggttaaaatgaaatcttattaggactaaagatgtattgattttatttttctaactgcttactacaatattgaaaaaatattaagtagacattgcaatgatgtttgcaagctaacctgtgaattatactgctaatatttgctagcaattagtactaaatttattggggatagattttgaaactttattatctgattatttaaaaactcaatcacaatattgaggaaaaaagtacttaaaatatttataattgcaaagcatttagagtcatgttgtctaagcaaaatggtttattattacttaaaaattcttaaatttaaaaaatgtacatatttatatttatctaaaattgtatttacttatccatacgtttattaataaataaaactataaaggattataaagttattttgtttgggaaaaaaaatcttccagaacaatatgcaaaagtaacattattatttaaaatgtggttaagtaaaaatttactccataaaattttcactccattaaataactcattttgagaatttactctctcaagttctggaaacagttactttaaaatagttcatctgtattttatgtattctttaaaagaagtaagaagaaccagggtagaagaaataatgagaaaatgtaacaaaataggtgataaggcagttttatactgaagtttatatgctcctaggtacagaataggactattatttctgagaaaccaagtggaattaacacttactcaaatagaaaccaactcatatactttaaaaattgaagcaaattctcaaactctatgtcataaatacctttgcttcattaattttggcaactgagtttactgaatgtcagaagtatctcatatttgcattattgaaaacatcttttaaaatagttgtcattttagttttaaggagtcctgaatatttatttaaatttgagctatgatttatttaactataaaaaagtatttctctgcaagtacatttctataagcaagctacagtttcacaatttctctaaccatgtatatggctgtataatgaatattaacatatggtctataattgtatatacatacacacagttcatatacatatgaactatgcttctcaatttgatgataaaatatagaaggagaaaacataaattgaagaattaaaatgtacttacaaagtcaaagtctccatcttgaggaactttccagttatcaggaaaaacgtttttggacatagggaagggttcatgcatgttctgattacagttttcgtgactcttattcttgaagtcttgcttatcaaagtagtccatgaaagatggtctttgtacttgtggtgaggttgcatttccttaggtaaacaaagaacataaggaaggtataagttcttacatttaaggaagtattttctttgaagtatgatttttttatgaagccatataataaatttgcactggtcagattcaaggccaacataattaatttcataaagaacaaagtgaaataaaataagaattaaaaaatacccagaccaaataaaaattaagctgatgattaggcaaaggtctggaatgtttagattgtagaaacatttcagaagtttagtaaaatcattatcagaattttattaaaaatcatttcagctttatttcaaatttctcaaagaaagtaaattttaaaaactcaggtgtttttggtgggctttttttctttgcatttaagcctgcattgctattgttattgtacattttcagctgtaagaaattatgaggacttggctaggcatggtggcctgtaacctcagaactttgggaggctaaggtggaagggatgcttgagcccaggagttcaagaccagcctaagcaacatagtgaaactctgtctctataaaaaatacaaaaaattagccaggtgtggtggcacctatctgtagtcccagctactttggggacagaggcgggaggatcacttgagcctgggaggtcaaggctgcagtgagctatgattgtgccactgcactccagcctgggcaacagagcaagaccctgttcaaattaaaaaatatatatatatgaaatacataaactttaaaaaaattaaaaaaaatcataagaacttactcagtttcctcttatatttatcaaactgcttcctcagtctttctgattccctctgtccctggacttccatggcttcgcctgccacacttacatccatgtctcccaacactacttctctagcccagactttgcgcctaagttccataactaactttgctagctattagacaacttaatctgaggtgagttgccaattaatttaccagttctaaaactaaattcaagatctttcccttcaaacctacagctcccccgacatattctatctccactaaagtcaaccttatttactcaatccccaaaataataaagttgagaattaattcagactcctcccttcccaccatagcaaactgattattaggtcttttaattctacttctcagtacagttaactataaccccttttctctacttatcattgcaactgtcttagtttagcttctaatcacttcttgcttaggccattgtagcagcctccaaactagtctccttgcttccaatatcacagttttgattttaatttccatattgtcaaagtggtgacctttctaaatacaaaccaaaagatgtcattctgctcagaatctttcaatggctcttcattttttatactgaatgactaaataggaaataaatatttggaataactagatttttaatctggctatattggtcttgatcagtggttttcaaattggatccttaaagccccagggctccaaataaatgtcccagagaccaccaagaaggcatttcccatataattctccaaatagaaagtaagctactttcctttttcttttctttttttttgagatggagtttcgctcttgttgtgcaggctggagtgcaatggcacgaactcagctcattgcaacctccgcctcctgagttcaagcaattctcctgcctcagcctcccaagtagctgggattacaggcatgcgccaccatgcccggctaattttgtatttttagtagagatggggtttctccatgttggtcaggcagtaagctactttcttaagaattttttgtggggagtacacctccccacaagggaccctgatgggcaactgtaagttacaaaaagtatttttaaaacgtaaaattgaaatctttccttccgtaatttacactcatgttccaaataaattactctttcgtataattgtccctcaaatatctgaagacagaggtaatggctcctgtcttggctgtctatttttaatataaaacatccccagttcctttcataggatatatgtttcagattcatcatcaacttgtttacttgcctatggagacattctagtctactgttcctctaaaaagaaacataatattcataacagttatctgaccaacctagattgcatttgtaatagtcctagcacagttgaaaactacagttactactatgacaactaagtaacaatgttagttgggacgagctttaaggtcattttggtcaaaagaaagcatgttaagacttatttttagtctttaaaaatatgagggaagcctaaatcgatgcctactttatgtggcaaatcagagagtccggaattcttaatcaaacttcaaaaaacaaaagggggggggacggagattgaactgacaggtaaacgtcctatctcctctttcctttctccctacttttggatctctatgtgtgttatttgacagattggaagcctaggtgaggcggcttaggtgaggttataagagagagtggtaatggtgatatttattcatcaaaagaattctgtctcattgccttaaaataaaatggtttgccatatcaaaacagaggttttattgacttcaccttatgtgttttaaaaaaatttttataagataaaatttaccatcttacttctgggtatatatccggaactgaaagccaggtcttgaagagataactgtaaccccatgtctattgcagcattattcataacagctaaaacatggaagcaagccaagtgcccattagcaaaatgtgaggaaggaaattctgacacatgctacaacatggatgaaccttgaggacattatgctatgtgaaataagctagtaacaaaagaacaaaatactgtatgattccacttatgtcaggtatttagagtagtcaacatcatagagacagaaaacagaatggtggttgctagggactaagaggagtgggaaatggggagtcggcgtttaacaggtacagcagttgagttttacaagatgaaaagagttatggaaattgatggtggtgatggctgcacaactttatggaagtgcttaagattaatactattgaactagatacaggcatatttcgcagttattgcaggtttggttccagaccactgcaataatgagaatatcgcaataatgtaagtcacataaattttttggtttcccagtgcacataaaagttatgtttgtttgtttgccttcacaacgtcaattttcttaaaaatttctttttaacttttaaggtcaggggtacatgtgcagatttgttacataggtaaacttgtgtcatgggggtttgttttacagattatttcatcacccacgtattaagcctagtacccatttgttttttctgatcctctccctcctcccagcctccactctctgaaaagtcccagtgtgtgttgttccccagatgtggccatgtattctcatcatttagcttccacttgtaagtgagaacatgcggtatttggttttctaaaagttatgtttaggagtgacatcagaaagatggctgacaagagaggcctggtgctagtccactctcaacaaaaaaagaccgaggcaacagataaatagctaagatttgactggagtgtcagtgggagaaccctggagaataacgagagagtgcagaggcacctgtgctgcttagaagtccagtttggggtggctgtagtgtttcttaaataataccgcagtgaagtttgctgtatcagttaactcttcctttcacaaaatgtttctctgtagcatgagatgctgtttcgtaacattttacccacagcacagtgtctctcaaaattgtagtcaatcctctcaaactctaccactgctttatcaactgagtttatggaaaattctaagtcctttgttgtcatttcaacaatgttcacagcatcttcacaaggagtagattccatcgcaagaaaccactttctttgctcatccataagaagcaactcttcatctgttcaagtttaatcatgagattgcagcaatgcaggcacatcttcaggctgtacttccaagtctagttctttcgctattaccatcacacttgcagttacttcctccactgaagtctttaaccccttaaagtcatccatgagggttggaatggacttcttccaacctcctgttaatgctgatctttttacttcctcctatgaatcacaaatgttcttaataacatgaagaatgatgaatcctttccagaaggttttcaacttacttgatccagatccatcaaagcaatcattatttatggcagatattgccttataaaatgtatttcttaataataagacttgaaagtctaaaatactcatggatctatgggctacaaaatggatgttgtgttagcaggcatgaaaacaacattaatttccttgcatatttccatcagaccccttgggtgaccaggtgcattctcactgagcagtaacagtccaaagataatctttttttctcagcagtaggtctcaacagtgggcttaaaatattcagcaaaccatagtgcaaacaaatgtgctgccatccaggcttcattattccatttatagagcacaggcagagcagaatgagcataatttttaagggccctaggattttcaaaacagtaaatgaacattggcttcaacttagtcaccaccaccagcctgtcctttgaagctctgaagccaggcattgacttctcctctgtagctaggaaagtcttagatgacatcttccaatagaagacttgtttattctatattgaaattctgttgtttagggtagccaccttcatcaattatcttagctacatcttctggataacttgctgcagcttctccatcagtacttgctgcttcactttgtacttgtatggtctggagatagcttctttccttaaacgtcatgaaccaacctatgctagcttcaaacttttcttctgcagcttccttacctctttcagccttccagaattaaacagagttagagccttgctctgggttagactttggcttaaggaaatgttgtgactggtttaatcttctatccacaccactcaaactttctccatatcagaaagagaaaggctgtttcactttcttatcattcatgtgttcactggagtagaacttttaatttcctttaagaagtttttctttgcattcacaacttggctgtttggtgcaagaggcctagctttcacccagtctcagctttcaatatgccttcctcactaagtttaatcatttctagcttttgatttaaagtgagagatgtgtgactcttcctttcactttagcacatagaggccattgcagggttatcaatgggcctaatttcaatattgtgatgtctcagagaaaagggaggcctgaggagagagacagagacaaggtaatggcctgctggtggggcagtcagaacacatactacatttatcaattaaattcgccatcttatataggcgcagtttgttgtaccccaaaacaattacaatagtagcaccaaagaccactgatcacagatcagtgtaacagacataataatgatgaaaaggtttgaaatattgtgaaaagtaccaaactatgacacagaaatacaaagtgagcacataacattggaaaaacagtgccaatagacttgcttgacacaaggttgccacaaaccttcaatctgtaaaacacagaatgtctgtgaagcacaaaaaagcaaattgcaataatgaggtatgcttatgtttaaaaatggttaagatggtgaattttaggttatatgtattttaccacaataaaaaaaatttttttaattaccatcaaaaatgtgccattcagtagcatgaagtattgtgtgaccaatcttcaccttgcaaaatggagactcttgtacccaatgaacaacttgccattttcccctacctctagcaaccaccattttacttcctgtttttatgaatcttactactctggatatgtcatataagtataatccattaaagtggtatttttttgtttttctttgttttttttatgactggcttatttcatttaacataatgacctcaaggttcattcatgttgtggcatgtgtcagcatttccttccttttcaagaataaataacattcaactctatgtatatactacattttgcttatccatttgtctgtcaatgaacacttgggtttttctacttttgttgaataatgctcctatgaatattgttgaataatgctcctatgaacatgagtatagaaatacatcttagagatcctgctaattatgtggctttgtgttatttactcttttttaaataagtttttctctatgtgcagatctttagttgcaagtaatcttattttttaatatctatccagaggccttttttgctttctaatgggtgttttgatggttgagcctaatctctgattaaatgaatgattacaatacaatgtaaacatgtgaataatataattattggtaaaagtaatttttatttttaccctatgagtatgttgtatgtatgtatgtatggatggatgggtgggtggactgactgatttgattgcctgacagggtctctccttctgtctcccatgctggagtgcagtggcatgatctccgcccactgaaggcttgaccttctgggctcaagcgattttcccatctcagcctcctgagtagctaggactacaggcatgcaccgccacactcggttaatttttgtttactttttgtagagatgaggtcttactatgttgcccaggctggtttcaaactcctggactcaagcaatcctcccattttggcctcccaaagtgctggcatcacaggtgtgggccaccatacctcgctgagttatgtcttttaaatgtgtttccatctttacttttcattaaaccgtaagttccctaatgtagaattccaaatcctttacctaaataatttcacagataactctattaatttgtgtttttgactgtctacccagatgttgaatacctatgaacaacagcaggagccatggtttttcatcattacttttgaattagtagatgctatatgtatttcattactagcattggtgcactgctgataatgtatttgagaaagtattgtgactactacaattattattaggctggtgcaagtaataacagaatgatctatcccagtagagtcagaaagaacctgattttcagaatatacatgtattagtggaaaaatagaaaaagactctcaacacaactgtttatctaaggaccaatcctctaattacagctgttccagctttagatggctagaaaatgtgacaagacatctgggacccaaatggtacccactgtaaagatattgagacattctatgaaatttaagatagtataaaacaccaatatttgtggtaaacctttagaacttagaacactctcatatctcacattcaaagctcatgaaaaagaaactccttagagacagttcagcatgaaaacagccaaagctgcctttagatttcctgtcataacagactttacaagtatgttaaaaatgaacaaaatatatagaagagaaggtgtaatatttcaacgatcaataaatatgctaaaaataaagatatggtgtctatggtgttcatcttcaactttgttccctgaaatcaacaacaaaaatagaaattggttaatttgatgggttacattactgacatttagacaggacacatacattccattaacattttcagcagatttttagtacctttgatttgtctctaggcttcatcattacaagacgtatttctctatattcagaattgaaactcggttcccatggtaacctcttatactaaaatagagtctaggaatttaacctgttattctccatttctgccccattttgtaagtttaaaaaaattacaagtgtagctcaacttacacatattttttataaaccaattgagtaaatcaaaccataaagctgggagaagggggataatcccttaaagaaattctttgctcaatattctttttgtttctttttctttttaaagggaagattaattctgtaatagaattatatatttagttgtaagttctgttttcatcaagaagtcttaaaatgtgtcacacacataaatacatctgaaaactttaacattcagtattatataataagggttatcaagtttgtcaaggaaagtcagaatcagggaggagagaaaaaatggtttctttagaaactaactgctggaaaagtaagaaactcctaaaccaccattatcaactgcatttgataatgaaaagaaaggtttcactgaagcgtatttctagatagcattctttaaaaagtaaatttagtatttgtaggtgctttggtaagaacaaaacaaaaacaatagaaactacaaaaagcatgcattgtagcactactaatccagtgaagacaacagcactctgtgacctatgttcctccccagatcatcttcctctctccacaccaagccaggaccacattgctttcattaattttttttttttttttcatccagcactggcttcactgctgaggctctcgttatggtcttgttttctcctcaactgggagataagaaactcttcatcccagaatctttacaaactccccagtgctgtaataaacagtcagggttctcttgatataccactgactcttactttggacctctatctgagaaaattcacccaaaccattattggagtaaattaaaaactaatcttttcctaccagaaactaacatttatagagcacctattctaatatgacctacatattaagagtagcagcatacactgggaaggagaaggagaaaaataaaatctcagaagttgcttttttcactacaaagaacagagtgggggaaattttaatcttctataaaaaccttcaaaacagaaagatgggctgagcaggcatttcctttagaaatgaggagagtaagaaaaaggctgaaggaaagacaatgttcttttctgcaatgagtcagagaagaaacagtttgattagagagaagtggtagcaacagaaaggggagaagcagactactccttggtgttgactaaataaagaaaggaaattactaggaaatttcattccaggaatctactcttccaaccccaacagccttgtgcgtgctcctgacaacatcccaatcaggagcttctaactgaagtcacataagccaccaccaatgttgtagtgtctcaaagtgaaaaatttgcctccctaatatctataatccctagcttcctgactaggggtgagaaagtatctatctcattggaaaaagtggccatgtaatacaattctggctaatgacacataaaaataagggtttaggccaggtatggtggctcatacctctaatcccagcattttgggaggttgaggcaggaggattgcttgaggccaggagtttgaagctgcaataagctatgggctatgatcacaaacaccatattccagtctagatgacagagtgagacccttctcttaaaaaaaaatcaagtaaggttttctaggaaagttctgttttcttgatataggcacaatcctttctgttttttgctcttttctactgcctggaatacagacttgatggctagagatcctacatttactctgcaggcaggagaacaagcataataccctaaaagatggtgtcacagaaatgatttctaatgacatcatgaactcactctgccagtgccggatactctgcttttggatttctcatcaaatgagaaaagaaattaatcttattttgtttaaatcactgttatttgggtttattggtacatacagtcaaattcagtccttaactgatacatttctattcccaaatggaggatgtagggagaagcagaaggagcagcaatctgcagtttcactgcagaaacatcccaatttcaaacttgaagtccactattatacagagtagtttaaatatcactacgtctcagatacattatagttttaaaggtttttttacaggctgacctaaaaaacctatggcaaaatgccttttggcttccatactcaaaaattttaaaaataacccactcctaagataaaaataaacattcttacagagttaacaaaagttttaaaagcaacttaaataaaagaaggagtctattctgtcagatttttctttttggatgatttaataacaagatactattaaccaagatatgtttacacttaattttttattcaaatgtataatgtatgtgcttatacttctaaatattttccattgcttaatttaaaacctagtattaacatttagagtatctctttgtcatacacacaaaaaaagattaaaaaacaatttttaaaaaattttaaagaggaaaacaggttaggtttgttttaaaagttaatgggagggggcagctgcaattgcccagtaatgtttaactacacaatatgaaacacatgccacaatgcgcagctgagtctccagggagatacatgttcacagaagtgggacagagaggatgatgtttctgacttacaatttattaaaaaaaatactaggctcttcaatgagaaaataaagcaggaaatctcaagatagtaaccactgtcatatgtgatgtggttgctatggcaaatactttttttaagcacaaaaagaataatcatataaaattgacatcaatttctccagctgcagccgaattctgaccccagcttacaaaaacattttattttaacaataattttaacgttcagaattacctagttcctcaattttggccctaattccttcaactagttgctcatggaactaaaaacctattagcaataaagaataaagtaactatcattcattctctttgtggataagaaattttaaagaaaaaggttgcttttcatctccttcatgcatccccaaaacatttacaagtaaactaaattgtgagaaatataataccgtagaaaatacgtcagtccacccacaattattcattaagtttcctaatttgcacatcttctaaacaagtaaaaagtcctcataaaaatttaaatatataaagtaatttttaaaaatactttaacaaaataatttaatttttaacttcttagcatgattatgacaaagatattcaagtttagagaataaaataacaatcataactttagtaaagtatgtgtcaacatcaaaaagatttatgaagattacctaatttgttcttctaaaaatattttaagatgtgggtggttccacctcattaatggccttcgaaatgtgtcctttaatttgctgccaagagtatagtgaatacatataaaaaccaggatgttaacacagaagctactgacatcagttttttcctgaacttcaccatactgtattttaaaacaaagaaggataaacataacatggagaaggtccacagactattcataaaagattaaaaagcttagaaaataatacctgcacaaaggttaaagagactgaaattattcagccaagaaaagtcaagtctgagaaagaacttaataagtatccaagtatttatgaagggttctttgcacagaaaatagtgaccagctgttttcaatctccaatgaagtcagaatagaaggaaacaaaaattgaagcccaaagattttagttaaataaaaggaaggagttcctgtgcgagtaatgaatattgtaatggtcactgtatctatgaaaatgctttcttccaaggcctgtacaggaaagatattttcatttttacagggaagactaatatttacatccttgtgtgtgttttgtgctaataaaagaggtatcctacaaccaaaatgcatacaccagcaggtctgagctgggttatacttcgttaaacgtcccacggaccaagagcacacagaatagtagactatactcagtgcccacagggaactccaaaccactgcagccacaccttacctggattcctcgtacttttgtaaaggaaaatgaatgatttctaattgcccagaaatatgatgggtatttgcacccagctgcaagagggacctgtagtttactgctgtcacctttattgtcatatcccgggcaacattaacctcctaagttaaagaggaatggaacagtttttcataaaagaatggtaagtgagaaagtagttcccctacacattctcctacccttgccaattatttcttggcatctcaaattccatccttagtgatttactcctttggctcaaggctgtacgattctgggagaaaatgtatttcatgagcattaaacattattaggcattttattcctgtgtatctggtctctttccaaaacagattttgggggaaaaaagggaggaaggaaaggatatgagaaccgagagaaagatattactaagcaaagaatacggcatggaagtagatgctcagaacaaaacaaattgcctcatacttcacgattttgtctaggaacaatggatgaaccagggagtagagtcagtcttctcttcttggtatctctcctcaactgacactaatatctagtatcgtttccagagtaactcctaaaaagctaaagcagaacttcatttgctttctcttactaattaagtaaaactgcatatatgtgctgtccaaaataaactctgaaattttcaaaatcaacaaatactatatgcatatacaggtaagacatttttaaaatgtatatttagtaaatattatttaacccagtatttaagaaatgataaacatttatgaaaggttaatataagtaaataatatacaacctaaacataaccggttatttctccacccattcttttttgtttttctgagatagagtcttgctctgtcgcccaggctggagtgctgttgcgggatctcagctcactgcagcctctgcctcctgggttccagcgattctcctgcctcagcctcctgggtagctgggattacaggtgcatgccaccatgcccagctaatttttgtatttttagtagagacggggtttcaccgtgttggccaggctggtctcgaactcctgaccttaggtgatccccctgccttggcttcccaaagtgctgggattacaggcgtgagccactgcgcccggcctctccacccattcttaatacaacatggtctccacctacatcgccatccagctgcctctctgttcaatgtgctccagtgtatctccagccttcttaaatactccaggtaagttctaaacacaatactccaggtgagttctggctcctgagagcagagggaagctgtttatttccttgttctaaaaagtggttatctgtcctagctgcacctcagaagcacttgtagagtttttaaattttaaaaaacgtattttaaaagcagagatgcccaagccctgctctagtcttcagaccagcatctctgaagagcgactgttacaatacatacttgtgaggctggttatttggacccaaaagcagggtttatcttgtaaatcaagcccactgctccagcctgtggtgatcttttaggatcctcgttctatcctataacatatttttattttgttccacttcatgttatttgcaattctgatggaccttcaccttatagcttcatccaagtttctatgaaaaattttgagctagccagggctggaggccgaggtcctgtatcacaaaatgagaaatcttccggtaaacaatttattatttaacattgtagtcgactgaaatttagcaaccactgccgtgtgcccctggtgagcctttgtatcatagaggctagagagctgaacaccacatttctcagaattccttgcaactagagttctgggtaagtgcactctttcgcaactggggtggtgggggcggtggggggaagcaaacagaagctatatgcctgctagtttagttatttccttcttacaagccctgtcatagaggcttgattatttacagcagcattctagcatctagtcaccagtttcacaggtactgaggagtggttgcagtaatatttagtagctttctaatccctaaatagcagtgagggttgatttcaatctgtattactgaactcagcggcgccagcggtagcctctggattgctattcctcgttgtggcagtagtagttgttccttatatgctcacttttgtggtgttgtgggagtcactcttgaagcctatgctacacagccttctcctctaggctttccattgattttcttaacttctacatctttaatatggcttggctctatgcccccacctaaatctcacgttgaattttaattcccagtgctggaggggggactggtgggagatgattggatcacgggggtagtttctaacggtttagcaccatccccctagtgctgtctcgtggctgagttctcacaggatctggttgtttaaaagtgtatagccccacccgctttgctctttctcccgttcagccatgtaggacgtgccagcttccccgtccccttccaccatgattgcaggtttcctgaggcctccctagccatgcttcctgtacagcctgcagaaccataagcaaattataccccttttctttatatattacccagtctcacatagttctttatagcaatatgagaacacattaatacaatctctgacttaaattgctttgtgtgtggaatacctggagtagattctgtttcctccaataaactctcactgatataagcacatttgagtataactgttgcactctcataacaggaccaccagctaggtcacactacatagtgtctacaagggtatcatgaaagaccttgtcaaatactttcctaatatcctaagatacaatattcaaactctgcattttctctgaccttgaagtttagcaatgctgtcaaaaaaggaaattatattattctgatacgatttcttctcagtaatctatgctgacttataacgatcctgatctttcctaaaggactcttaaatgttctagaatcctgcccaagagggacattgagctcactggccccagagtagtgatgtgattctagtgtcaaccctgtgtctatatactggtttcatcacttacttgctaggaaatcttgaacagcattcccaagtctcagtttccttagtgctaaatggtagtgaaatgctattttataggatccttgtgaggagtaaataagataacatatacaaaatcctaagcacagtgtttggcctgtagtaggagctcaattagtaacagctataacctgagaaattcacctttttctccatttccaaaaataaaataaaataaaatgtaaatgtacttttatacttccatgacactctcctcattttctcaaagagatgtcaaatttcacaaacagtggaaaacagttctctcatctcaagtcgtatcaatagatattatcaaacacactctcggtcaggagatgccaagtgcgctgagtacttctctagcatttgctcatcttgccattcaaacccctcttattcatgttgatgctactcagttcattttggagatcatcattctctatagaagcccctttgactagcttactaaaaaaaagagagatggagcaaggtcttggaggaggcagggaaaggtggaggcaagaatttgccgtgggaagaacagagttgctcgatagctcagcatctctggtcccaggaagatatgatttttatcaccgcatgggaagcagggctgacaatgcccagggcttcccggatgctccctcttatcaagttgttggaaggataaattaatagggtggacagatgaatattatcctttattgattatcaactatatttaaaacactgctaggcatgttttgaatttacctaatacacacacctgcacatatacacacaacagagagacaaatatttatcactgaaactcagacagaattaagcaacacaattactaaatgatttggcttcacatcccatgctcttcactataccacatcatttgttcagaaaacatttcatgaactcttaccaagtgctaggtattgtattaggtatcaaaaatacagtgggaaataaacaaaagcacacgctcacaataaagcatgacagtgctgtaagagtgaaagcttggggtgagatgggagcctattagaggggcacttattcctaacctggggttgatagaggaagcaacctcttaactgagcctgagtgaatgaatatgatttagcaaaagaagcataaatcccacaggaggatttaggcattgcaagtggccaaaggtaaaaaagctctgtaagagctgagaagctggaagaaggatgaagagggaatagaaaggtaagtaggaaccagagcatatactgcttcttaactggtgttgagctttagcctataagcaattggtagtcactgggagggcataagcagaagagaaatgtgctgaaatctgtatggtggggagggaatgaagattggaggcagaggatcagtttagaagcctcacaagtgagaaactatgaggacttgcactaaagaaatgcaagcagagatcatgagaagagaatagggatatttagggggcagaactgatgagatgttacttccatgaagggtgaaggaagaaacggaaattaagaatgactcaatttttcaaccttattccaaagaccacatttaaaacacctatacagcttctctaggtacttgcatgataacatttcactttttttctgtaaagtagggagcaacgtcatctactgaaactgagatgggaggcaggaagaagagatctagtgaagatctaaactagccactctgtagaatgaggaattgctgaacagagaaacacaggcctccaggaaagttgagggcccaaatgggggagaaggtcttgatctggcagccctcatctgtgcagatggaagattatctccagcagcactcaatagccagggtaaagatgcagagaagatgaacactgagactggaccatatcaaagttttccaggagaggcagaaaagacaagacattagggcagtggagtttagaatataagagagtggcagaagcaatgaaatatagcctctaagaggagtttagaacataagagagtggcagaagcaatgaaataatgaaatatagcctctaagaggagtttagaacatacgagagtggcagaagcaacgaaataatgaaatatagcctctaagctggatatagaagtgaagggagggtgtgctaataaaaagaaagcagactaggaactagggtcagggaactagagggctctcatgatagcatttcccaaaatgtgtttctcagatgcttattacacaggatgttaatcactgatacgttcctcattaaaagcttttcatggtcaaataagtgaaggaaagtttgggtaatgtaatttttaaactgtttccttcctgtactatttgtatttaataagttaataatatatactgtagttctctaataatttatctctaggataaatatgcatttcccaaataattctgattactgtatattatttatctatatttatcagagaatttcactgaatgggtatcttaaggaacacattttcagagggtctgctctgtgaaatgagaagcagggatggtagaacacttgaaaagaaagtatcttaccaaggcaggaggtttacctgaaagttctcttagcttccagagctatgtatctttaattctactataacacacacacacacacacacacacacacacacacacacacacacacagcttgactctgactctactgtaattagtattcattcatgaaaccaatattccaagagcatgtactattatgtggcagaggagatttatacagcattcttaccaggacaaacttcgtgacttatctggagaaacaacagatacacacatgaaaaataaaaacctggctggaaaatatggctcttcctcagatacccataagacatagtttccctccagggcaactagtgctaccaatctagccacagctctgtaagatcagaaagttcctccataaaaacagagctaactgagtagatctgagctgaacaaactaaaaagccccagtctttctttgctgaagctactactctcccagagtcacccatgatgaaataatctctcctaccccatcagtttgatgacatagattcttgacctggtcctaatctactccaggataataaatcctaaattgattttcttgaatgacaaccaacctgcttttacccagtgtcaagcattcagaattccaactggcacagactagtatggataaaacataatccataaggaagaagtagagatccacatgtaaataatggctagtgccagactgtgaaggatcttggtgacacagctgaagcctggacattccatggggaatgaggaggccttagggatatctgaataggaagactgggagcgggagggtaaaagtaatgccatcattgctaaaaacaggtttagaaagttattcttgggacatgcccatagggtccacgtccattttttaaaaggcagatcaaattttaaaatactttttgtcatttttctccacttcccttcaaagggtctgtgggtaattttcctttctagaggtaaggaaaataggcccataatttctagcttcatggttaaaggtataaaagagtaagtgtaaacataatttaaactgacaaggatgttaaatcaggcaactcacttgaaactccaatggaaaaagagatgaaattctaaatcttcagtacacattgtagagattttagaaaaccaaaaataatatactgctatcatcttattagggaacaaaaatgctaaagacacattagcaaatgtggctttgactgatgtgacataagctgagacctcataccaactaatttaagaagttttaaagatttagatcacgagaaaaacaaaactacaataattatatggtttcagaaaaagtaagtcttccctcaataacttcttcacatactttactactgctatactacaatatgacaatccctaggggttatactaacatcacttgattagaattttggaaacactgaagtctcacattacagaatgatgtctaacttgtaaaaacaaaaaacacagaaagttggctcatgggatttaaaatttgctgaggtccataaaacaactgcagctataaaaaccacttatctgttcaacttcaaaattggttttcactaaaatctctgtgacaaaaagtcatacctatacaatcagttataacaaaattataacatgtattgatttttgtggatgtcaaatctaaaagtcactatacaaaatgtcagaaatctgtggtataaagtatgatgtcggaaacatcatcattagtctctcttccttgaaatataatacactgcaatctaaatgaattagattctataaagactcatttttcttaactattatatatatgctgatgttcaactatatgactgcatgaaaagttgttcatatagtttcataaggagctcagtaactccctaaagacacaaaaaagcactcaatgatctaattgatctgttaagaatcataaaatttgagttaaaaattatatcagcttatggaaaattgatattacatgttgatgaaaaatgtgttaactgttttaccacagagtctttgtgatccacttgtaccccaacactagctggttctggaggccataagaccatcctctgcagtggagtgaggcacgttatggatgcagaaaacttactctagtcagatgcccagctaggaatttcaggaaatccaagatgtaggctgctttccaggaaaaaggcacagaagacccaccaatggcaggagatagaaaattcatactccacccccaggattatggcaatatagcaatctattacattttgtgcttcatgatcctctctatccaaagtacatatgcaaccatagtgggctacacagaactagggaatgtgaagaaagcagcagtactgagccacgtgacttgaagttatgggtcagacctcatggcggagtagcaaaaagaaaagggtgggcaaaaaggaaatggaagtatctgagagaaaattctggtatccattttgcagtaccagcaaatcacttgaatatttacaattttctaggttctacaatgctagaagtcatgtaattctgctgttctgccatggagaggcaatactcttcagtggaaagcagcctagtgcttgcttagactttgacactaaccacacaggactagggtaggagcatgacaggaagaaaaaggtcagttggtgctaagagaaaattcatttttgcctataactgtgaaatcacaatgacctacgatgttaactgcagtatcttaaaaaactgtttttaaaaaagagaagtgctagtctgtgaaagcattcctattgtcatcactttgtaagcaacagaggtcagagagaatgtttgatcatcattttagccactgcagcacccccagcactgtgcctcacatatgataagcagcagtaaatattcatgcaactgaatcttctgtatgagcatccctgtctcttaatccttctttctagtgcttcttattttcccaccttatttcttcccatagctcgcactgctctttgtggtttaactgataatttggacaacataaaataatagtctgttgaatttactggaagataattttaggttcacttttttaattgggaaagtaaatgttaggaacactatctttttctctctaaaatactttgcaaattaagccgtgggttagcaaccttcaacagaaaaaagttccataactctaagttgaagatgtgttgttttctgctatattaaaatacaattttaaaaaggtgacttgtgccatactcttttttactgttacataaatctaagaaacaaaattttccacagttggctataaaaagtaacacagaactagcctggttcctataaaagtatcctttcgaattagaaaactaatatttaatgtaaaaaagccacatacttttcatagttccatcttcttcttcctcatcctcactgtttatcaccatggtccccaagtcggattccaacatcgtgctattatgttcaatcatggtctgggccccttcactcatcgtgcttgtggcccgcatggtgcccacactctccacactagtcttcaccatggtgtgggaatccagctcatcttcatcctgcaagcaaaatactgcaatgagggaagacttttctatgacagctggatttcttaattcttaacaagagaatgaatatattatagttttaatacttattaaaaatactattagtactgattttaatataaatacatacatacaaatgttattttaagagtgaaaattattcaaaataacctaaagctttaggtaattacagatcaagcaacagaaactgatgaagtagaaggctgctagttgcttttaaaataaggattaagataggtaaactatcagcaaatgcataacaaagaatatggtgacaaaacaactaaatatatatgagagcacctttaagacagaacacattgacactttgtattataatgggcataatgatgtctataaccttgtaaaacagccattagctttttcttttaaattatggcaaaatatacaaatacatatatataaaattcaccattttagcaatttttaagtgtataactctgtagcactaagtatatttacaatgttgtgcaaccaccaccattatatgtttacagaactcttcattccccctttccccagccctggcaacctctattgtacttacaagaggtatctagaataggcaaattcatgagtactactattcataccatagtactaattcataattactattatacttatgaatttgcctattctagatacctcatgtaagtggaatcatacaatatattttgctgagcctaatgcattcaagattcatgcatattgtggtagaaaaatttcattcctttttaaggctgaatgatattccattgtatgaatacaccacattttgtttccctatttatctgttgatggccatttggattgttgacacctttggctactgtgaatagtgctaatgtgaacactgacctacaagtatctgtttgaatccctattttcagtttggttgggtatctacctagaagtacaattgctggatcacatggtaacttcatatttaattttttaagtgcccaaactgttttccacagtggctataccattttacactcccaccagcaatgcacaggattccaacttctccacatccttggcaacacttgttattttccatttttaaaaaataatagccatcctaatgaacatgaagtgttatcacattgtagtttgatctgcatctccctaatgactactgatgttgagcaatcttttcgcacgcttattagccatttgtatatcttctttggagaaatatccatttacccattttaaaatgggttgtttggtttttctgttgttattacaaattctggatattaattccttaccagagatataatttgcaaatattttctcccattctgtgtgctttttacttcatttatagcgtcttttgatgtaagtttttaattttgatgaagtctgatttatcaattttttgcttttgttgacaaatctcagcttttaaatgtttcacagaagaatcaagtcagtaataaaagtacaaattaaaagtgctctttagaacattcaccaaagatatactggaatagggtcataaaaataaattaacaaatcctgtttgaaagaccaactgataatcacagtgctttgggaggtcagggcagaaggccaggagtttgagaccagcctaggcaatgcagcaagaccttgcctccacaaaaaatttaaaaattagctgaacacggtggtgtgcctgtagtcctagctacttgatgggctgaggctggaagactgcctgagctcaagagtttgaggctacagtgagctatgatggtgccactgctctccagccggggtgacagagcaagaccccatttcaaaaagaaagaaaggaccaaagaatctgctatttagaaaaacttgattacgcacggaaattcatttatatttattccatttttagtagaaacatataagcaaaatctagttctggcagaggtcaaaatgcaaatctgagaacatcaatgttgagtttcagcaacttgggttgtataatataacaacagttggacagctgtttgatacctttcctcttcctaaacctacatgctaagcttgggcattaggtctcaaagtcgtttgcacttctttcatgatcctttctcttttagaagacctcttcattctcatgccttcaactatctaataagttgaggagtctcaaatcctgaaatcttcctatgtctttacttattacgtaaatacttaaagatgtctaaaatttgacagtcccaaatcagatattatttcatttatctctccagtctctcctatctgtctccatccccaacaaccaccacaaagcatggtaatcttcacttgctacataaaacttcaatgtcttcttacatttattttctctttcattccctatatatgcatcagtcaactagttctttaaataattctctcttagctccatctcttcttttccattcccactgctactgggtataatcctcactacatcataggtggtttactgcagctaatgcttcctgactgaggactctcccatctaactttctagagtcagacagacattagttcaaatcctggctcaaatcacttatgaggcataggatccttgtctccaaagattgatgattaaataaaaaggtaagcaaaatgcctgcatgctacctggaacaaggtagtttcacaccttcctcaaagtacacggcattatactaacctttcttgaatactatttctatcattctaatgaagaatctacaatggctcccagttcctgccttcattaaagctaaacatttctgcctaaatttcaatgtcttctatggaccaatcctattttcccattgttcatataacctccaatacaggcaggctggactttaactgaatctctttgccataactccatatgatgctatgttcattaaagacttcctttgtgtacgtcttattctctatccagaaggtccttcccctctatccatttaactaaatcatacctagtttcagatcaagtatctactacttccatggctaattcagtctttgttaattattctcttttctaaacttccatagaatttacaaccggcattagacacttctgtattcaatttatgatctcatattgcaagcaattgttttgcaaaatcttttataaatgtaagtaccctatggacaagaatgtcttagagtacctctgaatccactaaagtgcttcattcagtattcaaaacacagtaagggtttgtgaaagttgtcagaatcaaaatgaagtcatttctgtttaaaacaacaaaaaaacaaacaaaaaccaaccctgacaaatggagcaagggaaagccataaagagatggtcctcatgcataaatgcctgatagcgaaagctatcacaaaagactgccagaaccactatcttgcacaaaggccattgcaatcttacatgaaaaatactgcgaggacatctacccagcaactgcctatccaaccacagactggcgcacaaggataagcacttcaaaacaattaggcagttctccccatttttcctttaaaaacctttgtcttcctttaccccccgaatatgcacattgttttgtatagcacctttactcgcactgccctattctaaaataaatgttactttcttttagagagtctttgctatttaggttgacacgttcaatacatattgactttttcatggaattataaaatcaaggacctttacagttagagagaaactaattcaaaccatcattttatatctgaaaacactgaggtccacagaaaataagagacttccctaaggtcacacacctacttaaaagtaggtctgggactaagaaacaagttcttttatttcttagcccattattctactatatacatgtacctgaattatgtttaaatttttctctactcaaatgcttaagttggagatgtaagctcacaatttttaaaagcttatatcaccaccttctattcccagagtcccatataaattattccatccattctagtccaagccaccatcttctcccacttggagcatgaaaatagcctactgactgttcttattgtttccatttttgccccttttagtctcactcacataggcagattgatcccttcagaagacaaatgacatgttactctcctgctaagaactctgcatttggcctcctatcacacttagaataagatccaaaacctttatcatgtccaaatgtgatctggcctatcccatctagtaatatctgccaatcccatctcctatcacattccttcttgctcaccaagctctaaccaagctgacctcctttgctgtttcttgagcattctaaacatgttcttccttttgagcctttaaattggctgatctctcagactggaatgctcatccataaatcagtttgataatttatttaactcaggtatctatttagctgtgacctcttcggtgaagctttttctgaccaccaatctaaactaaagcctccatcattttccattcttctgtattcttcacagtctatatctggcctttacgaccactagaatgtaagtctgatgaagacaagagactgttttaacctctgaatcctcattattaaaacacctagcatacagtaggtacttgataaatatttatttaatgaataaatcaatttatattttcacttattaatcatccaacaagcatttattgtacatcaagtagtacaccagacattggagatgaataagatagtttaattccatttcagtttttagggagtttgagatctaagggaaatctactaccatgtgaacaataagttacaggacaatctattaagtgctacaagaaaagtgttgacagtaaaatgggaataccaagagtagagcctctaactctgcctttagaaagtgaagaaggtctcacagaggaggctgaacttgagtcagctcttaaaagatgagtagactatatatttaacatacaacagatacatttgggtggagtgttttacaactttttacattagaactacactcagacacattccttctcagctcagacaccccaagattgaattaggtgtcatgcctctgtattcccatagtactctgtgcttatgctgattttacagtactgtaattgtctattcacttaccttgtctaaatcccccattagactctcaaatctataagggcagtaaccacatcttgtttacagttgtattcctgatgtctggtaaaaagcaatgttcttattatgtaatttattgaatgaatgttaaatgcctcattatgaggtaatgccaaaacacagaatgaaggacaattttatgaggttctagtaacatgttcttattataaaacatagaatagctattaaagatattatactttgggacaggaaataatgccattaactacaattattcagttgatcatttatttaataatgaaaaaacacttatcaatgagttagaagcactatgctaaggtctttttaattctctttcggctgggcatgggggctcacgcctttaatctcgacactttgggaggccgaggtggttggatcacctgatggcaggatttcaagaccagcctggccaacatagtgaaactccatctctactaaaaatacaaaaaattagccaggcatggtggcacgttcctgtaatcccagctacttagaaggctgatgcaggagaatcatttgaacccgggaggcagaggttgcagtgaaccaagatggcacctgggagacagagtgagactccatcccaaagggaaaaaaaaaaaaagtctcttattaaccctcagaggtgctattattcctcttaggcaaaggaacctgaggctcaaataggtttcataatttgtccaaggtcatacaacaaataagtagagaagcaagaattctaggcaggtctaattctaaagcctaagacctaccttctaattatgtaaggcttttaaactatctacagcatttctcaagccccatttaactcatactacaggtttgcaagaacatgtttcattttccgaagtaaagagatgaagatgattttctatcagttccttttttcaaatctgctggttgaatatcttattttgtcacggttgcaaccagtttattcccaaaacactaactctattttaacacgtgtgagtcatttttctcttatccttgtgagattcaatgctgtgaccattaaacttaacaagaaacataacatctgattggtataaaatagtccttagcctccctatattctacattagagttgaatctacaaagggacaataaagcctgaacctctggattcacacaattggcttagataaaattgtaaaaacattgaattaagtttggaagggattgatcttactgcatattatttttacttacgtagtcaatttgctaaagaatgctaatctaatttacaaattgacagtaaaaaatagcaataaaaatagcatgaacactcaattcactaatgagagggtgacacacaaatagaaattaataaagtacagatggaatgataactagttaaacgaaattagaaaactcacttataatttggtgatggtgttgaaaacttttaagccacagcttttactttttaaaattcttaacttattcttgatattttagattagtattataatttcatttgatactttttatatttttataatgaaacatttatgttttttcaaaattatatttcacttacatatactctgttattcctcacaaaagaaaagcagaagaaaaacatgttgatacttcatagaaaaaggtctgcagaacagatgcttccccactgtagaaagcagccaattccagtaaggaatacaatagcattttcaatcagtggccatcatgtgccaggaatgcaaaacacagtactgatgataatccagtttatgaatcataaaatccacatggaatacaaatatttgaaaacattattaggaaatcctactccactgctaagacatgcttatgctaaaacagcctgagaaataatcagagattttgcattatctactagtagatatttgtaatatctactaccttaaagcattttctaaatactcagtaattgactgaattaaggataaaaagtatttatcacttgtgagactaatttgtcattagtgtcacaaaagacaaatactttagaatataaaattgtttctatattctcaaaatgtttagaatataaaaatagaatatttctcagttaggatacctgtttagtgagacagttagactactccttaaacaggtgtcctaaacggaaaatattctaattttatttttcttcttaaaatgacattaaacacttctttattgcacatgcaatcacataacagcatagtatcagtatcagagcagtgatcttaatggctttcattcaactggacaattctaacgagtatgcattctgctatagcatgaaaaaaatattcttcagaaaaaaacgtgtaaaatatatacttgaaacaattatacaaaaagttgcattatagtggtctaaatatttttaaaacctcttaaaggtgctaattaaacagcaaacaataaatgtaacaaacatactacaaatacatagctgagttttcaagatagtaagggctcaaaacggagctatggtaataagccaaatctaacttgaaggcttctttagaggcatgtgatgatgggggtgggggattagtggttaaataaggtttatattttaacagataaaagggaaaagggaagtatttggattctttccaaagtagaaatgaaacctccacttaaaattgggaattttgaaagtctacatcctcagcaaaaggataggcaagaaacaatttacccagtggcaaaggagatgacaagtcttacctgagctaggtaaggtaggggacagggattgggaagcctccctaaggtaggggacagggattgggaagcctccctttagaatttataaccatggtttaggccttcaattttacatcactcacacgctctaggggaacctcaaactgagaagttaaccaaatatagccccagtaaggtagcaccccaggtgcctgatagaaacaaatacaaatccatattacagggacgcatactgaaccctcaactcacaccattctcagagataaaatctagccaaacgtgaactcactatcccaaagataaatacatgagtaaacaagccactgagaatgggtagaaagaacaaacaacagaattaagatgcccttgctccttagaattaatttagtccccttagaaagctggatcttggggtaaaattagggaagaatagacagtggcattctaaactgcagaaataaccgagaacaaaagtagaaatattccagctagaatggaaagcaatgagtaagtttgattgaattagggaatgtcctacagctcatggatgctttcaacactgggagcccagcataagttgcttggcaaaggagtgataggaaccttgggaactaaaagatgatttggagaagggaaagactggagaaagactagaatcagacggttattactagaatccagatttgaggataattaattagagcctgtactaaaaagggtcatatagtaacagaaatgacaagctgaatctgaaagaaatcaccaaagaggaattaacattttctagaaagtttctaggcagtcaaatataatggatcaacaataactccaatattcagaacctaaagagatcaaactgaatctaaagagaaagttgagagagattttaatttgaataaaataggtaacaccagttatttgtaatcaaaaaatgacttactatactttgtcacttgaccatatgatcaaggaaatgaaatctaattattcattttcccatcaagtaagaaatcaacaaggcatgtccaatgcaactgcaagatgagcacaaaactggggaaaactagggtaagaatctttcacttctttcctcatgcataacggaattcgggggctggtgactgcttgatgctaacatgttaacctaggtcgataaatatattttaatcactgagttagaaaggcaaaaatcaaagggtactatcgtacatttgcttgtatgtctcgaatcatgtaagattcctactaaactaaaaacactctttcctatagcaaggtgaaactactgatgtgaccaacagagcattaccttgaaactgtacttccaactctggtaaaggatagcagttatcccattgtccttgttattaatacacaaggttgtacctgtttgttgtttctgtgttccaagtgaaattgcccacagtagatcaactggtaactctgatccaactgagctaaaaattactgagaaaacatcaaaaatagtctctttcaaatagccgcccttaagtgccacttcaatgtctgacgggctgaaaaaagtaacaaattggtattcacccattaaaaactaagatttacagtatctgaaaatctataaaaagaattaattgtcttctcactgctgtaagtaggtggtctttccctttcactacgaaatcagcttaatagcttatacagctgctgtctttgacatacctgtctttagcaaacagaaacttcatggatcctaactttttgcacattcacaggcatgttttaaagttacatcaaagctttcaggatctccaaacgtcataaaagacttattcatcagtataacaagcctaattggtgaaaaggcatgtgggcaggacttcagaggctccatgatgcaagactgtacaagtttttggcattataggagaagtttccaaacaaaagattaccttacatctcctgtgcacaatactaatatacaatagagtaaattaaaagtaaaagcaaccttaaccgtgacatttcttttttctttcacagccaaaagcatgtcaaaggattgacaaatataaagaaacttataaaatcaaatattttaaaataagaatgacacctttaaaaactgttgtgttcttacaagcagtttataaaacatccacaagagggaaccaaagacaaaagactaaaattccactatttggagatttacacaaataggtttataaaataggttattacattaactaacataccatcaatagctttcagaaataggctaatggtttcttgatacatttttaagcagtgatatatttaaaaatactgtaaccactgtcatgttgatacctttatataagcaatgtttatgttcctcaaggacaacaaatgtctttcacattcagtaacctccacttgcatataatagcatgaactcaatgaacaggtggtgattccacaaaatttatagaagtatacaaaagtaaataatgaatattcatattaatttatcaaaacttcattctaaattgcttttatatgaaaagatttatgattgtatatatcttatgttcttagaacaaatacaactaagggctaaagggtctttaaaaagatttttttcttttcttcattctttctttctctcattccttttctcttccattatgatagtatttttaagagttagcagaaattttgttgttgttctttttggtttgttggtagtaaacagaaattttaatacataaattgtatttttattgtttaaattttaacaacagaaatatcacctacataaacttagatataattttgtaaaataattttagaaaatttccaaaacatacaattcaaaagaagactacttgaaacatgctaaagtaacaatattgattttaacatacagtttacatcactgaacttcctgataaaaatgaaattctggggcagaaaaatgtcagggcaacaaaaaacaatctcccccacaacccaaatatttttcacacatttgacttaagcattgctgaagaaatacttcatgtgcaagtatacaccttattaattattaaatgcaaatacattctgtgttgatgattttgtggctggcactatccttaatgatgagtaaaagtcaggcaaaacctgtttaaaacagttttatacacgtgtttcttgatttgataagtatttaccaattaaatatttatgtaataaatgtttgctgtgtgccaggcaagtgtgttaaggtataatcttttccttgagaaatgtatagtttaatggggagttacaaaatagacaaacacagtgagataaatattctcagagctaaacgcagtattccatggtgaacacagaggagcacttgccaaactgaagcctggaggagccccatgaaaggcttcctctttccagaggaggcaatggctaggatgtcaagacaaaagcagcaacctacacttttctttaaccactttttgagcaatccaatctatgctcatggtttaactaccaactgcggaaagcactgatttcctaatttgcctgagttctcccttgggattcagaccgctgtatccaactgcctgctacacaaaatgacttaaatgacctatggacatcgcaaattaaataactgctaaagtgatctcatcttacacagaaatacgccttggagagaatactgctggagaatacttcagccacagtgtaagtgcaaagtgaaaaaacaaaggctctgactatgctatcaagaagtttagttgtaaataatttgttgttttttcccttattttttaaatggtcaaaggataactatattttgaatgaggaaaaagggcccagaagaaagggataatgtagctgactaaagaaacaagcagagaaggggccttttgagggaagtaaaaagaaaaccaagagcaataaaacaattactgttcatgcatacctctatcacagtacttgctacattgcattatgatcagttatcagtttatttgtctcactcattagattgcaatcttcttataggcaattaccatgtcttatttttcttccatatccatatttataaatgggaaaaatatataacctctgaaccagggagacaaggaaacatagtgaggatacagaaacatattaaagttaaaagaaaactgaggtctagttagtacaataagaaaaaagttataaagattggaaagaaactatctatatttgcagatgacatcattgtctgtgtagaaaatttcacagaatctacaaaaaactcctagaactaataaaaattagtgtgtgtggcaacgtcacaggatacaagggcaatacacaaaagtcaattgctttcttacataccagcaataaatgactgaaatttgaaattaaaaaaaatttcaacagaaaaaaaacccacttaggtctaacatattaaaacatgtacaggatctgtatacactgatgcaaaaaataaaagatgatctaaataaattgagaaacaccccatgttcatgaatttgaagactcaatactgttaaaatgccatttcttcctaacttgatgtatagatttcattcaatcccaataagaattccaggaagttaatttagaaatgttgacaaaatgatcctttctatggaaatgcaaaaggcctagaacagccaaggcaatactgaatcagaaaaacaaaatttggccaggagaagaggctcacacctgtaatcccagcactttaggaggctgaagtgggtggattgcttgagcccaggagtttgagaccggcctgggcaacacagcaagacaccatctctataaaaaatacaaaaattagccacatgtggcagcatgcgcctacagtcccagctacttgggaggctgatgtgagaaaatcacttgagcccaggaggtcaaggctgcagtgagccgtgattgctgtcactgtactccaacctggttaacaaagcaagatgccgtgtccaaaaaagaaaagaaaaggaaaaagaaaattggaagattcagtgtccaatcttaaaacttctataacactacagtaatcaaaacagcacagtactggcaaaagaatacacacatatatcaatgatgtatcattgaaacagaataaagagctcagaaacagacctacacaaatatagtcaacagatttttgaaaatgacacaaaggcaactcattggagaaagaacagtcttttaatcaaatggtgctagaacaaccggatatccatacggaaaaaaaaaaaaaggacccagatatagaccttacagctttctcaaaaattaactcaaaatgcttcaaagacccatataacatgcaaaaccataaaacctatagaagaaaactcaggagaaaatctatgggaccttgagtttggtagtgaatttatagacaccaaaagcatgatccatggaaaaaagctggtatcatcataataaaactaaacacttcagctgggcatggtggctcatgcctggtaatcccagtacttcaggaggctgaggcaggaggattgtagtttgaggctacagtgagctatgatcatccactgcactcagcttgtgcgaaagaatgagaccctgtctctaaaaaaacaaaaggcaaaaactaaaaactagaaatctctgctctgtgaaagacactattaaagaatgaaaaggcaaatcaaaaatgggagaaaatatttgttaaatacttactttataaaggactcgtatccaaaatacacaaactcttaaaaattcacaataagaaaacagacaacacaatttaaaaatggggaaaaatattgaacatacactttgccaaagatatataaatggcaaataagcatataaaaagatgcccgacatcttcatcactaaggaattgcaaattaaaacgagataccactaaacaccttttagaatggttaaaatgcaaaaacaaacaaacaaaaaccctgaccatacaaactactggtgcgcagcaacagaaactctcattccttggttagtaggaatataaaatgatacaactttggaaaagagtttggcagtttcttactaagctgaacataccataagatccagcaactatgatcctagatacttactcaatgtacctgaaaacttatatccatacaaaagccagcatatgaatgtatacagcagctttatttattgataactgccccaaactaataagtaactattgaagatggccttcaataagttaatggataaatgaactgtcatgtatctctgcaatgtaatactattcagtgataaaatgggctattaagccacaaaaaaaaccatggatgactgttacaaaaaacgtagtgttaaatgaaaaaagccagtctgaaaaggctacataatatatgattccaattatatgatattctggaaaagccaaaactataaatggtaaacagatcagcggttgaaagggggttgggggagagttgattatgtgaagcacaatggattttttttaagggtgatgaaactgttctgtttgacagtacagtgtatcatgtgtatcgttttgatgcctaataccatgcgtttgtcaaaactttacatcataaagagtgaacctactgaggcaggaggatccctcgagaccaggagttctagaccagcctgagcaatatagtaagactcccatctccacaaaaaatgaaaaaaaaaaaaaaaaaaaaaaaaaaaagtcaggcctggtggtgcatgcctgtagtcccagctacttgggaggttgaggcaggaggatcgcttcagcccaaaagttcaagacagtgagctatgtttgtgccactgaactgtagcttgggtgaaagagagagacccagtctcaaaagcaacaacaacaacaataacaaaaagagtgaacccaatgtatgcaaaattaaaaaaaaaaatttaggaggtcaggggatcccagggtgaaatgtagaatgtggcaaaaaaaaaaaaagtaactgtattaaaaatatattgaaacaaattcactgaaggaggtgagaagaaaaggtactaacctaagtaactttggagtaagtgaactgtgaattctgttagactaaagacaaaagaaatgatacataagcagtgtaactgataatgttgttttccatgttttccacatgggttaagaattctgaaaccactatacatgtatactggagttgagaaacttagtaaatgaatgataggagccaggtttctcaccattggagttgtaggttataaacaagcaagaggacccatctagaataataatggattagagtcagacacaacagtataaattaatgtttagtttaatacagatacagatgtatacacatacatatatatacacacacacacgtgcctacatatatagttataaatgtgtatatacataggctagtatacacacatatatctccttgcctcataagctgagagggcacagaagcaacaacatcccacagtacaaaaaagtccccctggaatccaaacttgatttcctacagttttccagtaaaaggaagtaggctccttattctagtactggaacaggaaatatacaagatgagcctagaatatcttatagtgtcagagagtaaggaagagctaaaaacaaaacaaaaccgcacaatgatggggatatgtcatagggacaaaggagtcaaaacaaaaggttcccaatggccaaagctggaacaatttaagcaaaataaataaataaataaacatagtagtattggattataatccaaaatataaactaataaccatgagtcaatattgatgcgaatgactgaataaatggggagaagagacaaatctcctgtgtagaaaaaattctaaatactccatcctcaagaaagtggagaataaccccccacttcttaaatgtgagctgtgtactgtgacttccttccaaagagtacagtatgaaaagaaagaaagaataattttactgtaaagaaacatgacatgctacctcagtcatgtgatcctggttaacatcaacagtggtaagtcatgttgacagaataatttactcttgatgtgatgagacttatatttatctctgggtcttttcaaaaaccaataagcctcgtctcatcattagaaaaaaaaatcccaattgaaggacattctacaaaatgtctaaccattattacccaaaactctcaaggtcaccaaaaacaaggacattccgagaggctgcgacatcatgaaccctttctgtgcctggcttatatcatttaacgtcctccaggtaaatacgtgcttgccacaaatgacaaaatttcattcatttttatggtatatacataccatgtgaaattagccaagcacagaaagactaaagaagctgatctcatggaagtagagagtagaaatggtggtttccagaggtaggggaggcttgtagaggctaggggtggtagggagagattggtcaataaatacaaaattacagttaggaggaataagttctggtgttctgttgcatagtacagtgactgtggtcaacaatactgtatatttcaaaatggcagaagattttgaatgttcttaccacaaagaaatgataaatgcatgaggtgatggaaatgctaaatattctgatttgatttttacacaatgtatacatgtatcaaaatatcacactttaccctgtaaatatgtataatcgttatatatcaattttttttaaaaaagagaagcctaaggagacatgatgactaaatgtaatatggtaacttgatgggtcctaaaacacaaaaagaacattaggtaaaaactaagtaaatctgaaaagaataggcactttagtttcaaatctgtattaatattggttcattatttagacaaatgtatcatacgaatataagatattaataacagggaagactgaatgtgggtggtatatggaaactctctaaactatttttctatttcttctataaacctaaaactattcaaaaataaaaagttaacttaaaaaattgagaaaatcctttgctttttaatttgagcaaatatttattatctgttttatcacaaggcccaacactacaacccataagtcagtggttctcacccaggccacacattggaatctgttaggaaggtttttaaaaaaatcctgatgcctaggccctagcctacaaaaattaaatgagaaatttcccagaataaaaatcaagcattgttttttgtttgctttttccaaaagccaccactaccacaaagagaaagctcaaatgatatagcaatttattaaatattttacatactatatcgagtatcacaaatcccaaagaatcatgtttctattagaggtaataaagcatataaactctaagtgattaatgtctacaatttttatattgacaagaactctgtattccattacttcaccaaaaactttttgcagtttcttttcagagtatttttaaaatattttacaaatttcaatatgtatatgcttttaaaaaatgcacttaagtacattctattttcaaaatagcatcatttattcaataatatattttaaactttcatatggcagagacaattcccataaatttgctttatatcatacacaacactaccgtagaatgctccttggtaacaacaaaatgttgcattttgaagctttattgcatagaaagaccaattttgttaatacatactctttaaaggtggacttgccataagcaattcaagtgtttacagtaaatatgaacaaacagatatattatttaatcaactcatgctaaagatttgggaatatcttccactaatatccagaaaacgaattcttactatgtaatacagttgacccatctcaacacctaatttacatcacatactcagaaatgccaaaagaagatctttgtcatatttaacaacacttaaactaacacaaaaactttgatattggattaaccttctacagaaatctctgtttgcaatttgtttaattttagaaatctgtacaattacctcagcacctatcaaaacatgtcaatttgtcaagatacattctcatcagacaagctttttctataataggtataaaaatcaaattcataaggcactatttccaatcatgctccatacttttcttgaataaaaaatattttaaaagatttgtttataatagttacccagggcacaggtgtatgcactaaaattttaaaaaccaacatatcttgtaatggttatcatataccatttcctttttaaaagccacattataaattgatgaaaatggcaatttaattttaggcccctaatttttccccaactgcaataagccaaactagatagaagtaaattaaatttggaaatttttctttatattgttataacccatacattttctgaaaattatgttaagaatgcaggatccacacacaatagacccaagtatcaatacttgatgtgaaatataaatctctcccttaatgtagcagcgaatttcagttctgaaattctgaaatcagagaaaaaatttgatctacattatctaaaaagttagttttatgaaatttttcaatggtccaatgctaaacttgctctgtgtcattatttgctccaccactgcttaaggaccaatccagagtctggactggaaacagctacagtaaaagctgccagagaatacaggtcctctgggctgaaaataaatcagaagcaaaagttggcaatacagatctctcaccatgctgaaaagacctttcatccatgaaataatcaaaaaggagaaaaaagaatggagaaaaatttcactgaaaacaactgggacaccaaaatatccatctaaaactttccgccatatcctaaaagaaagtcagttccccagtaccaaaactaagtaggtaatggccaaatgaatccctcaaactaaagcaaaagaaaaaaagaaaagaaccagaaagtttcatgggccaaaggtaaccaagctaagctgtgaacacaaacaagaggttgcaatgcaacaaccttgacttaacagatacacatgttaagtcaagcacagtatcaattagataacaaggggtccaagcttgtactttcgttccataacctagacaaaattattgtaaaagacacagtggttaagaaaaagaaaaatatcatttatgtctattctttttgttgtgttgttgagacagggtctagctctgcagtggcgcaaagtcgactcaatgcaaccttagcctcctgggctcaagcaatccttccacctcagcctcctgagtagctgggactacaggtgagcaccaccatgcctggctaatttttgaatttttggtagagatggggttttgccatgttgctcaggctggtcttgaactcctgagcttaagctatccacctgccttggcctctgaaagtgctaggattacaggcatgagccaccgtgcctggaccatttacttctattctaatcaactataaatttggatatgatttgctttaattgtcctgattccttgtaatgctaccttacagaagttttcccttccctgcttgtcactttgacaacttgtctaaaacaaatcagaattgaacaaactatgattttttctttgaattgttctaatttatgggcactcaaggagtttgttaatcactgaaatatacggagggttttatagatttataaagagatcatattacaaactcaatatcaaaaattataattttaggccaggcacagtggctcacacctgtaatcccagcactttgggaggccgagacgggcaaatcacttgaggtcaggagttcaagacctgtctggccaacatggtgaaactctgtcactactaagagtacaaaaattacccaggcatggtggcaggcgcctataatcccagctactcgggagactgaggcaggaaaactgcttgaacccaggaggtggaggttgcagtgagctgagatcacaccactgcactccagcctgagcagcagagtgagactgtcttagatagatgatagatagatagatagatagatagatagatagatagatagatagatagactgatttaaaaaataaaataaaaattataattttagaacagtccaagaaattacaaatggcaggagctcccatcaaaatggagattagaacacacaggtttacacctatccctctcaaaaccctctcaaaactacaataaagccacagaaaaggataaaccccaaaagacaaacagcacaggaattgaatagataacagtatatgggagatgtcaaaaatgtggaagctagaaaaatgtttggaagttagaaaacagataaatatgtaagcagctaactcagcagaccaaaaataagacttaagcttgcaaagagaaaagtcacaagaagcatgtgaattcagagtagtgaaccctaacatcttttacagcaaaatttgctggtcaactagttccactcttacacacagagctgccagaggtaattttagtgcttctctcaaatataatccccgtacatttgaagaaagcccataaagtgaaatgtcagagatcaaaacaaacacaaaagaacagacacaaggcagggagcaaaagataactcaaaataataataatgaaataataacgtagaagagaaagctatcttagacattaaatatctgatatgaaaaaatagcaagtttggaagataaacttgaggcaatctcagaagaataaaaagagaaaaagagggaaaaggaaacagaaaagataattgaaagactaacctaaaaggttcaacaaccaaataaaaggagatccagagacagagaggagagacagtgaaaattaccaagaaatagcaaacatgaaatcacatagaactgaagggtgtttccagatttaaaaagtcaaaagacactccatacgatgaatggggaaaagatgtataccaaggcacattattaggaaagttttaaataacagggacaatgcaaagatccaaaaactcccacattcaaacattcaaagaatcaggtatctgaatggcatctatcttctcatcagcattattgctgagcaaggaaaaagagcaaggtcttcaaaattataaaagaaagttattttcaatccaaaattttacacccaatcaatcaatcaatcaattaagggtaaatgtacaataaagacacggtcagatatgcaatgactgaaaaaaactgctgctgtcaggaagctactgggagatatgatacataaaaataaggaagtaaaacaagaaagacagaagacagcatcagggataaagagattacagaagaaaaaaaagaggacattccacaggttgatgttgaaaggaagtcttaggatgacagctgctcaacactcctaaagaggaattagttccgattagtaaaggacagaagactattgaagggatgaatcaataaaaaaaaaaaagtacggcattaataaattgtgtttgaacatacacagaggagctcagagatccagcagagagtttgggaatatagcatttgggaacaaactagtgattagaaaactgtaaaaacaacaacagtaacaaaaacggagacaattattggttctgaaaatcacaaaaagaaataacatgtaatgataatatgatataagtgaacagtatttacacagttataactatataagaatttgttttaattgtgattacataggaaaaattagacataacaagtaatcaattcttttacaagttttcaatttgtggtaaataattttatctgaaatatttcttattaaataaaatttactttttaccatgtaaaggaatgagaataagtaaatgttctttactggttttcctcaaaaaaaaaaaatatgtgtgtgtgtgtgtgtgtgtatgtatatttatacacattttcaaatatatgtatacaaatatacatatctatacttatatttaggaaaaccagtaaagaacaaatacatattacatattaataaaaataaaaatattaaagaatataaaaatatatattgtaaaaatataaatatataataaatatataaatatatatatgttttttctttttagacagagagagagagagataaagagagtctcactttgtcacccaggctggggtgcagtggcatgatcatggctcactgcagcctcaactgcccaggctcaaaccatcctcccacctcaggctcccaaatagctgggactacaggcatgcatcaccaagcctagctaattttgtgttttttaatttttttttttgtagagacagggtttcactatgttgcccaggctggtcttgaacacctgggctcaagcaatcagcctgtcttggcctcccaaagtgctgggattacaggcgtgagccaccgtgcctggcccaaatatatttatttttaattttaaaactagatttaatatctaccaactcttccaaacatatttgaccagttaaaatttgttttaaaatgttttttaaaaaattgaatctatatcagttcacaccagatcagtaatgttattttggtggccacaaggtagggcaaaaccagtaagggcaaccagcaaaaaaaacccgaaaactaaacaaacagaacaataacaaaaacaaaaaacctggccaaaatgttacaacagcagtagtgatggtataagtagtggcattaataaaaacaaaagctaaactttattgagcatactatgtgcaaaacattgttctaggtgtgtatatatgtaattatatcctcataacaactctatttgcagatggtaaaactgaagtagagaggttaagtaacctgcccaaagacataaagttatttgggaacagaactagaattcacatccagatagtatgatctatttttagataatgcaacctcccttttaccaagtaagtacattacaggcttctggactgacttgggctaattctcctgctgttcttttctttacctaattcaaaaggttctcaaaaggtagacttttggccagaaacagtggctcaggcctgtaatcccagcactttgagaggccaaggcgggtggatcacttgaggtcaggagttcaagaccagcctggccaacatggctaaaccttgtctctactaaaaatacaaaaattagctgggcatggtggcacacgcctgtaaccctagctacctgggaggctgaggcaggagaatcgcttgaacccaggaggcagaggttgcagtaagccggggatcacgccactgcactccagcctgggcgagagagtgagactccatctcaaagaaaaaaagaaggtagacttttgaaggtccctattgaacaggggtaaggggaaagaggggaaggcgggggaagtttctgtctaagaaatgctcacctgaaactgtatcaccacctgaggggaatgggttattcaaagcaccctggcatttctccccacacccatgctgagaattaattgctttagtgaagcatgtttaaagagaacatgacattattcagacattaaggaccgcaacctgaacagctctgagttcagaccataagaggtcaccagaaagtcctcatttcttttccaaggatagaagctctaagacatagtctaagaccaattagacttcttttctttgagtcattaataagttaatatgaagtcaaataacacctttcttcagataaaagtaaaggacctgatacatgcataaaagtgaaaagatttcattcaagcttaacatcaaaaagtatcccattttttgctcaacatttcacttaaaattcttctacatccatttaactccttgtattttacttaacattgtgatccttaagaaacgtctgagctccagtgacaagcaattcttctaaactccttatcagtcttttaaagtgctttaaaaatagcatgtcaatgctacattctatgccttatcttataaattcaattaacatcattctgctttgaaaatcatcatccaatgtaccacatgtagaatatttgctttgctgttttacttaaaaacaagtactcttttactgtataaatatttaaaaactcattcaagtacctgtacaatattcaataagccataccagcaaacttacaaattagtattttaaaaatcatcaactaagttcaagaaatacataagaatgaatactgcttgttgtgtaactaccaaattaccaaactgcatgcttacattttgaatactagagttaaactagtactaactgcacaaatcctgtatgcctgctttttatatacacaacctagattaaactttgtgttcatttagtcaaaaatgaatgtaaattttataaaaaatattttacttttatgaaaaagagtatcacttcaatgaaataaattgtcctactgaacatcaagagatgtgtagtctatgataaattagctgatttaaaactgtatatgtaattcaatttaagccaattcacaaaagaatcccaaaggaataaatgatataaactatttaagattctgagccttcaatgtggataaactttcctgagaaattacatctactaattttaaaagttgctaaaaataaatggcaatgtaggatatacatttactgtagaaagacttcagattcattctgcctatctcgttcttttaagtgcttgtgagagtgtatgtgtgtacatattgtatattttctatgcagggcaacaacagataaaataacctcaaaatggaagctactgcctgaaaaaataatctgaagaaagcatgtgaatattgctcaatgtgtgactctccaaactttttacttttttcttataatttcagtaaaaaagactataagagttttacccagaaacactaagctttgccccagagaataaatgtttattcaggaaaaaaaaatcataaaaacctgacataatttttaagtgctcataatatttcccctcaccttgaatatggacaggaccaagtaacatatacctaaaacgacttggtatcattggatttgaaactaagcagtgggcagaagctagaagcactttgaagacagttttagtaagagcctgaagagtcattaaaaaactgtcagaagcctgacagcctttaagaaagtttcaggaaggtaagggaaatattagaaagctggagaaaaggagattcttatgtggtggcagaaaatttagaaactgttgtattagtccattctcacactgctatgaaggaatacctgggtaatttataaagaaaagaggtttaattgattcacagttccacatggctggggaggcctcagaaaatttacaatcatggcagaaagcacctcttcacagggcagcaggagagagaactgctgagcaaagtggggaaagccccttataaaaccatcagatctcctgagaactcattcactatcacaagaacggggtggttgttccctgattcagttacctcccaccaggtccctcccatgacgcgtgaggaataagggaactacaattcaagaggagatgtgggtggcaacacagccaaaccatatcattctgcccctgccccctcccaaatctcatgtcctcacatttcaaaacacaatcatgcctttccaacagtcccccaaagtcttagctcattccagcattaactcaaaagtacaagtccaaagtctcatctgagacaaggcaagtcctttacagcagcactccactacttggtaccaatttactgtattagtccattctcacgctgctataaatacctgagactggttaatttataaagaaaggagacttaattgactcacagtttcacatgaagcctgaggaggcttcaggaaaattataatcacggcacaaggcaactcttcaaagggcagcaggagagagaagcgccgagcaaagagggaaaagccccttataaaaccatcagacctcatgataactcactcattatcatgagaacagcatgtgagtaactgcccccatgattcaattacctcctaccaggtccctaccatgacacatggggattatgggaactataattaaagatgaaatttgggtagggccacagccaaaccatatcaactgttggctataggaaccagaaaagtaacaggaaaagtaaaaaatgtacctaatgaactgggtggtctagcaaagcatgtaagatgttgcctggtttcttcttgctgcttataatcaaacacaaaaggagagagataagcttaagaaacgacaattaaacaaaagagggactgagacttgtcgattttgtaaatctccagcctctatagacagcaaaccatgctacagttatgagacagcttgcaagcaaacctcaaatccaggcaatagtcaggaaattatggtctaaatatcaagctgaaaaggtgactgtaaaatcctttgttcagatttctgacagatccatgcagttcctcaacagggcttctaagaagcttaaaggcattgtccctgcacaatctcatcaagaggccaaaatcagggaaacaattatctcaacaaaatgtatgagtatagattattctaatggagtaagctgcaatgagatttataggagacccacaaagtgtttttggcagaaacactaccagcattgactgcatagcacagagatgcacgaaatgaaaagagggctttggactccaaaatttctaaccacaggaagcaggctgagaaaactatctagctcaacacacaggctaccttccatgaaaaaggaagaactcagtgggcagagcaaaaaactcagagaacacagaaaggagccatgaaaaactatcctgaggtaggaatagaacttagttttaatgaagaaacttctaacatttgcttggctggattccaaaactgctatggaatagtgactcgtgcacttcctgtcttcctttttttttaaacagaactacccataatgatataattttatgcctgacccaccattgtacattggctattcggggtggtgggggtgaggtaagaaacatctcttttgtttataggtcttcagattgaaaggaactggacccaaggaacattatctctatctgaatgtaatttagaagatgacattctagattttgagctgatattgtaaagaaataatacttggggtagatgggatagtgcgtgtattttgcatgggcaaggaatgtaaataaggtgcggccagaggatagtctgagccagttttaaaacataaccataaattctttggcaattctcccctcaaaaggtggagcctcattcctattgccttgagtgcaggccagacctagtgacttgtttttttttttttaattgaggtgaacttcatatacaaaaaattaaccattttaaagtatacaaatcagtggcacttagtacattcacaatgtgcaaccatctcctctatctagtatcacagcattttcatcacctcaaaagaaaacactgtacccattaaggagttgctctccatccttccttctttcccacaccctgcacaccacaactgggccctgtcctggtctctggtaaccaacaacaatttgcctataattcaattgtaagttgtaagagttctctatacagtttgcttttttttttttcttttaaacagatggggtctcattatgttgcccaggctagtcttgaattcctgggctcgggcgatccacccgtctcagcctcccaaagtgctggtattacaggcatgagccaccgcacccagcttctatacattttggatactagacccttatcagaagcataatttgtaaatattttctctcattctacaggctgtcttttcacttcttgataatttattctcttatgcacaaaaatgtttaattttgatgaagttcagtttatcttttttgttatttctgctttagtatcattctctaagaattcactgacaaatccaaagtcatgaagaataaccctatgtttttttataagagttttaaagttttagctcttacatgtagggtgttgatccagccaatcagatcttatactaaaaggctgctgtatttgataaaacataggggtctaacttcattcttttacatgtggctatccagctatcccagtaccatttgttgaagagattgttcttttcccattaaatggtcttagcaactctgttaaaaatcagttggccatagatttatgggtttatttccagactttctattctattcccttggtctacatacctatccttatgctagtactacactgatttgatcactgcagtttcatattaagttttgaaaacagaagtgtgagtcttctaacatggttcttcttttttgatatgttttggctatttggggccccctgcaattacatatgaatttgagaactgacttttcctcttctgcaaaaaatgacctgaaatttggaaatagatctttaaaatctgtgaattgatttgaggagtactgccatcttcacaatataatgtcttctaatctctgaacacaagatgtctttctattgatttaggtcttttagcaatgttttgtacttttcactgtacaagttttttaactccacggttaaatttatattttaggtatttcattcttttggatgctattataaatggcattgtttgcttaatttcctttttacatttttcattgctggtgcctagaaatacaactgagttttgtggttgatgctgtaccctgaaactttgccaaatttatttactagctctagcagatttagatggttgacagataacaaacaggaagttgctctagctcatggggggctgaaacaaaggtatctgcaccagtccctcagggaaccaccagacaggtcaaaatgaaaactacaattttttttcagaacaaggatcttattgtccccgtcctggcaccagtgagctacaccgggaatatgggttgctggccccatagctgctgctgagctagaaaataaaggatattaggtatataagcaaaaatgtcataatgctttcttatcaaaatctggcactcccctggatgctgttaagttttctatcagattccagagttatgcaaaagttgatttgtcagttttttccagtttaacatagttgcttctgtggaggtaactgattcttagagctccttgctccaccactcacttgcttttaaaaactgggccgggcgcagtggctcatgcctgtaatcccagcactttgggaggccgaggtgggtggaacacccaaagtcaggagttcaagactagcctgaccaatatgatgaaacctggtctctactaaaaatacaaaaattagccgggtatagtggcatgagtctgcagtcccagctactcaggaggctgaggcaggagaattgcttgaacccaggagatggaggttgcagtaagccaagatcatgccactgcaatccagcctgggcaacagaacgagactcggtctcaaaaacaaaataaaataaaaataaataaatagaatgtggcagaagtgacagtatttaactcctgagactacaacataaaagacagtgagaggtcctctttgttctctctcttggaccactcactctgagagcccctgaatgagccatcctggaagtgaatcctccagcccttgtcaagccttcagatgactgcagctctgatgaacacttagattgcaatctcataagaaaccctgagaatgaatcacgtaactaagaccctcctgaaatagcaatctacaaataccatgataataaatgtgtgttgttttaaggtgctatgttttgggggtacatgatatttaaagctgagactcaaaagaaaagaacctagccactccaagagttctaagaaaaagagtgtttcaagtaccgggtatagcacatgcaaaggccctgagtaaggaaagatcttaagcatgttaaaaaaaaaattaaaaatctgaaagactagtgtgacttaagctcagcgaaggaaagaaaaatagtgaagaaagagacccccaaaggggcagaaagaaaccaaaattactataacaaagtcttaaaaagtagtaaaaactgataatatatgataaagtgcctttgaaaccacaagaaacaactacaaaaatttaacatttagaaacattaactggagagaaatctgaaactaaatgtatctatcatcacacaggaatccagggtaggaaatatgaaaccccctgagagcaagaaccaagggtctttacatctcccatatcacctactcatctttgtagaattaatgcacaatgacaaacctgaaaaaaataccttttgaagacactatttaaaattctaagtaatgaattcattggtgaaagattttaagtctagaatacaggcttcaagtatctcctcactaggtagtccatgacaacggccaaataaataactcatgtagctgcatatctaaagaacatgattataaatcagctctacaaagatgcacatttctccttgtcctgggctaccatgtgataaaaggttttataattggtaaaaagagtaaaagaatttcaaaagaattcccaactggataaccagtctctgaaattaaaactgaatttaatttagcaaaataattccatttgtatacagaaactgtaagatttttaaaatgaacttttatgggagaacatactgttacgaaatacattttcaatcagtaaaacataaaataatacatgtgttttcagattttatgactatttgaataccaagggttattctcctctatatctttatccagaaaaaaatatataacttgaaacacaaaggcaaaaaataattagcaaggtatagaagcactagacactacaaaccaggtgcagtggctcacacctgtaatcccagcattatgggaagttgaggtgggtagattacttgaggtcaggagtttgagaccagcctggccaaaatggtgaaaccccatctctattaaaaatacaaaaattagccaggcatggtagtgtgcgcctgtagtcccagatactcatgaggctgaggcaggagaatcgcttgaacccgggaggtggaggttgcagtgagccaagatcgtgccactgtactcccgcccaggtaacacagtgagactctgtttcaaaaaaaaaagtattagacactacaaaatgtggtaaataaatacaattattttatttcgttatttaaatgtagtaacatcaatataaagtaaaaggaattaatagctagtttaatatgctaggcctttttatgtcccacctgcaactcctgctatggtacgttttatctacagcatagctggtgaccagttaaaagaaaattccagaagatatgacacaaaactgtataaattcaagacaatatttatttaacaaacccagagttagtatcaactagatactaggtactgtggaagttcatcctatcaacattacattccactaatcactaattcttaagacatcagaaaaagatagcaaacatataaggcaaaccaaatatattttgagattcaatgaaaaaacatatcttacttgtatagtaaaacagtaagtgcttttaatatattttaacagaattacagacaaataactcagaagaaaaaaatcaactttttgaagataattacaaaccgaattttcttcttcctcttccaattctcgttgctgttcctcatgtcttttagctttgatctccatagcttctgtgatcaggtctcttaatattgatacaggtttggcattcttgataaaaggatgctaaaaaagtaaaattcaatggtataaattcaaaagatttttccgaattatagctaacaaatgttaaaacaacatgtaaatgttaaccaggatcacaggcttcaatgattgttttttcatctagaattaaatgtataggttaagaaaagagagtatggccactgcctagaaataaagaatttgctttggggcttgtttaaaaaaaaaacttaaagcacacatgcaaaaatgcaaccctgttaataaaactataatatccttaaagatctaattgtccaaaggaagtgtacattaggagtaaaaaagattaagttaaaaataggattacagattatattacacatagaaataaacttattttggtactgagttacgtaatttaattaatcttaataagttgacagccaaaatcagtggccaaaaggagagcaactattttgttacttctttaacatattttctattttattgtatcttaagtaatttaaccaagacaaaaatattttttcagaaaatgaatgttgcctaatttctttactatatataaaataacttgtcactttttaaaaaatatcaccctgatctagctaaaatagctaagctctctatcattctgacaaagagaaggaaaactatcagaatagacctaggttttgaatttctttttattgagaaggagggacatgagagaaagtagagtgaaaggttataattttggatagataacctaaatttggggcagcaatcagtttcagtaattttcatagttacatgtcagtagatagcatcaggtaaaagtgacctgactgagtgagtgagttatttgtttatttgtttgtttgagacaggggcttgctctgttgcccagatgcgagcacaatggtgcaatcatggctcactatagtcttgacctcctgggctcaagtgatcctcccacctcagccttcctaagtgctgggaatagaggcatgagccactgcacccagccctgagttattttaataaacttcaagagaacacaaaaatatatttaaagacaaaaaaaattgtgctgaagaagaaatagatacttgaaagagggtttaaaatggcaaacatatcatttgggacaactataagaaagaactttttcagagtacagaaatactaaaatcaattgtaaagaaccaataaattattttagaacagttatagattaatcttaccaaacaaattaagtcctattaacatatctgtggtagagactcctggtcatacaccaaaaatagagttgtggttggaccgacaattgcccaactggatcctacgtttctcaacttaacccattcaggtggttatatgcgactaagtgaatgcgggagcaaatactgtgttccacttcctggcctgggctatggagggctccttgttactaatggataagggtgagaggtcaggttctcccagagtcctgtactggtactgtgggaagtagtctcattttagctgattggcgatgaaagtcctgacccttcaccagactgcctctgaccccactccaacagggaggttgttgggttcttattcctgcctggtaggagtataagtctaggctcccacatggtcttcactggcactccccacttagggagggaatactttctacactgccttgtggagatgaatgccttagcatgacagccttctctgacaccgcctgagaaggactggacagcctcaaaaggatagaagtctaggttctccatttagcctttgctggtgaccggggtaggccatagttttcttggtggtgtttggctagagtagaacggttatcatctgaaagttttcagtcttactaggctgtccatttctccgtccttctgcttgaaagagcaggtttttatttctagtttgtgtccaatgttgtttctgggttgttggcttctccactacccagtgtgggataaatgagggaaaaagaaaccccagggaactcacagctatgtctttccttgagtcccaccatctctagcagtctattgccttctttccaccttttagagtctttttatgcttgttttatatacttacaatgtccatggttttagctgtactttaatgaggaagtatagagaaaaatatggttactcaatctgtccagcggcagaaatgccttcttcaactcactttaagcacttgttttatctgaagtgtttttgtataaatcattaattttgaacactatcagtttagaaattgataattcagaacatgaacaaaatttaagaggaaatatttcagattttaaaagaataaacttttcaagcagtctcaatttttaaaatacatcatcaagaatgtgataggttgatctgcagtaatttctgtcttctcattactttaggtggtttaagaatcctcaccctctttaatttttattttagacacatttagaaataggaaaactttactgcctattagaatctggtacattcatctttttcttgttgaaatactttataaaacccttcatataatcagccccttgcctgacataaatatatatatatattttttagtttccgttttttgccattcatgcattttttaagttatatgtattcaaatcatccatttttcttttgctttattgcaccggaatgaatatataaatattctcctatattaacccctagttctttcctatttccattttttgttttagtttttttaacatttaagaccttaatctatctggaaattactttggtgtttctgtggtgaagatctaagttaatcctcccaacaccccctaaaggcaggcagttatctcagcaccatttttactttgtttttccctcactgattagaaatgctatcttcataatatgctagtttcctttgtatattatataccatttgtgggcatttaattctgcttcattattctatctcatactggcgttacatacttttctaagcatttaacaaaaagatgtaatttgtttattaaacataaaatttgatttttctattaaatcaatcactatataattcagatgatgtttattttttgcctatatggttactcagtgactgaaaacggaatatcaaaatatcccaatttatttatttagagcaacctcttatgtctttaatttgtaacatacaatgctatattaatatatcaagtttataactatatcttcctttatattatgttctttatcaatattaagtgactccatcctcatttactgatttctgctgtcaattttgcttttttgatcatgttattcatactatctttttatattttattaaaatttcattgcctgtttttaacttttttttttaaataaaaacagacaattgaaacatttttattaggttaatttcactttttacattactacaacaataacaaaaataccaataccattgaatacaattaagaagtttacttaaatcatattcctcaaaatttggtgtgtatcatcacatgtgttagaatcatgggagcgagggcagagggttacttctaaatattcaaattctcggcctcccctagacaaactgaatcagaatttctaagaatgttgccatagaatctgcattttagcatttctttccaagtgatttttatgcaaaccaaaattaaaaatactgcattgacattttccatcccagtcttctgaagattgaaagttaacagcagggttggggtgggctggggtgggacaaggtcatgggaaatagcagcccaggaagcatcagcactgtcatcctcactgtggtttggatgaagtaccttttcaataagctcttctgtatctcttgataaacagttacatggtaatgaaacttttcaaggttatttccttgagaatacagctaaggcagcttcttgcgtctttccaagcagaatattctgatattattattaatctttatcttgtcttgttctgaaaacaatttgagctatcttatgaaattcatagtctatattagtttaagaagtagatgagaaaataagctcaggaaaataaacctatgggtaagagagagagtgtatgtgtgtgtgtgtgtgtgtgtgtgtgtgtaagagagacagagagaagaaagagagagaaggtaacttagagattaataaatacttcttttaaaaataggagttatttgtattttagtttttaattcaacctaaaccttctctctgtagggtttcacaattttaaaaaagtatgtcttttaatttaacaaaatgcaaacatgtatctctgctagtggagaaggtagtgaaaatctttttttttttaaagtttttttttcttttattattatactttaagttttagggtacatgtgcacattgtgcaggttagttacatatctatacatgtgccatgctggtgcgctgcacccactaacttgtcatctagcattaggtatatctcctaatgctatccctcccccttccccccaccccacaacagtccccagagtgtgatgttccccttcctgtgtccatgtgatctcattgttcaattcccacctatgagtgagaatatacggtgtttggttttttgttcttgcgatagtttactgagaatgatgatttccaatttcatccatgttcctacaaaggacatgaactcatcattttttatggctgcatagtattccatggcatatatgtgccacattttcttaatccagtctatcatttttggacatgtgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttagctgcataaatgtcttcttttgagaagtgtctgttcatgtccttcgcccactttttgatggggttgtttttttcttgtaaatttgtttgagttcattgtagattctggatattagccctttgtcagatgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaaggccttgcccatgcctatgtcctgaatggtaatgcctaggttttcttctagggtttttatggttttaggtctaacgtttaagtctttaatccatcttgaattaatttttgtataaggtgtaaggaagggatccagtttcagccttctacatatgactagccaattttcccagcaccatttattaaatagggaatcctttccccattgcttgtttttctcaggtttgtcaaagatcagatagttgtagatatgcggcattatttctaagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggcctttttcacgatattgattcttcctacccatgagcatggaatgttcttccatttgtttgtatcctcttctattttcttgagcaggggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgaaactttgctgaagttgcttatcagcttaaggagattttgggctaagacaatggggttttctagatatacaatcatgtcatcagcagacagggacaatttgacttcctctttttctaattgaatacccttgatttacttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatatcccatcaatacctaatttattgagagtttttagcatgaagggtggttgaattttgtcaaaggccttttctgcatctaatgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattaggctgtgaatctgtctggtcctggactctttttggttggtaagctattgattattgccacaatttcagatcctgttattggtctattcagagattcaacttcttcctggtttagtcctgggagagtgtatgtgtcgaggaatttatccatttcttctagattttctagtttatttgcgtagaggtgtttgtagtattctcggatggtagtttgtatttctgtgggatcggtgttgatatcccctttatcattttttattgcatctatttgattcttctctctttttttctttattagtcttgctagcggtctatcaattttgttgatcctttcaaaaaaccagctcctggattcgttaattttttgaagggttttttgtgtctctgtttccttcagttctgctctgattttagttatttcttgccttctgctagcttttgaatgtgtttgctctggcttttctagttcttttaattgtgatgttagggtgtcaattttggatctttcctgctttctcttgtgggcatttagcgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagtggttttgagtgagattcttaatcctgagttctagtttgattgcattgtggtctgagagatagtttgttataatttctgttcttttacatttgctgaggagagatttacttcaaagtatgtggtcaattttggaataggagtggtgtggtgctgaaaaaaatgtatattctgttgatttgggatggagagttctgtagatgtctattagttccgcttggtgcagagctgagttcaattcctgggtatccttgttgactttctgtctcgttgatctgtctaatgttgacagtggggtgttaaagtctcccattattaatgtgtgggagtctaagtctctttgtaggtctctaaggacttgctttatgaatctgggtgctcctgtgttgggtgcatatatatttagtatagttagctcttcttgttgaattgatccctttaccattatgtaatggccttctttgtctcttttgatctttgttggtttaaagtctgttttatcagagactaggattgcaacccctgcctttttttgttttccatttgcttggtagattttcctccatccttgtatttttagcctatgtgtgtctctgcacgtgagatgggtttcctcaatacagcacactgatgggtcttgactctttatccaatttgccagtctgtgtgttttaattggagcatttggtccatttacatttaaagttaatattgttatgtgtgaatttgatcctgtcatgatgatgttagctggttattttgctcgttagttgatgcagtttcttcctagtctcgatggtctttacactttggcatgattttgcagcggctggtgccggttgttcctttccatttttagcgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacattttttccttcatttcaactttggtgaatctgacaattatgtgtcttggagttgctttctcgaggagtatctttatggcgttctctgtatttcctgaatctgaacgttggcctgccttgctagattggggaagttctcctggataatatcctgcagagtgttttccaacttggttccattctccccatcactttcaggtacaccaattagacgtagatttggtcttttcacatagtcccatatttcttggaggctttgctcatttccttttattcttttttctctaaacttcccttctcgcttcatttcactcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaagtcattctccatccagctttgttccgttgctggtgaggaactgcattcctttggaggaggagaggcactctgctttttagagtttccagtttttctgttctgttttttccccatctttgtggttttatctacttttggtctttgatgatggtgatgaacagatgggtttttggtgtggatgtcctttctgtttgttagttttccttctaacagacaggaccctcagttgcaggtctgttggagtaacctgccgtgtgaggtgtcagtgtgcccctgttggagggtgcctcccagttaggctgcccgggggtcaggggtcatgcacccacttaaggaggcagtctgccccttctcagatctccagctgcatactgggagaaccactgctctcttcaaagctgtcagacagggacatttaagtctgcagaggttactgctgtctttttgtttgtctgtgccctgcccccagaggtggagcctacagatgcaggcaggccttcttgagctgtggtgggctccacccagttcgagcttcctggctgctttgtctacttaagcaagcctgggcaatggcgggcgcccctcccccagcctagctgctgccttgcagtttgatctcagactgctgtgctagcaatcagcgagactccgtgggcataggaccctctgagccaggtgcgggatataatctcgtggtgcaccattttttaagcccgtcggaaaagtgcagtattagggtgggagtggcctgattttccaggtgccgtccgtcactcctttctttgactaggaaagggaaccccctgaccccttgcacttcccgagtgaggcaatgcctcgccctgcttcggctcgcacacggtgcacgcacccactgacctgcgcccactgtctggcactccctagtgagatgaaccgggtacctcagatggaaatgcagaaatcacctgtcttctgcggcgctcatgctgggagctgtagaccggagctgttcctattcggccatcttggctcctccgaaaatcttctcttgagaaaagtgaatggacaaataaagatttctcatttccgacaaaagaaaataaccagcattgatttgctatttctgttgttatgagtgcttccaggtggttgtctttggatctgctctgttcctgtgcacctcttcttggaatataaatttctgagcctcaatgtgccctgatgccgttcctttcttccaccgtaagagttaccgaaagctcggcgtccgtgatggggtagagggcttccgaggcgatcgggcagtgtcagtcttcagccgctaagccgagaagatctgggaaggagtcagagagccttgggccagagttccaggggctctgggagtggcggatttgaaattggtgagatgtatcttgggctggtcggtctgaggacctgaggtcctaggtggatctttctcaaggagcaaaaagcaggaggacgggggattgatctcccaagggaggccccccgatccaagtcacagcaccaaatttcatgcacgtccgtgtgaagagaccactaaacagctgtttttaacttttaacccaaattcttttaagtatgcctcatgtagaaacatgagttggattttatgtaagtttgtaagtttatctcatgtagaaagcatggagttgcatttatcttatgaactaagtgaaccatttagtacttaactaaatattatttaaaaaaattaaccacttatgttagtatataattatatgctaatgccattttatcacaattgttttacattatgtaaaacatacatgttttatcataatattctatcataaatgttttacatttgccatcttgttttttctgcattcttttttacgttgctttgcagttttaattttaccacctgctaatcttaaaatgcctttaaaaatatacagatagtccctgacttacaaaggttcaatttaggatttttcaactttacaatgctgcaaaagtgatatgcattcagtaggaaccatacttggaattctgatatttgatattttcccaggctagtaatatgtggtacaatactctcttctgatgctgagcatggaggtattaataagtcccagctcccagtgagctatgcgatcatgagggtaattaaccaatattctatagtgtactgtgttgtcagcattttttggatattgtgttttgtgttttcacattcaattgcgtctacaaaacactcaactacactaatgtatgtgttctgggcacgtttttggtaggctaggctaagctaggataggtgtattttaacacctttttgacttacaatattttaaaccttcattggggtttatcaggacctaactccattgtaagttaaggagcacttgtacttaaaaacttggcaatttgtctgataaaacttctcttctgactcaagaatactcaaataatatggtcttgctcttcatgtacccttttaactttattagccagttcctctttgttgatcaaaaccatgtctgcagcagttatgtagggaaagcatgagtacaaatgaaattggacataccgagattttgagattaagaatgttaagctctatagactaactgtagcataacactatagtgaattgacaatgaattgcataaaagcagggttgtggtaaattggacgaaccagataagtatattggcttttcttaaaaataactgcagcttagaagggtagtttatacattcccctgagaagataaagtataatgtagtttgaattttctatactttgttaaagaaatataattctactggtttctagtttctgtagtgttggtcttctctcacttctgttaatacataatcagtcactaaatccttctcattctttcatcagatttactattttctattttggcaactatttttttaaactcaggtccttaacaattcacacctgtattattacagtgcctcctcattctatttctatactttgttgcaatattatgttatcaaagacattcttttcttacattctcttgtttacatatgtaagtaaggtggctctcagacaaaattgaggcatctcatcctaggcatcagaatacccttcttgcttcactgttgtctgtatctaaactcagacaccacttctctaactggtgtttctattctggctaagcagatcttactgtgttctaaaatacatctcccatttttgtgtctttgttcatattgttcataccatttctcctccctaaaatgatctgcttcttctgtatgaggtatctgtgattaccatatccattcttctacttttacatttcttaatcatataggctgtgcatcatgaatgtaacttctacattgtattataattttttaacatttttgtctttcatttctcaaagaatataacttcagttttttgtgtgtttttggggtgtgtgtgtgacctttctactagtttgtcaaaaatgtttagagtaggacaggagtcttttctttcttattgctctacactcctctaggacactgtctttgtctttacagttgtttgaagttgtgttgtaagtacctctgttttccaacttgataaaaagggaagagatcatggaagactgctcactgacttactttatttatttatttatttatttatttatttatttatttatttattttgagacagagtctcactctgttgtccaggctggagtgcagtggtgcgatcttggctcattgtaatccctgtctcccgggttcaagtgattctcttgcctcagcctcccaaatagctgggactacagacgtgcaccaccatgtctggctaatttttgtatttttcgtatagacggggtttcactatgttggccaggctggtcttgaactcctgatctcaagtgatccacctgcctcggcctcccaaagtgctgggattacaggcgtgagccacggtgcctggccacttactgactttagaatctcggctgcccaccagcaggtataaggatcatcttcagatcaggaactccggtgctaatagactgaaactgaaccttgtcttttaacatctccagggttttaatttatctttaaaaactactaaaatttcaatttaataatctcaaaggatccttcccttctatgatttttaaaaatgtatacaataatctatctgtgtcatagaaaatcaatcactattttaaaaatccatcaggaatttctttttaaatattgtttctttgtttactggaaatgaatatggtataatctgtacacgtaagctatagatatatgtcaactaaaatttggtaatcagattgtccactgagagttaaactatgatttaaattaggggtccccaacctccagctgcagactggtacctgccttggcctgttatgaactgggctgcacagcaggaggtgagtgagcattacagcctgaactctgcctactgtcagatcagcagtggtattagattctaacaggagcacaaaccctattgtgacctgcacatgtgagggatccaagttgcatgctccttatgagaatctaactaatgcctaatgatctgaggcaggacagtttaatcctgaaacaatcccaactctgctcaccatccatggaaaaactgtcttccatgaaaccagtccctggtgccaaaaaggttggggacaactaatttaaatcataacagataagacatacaaaactccttgaagagacagaatggttcctaggcttcctgctaaataagactctaatgaggccaaagataattatcctacccccccaaaaaaaaatttaaatcagaagtttgttaggttaaatacacacatattaactttaatatgtacaagtactggatactaggagtccaaaggtagtaccctttggactactttaaaatacatatatatttcagcagggcgagatagctcacgcctataatcccaggaatttgggaggccaaagtgggcagattacttgagcccaggagttcgagactagcctgggtaacatggcgaatcctgtctctacgaaacagacaaaagttagctggatgtggtggcatgcatctgtagtcccagctactcaggaggctgaggtgggaggataggtggagcccaggaggtagaggtttcagtgagcgagatcatgccactgcactccagcgggggcaatacagtgagaccctatctcaaaaaatacatgggccgggcacggtggctcatgtctgtaatcccagcactttgggaggctgaggcaggcggatcacttgaggtcaggagtttgataccagcctgatcaacatggcgaaactctgtctctactaataatacaaaaattagccaggcatggtggcacacacctgtaatcccagctacttgggaggctaaggcacgagaatcacttgaaaccaagaggcagaggttgcagtgagccaggtgccactgcactctagcctgggtgacagagtgagataccatctcaaaaaaataaaaaataaaataaaatatatacacacacatataatatacatatataacacatacatatatatttcaaatgaatattgacaatatttcaaaataaatgttttaatcaatttttgtggaaaaataaaattttaccatcttaaccattactttttgaaaggtagtatttgcacataacccaaatcgcaaaagtctcataaacagttttcatcaaaaagcaagtctccatcccagtcctgccccatccatagttagttaccttttctggaggccagtttcttgcttatttttccagagatacttcattataagcattaagatatgtatatatgttgtgtgtacataggtgtatttttccagtaactctttttcttgtactttaaattgtttccaacttgttgacagacatttaggatctttccaatcttttacaatttcaatgttctacgaatatttttacacatgttatttcacacatggttaaatatttctgtagaataaattcctagaagtgcaactgttggatcaaagaatatatggatttttattttaaatagatattgctgtactggcatctatggagattgagtaccaagttacactttcataacaataaacattatacttaagagcctgttttccatacccctcaatacatccttttggaaaaatgggactttggaaagttacttttttttttttttccttttttctttttttgttcttttaacccaatggttcctttagagacagggaagtccctttttacaagaaccatgtttttcatccttttgtcacttaacaatagaaatcatttagcaaatatcaagttttgttaatgtgagacatacttattattagctgaaagttctaagactattctgttggggaaattaagattcacaaacacctattataaatattaaattatttctatttgcattaaattttaaggtagattttaaaatctactgacattctggatacaaagtctacttacaattattctatcaaaaaaaattgaaactctgaagctcttcatttagataatcctgtaactgatatttacaacgtgataatctcttcaaggagtccagggatcttgtacttacatattttatggtggagcaaaaagtcaaaggataaatgctgagtcaaggaacagaagaaaaaaaaaacatgagaaatagtaactatgaagacaaagattcctttctgaaaggagaatgctttggaaattttgttttaaaatgactctgggggaaatgaggggacgagaggggaggaaagaaaagaagggagcaaacaggaggggaggggaggtttacatctttagaaatcagttatgaaacacacagcaattctggccaatgtcagaaagctgaaaggtatgaagaaaatatccttcccttcgaggcacaagcactgacctgtaaaagttgtgttgcagtagctctctgctcaggattcttcaccaaacactttttaacaaaatcggtgaaatcatcggaccaaagttctggctttctgaatgttggtggtggatttgtgggaatcataaaaatagcctagtacaaatgaaatatccaaaagacagtaagaatcacactagcacaatcaaataaacaaatctctttatctgtctttttatcagactctaaatttgaaaaacaaatttaagctgttctaggatttctagtaacactgaaattcaggaagccagtccatctgctactaatgtaatcatttcccattaaatttcctctatttgaattgtagctcattgagcacatcattctttattttacctattacttttttttatcagtctctaaagaagactatatttctgacccactaaggactttccctaaacatatatattcccaaattttgctactacatgccagatttacttcttgtttcagttttatataagcattgctgcttaaaatgggtagtaggagtccaatttgcttttgcaatccagaatatttaagtaaaattactgctataatttgaaataatacttgacagagccaagacttttctctttttaaatatgagtcaaaatttcaaatgaaaaatttcaaaggtaatatactactttaatttattactaatgattgagtacttataatttagtggtaatgataatacattcagaaacctcaaaaatcaaaagccataaaaagagtccatctcatctctcgcctcctagatagtcaccctggcctgtttttgcttttaatctgagtatgtttatgacccaagaagtagattaaaaaaacaaaaacaaaaacctgaagacattctaaatatgaaatacaagtcagttagggggttaatgtagatgtcccaacatgagtaataaaatgttcaaactagaatagtatctacaggaatgaaatggaagaaatgaagcatgagatacttcaaaggaggaaccaagagtacatgctaataatattgttttggagaggtgaaaaaaggaagcatgaaaaattactccagaattcaagaaataagaaataggtaccttaaattgcaaggcactcaggtattttaataattgcctatatcattcttttgaatgccctcagaatatgcagccatttaatataatgcattatcattggtttcttacttggaaagtgatcaaatggactttctgtggacacagcagcaaagactcaatatccaagtctgttgattataggttaagagtcaatctttttaccagtatatgcatcttctttcaaaaaacgtaaattctttaatagattagaatattttatatacctcacgtcatgttatacatattacatctatgatagtctttcaaaagcagtgtagccagtattacaaaacaataaacatctttcaatcaaacaaatatttataaagcatttctgtgtgttcagaacaatgctataatttagaggtatcaaaacaaagggccacaggccaaatagtgccagtggacctacttcgttcagacaaaatcaatctcacattgccacaagatgaatctgctgtaattagactaatttaaactaggacatatgttcttccttttgcgtgagctctatctagcctggctcaattatctactttatgtgatggtccctttaaatatcagaccttataaacccggctattacagtttttaaaataggatacatatctcagacccccagagctcacagtcaacttgtgcagaaaaaaaaaaaaacacatatgaaacgaatagcaaacaactgagtgccagacaatgaaattctgcctgcaaataacctaattaatctcagacagctccacagttgaggcagaacctaataaggctttaaaaaatgagtaaaatggggttaaaagcagctgctggaaaaggcacacaaaaccacctgctacttccaactagagaataaaaataaatttgaactctcatctctgtgaaacagttcaaaggacttacataagcccctatatagactgacctcaaactgcaggtaaattatactagattgtctagataaatattgttcatctgcacttctgttgtaaactggtggataacacaatgatttatgtccttgaagccaatgctctcctttgaactttgaggcaatgagttgcagtcttatcttgagataatcttaacatataaggctcaccttagcagtagctattagaaacccaaggataaaaagcttaactctaactcttatttacccagtactctcataaagtgaacctaaaatgtcacattctaccctcaaatatgcattgaacaagcatgaacaccgagcatacagtccaaacaaataagtcttagcgtatgatctacaccaaaatgtctccaggaaaaccactatgccatttatttccattttttaaggttagctcatcaataatagattttcttgacagccttactgtactaatttaactaatttaacctaataatgaaccacagaggatcctcttaagaatctctaggttttatatgagttgattaggtattaggccccttctatagaaagttttggcaatcagtggctcactttagactaacaattcattcccttgccaccaaccaaatcacagggacacacattacagccatataatttatcttatctctaacaccattttgattgaagaatgttagtaaaataaatgacatgattatccttgtgtttgtttctacacaatgtgttgcttaactacataccaaacctctgattatgtttctaaaagaactactctgatcacaagcagtttaataacgcaagaaatctaggtgcttcaaaacaactaattatcttcatgcctgaaatgtcatgccttagactgcaagagtacccaggagatgtggaaagggctgaaaatgagaatcaacaatgactgaactttataatctcagtggaatgagtcaacacatgtctgactctacagcagctgagtctgtgaatgtatagaagtgatgggcatgccagaataacaaagaaattcatgctattatttaagaacctcagatatatgagcaaaaggttatcttcacaacaaataaatgagataaaggatgagaaaacactataaaactataaagaagtaaacaaatatagctgtttcctgatagcaaacataatacacaggtaacaagctaaataaaattttaaaataatttctggaaaggaaataaagtaattacactaatttataaaagacagtacaaataaaagcaaacagtacaatgtgatgaggccaatactggacatgagtcagaaaaactggcttgagttctaaatcactacctgactgtgtggctttagtatcattttgttttttttttccaagtaaggaggttgaactggatgtttatcaggtcccgtactgggtataaaaagaccctggcactctttaccacgtattaaaaaaccctggcactctaactgcctagcaattgaagggtaaaattatactaaacaagtattaaattgctagttaggaaagggatggagaagaggaaaaagagggaaggacaggaaaaggccttttagatgttaatataaaaatgtgaatctaggccaggtgcagtgactcatgcctgtaatcccaacactttgaggggctgaggcaggtggatcacctgaggccaggagttcgagaccagcctggccaatatggtgaaaccctgtctctcccaaaaaacaaaaattagccaggcatggtggcaggcacttgtaatcccagctactagggtggctgaggcagaattgcttgaacctgggagatggaggttacaacgagccaagatcacgccattgcactacagcctgggcaacaagagggaaactccatctaaaaaagaaaaaaaatgtgaatctaaatttttatcaccattccctcaaaagcaaatatgaaatatacagaaattttgaagagaatagtaaatctaaagtgaaactttctcctataataaagtttccacagtaagcacagagttaaagtattgggaacatgaactcacaattcactccagttccagtagcaatcattaatctggccaagaaaggccaatgtgccagcctggaaaccaaattaagggagagggtgcagctggtattctggaagtacaaagcaaataagagaaccagctctagatggcactgggtacataacagcaccattattagtaactatctgacctatttaactactctatgcctctgttcccatatcttaatatgggaatgttagggctgttctgaattttaaatagattaatacatgtaaaacacttagaatagtgcctggcacaattgtaaatgctcaataatgtgagctattattaacctaattttacgactgaggctcacaagagtaagctagcttattcaagatcacacagctagtaaagtgaatgtcaaaattagaacaagtttgattccttagcatatgctacctcacattaccactgcttccatcagatttctgctgcacataattttattttaagataaaggctctgttatatacattcagtctctagaaaaaagtggaaaagtatttgtaacaaagaagattatagttttactgtctctaacggtggaaaactgaagaaaaaaaaagtcaaacaattgagggtgctaagtaaactatatatgaataacataaagtaacatattgccataaaaactgacaaatgtgtgaattacaaaaccacaaagaaaagttcttaaaaagcaaaaatgagggagtaaaacagtaaagactgctttcacataaaaatgactagtatgcagcaataaaaactaaaagatggtatagaatcttaaaaatttaaactgtcaattcatagcagcaattatgtacaagattgtataagtgtctttaaaatttatttttactatgatggtttttaaatttttttttacttttaaaaattatacttgcagctaggcatagtggctcatgcctgtagtccctgagctgagaggctgaggaaggtggattgcttgagcccaggagctcaagacaagcctaggcaacacaatgagatcctgactctatttaaatatatatacatatatttaaaagtatttaaaaattatactcgcaattgcaaaagcttcatttgataccaccccttaagctgtcacctattccagtctgccccacaaccacctcttactcatgcactatttaaatcccaatacaatcaattgtaaatcttaaccatctttcaagactgaaatataatatccctttaatacaatccaacaatatcataaaacatggctgtagagaaaagcaaaagtgaacaaaagccaacacttaaagaactttatcacaaatttcactctctcagatagaagtcctatgatcagttcaactgacttttgtaagcacataaatgtatccatacctgcaatatattaacttcttcaagaaatttagagtctaatggaatataaaaatgtatatcagatcattttaataaaatagtgtaagtgctcaaatacatgtgagcaataggtattacaaaggatgacttagcccaaataggtatgtgagctaaatgggtatgggaagatgagatttcagctgagtcataaagaatgagtgagtcagtgaagcacagaaaggagaccagcatcttctcagttgtgaagtttgaaacctcatggagctgtgagagaaactgacttatttcagatgtagggcagggaaattacgaggtgagccaaaggcatcttgttgcccataaagaaagaaatcactcaaatactaactggatcacatcagaagttcagcacttgtagaacttagtatcagccataaaagagtctgatttaactgatctggggtgacgacaaggcacaatattttcttacatctcccaagcaattccaatatgtgagtaacatggagaaccactattctaaaatataaaatacaagacaagtgctatcactgtttaatatctcaacttcagaactttccatattttaatattgtactctgattagttataaactcattctaaatgccctggataacatgaaaactacctgaaggcaagacagtgtcttctattgtctgaatgtttgtgtctcttgcaaaattcttatgttcaaagcaaatcaccaacgtgatggtattagaaggtggggcctttgggaggcgattaggtcataagggctccacctttgtgaatggaattaatgccctcataaacaagtccccacagaaccatctaatcccttctgccaaataaggacacatagaaggtgccttctatgaggaacaagccctaactagacaccaaatctgctagcacctagatcttgaacttccaagcctccagaactgtgagcaatacatatcttttgtacataaattacccagtctaaggtattttgttatagcaacccaaacagactatacaatcacttaagttttatatgtcaactgcattaggcatagtacttctccatagtaaaacctaaatttatactgagagtgttgatataaagacatccagttaagtatggtaactgaacatactgatttacttcaactccttccccaaaatcctgctaaagtacagtaagaattttaaaaaggcttaacctccaaagagagaagggcaatagaaaataagagacagcaataaaattttggaaatagaaagtagatgaaagagtcataactgactcaaaagatctgagaaatcagtaagaagcacatcaattccctccaaataactaaaaaaaaaaaaaaagcctaagaacttggaagtaccaaatatatctaaagatagtggacacctgtaacaaggagcacacctggtaccaagatcttggcttctaaaatgccaatccccagtaaaagaaacctatgctccttgaggaaatgactaatttcaaaggtcaaaataggaaaatcacaaggttagctctgggtatcttgctaggccagaaggtaaggaaacactcaaagattaatggtattatgtcaaaaggacatataaataaccaaatttaggataatttgagcatcaaaataataatagtaataatgactataactgattataacaaattgaaaacaattagtctacagtgttttttttttttatttttgagatggagtctcgctgtcacccatccaggctggagtgcagtgacatgatctaggctcactgcaacttctacctcccaggttcaagcgattctcatgcctcagcctcccaagtagctgggattacaggtgcccgccaccatgcctggctatttttcacatttttagtagagacaaggtttcaccatactggccaggctaatctcaaactcctgacctcaaatgatctgcccaccttggcctcccaaagtgctgggattacaggtgtgagccaccgcacctggcctatgacaatatttttcaaagagtttaagaaaagctgttctttatagaaaaattctaaaaatacacagtaactgaaatacagtatcaacatattgcaccctcaatgtaatttaatgatcaattcaggcaaggaacaccaatggatacttgagtttggatatctgtcccctccaaatctcatgttgaaatgtggtcctcaatgctggaagcggggcctgggaaggaagggaagaaggaaaggaaggaagaaggaaaggaagaagggaagggaaggagggaaagatgatgtagagagatagaatgaataatgcccccaccccgcaagatgtctacgttctaatccccggacttgtgaatatgttactttacatggcaaaaaggattttgaagataagattaagttaaaagtcttgaggtggacagattatcctaaattatctaggcaggccaaatgtaatcagaagggtcctaaaaagtggaagagggagccaggagagtcagagggagatgtgagtttggaataatggtctgctttgaagcagtcttcaaataatgctgctttgaagataaaggaagagggccatgagccaaagaatgtgggcagcctttagaagcttgaaaaagcaaggaaacaaattctctctgagatactccaggataaaaaagcttccctgccaccacttcagatgtagcctagtgagatatgtgttagacactgtattttggaaagctccaaaataatctcctttgactccatgtcccacatccagggcacactgataaaaggcgtgggctcccaaagccttcagccactccatccctatggccctgcagggttcagcccctgaggctgctctcatgggctggcattgggtgcctatgggttttccaagtgcatagtgccagctattggtagctctatctggaggggtctggaggatggtggccctcttctcacagctccaccaggcagtactccagtgaagactctaaccccatatttccctcttgcattgccctagtagaggttctcatgaaagctacagccctacagcagacttctgcctggacattcaggcttttccatatctcctctaaaatctaggctggggttcccaagtctcaactgttgccttccttttagttatgaaaatggctgcagctggcttttgcaccctcaaataagtttttcttttctaccacatggctgggctacaaaattttcaacttttatgttctgcttcccctttaaatacaagtttgagttttacatcatttctttgctcatgcatatgggcacaggttgttagaagcagccaggtcacctcttgaacactttactgcttagaaatttcttctgccagataccctaaatcatcagtctcaagttcaaagatccacagatccccagggcaggggtaaaatgccactaggttctttgttaatgcataacaaaagtgacatttgctccagttcccagtaagttcctcatctccatccgagacctcatcagcatggatttcattgtccatatcactatcaacattttggtcacaatttaacaagtctctaagaagttccaaactttccctcattttcctgtcttcttatgagccctccatactcttccagcctctgcctgttacccactttcaaagctgcttccacattttcaggtatctttatagcaatgccctactccttggcactgattttctgtattggtctattctcacatttcaataaagaaatatctgagactgggtaatttataaagaaaagaagtttaactggctcatggttctgcaggctgtataggaagcatagcagcttctgtttcagggagacctcaggaaacttacaatcatggtggaaggtgaaggggaagcaagcacaccttttttttttttttttttttgaggcagagtttcactcttgtcacccaagctggagtgcagcggcatgatctcggctcactgcaacatccgcctgcccatttatggtgataacaacttcttcctctcttacttcctccctctctgtcttcgccctgcccccagctatccgtctatactagttttctatttctgctgtagtaagttatcacaaatgtagtggttcatacaacacaagtttattatcttacagctctttaggttagaagtacaatatggcttggctctgtgtccccgcttaaatctcctgtcaaattgtaatccccaatgttagcggtggggcctgatgggaggtgattggaccatgggggtggagttgtcatgaatggtttattatcatccccttggtgctgttctcatgatagtgagttatcataagatgtggttgttaaaagtgtgtagcaccttccccctttctctcttcctcctgctctagccatgaaagatatgtttgtggccgggtgcggtagctcatgcctgtaatcccagcgctttgagaggctgaggcagtcggatcacctgaggtcaggagtttgagaccagcttggccaacatggcaaaaccccatctctgctaaaaatacaaaaattagccaggtgtggtggtgggtgcctgtaatcccagctacttgggaggctgaggcaagagaactgcttgaagaagctgttatctccataaatgggcagtatcaggctagtatgatactgctgtagtgccatcagtatgtggtctccaccttccaatttacttcatggtttaagatgggtggttgaacattaccacacactgactccagaactcaaaaaaaaggggaagggaatggcaatatagagtattaatcagatctctttacccaggctccctggaagtccaacacaacatttctcttttgcagtgttctgaacacttttgaagctcttttccaagaggctgcaaaagcccatggaatttccagagatataaatgtctttgttatgctaaggagttgacacatgccaactgaagcccctagatagcttcaggatacaggatggtcagcagaaagaataagcatgtaattagcaggttagtatatttagctgcctgacctctggtgagtggatactaaagactgagctcaaacaaatggccaaaggtttaatcaatcattactacttaatgaaaccccagtaaaaactctgtacatctaggcttagcagagcctcctggttggcaaacacattcacatgtcctgattctacaaaaggaagtcacacaggctctgtgttccctctcagacaatcatatgggtctcttcatttgactggtcctcctgattagcatcctttataataaacctgtcattctaagtatagttctttcctgaattctgccagtcattctagcaagttatcaaacctgaggggatcaaaggaactgctgaatgtataaccatttagtcagaagtatgggtaacctagggacaaattaagtgtagctggtatctgaagagtggtcatgttggggatcatgcccttgaacttgtggggtctgagctaactctggatggttagcagtagaacagaaccacagtacactcaatttgtgttgaaatagaatactgtaattcaggtggtattcaaatgtattttcactgtttttcaaacatagcaaaatagtgaaattgataagcaactgatataagaagcactttttagacaaaggtgaaaaatactgtttctctaacagcttttctctacagttgtggttctcgaggtgttcatgaactccttcactgggccctttcagggatctaccaagtcaaatctttttttcataaaaacactaagccattcttttcctttttctctcaattgacatttgcactacaggtacaaaagcaatgacagataaaattgctggctccctagcaccaatgaagacagtggaacaaaactgtaatcattgtattcttcattgtcatgcattcacaatttttttgaatctgtgaattcacaaaaaagacacttttgattaagaaaatccttgatttaaaaaatactctttttagcaaatctttttagcatctttttagcattttgtagtgaaatgagaaatacgcataaactatacctgctacataatgaagtacaatggttgtctcaaggaaaattatctgtgattaaattgcatgttgaactacagcttttttcatgaatcatctttttcatttgaaagaaaaactgagagataaactttgattattcagatttggatactcaacagacattttctcaaaaatgaatcaactgaacctatgacatcatggaaacacagatggtttttgataacaattataaaatttaagctttcagttgaaaagtcaaattttcaaaagcttctatctgccaccatgaacttaacagtttcctagtatttagaaacttttctgatttttccaaatgacaaatacatgacattacccgttcacatatgaataaagatctattccaagtacaagatagagaaatagattttaatgtaacaaaatagaaaaactcactactatggtttcagattctaatactggaattaatctttagaaaattatcactgttgaattttggtgtagtatgaaaggaagaatatcataattaccagaaaacaaatgattagaatattgctccatcttaatcacatatcatatatgtgttaggccagatatttttcatacatttccattgaaataatgtgttacaacactcacaaataaaaaaaaaaattcaaccatcttctattaagctatccactcattatttttatgaaaatagtaattgattcatataaacaaaagctcttgggtcctcaattctttaaagtgaaaaggactgctcaggccaaaaagcctgaaaaccactattctatagtgaatgcaaaccagggaaactaacaggaatattttcttctgtttgatgcatgttcaccagcaacagtaccacaaacttgtttcattttatattatgtccttctaatttgtttacttttttacatatttgaaattttaacacagataaaatttggtatatagtttattttttctaagtaactgtattttaatatgcctgaaaaaataatgaagagacatggttcacaagacatcaaaagagcatccagaaaaatgaaattggtaatgtgtctccattctgtccaagaggatgccctggaccactaaaaaatatacctggtccttgcaatagataaattcaagtggtagacacggatgagcatagcttgatgcagtagtcaataagatcatccaactaatcaccttattctagtaaccattttcacctgacagccttctggtcaaaatttggattcccatgtaaaactgacttcagaagagaatatggtgatgaacatctgattacttgagggttaaatatctatttttaaagtaataaattggaattttgatttgtatatcagtgaacttggttaagtccatcctatgagacagttctatatttattacattggcagatcggtcttcgaataataaatgctgctctgtgatcttgtctgggtagccaactgatcttccttagaaaatacacaaccacaacccttccgcaagcattatgctcatactacatcactgattacctaaattcacaccctgacaaagaagagggctctgccaataacaaagcatattaagttatatatttcagaataacggaataagagtgaaactttactaagaatagtgaataaaataatattttaaatgttaaataagttttgagataaggccttttaatgtttaattttagaataattctaggcattttaacagcataataactcctcaaaaaaagaagtgtatggtttggatgtcactttaagccatgaaatttttatctcagctatttaaataaagtatctcatctgaaatatggtacaatgtatactttacactgcattagctataacaataaataatggatcataaacatttacatataaaaagaacaaaatgaaaggtaagactatgcggaaaaaatactagaacaaccactagaagtttacaaaaaataagaagacagtacaaaaacatcaataaaatagattgaaaaataaagctgatgaactaattgccttgaatgtatcagaaaacttaagggaagacaaaatattagaaatcagtggccaggcatggtggttccgcctgtaatcccagcactttgggaggctgacgcgggtggatcacgaggtcaggagatcgagaccatcctggctaacacagtgaaaccccgtctctactaaaaatacaaaaaattaactgggcgtggtggcgggcacctgtagtcccagctactcaggaggctgaggcaggagaatggcatgaatctgggaggtggagcttgcagtgagccgagatcagagatcgcaccaccgcactccagcctgggtgacacagtgagactccgtctcaaaaaaaaaaaaaaagaaataattgacatatatcagataaactaattgcatgtattatcaaaacaatttcagaagcatgataaaattaagaatctggaagaaaactttcatagtaacttatcttagtaataaaacagaaaatgaatcagagcttcaaaagcaagaaagaagaaccaatacccccatccaaaggaactatctggaatgtaccaaaatgtttcaaaacagaaaaaaaaaaaccatatgattacaaaatgagaaaaaaggaaataatgaacaaaagattcatgtaatgtaacttagtataatttgaccataagattagggaaataaattaatactagtcattagcagtttttgtatcatctggtaaaagagttccaaggacaagaagttcaacaccatgaagtactattagaagatcagaatattatatgcaatactgcctagcttcattttaccaaagtgcaacaataattcaattcaatccaaagtaaatcaatagcatccattgattttctttctattctattcccacctctgactcctaaaacagtgcggcacacacgtcttagctctatcccagtgcccccaccaccatatgccacccttgcaatagctgtgtcttgtccatcactagcctggtgcagtctgtcctaatgaggaaaagcagggaagatgcccgcataggctcaggaccatttaaatggggaatcctgggatcctgggtctgcagagcatgatctaggagggaaaactatgggctctagcacagagatgtagcatggcccatgcagggcataatctttgggcaaaggctccagttaccgggcctagtgcctataattgacatactatcctcaaaattatcatttagcataaaatcatcctgattcgagttaaaatattatgtcactttacaaccaaagtgcaaagactaagttgttatagaatctgtgaaagttaatcaagtaatcaaaacatagtaaaatataaaaatgctcattataaagaacacatcattcaaaatccagtcatatctaatagagactacaaaacttaagcagatgtttacacaaaggcctataaactcaaactgatacaaagaactgggttaaagctaaacaagcagaggtcagcacagagctcctgtgattgaatcacaataaaacaatacactagtcctaagatagcaagaatatgatgcaataagtgaggctctggtcccaaaacagtataatgcccagtacaaatcaatttcacaaaaatctataatagaagtcaatgtaaattaggattaagaaaatcaaaattaacaacaaaaaatatatgaagaacaaaaaagaaacaactgaaaatatgaaaagtttataattaaaaaaagacacacagacatatatacatacatcaaagtctacaatcagaaaaaaacaatagatctcagaaatttagtgtgaaatttaagagtaaatagtaagttttagaaagaaaagaaatctgtcaacacagcccctcattttcgtgcctagggaaaataaggcttaatctacagccttggccaaatatgattgccagataaataaacccttagattctaccataagttaattaaaatgataaaaaaaaattcatatattagtttctaactccaaatttctttaagaaaaccttatgattcacaagcaaccaaccaattccaaactctatgccagtggttcttaacactggctacatattagaatcacctgggaagcattctaaaattgcttattccctgaactcaacccaaagaatctggtgttgtctaggcctaggttggttggtttttaaaaaaatgtcctatatgagtgtaaggtgtatcaagggtcaaagatcactgcatgaatcaaacagtatggatccaaattcccactacatttagcacaagtttggggaataaaaacttaccatttttagagacagagttcataaatagaatgggagaaactaggaaaactaattcaggggccaactctaggcaacaacaatcaaactgttccccttgctaaataaataaatacatatatagtatataaaatatatataaatatacatataatagacatttatataaatatatatgtgtatgtatgtcactatattttatatttcatctaaaattccataaattagaaagtcattgctgtttaaaaactatgtgtaacttctgcttctaggaagatagagtagatgtacattttcctatttctctcgttaagtacaaccaaaaaccatggacattatgaataaacaagcatacgaagatccagactgggcacagtggctcatgcctataatcccagccacttgggaagccgagtggggaggactgcttgaaaccaggaattcaagaccagttcaagaccactgtttctaaacatatatatatatatacacacacacacatatgaattctatatatacatatatatcaattctatatatatatcaacccatatatatagagagattctaatatatatatatatatatgaaagatggagagaaggcagaacagctagggatcttggaacccaaggaacataactgatgacttccctggatcttctttgtcccttatatattccacacttggggccagataagccaacaaccagaaaaagctaacaggtacaaacaaaaaagctccgacaaaaccctgcccaaaagatgaagagaagaacaccatggaaagaagaaaactttaggcaaatttcactctatgtcagccaaacaccacagaaaaaactgtagtcccactctaaccatgtcagaaaggcttagtggacagcctaaagttctatcctcatgagactataacaaggtcccacaatactcctgacatggtgagaaaagaacaagtagggagccaagaatttcacccctctggaaagtaaaaggacagccccccctagcagtgtcagtagacagcaagtagaacctgtacttcctctccaaactggcagcaatgaggtgatcctcccactacccactgaggaggactagaaaaaagttaaattaagactttcactaaccagtggaaattaggtaagcaccaatacaatagagactacacacggagagctagaatcaccactctgactcagcaataatgaggagccactcctgctacttgagtagggcaacagagactgaaaggggaatctggacttcaacaaactctacctggcagtgatgagctcccttcccctcttaaagtaatgtcataaacattcacctaaaacagaaggtttaaataagatccagtctcagaatataatggggaaataggtcctgttttcaaccaaaaattactcatcagaccaagagtcaaaaaaatcacaaactgaccaaaaaaacaaaaaagataaaagtcaacaccaaaaaaagacatgtcagaagtatctgacaaatattttaagagtctttaaaaaaatgcttcaatgaacaatcatgaaaataactgaaacaatgtaaaaatagaaagcctcagctttaccagtaccttgtgataatttatgtacatatagaataatactaaaataaaccaccaaaaagttttgcatagaaatatcctcataaacactatagataaatcaaaagaaaactcttaaaaaaaatcaagtaacccacaggaagtaaaaaaaaagaaaacagaaattaaaaaaatgcaaaactttagccataacatattaataattacattaaatgtaaatcgcctaaatatgccaattaaaaggcaaaaactgaaaaggtagattttaaaatgcaactcaattatatgtagtatataagaaactaacttataatataaaaatacaggcatgttgaaagaaaaatgatggaagaaatataacatgcaaacaataatcaaaccaaagcagaagtggctatattaataacagataaaggagacttcagcaaagaaaattaccagagacagagagggacattacatagtgatgagacataattcaccaagaaaatataacaagcactaatgtatatgtaccaaccaacaagctataaaatatatgaagcaaaaactaaaacttgaaaggagaaatagataaattcaccattatcagtagaaatgtcaatatcctctaacaacaagagataaaacaaatagacagaaaatcagcaaggatacagaagaaatcaacaacaccatcaacaaaatttatagaataccccacctcaacaacagcagagtacttattactttcaagtaatcatggaccatataccaagagagaacatatactgaggcataaaacatacatcaacaaattttaaagaactgaacagagtagagtctccaagcacaatggaatcacattagaaatcaataacagagacataataggaaaatcaagcacttgaaaactaaagaacacgctttcaaataatctatgtgtcaaagaagatgtctcgatcgggggaggagccaagatggccgaataggaacagctccggtctacagctcccagcgagagcgatgcagaagatgggtgatttctgcatttccatctgaggtaccgggttcatctcactagggagtgccagacagtgggcgcaggccagtgggtgtgcgcaccgtgcgcgagccgaagcagggcgaggcattgcctcacctgggaagcgcaaggggtcagggagttccctttccgagtcaaagaaaggggtgatggatgcacctggaaaatcgggtcactctcacccgaatactgcgcttttcagaccggcttaaaaaacggcgcaccacgagactatatcccacacctggcttggagggtcctacacccacagaatctcgctgattgctagcacaaagcagtctgagatcaaactgcaaggcggcagctaggctgggggaggggagcccgccattgcccgggcttgcttaggtaaacaaagcagccaggaagctccaactgggtggagcccaccagagttcaaggaggcctgcctgcctctgtaagctccacgtctaggggcagggcacagacaaacaaaaagacagcagtaacctctgcagacttaaatgtccctgtctgacagctttgaagagagcagtggttctcccagcacgcagctggagatctgagaacgggcagactacctcctcaagtgggtccctgacccctgacccccgagcagcctaactgggaggcaccccctagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacacagagcgcctctcctcctccaaaggaacgcagttcctcaccagcaatggaacaaagctggatggagaatgactttgacgagctgagagaagaaggtttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctaattggtgtacctgaaagtgatggggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgaaagattttgtgaccaccaggcctgccctaaaagagctcctgaaggaagcgctaaacatggaaaggaacaaccagtaccagccgctgcaaaatcatgccaaaatgtaaagaccatcgagactaggaagaaactgcatcaactaacgagcaaaataaccagctaacatcatcatgacaggatcaaattcacacataacaatattaactttaaatgtaaatggactaaatgctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagacgttaaaccaacaaagatcaaaagagacaaagaaggccattacataatggtaaagggatcaattcaacaagaagagctaactatactaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaatttaactcatctccgcaccaagcggacctaatagacatctacagaactctccatcccaaatcaacagaatatacgtttttttcagcaccacaccacacctattccaaaattgaccacatagttggaagtaaagctctcctcagcaaatgtaaaagaacagaaattataacaaactatctctcagaccacagtgcaatcaaactagaattcaagattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaacaaagaaaaaaagagaggaaaatcaaatcgacacaataaaaaatgataaaggggatatcaccaccgatcccacagaaatacaaactaccatcagagaatactacaaacacctctatgcaaataaactagaaaatctagaagaaatggatacattccttgacacatacactctcccaagactaaaccaggaagaagttgaatctctgaatagaccaataacaggagctgaaattgtggcaataatcaatagtttaccaacgaaaaagagtccaggaccagatggattcacagccgaattctaccagaggtacaaggaggaactagtaccattccttctgaaactattccaatcaatagaaaaagagggaatcctccctaactcattttaggaggccagcatcattctgataccaaagccgggcagagacacaaccaaaaagaagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacagaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagatagggatgccctctctcactgctgctattcaacatagtgttggaagttctggccagggcaatcaggcaggagaaggaaataaagggtattcaattaggaaaagaggaagtcaaactgtccctgtttgcagacgacatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaatagaagaggatacaaacaaatggaagaacattccatgctcatgggtaggaagaatcaatatcgtgaaaaaggccatactgcccaaggtaatttacagattcaatgccatccccatcaagctaccaatgactttcttcacagaattggaaaaaactactttaaagttcatacggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaagtaacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggagtaaagatttaaacgttagtcctaaaaccataaaaaccctagaagaaaacctaggcattaccattcaggacataggcgtggggaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacaggtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtgaggggaggggggaggggtagcattgggagatatacctaatgctagatgacgagttagtgggtgcagcacaccagcatggcacatgtatacatatgtaactaacctgcacaatgtgcacatgtaccctaaaacttaaagtataataaaaaaaataaataaataaataaataaataaataaaaaggtcaacatcaaaaaaaaaaagaagatgtctcaagggaaattaaaaaaaatacactaaaccgaataaaaatgaaaatacaacaaatcctgttaaaatttgtaggacacatgctgctacttgaagagcctagacaaagaagaacaaaaataaatgcaagacaagaagaaagaaaataataaagagtagaaatcaatacaatttaaaatatgaaaaaagttaaaaatatcaatgtaacaaacagctattttaaaaaacacacacacaagaaattgacaaacctcttccaaaatgacaaaaaagacaaaaagagtagtaaagtttctaaatatatttttgttttttaagcaactgtaaatggtattgcatttttaacttcaatgtccatgaattcattgttaatgtacacagaaaaacaactgattttttttttttttttttttttgagacggagtctcgctctgtcgcccaggctggagtgcagtggcgggatctcggctcactgcaagctccgcttcccgggttcacgccattctcctgcctcagcctcccaagtagctgggactacaggcgcccgccactacgcccagctaattttttgtatttttagtagagaccgttagtatttttgtattcaccgttttagccgggatggtctcgatctcctgacctcgtgatccgcccgcctcggcctcccaaagtgctgggattacaggcatgagccaccgcgcccggccaacaactgatttttatatcttgcatcttgaaaccttgttgcgcttactcattaattctatgagtttattcattggtattttctatgtagaaaatcatatcatctacaaaaggagatggtttcatttctacctttccaatctgtatgccttttcctttcacttcttgcctttttgagctggcaagaactcccagtactgtgctgaatgagtagtgagagtgaacatcgttcctgttcccaacattaggggaaaacattcagtcttttaccattaattatgatgttagctgaaaggtttttataggtattcttcatcaaattgaagaagttatctttattcctattattctgagatcattcaataccgtaaatgggtgctgaattgcatcaaatttttttttctacattatgtgacttttcttctttagtctgttaatatggtgcattacattgattcagctgaatggtactctccccacccaacaacccagctgtctgtatgttcttaaggtggaagctcagagtgttgttttttttaacactatgaccctgaataaagcaacatatctatatagctagtcccagaatcactggtaattgcttacataagaagctccgtatggccagatgatacagattgtggacacatgagaaaaaccttcttgttgcaagtaaaatatatctgtggctgagaaaaaaagaccgtcaaatgaaaaattctacatacaaaaaaaaaaatcagacattgggcacggtggctaacgcctgtaatcccagtactttgggaggctgaggcaggcagatcacttgaggtcaggagttcaagaccagcttggccaacatggtaaaaccctgtctctactaaaaaaaaaaaaaaaaaaaaaaaattagctgagtgtggtggtgcatgcctgtgttcccagctattcgtgaggcaggagaatctcttgaacccaggaggcagatgttgcagtgagctgagattgcgccactgcactccagcctgggtgacagtatgagactccatctccaaaaaaaaaaaaattggatttttttggtttactttccctgattctattaatcactgaatacaataaaccaaatactaaataggattagttatgactcataaataaacataaggatgtatattacattgccattcattcattgtatgtaaatttcctacagctagactataatatacagcttcccaaagcaatctaaaagtaacaaactttaatgatatagcacaactgaagtttggtatagtaagtgcaaataagtattgcaatgacaattcatcatggtaaactcaagggtctgtaaaaaatcaaattatcgaggaccgagttcaagaagaactatattaatacatagatttctgtaacttggcagagaattccctacaattgctacatttaaagtaatcaacacatttctatatctcagaagaagacggaaattatgtgttcgcctatcctaatgtattaaacttttattacaatagttttagtatatttttagcttaacattaaggtagaaacattctatcaaactaagaaatagaaattgctctgaaattgcaaaaacctgtactatttcccattttaaaatcagaaggattacttctacagcatttaattgttacatcttacaataataaattacatgggactaatatgcataatagaacacaacggtagtagtaataatgattgagcagtagtatatttacataccgataaaagaaaacccatgtagaagaaactgaagaaaataaacgctagagtgaacaaatgatgagtaatgctccaaaatacaagaaaaagaaagaatgggatacagaatagaggttgagagattggacttgagcagagaaggaaccctcttcctccacatggaacatattgtgagggagggaagaataagatgagaaggaggagaaaaagaaacgaagaaaaaataaagggaaggaagaaaggaagaaagagagggggaaaaaagacataaaggaaggaaggaaaagtatagatattgactgttacggactgaattgtgtcctgtccccccaccaccaccactaccaaattttatgtcaaagccctaatgctccatgttactgtatttgcagattgggcctttaaagaggtattaaggttaaatgaggtcataaaggtggggctctaatccaatatgacttgtgtccttataagaagaagaagagacattaggaatgtgtacattcaaaaccaaaggccagggctgggcacagtagcttatgcctgtaatcccagcactttgggaggccaaggcaggcagatcactggagcccaggagtttgagaacagcctgggcaacgtagcgacagcccgtctctacaaaatatacaacaattagccaggcatggtggtgtgcacctgtagtcccagctactcaggaggctgaggtggaaggatcatttgagctcaggaggtcgcggctgcagtgagctgtgatcacaccatgacattccagactgggagacagagcaagaccctgcctcaaacaaaaacaaaaacccaaaggccatgtgagaacacacagagaaggcagccatctgcaagccagagggagacctcagaagaaaccagacctgccaacaccttgatcttggaagtccagactccagaactgtaagaaaataaactgttgttgtttaaatcacccagtctttagcattttgttatagcagcaggaacagactaatacattaagttagacggagggacagaaacagtgaactgctaatagtctccagtttttctttggaccagaaagcaagtctgacaaaaccaaggagagatggggtaaagaaattttgcaacagacccagaagagaatgaggtggtaggcgtaggggaacatgtgaaaggattgccaactgtccatttcagattagaaatcaatcttttgggggcatcagtcttcacagttacataattgcagttaagcagcctggttacgaggaacacagcaaaatgggaaaggtaaaaacctttgaggttttttaagtctgagtgataacctagctctatcagtgtagctgtgtcttgggttgttatctagagttataataatgatagttacatagagtgtgccaataataatatctactccttttagagttgttttagagttatgtaaaactttatcatagagttggtcagatagtagacaataaataatagctactatacttattactatgggattagtgtagtattggtacattgttaggaagatacagcaaaaaagagaaggaaaaaaaggaattaaaagaaagtggttcagccgggtgcggtagttcatgactgtaatcccagcactttgggagaccaaggcgggtgggatcacttgaggtcaggagttcgagactagcctgggcaacatggtgaaaccccatctctactaaaaatacaaaaaatgagccgggtatggtggcagatacctgtaatcccagctactcgggaagctgaggcaggagaatcacttgaacctgggaggtggaggttgcagtgagttgagatcgtgccactgcactcaagcctgggcaaaaagagtggaactctgtctcaaaaaagaaaaaaaaaagaaagtggttcaagtgacagagtagagtcttggctagatagaggagtaaagtgaatgcctgaggatactgacaagctggaaaacaggaggaaaaataagttaaatggcctgaggatgaagtccagttgaattttaaacccaagaaaatgagaaagatcgaaagattggtaattaaaataaaatcctccagagaagactgctgagtgtgaatcagcagctacttcttatatgtaacaccacagagaaacataacaaaaaaagaaagccagctaaatggtcgtggccttgtcattagctagcagtgtatcttgaaagaaggcgcttaaactgtgagccttactgctatttgaggattactgacaaattacctctggtttctcctttattccacttccactgtaccctctctccgacaacacacacatacacacatacacactcatcattatagtaaagatcaagaaaggcagtaaacaagagcaaagatctggaaagaaggcacattttcaaaactgacatttgtcttgtgcatcctcccacttcccttttccctctcccagtcccacctctacaagcccaaaaaccccagctctcactgctggctctgctcccagaaaaagcccaaagtgccatgtttctctttgacctttcttccctccctcccacctattaaaacttccactgagtctatctcagtttaacaagggaaaaggcaaactgattatgccttttcataatgatgccaggatgaacagtaactcatctgtgcttaaacctcccaagtgtgtttggcttaaaaattgaaacgaatctatttggcaaaatttcaggcagaatggaaaggggataatttggggcaaggagattttctttcttccctgttttaaagttgtgaggaagaaaaagaagtgtttgtcgtaactgacaacagacaaccaccacagaaaaaacatccacagcagctcagaatgctagactgctacacttaagggtactttttaggtgtacaggcctgcataggatgctgaagtggggggcttatgatagcaaacatgaggaagcaatctaccctactataaccctgaaaaaagtggttcagaaccatctaccacgtcatggtaatgactctcttttctcttccctttattacagaggctgcccctcaccctgccccccagatgctcccctgataaaaggaggtggggaaaaaggaggcagccataaaggcagcagcaggagtgaactctccatcttagttatttcctgttagaagtggggaaagaatctgcagcatagaagccttaacagaagcctgagtataaagcaagaaaatagctgtagatagaatcacatgaaaaagtgactatacaggaaaaggtgccattcaatgagaaaagggggaaaagtatcactgaagaaaagaaacactctcttcccaaaaaaggtagaaatacaatcaaatgtttcagagcagggatcagaaaacttcggcccacatgccaaatctaaccagtctcctgttttggtaaataaagttttatgggaacacagccacactcattcatttatgtgctgtctatatggctactttcacattataatggaagagctgaatgactgcagcagagaccatataacttgtaaagactaaaatatttactatctggccctttacagaaaaaaggccctgctttaggaggtcaggggtaagaaggggactgagatgaggccatcggatttgataataagtgatctctggcaaatatgaagaaataatttaaaagaagtttaaaagaaactaaatgtattctaataaagtagagacaatgaggataaggtattctttcaaacagcctctaggaacaaaggaagactacatgcaagtctgcatggggaaataagaaattttcttgatctcaccaatcttcctcctcttggagtcactctctttaatcaccaaccaaacagcttcccaaactagaaactgcagaattttggtaagtgattctagctccacactgctttctgtatcctcagttccaggtgcaatgcttagtatacaaaagataatgtttgttgagtaaaacaatttaagagtacagaatgtagagagaaaagattgagaagagagaaaaaaattctgtccccacttcatacctggaaaaacattccatgccacctctaatggctatgtggcttggactcaagtcttaagagtcatcataggccaggcgcagtggctcatgcttgtaatctcaacactttgggaggccaagcccagcagatcacttgaactcaggggttcaagaccagcctggccaacatggtaaaaccccgtctctactaaaaatataaaaattagccgggcacagcagtacatgcctataatcccagcactttgggagactgagacaggtgtatcacttgaggtcaggagttcaagatcagcctggccaacatggtgaaaccctgtctctactaaaaacataaaaattagccaagcgtggtggcatgtgcctgtaatcccagctacttgggaggctgagacaggaaaatcgcttgaacccaggaggcagaggttgcagtgagccgagatcgtgccactgcactaaaaaaagaaaaaagaaaaaaaaaaaaaaaaaggtctggttatttaaaagagcctgagactcctcccctttcttttgctcctgctatcaccatgtgacatactcatgcccccactgcctcaggaagtaaaagcttcctgaagcctcaccagaagccaagcagatgctggcatcatgcttgtatgacctgtagaactgtaggccaattaaacctcttttatttataaattacccagcttcaggtatttatttatagcaatgcaaaaacaagctaacacacacacagcaaagcctaagatttacatctatgtttactaccaaaaattttatagatttagctgttaaatttaggtctttggtgcattttgaattaacatttttacagggtatgaggttggagtctaatttcatttttgtacatgtgggtatctaattgtgccagcacactatgttgttttaacatcaaatgagaaaatatataagataatttgatactacaaatatttgtggttgttaaaattcaggtactaagcaaacagctcagtagaatactacaacaaacatgtaacctaattctcctgtctctagtttctcctttaatatctgttttatatctgtgtaaaacacagtccagtaatgcaacaactctacataaaactaaagatacctactgctgacagaattagaatttctggaaattctgagacagaacttgcccctgatttttccagtttatacaagctatccacaatccttcgctcatggcctccttcctctcttttcaattttccaggctcatctcttaccattgttcccaaccacttggtctggctacacaatgttactagacacatctgatgtgaagtactcttgaaagactctgtagattactcatgctagacttttggctttccttaacctgggggttccctgaagcagaaagaattttatttatccctatattcaagagtccaggagagtgcccaacacaaagcaggtgtttcataaacacttgctaagttaaaggaatacacaggcaggcatggtggctcacacctgtaatcccagcactttggaaggcagaggtgggaggatcacttgaggccaagagttagaaactagcctgggcaaaatagcgcaaccctatctctacaaaagtaaaattttaaaaatcagccagtcctagtggtatgtgcctatgttcccagctactcaggaggctgaggcagaagaacagcttgaggccaggagttcaagacagcagtgagctatgatcacaccactgcactctatcccaggcaatagaggaatatcctgtctccactcccctccacactccaaaaaaaaaaaaaaaaaaaaaaaggaatgtgcctataaatggaagacagtgacgaaggtaaaggaataaagtagacgaaggcaacaggtttggaaaacattaaatcatcttgtttggcaggaaaaattgtctatatagggggatgttgagagaagcctggaaacctggatgggacagcaagagtaaaggccaagtgaggaatttgtacagtgatagttttttagggtaacttgatggatttttagacacagattataccaattctcttttcccccaataagagatttgtgactttggctaaattatttgactcagaaaagactcaagtacttcatacacaaaattagactaatctctttagtatgataggctcagctggtaggcccatcaccctagacacagaagaaaaaaataatcatgctataataaggaagcttgacagtcatttacgagagtttaccaacttttgagcagtgaaatctactttccaaataaactcatacatggaaccctagtacagaaaccttttttaaacccacaataattgaaaggggcatgaaaaaaactggagaccccacacacccaccttccttcctctcacaaacattggttcatataatcaagtggacttcaaatcaaatatggggaaccctaaacactactttagaacatggtcaaaagtttactaatctagagggatccaggtaaagtcatacaaccaagattcccctttgtggctactgattcgaaaataaatgctagggaggaaacaaagataaaaactaaagatggaaaggaaggtcctactgtaattttcctgaccagaccaatggagggcataaactaggatggtagtattaaaaagacagaagccaagcaaatataacatacagaaactgttttcactttgttttccgtattcttgatgggaaccatgctgacccaggagagactgcccctcccaaggctagctacttcttagacagcaaactacccctccttgagtgcttttcgcatgcaaaccactcaatctaaaactacctcccatccatccccagtattcagctctcacagaactcttatattctgggactattagaatagtcccctgttctaataatcacgccagggccaggtatcaaacaacttgggggctgctcttatatgtgactatgccgacattattaaaaccagccaattctaagcctccttaccctgcctcgcctgttccttctcactaaaatcatgataaaggctctcccccatgatttccctagctatttctgcctcctaaacaaccctggtgcttccctatgagcactatgtggcgtggcatatatgccaccctgtctgatgtgccatgccctctccacttagaaactgtatcaatcttttcaatggcagttgtctcctgacgtgttagtttcaccatatttgaataataatataaaccacattttaaaaatagttcaggaccaagcaccaaacaaacagcacgtacttagagaataaaatgtgaagtattaagaatcagtattaaggctgggcatggtgggtcatgcctgtaatcccagcactttgggaggctaaggcgagaggactgcttgagcccacgtgttcgagaccagcctgggcaacacaatgagaccccatctccacaaaaaaattttaaaaattagcaggggtggtggcacacgcctgaagttgcagctacttgggaggccaaggtgggagaatcacttgagcctgggaggtcagggctactgtgaaccctaatggcaccagtgtactccagcctgggtgacagagaggaacagaagaagaaggagaaggagaaggagaaggagaaggaggagaaggaggagaaggagaagaaggaggagaaggaggagaaggaggagaaggaggagaagaaggagaagaaggataaggagaaggagaagaacaagaagaagaagaggaagaggaagaggaagaagaggaagaggaagaagaagaagaagaaagaaagaaacagtataaagatgagattttctagttatgagagatgccaaagcagaatgttttaagagataaacctgacatatagtaaacatttctttttttttattaaaacacattaactataaatatgtttaacatcatttcttatcttcatcattcaagatatctgagccaaaaacctaggccaaaaatcctgactctcatttacattccacatttagataatcagaaaatacaaatatccagaatctggccacatctcaacaactttacctttactaccctggttcaggccgccattatctcttacctggactactgaagaagtaacctcctcactattcacctggcttccattcttgtcctgctacaatcccttctcaatgaagaacgagccgtttaaatcacacatcagaccataccattcctctgctcaaaaccctgcaatggtttcctgtttcactcagggtaaaagctaaaggtcctgccgtggtttatgaaggctctaagtgatctggttccctgccatccctctgatctcatctcctacttctttcaccatcttatccagctccagccacttaaacctccttactgtttctaaaacatcaaacacagtcacacatcagtttactctgactagaacgttctttccccagaaatctgcattgctcatttacttagctccttcacatctctactataagtcaccttattagacaggcctttcttgaccatcctacatataatatcacaaacatatctgtcattctgtatccctcttatcctgctttttcttcatagctgttatcagtacctgatatgctatagttttcgtttttttgtgtgtttttttcccgagacagtgtctcactctgtctcccaggctagagggcagtggcacgacctcggctcactgcaacctccgcctcctgggttcaagcaattctcctgcctcagcctccaaagtagctgggactacaggcatacgccactatgcccacctactttttgtatttttaatagaaaatgcgtttcactatgttggtcaggctggtcttgaactcctgactttgggtgatccacccgcctcagcctcccaaagtgctgggattacaggcgtgggccactgtgcccagctttttgtgtgtaatttactgtctttccccactacaaataggtacctaagagattggaactttgtttcattcactgttatgtatgagtgcctaaaacagtgtctgagcaggcactcaataaatatgaaataaattaatataccaaagcctttctgagggatttacacttgtactgctcaaaaatccataaacctcgcaaagagacaaaactggatcactagtggtaatatataaaaatgtaaaaataaaaatgtagtcttctaagaaagatagaaggcttgacagtaaatgattaactaccaaaagaataaagtataaatgagagattggcgaccatgtgaactcacctcaagagaataatagatacctacaaatgaacatgtgaaaaactttataataaaactatataattaagcacagagaataagactatcttgccaagatttgctaacttggcaaacatccatattaaactcagcttccccaattccagatacaaatgaaattgtgaatttggcaattcactggagagaaagactgcattacaatctaggttcacattaaagttacctcattcttctcaacttagatctgacgcagaggaaaatttttaacagattctattggacatatgccatactatagtcagtaaagttcaacattaacattttagatgttaacctaaatgatttgttttcctaaaactaaactgcactaaaaaaatatgcattatgagtataaaatgaattattttaaataatattttgtcaaagaaaaagcaatttataacaccagtccttccctcgtattttgatttcattcatgtagtgcctcacccacagctgaacacatggtagcactcaagctgttcactgataagagagagaatattctttccttcaaggtttattaaatatagatatgtccacctcaaccttcccagttattaaaaaatgcaaatgaaaattatgtaccccaaatttgtatataaatgtattaatcatttatttaataattagtatgtcataaagcgtagtattagatactgaagacacaaaataaaaattacacatgctgctatcaataacttcataatgtggtagagaagtcatataaactataacagaagatgataacttgtatggtcttggggcacacaagatgcaaaggaagcccagaagaaaagttcccaagatagaatgtgtagaaaaaagatgggagaaaatgcaggcataaagtaacacttagaagaaggcagaggtaaacctaacactacctacaaatgatagtatggctaaaggaaaggaaatatcacatgaataaagatgtatgcagagcccaaggtcttacatgacacccttaaaaatttggctattaatggggaggatcttaagtaagacagtaatatgagttgtgtttcatttaagatgatcaatctagcagcatcatgaagtttactttagagaggagattgagactgcagattattaaatcagttggtactgatccagaagaaggtagaacgatggcggtggcgttggctttgccagctcaggactgagtgcaagtaacagagaatcagccagattctccagaggctcttcaggttctcctctgtctttcagtcagcagtctcagtccatttgcggaggaacattggtgttacagcagtggcgtttaataaggaacttgatcctgtacagaaactctttatgtacaaggttagagaatacaaatctaagtgacagacatctggaggatctgttgatactgatccagagtaccagcaagagccagagaagaagctttttaagctcaagcaagtgtatggtaaagcagacatgaatacattccctaacttcaaatttgaagatcccaaacttgaagtcatcaaaaaaccccaggcctgaagaaataaagtaaaattaacctggtaagttgtcaagggttagctgtacaactagctagaagtttcagaataaacatacattcacaactgtcaaatgttcttttaatctcgattccaaataaattagttggtgatgtggagtattaaaaaaatctggaaggaaaaataaagatgtggacgaaaagaaggggatattacttgagagatattaagaaagttacagagatgggaactggtgaataatgaaaacttgaatcagcacagtggcagtggagctggacaggaaggagggaaggaaacatcaacaggacctggtgactgattaaaggcagaagattgggccaggcacagtggcctgtaatgccagcactttgggaggccaaggcaggcggatcacttgagtccaggagtttgagaacagcctgggcaacatggtgaaaccctgtctctaaaagaaaaaatatatatatatacaaaaattaaccaggggtggtggtgcatgcctgtagtcccagctactcgggaggctgaggtgggaggatcacttgaacccaggaagcggaggttccagtgagcggagatcgtgccactgcactctagtctgggtgacagagtgagaccctgtctcaaaataaaataaaaaataaaggcggaagattggacagagggaggatactcttggttaatggcaccaccatctaaccagttgtttcaaatacatagttggttcaaatataaagggagaaacaagcctgatgaaaaaacagtgaaaacaacttggagatattggatttgaattatctcaaaatagtaaagaaaattatataagcagattactagaaatatgtctagaattcaagacagagataaaagctggaggaaagccagggaatggagacagcagtgttctctactgctgtcttaaccctttctttcagagccacatataaaagcagttcactggcacctctgcttcctgggtccaagtgattctcccacctcagcctcccaagtagctgggactacaggcatgcgtttttatactattttgagagaattcaaatgcaatatccccaggttattttcactgttttttcattctcccaaaggaaaactgtttgtctcctaaatcaaggagcacgtgagcctgtaaagttccatagcagagaggaaataagtgatgggtaggagaaaaaaaaacaagaagaaagaggcatacccttctataatactacagccagaaaagggtaaaatgaggccccaaagttcaggcatatgtatatggccatttaactaggactttttaagcaataagcatgctgtgcttaggctgtctcagcactattgttaaatgctttaattatgtaacttttgatacattcatgttatcatatgttgtaattattgttgttactattacattttctctatatagcacttattatgtatggggcaatgtactaagtagctttacaaaaattatttcttttaatcctcaccaaaaccctatgaggaagtatttctccattttatatatgagaaaactgagggatagaaaggttaaataacttgccctcaaatactcagcaaataaaggacagagttgaaaatggaacccaggcagtctagctccaaagtccatgatcttaatcatcaagttatactacctcttttcaggtggataaagaatacttttggttactaacttaatctgaagacaactattttctagtaggaaatatttctaattttacaatacatgtaggagaaaattgagtttactgatcagaaacttgctagactacattattaagtaaaaaaacacacagaattaaaatattatttaaaacatctgtacatttttaatctgtataaacatgtatatataacaatagttctcatctatataaatatgtacatataataattgttcttaaattttactatgcatcagaatttcttggtgggcttgttaaatgcagattgctgaacccctacttcaaaccccaatctttcccctattacttacgaaataaagtacaacttcttttcagcatggcttacctttggccatgaggcatcgtctaaccatctttcaataagtttttagtacattacctatttttttatgctttccctaatacaacccttcctaataaagccatacattccttctatgattccaaagcacctctaaaatagtaaaaaacagaacaatgataataatatcaattaactctgtggggcattcccaaggaaacatgaattacctcattcaatcctcataacaactcctcaggataaagattataattattctcactgtacatatgggaaaaaagtgagacatggagaggttaaattgggcatggtaatacaatcagcaagtagaaaagctaggattctaccactgcaattatactatataagcaattactagattgttcagtacttggatactatttagatactagatttttctaagtactaatgtaaataatttccttattcatttttacacttatttaactgacatttactgactgcctatcatatgccaggcattgtgttaggcacgaaagactatcatgttaaaatacaagggaagacccagtacctgctctcttgagacatggaatccagtggaaaaaccaaacattaaattaaaaatcagagaaatatttcaagaaatatgtgttaaagacaaaaagtacaaggcactccaagattataataggaagatctaagctgtttatagttattgtactggcagtgtcctattacaagagtataagttacacagaatttgcatttcaggatgccaaataattccatttcaaaatgacgctttcaaaatcaaattaattaattataagaccaaagtcatatagttaaaatttaaaacatattatttaaaatgaaatttaaatatgtcagctctttatttttccccttagcaaatggagctattacgcatctgacacagaatgtaataaatataaactatccaaaactaataaaatagcatttgaaaatgtccttgcaatattggtcatgataaaggtaaaataatatgccaagttcctgacaatcctagtagtgcataaagtacttccattttggacaatgctaactttcttatgattgaattagatccatgacttaatatacatcatttgtaagattttttttttttttttttacaaaaagcagacttctttcataataaatttcaaaatgaaaaccaatgtttttttacagaggaaaaatgcctaaaagtccaaatactgatcttacaaagagacatgaaaggtaaaatcaagtatgaaccaggcctggattcccacatcttcagtttctatttatcaaacagaaaaatctttccaactttctcctttcctgtataagaccaaaactatgcaatattctgtttgtattacaattacactaattcaatgcaggtcacttgctttttactgagtccagatgacattcagtaaactaaacatgggccaattagtttaaaaaaaagaggaagaaaagaaaaaaggaagaaacgagtgagttctgattgcctttgggtaggtcatacagtggctacagagcatcacagcctgaacttcattttggctaacaccaaccatacggctaacattaaggactagcattttttattcctttcagatttctcacatttggaaattccaatttaaataattttctggtgaaagtgaggacagcactcctgcataatatcagttttcccctaattcaactccaatgtcttattttggagctactaaaatggaatctgcacaatgtctaaaaaagtataataatcctttttaaccaatttttttatgtattacagttttaaatgagcaaatgaaactgataatttagctgacacaaacccacacaaaaaaagatggtctaaagctatgaagtttcaacatcaatgtttgtaatctcaaatcaacctgaaccaccatacaattaggtatatgacaaactaagtaatagaaatattcataactaaaagcaatattatttttaaatatcttattaggtgttggcacccaacattttcttataatctatcatgtaaagaaatctgttttactattccttttaaactctctactcatgctactttaggtgtgtttctagaaataaatactaaactctctgctaattttttttggctaagaaattttttgaaagttataatgtaactaagttaaaatgtacatataatcataatttgatatcaagactgctttcatacaaaaaacctacattaattaattccttaagtaaatttacactttatcaattgttggtattttaaaaagtactcaaaagaaactcttcattcaccattattacaaaaatggaagtctccaaatatgtaaactagcttgatttttaaatttgttacttatttagcctaatttttttaaacttgcctaaatttaactgaagaatattatgttcctgcaagtgttcatgaatacaaagatacagtaatgaagatggaaattatttactctaacaattctgactgcatgactgttaaatcacttacatacggccaaatgatctacaaggaagcagggaggtcctgaaattgtgtactcatatccattttcaactactgcacaggtgacacaaccaatcaaggcattactgaaacagaatgggaatagaaaggacttagtgaataaaagtgacttctttagacaaaaatgtagaggttagcttgtgaccaaggtggaagaaacagcagcaccattcctcccattgcttgttcatattaagagaaaactgagaccactaagaggcaaaggacagaggacagcaacaccagcaaagagacaggcagcagtggggtcagagcatgagaacagtattaagagttaaacatagagcacagagggggtggtttaaaatgtcagttttactcaattatttataggacagttcttggaaataatgttacaatgaaatgttggttatataaaaatcttatttaatgtagtaattactatttagacaagggcaaatatagtaaatattaagtaaaaattaacaataattaaaatgggcttatggtctgaaatagacatattatgggaaaggattactgttctaacaactacgcataaagctgtgaaaaggcaatagttatactagtctgtagaaacagtactctaaaagttacaataaggagatacacttttttttttttttttttgagcaaggtcttattctgtcacccacactggaacacagtggcatgatcacagctcactgcagtctcaacctcctgggctcaaccgatcctctcacctcaggttcctgagtagctgggactacaggcgcatgccaccacacccagctaattgtttttgtatgttttgtagagacagggttttgtcatgttgcccaggctggtatgaaattcctgggctcaagcaatccacccacctcagcctcccaaagtgctgggattataggcatgaggcaccatgcctggtccaatatggatattaatcctcctgaaatagatgggattttaaaatgcaatactcagtttcaatgttgaaatgtgctcttctttcactgaaaatgacatgacactgtgaaagctttcttctaacacaggaatttttagaccttcacacaagttttcataatgtttaatactttcaataagcttcatgactattaatgctttggggaaaacttactttttgtttctttatttgcttttcaaaaccaaaggcatatagtaataattcattatgcttttacaatcaggtttcatctgatgtcaatgttacctttcatatctttttaagtgtttttccatgttaacgtgaaggtgtgtttcttaacttcacatagcaagaaacaaagacacgcctttgttcaatttaaatattttggttcctggccaggcgcggtggctcacgcctgtaatcccagcactttggaaggcttaggcagatggatcacctgaggtcaggagttcaagactagcctggccaacatggtgaaaccccatctttactaaaaatacaaaaattagttgggagtggtggtgtatgcctgcaatcccagctgcttgagaggctgttatttgttatatgttattccatattccctattctattctattctattctactcattcagagacaggatctcaccccatcacccaggctggagtgcagtggcgcgatcacggctcactgcagtcttgacctcctggactcaagtgattctcccacctcagtctcccaagtagctgggactacaggcacaagccactatgccaggctaatttttgtactgtagacacggggtttcaccatgttgtccaggctggtctagaactcctgagctcaagtgatctgcctgccttggcctcccaaagtgctgggaatacaggcttgagcaactgtgcctgacctccatattcattttattcaaaagaattttatacacaaaattgtggcaaaacttcaaggaagaatatattcttttgtagttctgtaatctagtggaaaaatgtgatataaaaaaacataaaagttaatgatatactagtgaagggttcctaatattcaattaactttgattttattctcaatctattttatactaccattcttcttatgaaaatatcttcaacactttcattgtaccaataaacaacaatacaataattaacaatttgcatttattattaaagtattaaatttaaaactccaaagcacctacttgaaaggaacattccaatataatttaattattcttggtcatttgctcatgtttccttaaatataaatacagtatacctaacaaataataagcataattataaatattatcacattttacaattttttattctaataaagaaaacatatgctcaaataatggaatttaactataaaatctaatttttagctcattgaaaaaacataaaaaaggatgatcaaactatttaccagtcttaaatatttaagagtataatatgtttatactactatatttatatgttataaatacagactatatattaacacatttataactatagtaatatgtatttatatagtataaaaatatactactatatataatactggctttttaaatacatttcctaatttcctttatttactactttaactttgtagtttataatttacaaatttcccagcactatatcttccccacaagaagatttccctttctagtggctactaacatacaatgtttaaggattaattaatgatagattggttaatgaatctgcaaaatatttagctcttttatttccatttttctctcctgctaattgacttttgaccatgttagtgtttattaagctcaagatccaaattagctaaattcttgccctcccaaacaggaggcagtctaaagcaaaggtgttggttgactgcaagttctggtggaatttacctattaatcagttctacaccattttgtcaaatctgaaccaatatagtgccaaaagaacattcttaaatattaagacttttatctttggcatacaggattcattcatccaacaaatacatactgagtaactactatgggccaagcactgttctagtgcttaacatatattagtgaacaaaagaaataagaaattcctgccctcatgttgccaatttaccaaccctgtgctgtgctccacactaaaaatacaaaattgaagatactaccccttacttaaagaagatttaatctaatcaaaggcaagaaaaatgtcctcaatgcaacttatcatataatgctaaaatatgcatatgtaaatggtagcagaagcatatataaagtgccatgaagagtagaggggaagaagcctctgtgcagatgttactgagtacaacatcacaaggagtataattctctctgcctataacaatcaaacacaggcattccaacctgagaacagatatgcccaatacagctttatatctaactctatgttgtctttcttagaggtaaatcaaggtgctgctttacagaccttcataattaatgtccccttagcatcttcaagagttaatggaaaaggagggaaaattctaatcactacatgttgacactttttagtagccaagaaaagttctcaaagaatgacaatttaaaaaattaacttgtatacactttctaggttaaccgtgggcctcaataatccctaccattccaatacacaaatgtcacaagttctcattcatatgtgagagctcaaaccagtggatctcatgacatatggagtacacttgccatcaccagaggccaggaaggggagcggggagggaggagtgaaatggagggaaaagggaaataaatgtatttattggcactgagctgtacacttaacaatggtaaagatggttaatttttaaaatattttcaataataatattaataattatccttaccatccttatctcttattcacatgaagacattagttaccatttattaagtgcctccagcaggagaggcactgtgtacaccctttatataacattatttctaaggcttaaacctttagaagattagtatttttattacccagtttttcacatgtgaagactgagagtgggagagattgtataatttgcccaaggttgtacaccatttggcctggaatgtaaaagaaatccatacgaacacaaagtcaaggatcttttcactctacctgatagctgcccactcccataaagaatctaatattgagggatattaattcctcttctatgattatttttaaccatcctatatgtagataaatatgtaaactgatctaaaacagtttacatccttgttgaaaacaggatcacatatgattacctagcctgctaacccagacaggcagatggatggacaggcagatggaagaatgaacaaaatctcaagtataatgacatccaaactgtttaaatctactgcacagtgttcttataaatcttcaatggcaagtccatttgactgacactatttctaaaagaacaattaggctaggcacagtggcccatgtctgtaatctcagcattttgggagggcaaggcagaaagatcacttgagcccaggagtttgggaccagcttgagcaacatagtgagaccctcacctctacaaaaatatttaaaaattagctgggtgtggtggcacacacacctgtcgtctcagctactccagaggctgaggtggaaggatcacttgagcctgggagatcaaggctgcagtgagacatgattgctctccactgccctccagcctgggcgacagagagctcaaaaaataaaatacaataaatgaaagcacaattaaacaaaaaataaacttaccttgagatctttgtaacacctttattatccctattattacctcatcttctattaatgtccttctggctcactccagccacactggcctctggttaagaatcaaagagccaagcatgttcccatctcacacagactttgtactgtctgttccctccaatcaaggcagtcttaccccagatggctcactcccttgtgtgcttcagtctttagcttagatatctccttcttaacaaggcatccttgactaccatttaaaagtacaatcagaccttcatactccctaatcaccatccaatgatatattttatgtatgtgttatatttattatgtctaacccaaccagaatataaacacaatgaaggcaggaatttttgttttactcaaggctatatatcctgcccatagaaaagtggctgatgcacaacaaatatttgttgaatgaataaatgaactttgtgaccaggcacagtggctcatgtgtataatctcagcactctgggaggccaaaggaaggatagcttgtgcctagaagtttgagaccagcctgggcaacatactgagacttcacctctacaaaaaacttaaaaattagctgggtgtgatggcatgcacctgtagtcccagctactcaggtcaatgtgggctgaagtgggaaaatctcctgagctcagatatttgaggctgtagttactatgatcacaccactgcactccagcataggcaacagacaaagaccccaactcaacaataataataacaaccacaataataataatactaaatgaacttcattatttggaacctaaagaggaattgtataagttcaatttcatcactgataaataattcaattaaagacttcttttaaagccaagttttatattatttagcactactgaacttccccttcttataaaatgtttgcctccttactctggccaaaaatcttcttttcattgctctttagaagtttaacatgatgaaaatcagtgtttgactttaaaagtcaaagtatgaatgaaaccgaacttgtatagacacatcttttagctctcatttcaataaactgttattaaatccataatcttttgagagagcaactcacagattaaaaattaaaattaatattttatctgatgctttacggcatccattgtattgaatgcatttgtttaatatttctaagtctttagaaaagcttctgagaaaattgatttccttatgttgtttacagtctgtgaccaaatatttttaggacattcacatgaataaagggtcccaaatgcaacagaaattataatcacatcataacttaagctttaaattattcatgtcttttatgtttaacaaaaaaactattatccaaaactatttattatattaaaatatttttactcaacaatctttttctcctaaggtcaatgaaggcatatgactcctccccaattatataactttttattattttaattaaattaactgataccagcatgttttaatatcatccctacacatttagaagaagtaaataacctagagatcaaaatacacagtaaacccatacaaacagcagtttttcattgccatctctctatatataaacattgaatgcaattctatgaaagtatggctccacgtattcagatgaggaatatgtctgtttacatgtgtctctttcccggtccacattacagggggacctgtgtgtgcctccgtggttaagatttactgcatgttcacattaaagtctcatttccaacatttaaacatgcagccacaaagaccaattagaacagttattagtacaacccttggtgtaccaaagatttgggagttcataaagttgaaattgattgtttatggacaattacaggtaccaaaatgatttaaaacatttcaatttttgctctgctgaacgagactcatttaaacagcagaactagaagcagagacttaaatatcaacttgtaatcaaaaatcaccagtaatgtcttagcagcgtgttcatcctcctactcagtagagtccttaaacatacagggactccaatattagcttcaaaacattttcagaatgtctagcaaaaatatgtcaaacctggatctctgacttaaaggaacacacaaggcctaagaaataattgctgtctcaaatactgtggagttaataaggttttaaagtatataaagttgctataggctaaacggcacattttatattagacaccctttcttgctaaacactgtattatatattaaactgtagcaaaagtgaatgaatctatgaggaaaatcaaaatgaaattttcaagtactcacataatgacatacctctaaactgtgaggtactttatgacagagtgtgtgattcattcatcttttaattcctagtgcttgaatacaaagttgatattcagtaaacactgattgaatagaaaaatgagtaaatacaacttgaagaataactatgtaatgagatttctgattttacaaaacactttcactacttttctaattatatatatatacatatatagatatagatacagatatagatagatatagatacagatatagatatcgagtagagacagggttttgccatgttgctggtctagaattcctgagctcaagcaatccacccacctcgaactcccaaagtgttgggattacaggcgtgagctatcatgcccagtcgtgcttcaccacttttcaatgtcaacttcaagaaaatgaaaattgcacctttctgaacaaactttaagtctaccctaaactgctaagaatcaacactaagagcagatgacataatgtgtgggaaaataaaaagtcagccagccagctggacatcagtctcttctctgactgctatgactaaactcttcaaggttataacttttcaaatgctaccactgtaatgaactatttcattgctagtgttacctcctttccttggtcttcccctttctagacaagaattcctgttattatctcattcccttcttgactgcactttacacactggtttcaatttgtacttgacctagttcccagaaaacacccagttttccttttctcacttagtatcttaatatttgtaatattaataacccacttatctattcaattgtttaattgtattttatctattatctattcaattgtttatttctatttaattgtagtaactctattcagagctagcctatgcaaaagagaagacagcagtcttcagatgtgacttacttagtacagaaagatcccaaccctaatatatacaaacacatacacatgcaaacacacacacctgctataaaccaaaattagagatacatttctttgtgttaaactcctgcttcttgaggttcttattctccctctgtccctctcaattgttctgtcactctttacctcctgcttttttctgttttacagtaattctctccagctaacttcactcttctttcttctacatacaacatccaatgtgtccaaaaaaattctgtgggtttttgtttcaaaatatatccaaaacctgattaggtcttaccacctccactgttaccaacctaacacatgccacgatcatctctcacttggattactgcagaggcctcccaactggcctctttccttctatctttgcccaccccgcccccacaatctgttctcaacaaaacctaagtaatcctttaaaaatgtaaatcagatcttatcactctgctgctcaaggcctgccaggggtctgtctacaaggcactactgatctcacctacctccatcacctcccttacttcctgtctttctctgacattatctcctacttctttgtccctagatcactctgctcccttctgcctctccaaacacaaaagggctttccattgaccattccatctgcccaaaatgatctccccaggtatatgtgtggtttactcccacaatacctgcaagcctctactcaaatatcaccttcccaaggaggctctgaacaccatatttaaaatcacaaatttgtccaccaaaactccctgtatccttcttagtgtacactctagttttctttaatcatttccaaaacacttatggctttctcatattctatataaattacttattatatattgttttatatctattgcctccttctaggatgtaatctctgatatatcccaaatgcctagaaaggtatctggcagagtagacaccgaataaaaatttgaatacatgaaaatatactagactatcttaaaatacaataaatatatagtatgttctttttgtttgttttttgagacagggtctcattctgttactcaggctggactgcagtggcacgatctcggctcactgcaacctcagcctctcagggtccacaggcaggtgccaccacgcccagataatttctgtatttctttgtagagacacagtatgccatgtttccaaggctggtgttgaattccttgatacaagcaatcctcccacctaggcctcctgagtagctgggattgtaggcatgagccattgcacccagccttgatgtcattatctaatgtctcctccttaataaattgttaataacccttaataaattgtggctaacataccttttacaatacaactctagaccattaatgtgtcccataaatcctgtgtgcatcaggaggtatcttttttgcctcaatgccttttattaatgcactgtcagtattctacttgggctttattcaaatacaagcctataaaactactgaatctttttccatccctcctactttcccattcttgatttttcccctacctttctctacaactccaggtgaccagcaatgacaacctaatatgtatcactccataccttcttctccatccttaaataaccacgtacaaacatatgtagagatttaaaattctattttgtttctttgggaatgaagttgtccccatatatgctccttcacatcttatttttctcatctcatagcaaacagtggaatataactacattaattggtatacacagaactccattctttttaatggccgcatgttacaaggccaaaatgtatcaaatgtattcaacttttcccaccttgtttccagttttttaccactaataaaaatactgcaaaaagatccttgctttgaaaaatgcatatatccttacatatttatgcttttatttttatgagataaattctaggggtaaaactgccaaaactgctttccaagaaaagaagtaaatgtcacatttctaccacaaatgccttttgctctaatttgccaccaatattgagtggagccataacatttttaattttggatatatgatgatatctcagccaggcacagtggctcaagcctgtaatccctgtacttcgggaagccaaggcagatgaatcacttgagatcaggagttcaagccagtctggccaatatggtgaaaccccatctctactaaaaatacaaaaataagccggctgtggtggcacccacctgtagtcccagctactcgggaggctgaggcaggagaatcacttgaacctggaggcggaagttgcagtgagccaagattgtgccacagcactccagcctgggtgacagagcaagactccgtctcaaaaaaaaaaaaaaaattagcccgggcatggtggcgggcacctgtaatcccagctacttgggaggctgaggaaggaaaatcacttgaagccaggaggcagatgttgcagtgagccaagattgtgcactgcactccagcctgggcaacaagagcaagactctgtctcaaaaaaaaaaaaaaaaactcaatgttactttaatctgcatatcctaaagtactattaatcatcttcctatgtgtcattagtctattgggatttgcatttctgtcaactattcatctctctccctgttttttatactggattgtcttttgacactaatttgtagttttttttaatatcgtagatatcaaccatttatctgtaatttgaagtataaatatttttcccaacctaccgcttatctattgagtttgctgccaatgagatcccacatataagttacaaaaaaaatcattatatgattagatttatttttctttcatagctcctgcatttcctatgttggttagaaacttctcccaagtttctaattcatgcatatagtccagaattcatattcttccatgtaagtctctagtatacttagaatttatttaggtattgtaagagaccaaagattcaattttctttcagatgaacagataattccaaatgcatgattatcattttcccattgagctcaaattttcacatttatcatattaaattcccaacagactattgtaattacagtagctttagaatttattttaatatctggtaaagctattcatttctcacttttttctccataattttcttagtcaacaagtatgaacattatgttacccaattccaatgtaaaccataaaggaattttaactagaactgcaattaacttttaaacaatttttggtaaaagattattatgatatagtttttgcatggcaacacaatattataagaattgggaacatatttttaaagccagcatgctctttccttcatttcaattccagtgtaatgtctttcaattagatttttacgaatttcttcctacagaagtgtacttcttttgttaactttattcctaaggattttctagtttttgaaactacttttaattgattactttttccaatttttctttaataacattattatcagcactgagaaaggctaccaatttctgtgtattttatatacaactattcaccaaattatgttattaagtctgataatattttactggtaccttttggatatcataagcatacaatcatatcagcaaaataaaatgtatttttcctcttcttttctaatgttcatacagattatttcattttttacctcattcaacatgctagaacaaaactaaataacgataatgataataatgataatagaggacatacttgttattagaaataacattagcattccactgtttaaaatgtttacttttgaagaatggcccggagggcagccaagatgaccgaataggaacaactctggtctacagctctcagcgtgagcgacacagaagatgggtgatttctacatttccatctgaggtaccgggttcacctcactagggagtgccagacagtgggcgcaggacagggggtgcagcgcaccatgcgcgagccaaagcagggagaggtattgcctcactcgggaagcgcaaggggtcagggagtccctttcctagtcaaagaaaggggtgacagagggcacctggaaaagcgggtcactcccaccctaatactgtgcttttccgacgggcttaaaaaacagcgcaccaggagattatatcccgcccatggctcggagggtcctacgcccacggagtctcgctgattgctaggacagcagtctgagatcaaactgcaaggtggcagcgaggctgggggaggggcgcctgccattgcccaggcttgcttaggtaaacaaagcagccaggaagctccaactgggtagcacccaccacagctcaaggaggcctgcctgcctctgtaggctgcacctctggaggaagggcacagacaaacaaaaagacagcagtaacctctgcagacttaaatgtccctgtctgaacagctttgaagacagcagtggttctcccagcacgcagctggagatctgagaacgggcagactgcctcctcaagtgggtccctgacccctggccctggagccgcctaactgggaggcacccccaagtaggggcagactgacacctcacacggccgggtactcctctgagacaaaacttccagaggaacgatcagacagcagcattcgcggtcacgaaaatctgctgttctgcagccaccgctgctggtacccaggcaaaccgagtctggagtggacctctagcaaactccaacacacctgcagctgagggtcctgtctgtaggaaggaaaactaacaaacagaaaggacatccacaccaaaaacccatctctacatcaccatcatcaaagaccaaaagtagataaaaccacaaagatgggggaaaacagagcagaaaaactggaaactctaaaaagcagagtgcctatcctcctccaaaggaatgcagctcctcaccagcaacggaacaaagctggacggagaatgactttgacgagttgagagaagaaggcttcagacgatcaaactactctgagctacaggaggaaattcaaaccaaaggcaaagaagttgaaaactttcaaaaaaatttagacgaatgtataactagaataaccaatatagagaagtgcttaaaggagctgatggagctgaaagccaaggctcgagaactacgtgaagaatgcagaagcctcaggagctgatgtgatcaactggaagaaagggtatcagtgatggaagatgaaatgaagcgagaagggaagtttagagaaaaaagaatgaaaagaaatgaacaaagcctccaagaaatatgggactatgtgaaaagaccagatctacgtctgattggtgtacctgaaagtgacagggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcaagttacccacaaagggaagcccctcagaccaacagcggatctctcggcaaaactctacaagccagaagacagtgggggccaatattcaagattattaaagaaaagaattttcaaaccagaatttcatatccagccaaactaagcttcataagtgaaggagaaataaaatcctttacagaaaagcaaatgctgagagattttgtcaccaccaggcctgccctaaaagagctcctgaaggaagcactaaacatggaaaggaacaaccggtaccagccactacaaaatcatgccgaattgtaaagaccaccaatgctaggaagaaactgcatcaactaacgagcaaaataaccagctaacatcatcatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagattaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacactccactgtcaacattagacagatcaaccagacagaaagttaataagcatacccaggaactgaactcagctctgcaccaagcggaactaatagacatctacagaactctccaccccaaatcaacagaatatacatttctttcagcaccacaccacacctattccaaaactgaccacatagctggaagtaaagctctcctcagcaaatgtaaaagaacacaaattataacaaactgtctctcagaccacagtgcaatcaaactagaactcaggattaagacactcactcaaaaccgctcaactacatggaaactgaacaacctgctcctgaatgactactgggtacataacgaaatgaaggcagaaataaagacgtgctttgaaaccaatgagaacaaagacacaacataccagattctttgggacacattcaaagcagtgtgtagagggaaatttatagcactaaatacccaaaagagaaagcaggaaagatccaaaattgacaccctaatatcacaattaaaagaactagaaaagcaagagcaaacacattcaaaagctagcagaagggaagaaataactaaaatcagagcagaactgaaggaaatagagacacaaaaaacccttcaaaaaattaatgaattcaggagctggttttttgaaaggatcaacaaaattgatagaccactagcaagactaataaagaagaaaagagagaagaatcaaatagaagcaataaaaaatgataaaggggatatcacgaccgatcccacagaaatacaaactaccatcagagaatactataaacacctctgtgcaaataaactagaaaatctagaagaaatggataaattcctcgacacatacaccctcccaagactaaaccaggaagaagttgaatctctgaatagaacaataacaggctctgaaattgaggcaataattaatagcttaccaaccaaaaaaactccaggaccagaaggattcacagcctaattctaccagaggtacaaggaggaactggtaccattccttctgaaactattccaatcaatagaaaaagagggaatcctccctaactcattttatgaggccagcatcatcctgataccaaagcctgacagagacacaaccaaaaaagagaattttagaccaatatccttgatgaacattgatgcaaaaatcctcaataaaatactgacaaaccgcatccagcagcacatcaaaaagcttatccaccatgatcaagttggattcatccctgggatgcaaggctggttcgatatacagaaatcaataaatgtaatccagcacagaaacagaaccaaagacaaaaaccacatgattatctcaatagatgcagaaaaggcctttgacaaaattcaacaatccttcatgctaaaaactctcaataagttaggtattgatgggacgtatgtcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaatcaagggtattcaattaggaaaagaggaaggcaaattgtccctgtttgcagatgacatgattggatatctagaaaaccccattgtgttagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaaattaaaagggacgtgaaggacctcttcaaggagaactacaaaccactgctcaatgaaataaaagaggatacaaacaaatgcaagaacattccatgctcatgggtaggaagaatcaatatcgtgaaaatggccatactgcccaaggtagtttatagattcaatgccatccccatcaagctaccagtgactttcttcacagaattggaaaaaagtactttaaagttcatatggaaaaaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgacaaaaacaagcaatggggaaaggatcccctatttaataaacggtgctgggaaaactggctagcgacatgtagaaagctgaaactggatcccttccttacaccttatacaaaaattaattcaagatggattaaagacttacatgttagacctaaaaccagaaaaaccctagaagaaaacctaggcattaccattcaggacataggcatgggcaaggacttcatgtctaaaatgccaaaagcaatggcaacgaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctataatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagacaccatctcacaccagttagaatggcgatcattaaaaagtcaggaaacaacaggtgctggagaggatgtggagaaataggaacacttttgcactgttggtgggaatgtaaatgagttcaaccattgtggaagtcagtgtggcgattcctcagggatctagaactagaaataccattgacccagctatcccattactgggtatatacccaaaggactataaatcatgttgctataaagacacatgcacacgtatgtttattgtggcactattcacaatagcaaagacttggaaccaacctaaatgtccaacaatgatagactggattaagaaaatgtggcacatatacaccatggaatgatatgcagccataaaaaatgatgagttcatgtcctttgtagggacatggatgaaattggaaatcatcattctcagtaaactatcgcaaggacaaaaaaccaaacactgcatgttctcactcataggtgggaattgaacaatgagaacacatggacacaggaaggggaacatcacactctggggactgttgtggggtgggaggtggggggagggatagcattaggagatatacctaatgctaaatgacgagttaatgggtgcagcacaccagcatggcacgtgtatacatatgtaactaacctgcacattgtgcacatgtaccctaaaacttaaagtataataaaaaaaaaagtttccttttttatatactttatatttatgtactcaagaaaggctgttgaattttattcaattttttcagcatccattatcatcatctaattttccttcttcaatttgatacaccctacttgatattctttaatttatgcagaattattttcagttaaaggctattaattagtgcgtcctttttatttcaaaaattcttatttagtatgcttccagtcactctatcattatccattgggatttggtaatatatatagaaagatttattgtttataactgtttcttcttcataatctttcaaggcctcaattctgattcatttgctgtttggttatagttagttcaagtattttcctcaaatgaagcaaatgagagttatattctgtcaatctctgaatatctaaacatatctttactctgaaaggtggatgaaatactggttgagtcactcattcatttattatttaataagaattactctacgtaatacagatggatacaaaatgacaaaaaactccctgcctttaaagaatacatatattccagcagacaaagacagacaataagcacataaatgaatcaattaattaaatataaaatggttagaagagctaagaaaaaataaggcaaggaaaggaaaatcttctataatatatacataacagtcaagaccgacctctgattttgacaataatggccattcacccatatatagtgctttctaagtgccaggtactgtggtaagtactggacacacatcaaatcattcaatcacaaacaacccttcgagatagttactatgaaaataaaaatgctataactggtgaaactgaggcacaaacaagttgatttaccaaaggtaaaacagcaaataagtagtagaaccaagctgtccagctcttaaccattatgttttcttgcttctctgataatatgccatttcagtagataatgaaaggaaatgagggcaggagagagacccatagggttatatggaagaatagaattcctagcgaaaagaaaagccaccacaaatcttataaacgccatgaaaaatagatataaatacattaaaatatttgtattataatcttagactcaaccttaaaatatgtggctgaaacaattcctcacatgtatagagaaatgtttaggttatattaccttatcactcaagaattgatcagataaagtactcaggattaaaatgcaaaaaagcaaaaaaaagagtattaagagtatcttaatgtgatttcttaaaatttatttctaaaactaaatgctagaattatataaagtgaagaaacacagacacattctcaataaaaatggaaataaaactagaataacagtctacctaccacccctatgtaccaatactgtaatggatcctttacacacaatttctcatttagtccttacaataagcctgtgattccaataaatctattgtgtccatttaatatataaagaaagtaaaatttaggagaatcagtatattgccctaaagtcacataataggaaaagtgggaagaaataaaatacaaatttgtaaaacatcactgtataccttaaacatataaaatctttatatgtcagtatatctcaataaagctgctgaacatatgaatttgtatgatggcatgagcacagactattagatccaagaaaatcaattgtctatggtaaataagttcagcaaaattataggatatatggtaaatccaaaaaagtaattccctattgaagctggactgtgcggtagagaaaaaaaatgagctttggagcaaaatatgcttgattcaggtcaggcagagaaggctatggagttaactgaagagggagtgctgctgagattagtacctgcagggtcatgcttgcaataaccctagtggatgcaccagtgacaaagttgctcagcaacaacagcaaactaaagcaaacatatctgttcctagttctgagagatcaaaaggcaaccaacccaaactatgtaagaagttaagaaccttactccctttcagccctcattctcttctcttctcaatactactacttttacctcctgttaactacctcatttttctttctttccttgctctttgactctttcttgctgacgcttcccttctaggtctcttttttcctttcaatcaccccctattgaactgctttcttccctctcaccaccagtttggtttcaagaggattcttaaataacttcattacctccaaatacattttgatctcaaaggtcatagctcttcttccaatattagtaatttaagaattactaatgagacaaatccacaggttaacatgaaacaattccacatgtcacagagttaaaaaatgggtcaaacacactgacctgtttatgttaaaatattatatggctttagaaaaaaattatgccctaaatacaacatgcgctgcattaacaactgcattaacaacattttagtcctttagatatgcaaatacttattgtgttacaattgcctacagtattcagtacagtaacatgctgtaaaggtttgtaatctaggagcaataggctataccatataccctaggtgtacagacagctatattatctaggtttgtataagttcactctatgatattcttcacagatttctcagaatgtatttccatcattaagcaatgcatgactgtattaaaaattctttcatacaatttttcattatttttgcaaaattcaaggagtaatatatcacttatttaacaaatgttaacaggatatttcagaagattggtgtcaaaaagaaactcagttattgctttaatgtctctcagcaccaaatttcttttccatttggacttaataacaccttacatatacaaatgattcacaaaagacaagtcctctacagtttactatcatgagactcagaaaccagtatcacacaatgcttttaattcttatcatattactaaaattttatcagaaacagatgtcagcaatacaattttgatggaattacttaactttttttttttttactttcataacaaattaagcattgctcagttgaaaagttataatgtcacaagccttgaggcagcattaggtgctataatttgaaccgatgcagtgtagagtttgcatgctagtagaaaagaatttattagctacattgttgataattatttaactagcaaactccaagttttcttaaaaacacttccaatcaattaaatatctaagaaaactaataaaataactcaaagttttctagatgtataattaacatagcaatacataagttagcaatatagctgcaaaacaggtggaaaatataaccattaaaatgacttccatcctttcggtaggaagtagcttaaaaaaacaaataaaaataaaaacaaaaacaaaaaataaaatgacttccaaagaacaaaccaggcaaatggtttatgtccctaaataagctgaagcctagagataaagaaatttagtgggtaaaaaggaaagataatctatactaaaaacaaaaccaaaaaatgaacgaagacgatgaatggataaacaaaacgtggtataaacatataattgaatattatttagccttaaaaaggaagaaaatcacatgctaaatacagatgaagcttaaggacattatgctaagtgaaataagcccattgcaaaaagaaaaatactctatgattacacttacaggaagtatctaaagtagttaaattatcatagagacagaaagtagaatggtagttaccaagggctggagggaggaagcaatggggagtggttacttaatgggtaagagttgcagttgtgctagatgaaaaaatcctgcagatctgctgtacaacaatctgaatacatttaacgctactgaactgtgcactgaaaaacagttaagatggtaaatttttttaaccacaattaaaaataagagctttttaaaagaatgtaaagtaaaaatggaagatctgtgcacaatttttcttacgggcaaagaaatggtacatcttacaggtaaaacatgtatgttatgtgttacaactttagggaagccaaaggttttaatatctgatgccccatgaatgtgatatagcagctctctccatatcaattctgacaaacactatcaactttatttcttaaaactgtcccttagccatattcattcacccctctcccaccaatgttgtaggattccaagccaagactttctgctttgaagccctttaccaatgcaatcagtacccaacatacaactttccatccagtatttgtcagtcaagatatcacattaggttttcccttccctcttctcttcactttcccatcatcactgtagaagcctctgctacctgggacttcctctccctcctcaaaaatgaagaagaaattaagacattcccagataaacaaaaactgagagaattcactgctagcagacctgccctgcaaaaaacaaaaaggaagttcttcaggtagaaatgaaaggacactagatactaacttaaatccacacaatgaaatcaagagtacagcaaaggtaactacagaggtaaatgtaaaagacagtataaatgtatttttttcttttctttgtaactctttagagcactcctaccataagtataaattacaatttttaaaatgtcacgctacaattcaataggtaaatactgaacctgttttaagaagtacgttttatatttcacttctagaatagagataactaaaggaaatacagcctctttgaaaataaggaaatgcttcaaaacaaatctgtggtagatgaactatccctcacatgtcataggcatatagtactcttataacttgattatttagctcaatgaagttttaaaatactaaccacatcttattttacctcttttatatctctgggacctgtccctttttctctatcaccgcagctaataccttaatccagggtatcatcatttctcccctggattattggcagcctcctaatgggtattcctaatattagtcctgctccactttaatctgtttcctatactgatgccattagtgacataacaacaacaacaaaaatcagatcccaccattctgctcaaaattttcaagtggcctcccataatcttcggggaggaaaaatttaaattcccaaataatatacaggtcaggacatgaccactacctctgtctccagtattagaatcaccacatacataaataatctacacccacattctctgctacagcccttaagagttatttaggatcccagaataccacacatctacttttatacatgcttaccttctctgattagaaaaaccttactttgtctacccccatctctacttctttagtcttcaggactcagtgcctatacctaccacccaccctaactcccaataatgctgagttatatcatctcatagattctagtcacaattaccacagtacttaccaaaatgtactataaacacctgcttgctatgtatttatcccacagactgtaagcttcttaagcataaagattgtttccttactcctattttttgtccctagtatacgcaaaaaatgtctgccatggagtaagtgtttaatcaatgtttgaaaaaaatgaatgaaaggatgaagcaggttgtacattgagagacccatggagaagctgttcaatttttactatctataacaaagacaaacatcaaaattaataatctgataaaactgaaataccaaaattaatctttactttgtaatcagtaaaaataagtaaatcgatatactaatgtaattcttaatttttgtagttcattcttcaaaatattttattcaagcaagtgggatccagcaaaaaaatggagaccctccccaaaacttttacaaccagaaaatgagcttctttcaaattctgatgtggaattcccaagtaatcttgcagcaaattaaacaatatgatctatgatccatatgtaggccttgactattaaacttattttgtcttattaacagtattggagggatttttttaacaccatggattaaaaagtgaaaatgagttttttaaaagtaaagcttaaataacactctatctactgttttgcaaatgtgttatgaaggctttgaaaccacaaaatttccaacagacctaaaaatgtataatgtgctatatgtcaagctgtatttctttttttttttttaaactttaagttttagggtacatgtgcacaacgtgcaggtttgttacatatgtatacatgtgccacattgttgtgctgcacccattaactcgtcatttaacattaggtatatctcctaatgctatccctcacccctcccccaaccccacaacaggccccggtgtgtgatgttccccttcctgttaattcaagatggattaaagacttaaatgttagacctaaaaccataaaaaccctagaagaaaacctaggcaataccattcaggacataggcatgggcaaggacttcacgtctaaaacaccaaaagcaatggcaacaaaagccaaaattgataaatgggatctaattaaattaaagagcttctgcacagcaaaagaaactaccaccagagtgaagaggcaacctacagaacgggaaaaatttttgcaatctactcatctgacaaagggctaatatccagaatctacaatgaactcaaattcacaagaaaaaaacaaccccaacaaaaagtgggtgaaggatatgaacagacacttctcaaaagaagacatctatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctagagaggatgtggagaaataggaacacttttacagtgttggtgggactgaaaactaattcaaccactgtggaagtcagtgtggtgattcctcagggatctagaactagaaataccatttgacccagccatcccattgctgggtatatacccaaaagattataaatcatgctgctataaagacacatgcacacgtatgtttactgcagcactattcacaatagcaaagacttggaaccaacccaaatgtctaaaaatgatagagtggattaagaaaatgtggcacatatacaccatggaatactatgcagccataaaaaatgatgagttcatgtcctttgtagggacatggatgaagctggaaaccatcattctcagcaaactattgcaagaagaaaaaagcaaccaccacattttctcactcataggtgggaactgaacaatgagaacacaagttgtatttctaaggtaggagaaaggttacatagtctttaatactttctcctttacaacaaacttttccttatatataaaatacagcaaaaatagtaccttttgttcaaaggattgttgagaagactagaattcacgtaccacacttttgcctcatgcacaataaaaactttttacatgtttaggtgttattattactataattattatgacatatccaagtcccaaaaagttatcagcagtatactctgcaaaggaaaagaaaacacaccactcagataagtctatattcattaatgaatatatctacataccaaacctgcccccatttctttctactgattcccatctaattgaagaaagattttagtagtattctgctgtggattgactcttaaatcacttcactaataaagtcctatgaaaatttaaccaccaccaaaaaaaaggggatcagcacttaatcgcaatcctggattgcaatatgagtgatcagatgctaccccggtctgggtcttcatttcttcatctgtccaatggcaatcacagttcctatcggatctcatagggttaactatctgtgagaatttaaagattataatttatgtagaattgtttgctaagcttgaaaatacttcataaatacagactaataatactattgctgtacaatgccaaataataaatattctacgttttaagcagattgtctttgcttccttcagaaccaggtcttgactctttagcccaacttcgtttggtttggatatataaaacgacatcttataaggtgttcccttcaagggtactttatattactatgcataagaaatgctttccatattaactgaaaaggagatgaactaataagttcaccgaaagcataaatgactaagaggagagagaatgatctctggctttgagaattctcttagaagtactgcctataatcccagctacttgggaggctgaggcaggagaattgcttgaacccgggaggcggaggttgcagtgagccaagatcacaccattgcactccagcctgggcaacaagagcaaaactccgtctcaattaaaaaaaaaaaaagtatctaggtatagtaagtagtttaactaaaaacagtcttagaaacatggatcccaattcctaccctaaattccactaggacacaacattcttataattgtatgtactgttctttcttgccaaggtactcagcactaagaaggcaaattcccagaaagaatgaaaagtgtaagaatgtatgtgcactaactttaacttcctactgtgtgtcaaacactatctttacctactttctcatttaactctcaaaacaaacttgaaaggtattacatcttttttacagatgattacgttacgtaattcacagagatcgtattagagagaacaaaatgctgaaactaaaggtctgactacaaaggcagttctttctatttcaccacactattgatcctatgaagcagaagtcaaaattttaaaatgtcatcagagggttgtatccccattgaagtagctggttacataaaccaccaaggtttctttttgtttgtttgttttttgagatggggtcttgccctgctgcctaggctggagtgcagtggcacaatcatgactcactgtagcctcagtcttcccaggctcaagcaatcctcccacatcagcctccggagcagctgggactacaggtatgtgcaactgcgcccacctaattttattttttgtagagacaaggtctcactatgttgcccaaactggtctcaaactcctagactcaaggaatcctcctacctcagcctcccaaagtgctgtgattacaggcatgagccacaaccacacccagtacccatcctgattttttttttttttgagaccgagtcttgctctgtcgcccaggctggagtgcagtagcgcgatctcggctcactgcaagctccgcctcctgggttcacgccattctcctgcctcagcctccagagtagctgggactacatgtgcccgccaccacgcccggctaattttttgtatttttagtagagacagggtttcaccatgttagccaggatggtctcgatctcctgacctcgtgatccacctgcctcagcctgccaaagtgctgggattacaggcgtgagccaccgcacctggccccatcctgatttttaaggaaacttcaacacgagttcttccagtcccttttaaatgatggacactgtcaagaagtaaatttcacctaataactggtttatccagaaagaaaactgactcctcattcaaatggcattatattaaaccagaataatctccttaccttgacacaatggtttttgtaaatgtaaaaaaaaaaaaaaatcacacagaggtattctgattcatccaaggacattttctatattagcctagtaacatatagaataaagtaatatacaagaaaacttaggggtagacaggtatatattcagccacatgcttctcaataagaaaaatgatttatctactgtaagaaaaagtaaccttatagtaaaaaacagcagcagaatattacttgtaatagatgttaaatatttagtgtctctgttagttctatatacagttatacctaatcatgttaagtgtagagatttagcctcataaatatttctataacagaatataacctatatttcttaatacacaaggcaaatgtaaataaaacaaagatttgctggtctaaatacccaattctttaaaagtaaaccaaaattttcccatataaattttcctttggagaacacaggaataaatcccatctgatgaaggaaattatcaaaagaatacacattgatctaacatgtctggctcagtttgcctattataaacaattctggtctctggacatgaaaaactaataattttcagccacttgttttattacatctaagtctcaattattcacaactaaaaaagatagaataatgacattttacaatgtcccaaacacatgaatcaatcatacagcaggtggaaaaaatgctagaaaagataacatttgtgtcagctttacctctctctcacaggagtctcaacagtgtaaaccttaattcgtatatcttgactgcccagagccttccagagaaaaggatcatattgtctttttaaaaaatctcaattgtcaataactgaaggaaagcaagcatagctttccaaaacaactgagtccagatattttttccattgttgctgtcaattacttttctaatttctaattataattctaataaaaacttcagcataactaagaaagacaaactaaaactactcaggaattttcatgcaaaacttccaattatgtgtcctaaactcttttactccaacatgagttcacaaactctgacagatgttttataaccctgtttaaatatttagtcagtaaaaggataaaatttttaaaaaacagaatgatttcattcttttcaaaaaccagggtggtctatgggcaattttggtactagcagtgttgccgggggaacaaaatgaaaacaggtgtcatcaaattcaaattaaagatttacttctattttaaaccaccttaaacaatgtttccataaactttctaactgatactactataaatttgacaatattttataacaagaaaaggattataaattgtctgtagaccatcaaattttaactgtaacaaattttgactgattggcaacacttccttttaaaaaacttttttcattaaatatgcagcatcattttaaaaattgaatgtataaaaggcaagtcaaaataagaaaagagagcaagtatagactctgatagtcttttctgaaagattttactttgttttgagcctatgctgttttaaaaataaaaaacgaagtacaaaacaaatgttaaattcacaacatataaggaaaaagtgatacaattagtaacatgacaatcataacttttcctcataaacttaattgaactacaatcttcaatgttaaaaaaatccattaatttttgtgtcttattttggtaatgaaaagagtataaatacttggtttctaccattaaatagcacttatttttactcttaaaagagatgatgaagcaagtgactcaccatataaaagttaatcaatgcttaaaaatacattagagtattagacactttctcagttgtttaatacagtttcagtgacaaaatacacttacttttgttaaaagctttaattaagaaatgaacatataagaaatttttaaataggtaatattgcagattggttatgttcttcttaataaaactgtttaagattctttcagaatggattaaatacttacccagtgaggattctagatacaggtaagatgaggtgtacattcttcagtattattaatttaaacagaattaatttctctttgtattagttttgacaggtgaaaacttcttaaacttttaggggcatttaatcttgcactgaggagagtccttttatcttgactgtgaataatcaaattccattgtcatttcaaatctttcagacagttcaaagttttatttttagcagtgcttcagggaggcacaagttggttcactagtgtggaatcataacttacagtcagctccaccagttggattatttccaatatttattagtttcatcaactagttttcaaaaaagcttaaagtttcagtattaatagataaatgtctttgaaactaatatttctagcttaaagtttccattaaattgtatttataaaaataatacaaaatcttttttcagattactacatgtattttaatagtaaaagaaaaatatacagcattatataatgttgaacaatataaaacttcctttacagttagtttaaaataatctcacttgcatataattataaaattactatactcatctattgcttactttgaaagtgattaatcaaagtcagagaaagccaaccatcaactgaagtgtgttacaaatttccttctcagaggcacatcaaaaaaagatgagtcaattctactttaattaaaaccttgtttaagaatatgaaataagtgttttctgtataattccaattatatttcaattgtgttcagctttcaaactgcctctgctacttgattacacgtgccaaattaatcttgtcttttttttttttttttttttgagatggagtcttgctctcgctctgttgcccaggttggagtgcaatggtgtaatctcagctcactgcaacctccgtctcctggctccaagcaattctcctgcctcagcctcctgagtagctgggattacaggcacgcaccaccacacctggctaatttttgtattcttactagagatgtggtttcatcatattgatcaggctggtctcgaactcctgacatcatgatccacccacctcggcctcccaaagtgctgggattacaggcgtgagccactgcgcccggcccattaatcttatcttttaaatcatatcaacagttctaaaaaaagacttggattttttattgttctagtgggtattgttctagaagcaagactcctctaattgatcataacaccaagcctaccccttagctgacagttcagatgtgtgtttttggttggttcaaatacaggaagacaccctttgtatacatttgactaattagtcaaagaataagaaggcaggggaaagaaatttatctaaaatattttttgactaatacatagcagtcttccaaaaattcaaagtggaatttttagagaaactacatgttctaacatgttctcttagggtgcttcatacagatcgtcaaggaagtatcccaaaaaaaatcaatgaacacccggaatacagggtcttcaacagaatcaagcaacatgttacacaactgagggtaacaaagtatcagtccctacaacacttgtgtcaaacaaatctgtttctcctttcaccttacttacctcctttctcctaccctgttctatgtatggcctagcccttcgaagatacccaaacacaggaaagattaaagatccctttcaaacgatagaagatctctttcacacgatagatgataaaatgaagagatgttcagaaggctgtagctgctagcattcttccaccataagcttctccacctatatctgtagtagataactgtacttttagataacttttcaacccttttgaagggtttcaggttaacaaatatttgaaaattagtactcacaacactgtatataaaaatgaatagaggccaggtgcagtagctcatgcctgtaaatcccagcactttgggaggccaaggcaagtggattgcttgagtccaagagttcgagaccagcctgggcaacatggtgaaaccccatctctacaaaaaatagaaatattagctaggcgtggtggtgtgtgcctatagtaccagctactccagaggctgaggcgagcaggtgcccaggctcgaggggttgcagtgaaccgtgatcgcaccactgctctccagcctgggttacagagtggggcctcatctcaaaaaaagaaaaaaaatgaaagaagtatggactcaggaaagaagtactgacacatgataagcaataatctagatgcaaataaaaatcattagatttaatataacatctttaggctcaaatggaagctcactaaatattaagtcaatcaacactgatagaggcaggaagcagaaaaatcctagtcagacagggtgaaaccccaccttcaagtcaaaaacagcctgaaacccatgacccagagagagaacttctatttctgtttgcctgctctttcccaactggttctttctgaataatgctttttaaccaatcaaatgttgccttttccaatactacctgtggcccatgggcccccccgatcctgtgcccataaaaaccccagatccagccacactgagggagatgacccaacttcgagtgagagaccaccttcctgtcccctctctagactgagagctgcttcatcactcaataaaattctctgtcctcatcacccttcaattgtcagtgagacctcattcttcttggacatgggacaagaactcgggacccactgaatgtgggggctgagtgtgcagttgtggcagctgtgggatccacactggagtgcaagccagatgcggcctggcaggctgagtaaatggggcacctgctcctgcgagcccagcaaaggggccaagaaaaatcctgcatcaacactatttaaatgttaaaggaaaagtcaatataagtaacatgtataacacactaaaaatatattaatgataaggcaaaatgaaattagagaatgtataataaagctctgtgggataagaaccttctcttataacattctgtcaatggctgaacttccagaaacattacctatgaaattaaggacagcctttgtaaatagaagggctaactccttacatggagacttaccacccagaactattgtctgaatccatctgagggggaaaaaacccatttccatggtaaggaacaaagcagagacaaagttcattacagctacatacaaatggaaatgccataaattacataaaagctcatacaacaaagaaactagcaacttggttatttgtatacatagaaagacagcaggaaataaaatattttatattatatgaaaacaaaatgcttaagaactcactgacacagttatttgacaaatatgctgaggtttttgtatataaattttttagtttggggtttttttttgttttttgtttttttgggacagggtctctcgctctgtcacccaggctagagtgcagtggtgtaatcatggctcactgcagcctcgacctcctgagctcaaaagttcttcccacctcagcttccagagtagctgggaccataggcacataccaccacacttggctactttttaaaaaatcttttgtagataacagtgatatggtttggttctgtatccccacccaaatcttaccttgaattgtaataatcctcaggtatcaagggtgggaccaggtggagataactgaatcacaggggcagtttccccctgctgttctcatgatagtaagtgagtcctcatgagatgtgatggttttataaagggcttccccctttgcttgccactcattctctctcctgccaccctgtgaagaggtgccttccaccatgattataagtttcctcaggccttctcagccatgtggaactgtgcatcaattaaacctcttttctttacaaattactcagtctcgggtatttcttcatagcaccatgagaatgaactaacacagacagggtctctcaaacttgcccaggctggtcttgaactcctgggctcaagtgatcccccaacctcagcctcccaaatatgtagacccagcactttggaaggctgagacatggtgggcggtgggtgtggggggttagggggttagggggtgtgattggtgggggtgttgtgccaaggggcttgaggtctcaaagagctacgatcccgccactgcactccagcctgggcaacagagagaaaccttgtatgggaaagaaagaatttttgttttgttttgttttacagctttgggaaagatcttttctatagaatcatatatctgatattacaataaaattatgactcaaaaatttgttttacataaaatctctcatctacatgtcctcaagctaattacttaaacaacatcaccatctcttccacaggcactagcacatttagaaaagaaagaggtttgggttttgtttttttcctgtactcaaagttcagctaagtaaagaaacaattatttcccaaaggtttcaaagcaattgcctcagtaaatcaaaagaatgctttcctattagcaaagccatataatttaagagtaaagggttaagatgatttaattttctcaaagaaaaaagtgaaaagttaggtggctatacagttaatgaccagaattctggaaaactgccaaattcaggcacattctaaccatcaagttattactatttagtggaggtcgggggcagtcactaagaactttttatgcaggtttaaattttacatacagagaagccatataattattgtgaaatacttcaagggattcaagaagaagctatgacagtttgctgtgtttctttaaaaaaaaatgcacatttactgactttgagtggtatttagttccaaaaatatcaaaaatatcagaaagataatgtctatatttaatatttggtattacatattttggttatggcttctaaactttctcatagcccaggcactcagctattcaacctaaatttttccagttgcctcaatgttatataattcccttttcaattttgttcagtcatacttaggatctactttatacaaggatgaataaaacactattttacatctaggtcataagaccaggatataaagtccagtgtctgggttctaatcctggttctaccaattactagttctttattctctctataccttactttgatcatctgtaagctgtagatatagtactaacacccacaaaatagggtttgatgtgagaatcaaataagttagtatacaaaaaatactcagaacacaaccatataaaggaataaaatgcgtgctacaacataaatgaacctcaaaaacattaagctaagtgaaagaagccagacacaaaagtcacatattgcatgattccatttagataaaatatataaatccataaagacagaatgcaaactggtggttgccaggatcggaggggtggggaggggcaggtgggatggtggagaatggggataaaatgcttaacaagtaccgggttgtattttggagtgaaagaaatgttttagaactagataagagttctgaaggccactgaactgttcactttagaatggttaattatatgttatatgaaattcatctcaataatttcaaattttaaaaaaagaaataaaaaacaatttattaacaccatccaaaaaaatacttagaacaatagcagtgatacaaaatgagttcagtaaatgtacactgtaataattatcaatgccacataaactggtaaatatgtagaatactatgctacattccaaagattaaaataaatatacataggtttggagtttatgttttcttttaagtactcattttaacaatttatttctcctaaattcagcatgaaattatgtaattcatctacaaggaactctcgcttcctccaaaagagacactcagagagaaaatacatatgaaaaatggaaactaaaaatttattttgtacatttactgctatatgtcatccaagttatgttattttaacatacagtgcttatgtgttaaactatctgggaaataaagagatgacatgcatgaagaaaatatacacaaaaggacaaccaaagaattattttgtaaatttaaccccacaaattataaatattatattgttacattcagttgtttaaacaatatataaaataccactaaaagactcatacacatatttataaactcaatgaaatgttcaatttgtgatgaatcagaaaaaaatgagaaaacatcttcataatgggatacaaaaatggaatttagaactggatcagcctggggaaagcaaattttaaaaagacaaaatcatagggctagatttgtggatatgagaaatcaatgaattcatttttgaggcaaaaaaaggtcaaagtaaaaaagcattctatatatcaaacttaacacatttatactatagtttaaagaatatgtcaacaaatgaagagatcacagttcccaaataattatagcagccaaaaggtcaagtctaaaaacccttcacttcaaataaaaagctactaggagagactatgaggtactttctactaatatctcagaagaaaactcatgaaatattcaaaagcaagagaataattcgtatcttccgtttctttgcctcacatatttgttttactattagaagaaggctgtttttttgttttctttgtcatgactaatgtttatcttataaatttctattaaatgtgttaccaaaagttcctgtcgggaatggtaactacatttcacatacacatttataaacaacaaaagagaaaactgtcattaattttaatatggaattaaattattagaataaactttcaaacatatgttgaccagtcaaagaattgtggcatgatgcatgtagccttcactgtttcaaaagcacagagtttaggtcaagctccttaaaacagccaaatgttttaacaagtaaagaaaaatatacataaagtgcttcatgaataaaagtagttcaaatgaacaaggcttgtggaaaataaagcactgtacagattttatatcaaacatgccaagaatgttaataacactacactacactatatatgagaaagaactctccaactacaagaattgttatattaaaaatatacatgttatctttttctgttaacatctttaaacaaataagtcagctagcttcctgaaatgatgtaaatgtgattcaacctaaagatgtgattttcttgcacgtcatgagttccataaatctttgaatacaaatattatgcattttatatgccatcttatctgtatgtctataaaaaaaatggctgagctatggaaaaacagtatggtggttcctcaaaaaagtaagcatgaaattatcatatgatccagcaattccacttctgggtatatacctaaaagaattaaaagcagggactcgggctgggcgtggtggctcatgcctgtaatctcagcactttgggaggccgaggtgggtggatcacgaggtcaggagatcgagaccatcctggccaacacggtgaaaccccctctctactaaaaataacaaaaaactagccagacgtggtggcgggcagcctgtagtcccagctactcgggaggctgaggcaggagaatggtgtgaacccgggaggcggagcttgcagtgagccgatattgcaccactgcattccagcttgggtgacagagcgagactctgtctcaaaaaagaaaaaaaaaagcagggactcaaacagaatatttgtgtgtccacattcatagcacgattcacaagagccaaaaggtggaaacaatcgaagtttccatcaatagatgcacagataaacaaaatgatgtgtacgcataaatgaaatactattcagccataaaaaggatatgaaattctgacagttactacaagatgaatgaaccttgaatacattgtgctatatgaaagcagccagacagaaaaggacaaatatttcttgattccacttacatgaggtacccagaatagtcagatttatagaaacagaaaatacaatagttctaacttgaagctagaggagaaagtagtaggaagtaactgttttaacaggcatggagtttcagtttgggatgatgaaaagttctagagatgaatagtggtgatgttgcagagtaatacgaaagtatttaatgccacttaaaaacagttaaatggggcggggcgcggtggctcacgcctgtagtcccagcaccttgggatcacccgaggtcaggagttagagaccatccagcccaatcaacatggtgaaacccagtctctactacatatacaaaaattagccaggagtggtggcacatgactgtaatcccagctacctgggaggctgaggcaggagaatcgcttgaacctgagaggcagaggttgcagtgagctaagatcatgccattgcactccagcctggggaacaagagtgaaactctatctttaaaaaaaaaaaaaaagttaaacggtaaattttgttaagtgtattttgccacaataaaaaagtaaaaaaaaataagttctgtgtatggatggtagtgacggctgtacaacagtgtaaatgtgtatataacatctctgaattgtacacttaaaaatgttaaaatggtgaatttatgcttatttccacaatatttttaaaagctggttaaggtctttcagtaattagcttcactctaaattatttttaaggcagatcagaatatagttgctcagaggcttctaaatactttgtaagcaactgaaccaccactacagctaaccagcacccctaaaccaattattgcctagcaaagtattactgcctttcaacccactggccctgcctaagtctggcaaccatataaaatgcttgatactgcttctgcattaataagcagtgagctcttcaaatgtaacacttgatgtccagggcaggagcaggttatagacatagtatgcttaaatctactttccccatggttgatgactagacttaaatcctcagtcacattccctgctacctgactggggccttgtttcattatctgtcgcccttggccctactccttacatctttaatcctctcctctgggtcctacatctcattctaaaatcagactaagtctcctcatgccattaaaatcttccctggactctcaaaccttcaaatctcaccgcacccccaccccccgcccccaccgccacccaacttactcctcttcttggctaccgaacttcatttctggatcccccaggaattgacttcagcctgctacttgactgaattacactcctgaaagttaaccatgacctccaatctgataacctattattcatactacccaaactaaaggcaaaaaagaagaaagaagaagaaagacaaaggaggaagaggaaggaagaaggaagaaggaaggagaaggagacggagatggagatggagacagagaagaggacaaacatttgtaaaaggtcatcaatcacaacctccttaaaactattttctcccttggctgaaactctcctaattcttctcttactctctggtctcttttatctccttccaccaaatctccaaatatgggtacttgtcattctgccttcaccctttttcttccctctcctaggaatttttcagaacttttcttctcaaaacttcgcaaaacatttgaaaatgttttttacattttatatgaataccatcagcacaagaggttgcagaaggagtcaggtagttggagaacaattctgcctaccccagtaactaagaagctggcaacagaagtatgcttccctactgcacatgtatatatcagtgtccaaggttaagaaaaccacatttgtattttttggcaggtacaatacattttaaatgaaaaaaacatttagaatgttttcttttcaaaatgattgtactgatagaaggaagtatctaacaatctgttcattattaattgcatgttttctgatatggttaattatttaggcttgatgtaatcactcagctggttaagactgcttactgatacaaagttaaagataggatgtacaaatgcaattaaatatcagtttcttaaggttaaaaaaaataataatttcctccaatagagagttcttaacattctatgtggaaataaaatttgtagaaaagaaacagaaaaatgaaatccatagagaattgatatgctacaccttaaattaaaacttatcatcagaatacttaaattcttaaaaagtataatttatgatatttaataaataatttatgagtatgaaaaattaaaaccatggacttttttaaactttaggattaatgactagtaatggcttctttgcataagttgcttcctttcgccttaaacaaagaaaccatacattttaaagttttatcataaaaacagaatgtatatgaaattatttcactttagcaatttttaaagtattttaaggctcaaaaacttaaggatatgggaaagtgatcaagatgtagtgatagaggaaaaaaagaaagttataaaacaatgtaatctcatgattccaattttggttaaaaaccagtatgtactaatgggcacagtagatacacaaagtacacagaagcccatatatcaaaatgttaatggtaaatcttgaggtagtacaagtatttttattttcttccttatactttgttttcttcctttatacctttattcctttctatagcaaacatgcatcacatttacagttgagttttgtggaagaataaactctatatttcattccatttctgccttcctgcttatattttgatagactaggaaaggaccatctttcaaagctgtgcagagtaactctttagcattgtcagtgctctcatatacctaatccatcagcaaatcctgttaatccacttacaaaatataacagaattcaactactcactattttcactgcttcttcaagagaagtcaccgtcatctctcggtttatgcaaaagtctcctaactagtctatgtaattccacccttaccacctttctggctctaatgtcactcctctacttagaaattctgtgacttctcatctcattcagaataaaagtctaagcactgattgtgaccttctaggctctatgatctggaccaggaatcaccatgcacactcccacttcagcaccacagaacttgcagtaagttggctctgcctagatattctacatccagataccctcattttcttcagctttttattccagtatcatcttctcaatgaggccttcactggcaatccaacacaacacatcaaccactccaccctacccttgaaatttcctatcttgtttccctgttttattttttctactctagcacttatgactatctaagacacatgatgtatttatttatttttgatattatctccctccctcagtagaatataaactcaataaagagaaatttttacctttgtttttcctgctgctgcatccctagtacctagaatagtcccaagcacatggtaggtactcaatatatatctactgaataaatggataaatgcattccagtgaatccacaagcttaaacccacagcttctcagttacagtaatagttggctcaatgaatgtcatgaaatgatagcaacacatttattcatattctgagaatcaatgactttctaagtgactttgcatagggcaagagagctgaagaacagctatagtaaacaataatgtagacatattttctcaagcctaaaagggagcatctaggatcttagcttcaaaatttatgaataaaattatgacttgatttggtataacaaaggtaaggtaccctgagatcatattgctgttattgttggtactaaaaagtaagcaaaactgtctaaaatcatattgttactcttctaacttttccattagaatattcaataccagtctgtgaaactggatatataactttccttatgcaaacaaaaaactagctgaatatcatactactatgcacctgagtatctgttatctgaaagatctttggatcttttataaacatcaatcaatgctgtgcagacagagctaagagggaaaggcaattagatactgtgaaaaaatggaggcaatcagaagaaatacagtccatggtggcagtgacagagctaagcaggaggtatggataatctgggtaagtgccatggaaaaataaatatcatgattgaacttgaggcaaatggaaacagttcaaattggcttcatacactactctgtggaacatatgatgtccatatgtccattaccaacaaactgaaacatggaaaataacaaaagccgatgctatgatggctataagaacacacccaatgccagtctctaccacaccgcagcagcataacttactacagctgccaggtaagttggctaagaagtcagaagcaataagaaaaaaaggagaaagaactaactataaactgttctctttccctacagaagacaaagttgggatctatactagaaagtagaatgtagcaacgataaaggctgaaagtaaagcacaattttttctctgtagacagtttctaaaagtataaactactttggaattaaagaaggcaacattttatccaaaactacaaacgatttaagatccagagaactaaataaaataacagaggaataagatggaataacttccaaataaaaaattataaatatgacctttcaagttttgaaatacataatagagtataaaaagaaactgaacaaaagatgtggtgggaatccattatgttttacatcagttttaattagtctaccaaattttccttctatagtttctaaccccacctttcttttttttttttttttttggtgttgttgttgttttgagatggagtctcactctgtcacccagggtggagtgcagtggcatgatctcggctcactgcaacctccgccttctgggttcaagcaactctcctgcctcagcctcccaagtagctgggactacaggcgcgtgccaccacacacggctaatttttgtatttttagtggagacagggtttcaccatgttggtcaggctggtctcgaactcctgaccttgtgatccaaccacctcgacctcccaaagtgctgggattacaggcgtgagccactgcacccggcctctaacctccacctttctatactctctaacccccaaagcgattcatcttcaagatacaataagagttgacataaaagaagtagagcttaacttaggcaagtatcatgaaggaccaatttacacagcaaagccaaaactgtaaaaaaaaataaaaatataaattttttaataatgtttaagtgttaaagcctatctggtggtcctgaccttttcaaccaatcaaaaccaggccagtcagatgaactgtataaaaataatatgtacaactactacatatccataatacttaaaatgaatgtttaagaaaataatctcagcacttattcagaaatatactagtgtcactcaaactatacagtaatgaaattcagcagctaaaaatatataactattttacagtaaatatcaatgtcattcctgtttcaacctgacttcccattctacccctaaactcccaaacttgaaaccaactacaatttcttgagtagctggagtgtggtttaggaaaggaagctatgcttgtttgtatggaatctgccatttcctccctgccaaaacacttgtttaaaaagtcatgtaatatttctattaaattgtaaatgcagtcgacaaggaaatggcctactagcagtgtattacctttgtggcagtgccaacgggcctacagcaaaatagtgcacatgataatttcaacatgcattcccaagtaacaaaattgtgctttacataaataccacagaacctgagcaagatccagaaaaagcaatgaaaatctgcccaagctttcatgcttgcctatatcaattgtatgtcataagtaaagcaaaatagaaaagcatctacatatgttcaagaagcttgtgaagttagatcatataaccctgggaaaactattgcagcttaaatctgtgtatttcttgttaaccactgtaacaactcactaataaaaatgaagaaaaaccatggatatcaaatgaaccaaaatgtactaactacatacaagtccttaaagatcatgatgcaacttattaacaggaacatattttcagtgtaagccacaattgttatgttaaattacttctttctttgatatcattcatttgattacagaatgtaagagattcacgagcattccaattaaaatggtgaccttcagtttataagtcacttaccgaaatgcttacaaagtcaccgctaatcatttatttcttaccttgcattgcatagcacaactacatttaattatgcaaattaaatgatcccagatgtaataaagatggttctattcatgtgaaagttatacttaaaaccaagttaacaaaattaaataattaatctgtaattaatatagtcttctaggacagctgaattctattctacagcaatttaactaaaatgcatatttattttataagtcaggtatgacttgtctttctttttaaaaatatcaatcgacacataatttcaaaatttaaacctgatagagacaccatttcctccaaaaatgtaaatttttaagtgttatacacatgaaattagagtaaatacctgccctcagtatacctccttccaccttcctaccctatgcacacctagctatttatgtctcctaaaataaatgctagcttaaatctctggcacaaatagttactattactggcttagaataaaataaaacttactatgaccaacagagtaagtccacacaattgcttttaagatatatatcttcaataatgcttaatggttgtctgttaaaacagttttcatccccaattagcaaaccaaagctactatatcctgaggccaaaattaagggtgcccactactgatttttctgatctctaataaggaacaggaactaaagtgccaaaaaataaataaataatataaattatatcaatttaaaatttaaatgttaaataaataaattgtgctaagtaaaagtttgaaaggcaagctgtgagggatgacagctctttcaagttggatttgattagcatttaattactttcactttttaatttatttcattgattcttatgctaagttgtaagtacaacacttattattttaagaaagaaaaatctgagcttaccagatttcagtattaacaccacagaagtatctttgagataggaaaggaaataagcacatattcaacaaaaatatttattggatattcttatgttagaatctgctagattcatttagacacacaaagatgaaacatacttgaatttaaaacttagatttagtagggaaatacgacaactatatcaaaataactatgataatacacagtaagtttaaaagtgccataagaaaattatagataaggtgatatgagaattcaaagaaagaaaagattttttaaatcagtgggatgaggaacttctaacaataattagacttatctaaaactaagctttccagaagtagaaagattacgggaggaagacatcataatctacatttggttccaggttgaaatgcagaactgtaatatgctatgataaagaaaatagtaaacaaaacactaccctaaatacacaatgtaacaagatacactcttgagggtcactgatattaagaaccacagttctcagttattttcgatcaaggaatccttgtttcaaggagttattattttcatttgatggaaaactatgaactatcttaccagaaaaatacatatctgcacaaacatcaatatttaagtgcaatttcataagatgtgctgactgaattctctgccccagaaacagctcattctaccctcttgtgaatcatggtttccattactgggctagtatgcagtataggggaaaatgaagaagtaaaaaataactgtttttcatcattagaaaagataaaatgtatcacagtcctaataggctcattattttcatattgcttccagtagaggctgcagaagacatctcagcagccataagcaagaacttaaaagttttcagcaatctcccctggctagcaataaactgtcaataagcaggttcaggcacagaaacagtaattcctttgggtactgtgtaacgtcccaatacctcccatcctactgaatgtcctacaacaaaatcaggtgatgaaaaacaactgctcgatccttccacagctcaaagttccttaagtaacaatagtaaatattaaacgggcatcctctgtaagaacctgaactaatttatagtctcaatatgttacttcaaaagcaacttcataaagctagttcatatttctacagtacttagtattttacatgtattgttcatatacactatcccttttgatcttcaaaaagaactctgtgaagtagatggatgagggtccattataactaattcagagataacaaaattgattcaagcctcacaagtctcaaacatcaggtcacaccattattacgtagcaacaatagaagcattcggactttgttagaatttggatttccaacacctggttcagtaattattgctctatagattcaagttgcaaatcattactgggtcataaaatcaatgtaatggatttggaccacacattttttaacgaaaagatgaaacagaatagaatactgtgatagaacagaagtcagagtgaatcacaaataaggaaaataagtatggtttcatgtatattttgtttcacttatgtgtgtgtgtgtgtctgtacacatgtgcataatggatcacactgtgaaaatatttctaccatggaccacaattttaaaagtctgaaatgtaaatgtcatctttcaatcattaataaatcaatttaactcatctcctttaaattctcccacacaaatacagagaaatattgcatttgtcagtatcccacattaaaatcctaaaaagatgaaatgtagtataattctttctcagtaagtattactctaagcaatacttaatggaaacacgtctccaaaactataattcatatttatataatttgtatgtcagtaggaaaatgataattatttcctcaatattaccaaactaatcatgtgtacagagcacttggcaataccaacagcaaggttagaatacagacgaagagtaggaatgcctctttcctgtgtaagtatcaggggtgaccccagcaggcttaatctagagaagttgagacctgtttattctcttcacttgttcatgtcttaaagaataataactctgacaagacaaaaatatgttgaaactgtcactgtaataaaccttaatccccagtttagggtctaggatgccttataccaccaccacccttcaatgtgtatcaggaccacaaagcagagaactcttaactttcaaatggagtaaaaatccatgtcttggaagcagtactgaaattccctgatgatcccatttctcccactcctctggatccttggatgatgtgaaagtacggttaatagaatcaaggtatcacctaaaataggcaaaaaaatagggaagagaaaggaaaggaaaccaaaggtagagaggggggtgaggggagagtattcacctacacaccctgtcaggaaacaaaaaaatgaaaagacaacagtaggaagaaaagaaaaaaaggaagataagggcaggttcaagggagaaatgcaagtaaagtatgtaatgacaaaataataaaatttttatctacaaccatatgatcttatgtaatttgagataatatatacatataactgaataaacgttttacagtgtatagcttcctattctaatcaacaaaactcttatctaccctttcctattaaataaaacagaaatctaaatgattctaacattaaaatgctagttatcactgaactataaattccaaaagaacagtgaacatgtctgctgtgcttactactacttcctaacagctcaagtggtacctgataagtgtgcaccaagtatctacagaaggaaataaaggaaagggaaagggagtaaaagaatacagaaggcactctagatgacatttaatttctctgacacaaaacaaccaatttgggagagaagagatactgtccaactggtcccaaagccaaatttattgcctttatgttagaatatgcatttcttgcattaacaatattaaatcaaaaataatttaatattaatgattaaatttagtattgacgaaaacatgggactgtcccatcatgagaagatacacatttacatggcagaaaatttcaagagtgtcattctcgttgctaaaagattcattaaaaattatttgtactccaaaaggtcccactagctcccaagcaattactcctaaccagaatgaaatgtatgaaataacagatacagaattcagaatatggatggcaaagaaactcaacaagatccaagagaaagttgaaatccaacacaaaggaaacagaaaaataatctaagatttgaaagacggcacagttattttaaggaagaaccaaacagaacctctggaactgaaaaatttactagaggaatctcaaaatacagttggaagccttaacaacagactaaaccaagcaaaagaaagaatttcagagattgaagatcagttcttcaaatcaacccagtcagataaaaataaaaataatttttaaaaatgaaaaaagccttcaagaaatatgagattatataaaatgaccaaatatgtgacttactggcattcctgagagagaagagaaagtgagcaacttggaaaacatatttgaagatagatataattcagaaaaaattccacaatcttgctagagggatcaacatgcagatacaagaaatccagataactcctacaagatactacacaaaatgactattcccagggtacacagtcatcagaccatccaaggtcacccaaaagaaaaaaccttaaaggcagctagagaaaagtgtcatatgacctgtaaagcagcagtctccaaactttttggcgcaaggaaccggtttcgtggacgacaagttttccatagatagggttggagggggtggtttagggatgaaactgttccacctcagttcatcaggcattagttagagtctcatgaggactacacaacctagatcccttgcacgtgcagttcacaaaagggttcacgctcctaagagaatccaatgtcagtgctgatctgacaggaggcggagcttaggctgtaattcttgatcgcccaccgcccacctccagctgtgtgacccggttcctaacagttcatggaccggtaccagtctgtggcccaggagttgggggacccctgttctaaagggaaacccatcagactaacagtagacttctcagcacaaatcctacaaaccagacaagattaggggccaattttgagcattcttaaaagaaatgccagccaagaatttcatatcttgccaaactaagcttcataaatgaaggaaaaataatgtatttcccagacaagcaattactaagcaaattcatcactgccagaccagccctacaagagatgcttaagggaggtctaaacatggaaacaaaagaatgacatttactaacacaaaagcacacgtaaagcacataacccacagactctataaagcaactatacaatcgagactacaaagcaactagctaacaaccctgtgatgggaacaaaacctcacatatcaatattaaccttgaatataaagggcctaaatggcccacttaaaagacatagagtggcaaactggaaaaaacaaacaaaatccctctttctcttatctgcaaaagaaccatctcacaagtaacaacacccatagactcatagtaaatgaatggagaaagatcagttaaacagaaaacaaagaaaagcagaggtcttatattagataaaatagactttaaacaaacgactgtaaaaaaggacaaaaaagagcattatataatttttaaagggttcagttatacaagaagacttaactatccttaaatatatacacactcaacactggagcacccagatttatgaaaacaattacttttagacctaagaaaagatgttgacagccacacaataacagtgggagacttcaacaacccactgacagcattagactgattatcaaggcagaaaactaacaaagaaattctggacttaaatttaatgcttgaccaactgaacctgatagacatctacagaatactctaccaaacaaccacagaatatacattcttctcatatgtacatagaacatactcaaagactgaccacctgctcagtcataaaggaagtctcaataaattcaaaaaaatcaaaatcataccaagcatcttttcagaccacaatggaataaaaatagaaaccaacaccaagaggaactctcaaaaccacataaatacatgaaaactaaacaacgtgctcctgaatgacttttgggtaaacaatgaaattaaggcataaataaaaaagttctttgaaaaaaatgaaaacagagacacaacataccaaaacctctgggatacggcaaaagcagtgttaagaggaaagtttagaatgctaaatgcctacatcaagaaaatggatctcaaattaacaatctaacctcacacctaaaggaacaagaaaaaactaaacccaaagctaggagaagaaaataaataagtaaagtcagagtagaactaaatgaaattgagaacaaaaaaccatacaaaagatcaatgaaacaaaaaattggttttttgaaaggatgaatgaaactgacagactgctagctagattaaaaaaggaaagagagaagatccaaataggcacaatcagaaataacaaaggtgacatcacaacgaagcccacagaaatacagcagatgttcagaggctactatgaacatttcagtacatacaaagtagaaaatctagaggaaattgattaattcctgaaaacacaaaacctccaagattgaactaggaagaaacagaaatcctgaacagaccaacaagtaacaagattcaatcagaaattacacacctaccaatgaacaaaatcccccaaagagagagattcacagctgaattctaccagtcctaataaaactattacaaaaaatcgaagaggagggcctcctccctaactcattccacaaaaccagtatcatcctgatatcaaaatctggcaaagacataacaaaaaaagaaaattacaggccaatatccctaatgaacataagacccaaaattcctccacaaaatattagcacactgagctaggtggaatggctcacatctataatcccagcacttggggaggctgaggcagaaggatcactggagctcaggagtttgacaccagcctgggacatatattgagatcccatctctccaaaaaaaattttttaattagccaggtacagtggcacatgcttatagtcctagctactcaggaggctgagatgggaagatcacctgagcctgtgaggtcaaggctgcagtgagccatgactgcaccactgcaccccagcctggatgacaaagtaagcctgtctcaagaaaaaaaaatttatatatatgagcaaaccaaatccagcagcacatcaaaaaattaattcaccaccatcaagtgggctttattcctaggatgcaaggatgattcaacatatgcaagtcagtaaatgtgatttaccacataaggagaattaaaaacaaaaaccatataatcatctcaatagacacagaaaaggcttttgacaaaatcctatactccttcattataaaaatccacaacaaacttgacatcaaaggaacataccttaacataataagaggtatctattacaaactcacggccaacatcatactgaatgggcaaaagccagatgcattcccttaagaactggaccaagacaaagatgtccactcttaccattcctatccattatgtcactggaagccctagccagagcaataaggcaagagaaagaagtaaaagacatataaataggaaaaaaagaagtcaaattatctctcttcactgacaatataattgtatactagaaaatcctaaagattctgtcaagactcctaggcctgataaatgatttcagcaaagtctcaggatataaagtcaatgtacaaaaatcagtagcacttctatacgctaataatgttcaagctgagagccaagtcaagaatgcaatgccatttacaattcctaccaaaaaaaaaaaaaaaacaacctaggaatacacctaaccaaggaggtgaaggatctccacaaggagaactacaaaagactactaaaagatagcagagacgacacaaacaaatagaagagcattccacgttcccaggttggaagaatcaatattgttaaaatggtcatactgcccaaagcaatctacagattcaatgctattcctatcaaactaccatcatcatttttcacagaattagaaaaaaactattccaaaatttatatggaaccaaaaaggagcctaaatagccaaggcaattctaagcaaaaagaacaaagccagagacatcaatttacctgacttcaaactatactacatggtactgtaaccaaaacagcaaggtactggtacaaaaatagacacacagaccaatggaacagaatagaggcataaaaaaataatgggatcatgtcctttgcaggaatgtggatgcagctggaggccatagtcctaagcaaactaacacagaaacagaaaaccaaacactgcatgttcttacttataagtgggggctgactactgggttcacacagacataaagatggaaacaacagacgctaggaactctaaaaggaaggaaggagtggagaggacaagggctgaaaaacttcctatcggatactatgttcactatctgggtgacaggatcagcagaagcccaaacctcagtaccatgcaatatacccttgtaacaaacctgcacatgtaccctaaaataaaaatggaaacttaaataatacaaactgtgaaaaaatatttttaaaaaataatttccaaagaatatgaaatgctgatttacaattattaaatatttacacaacttcttcagaacacacctattgcataatgcaaagtacatatatatgatttaataaaaataatcctctacttggtagacaactaagtcatttgcatagaaacagtgaaaagcattctgattgaaagatctctcaatatagtgattacaaagaagacatacaaagggactcagactgtgtattataattggggtggagaaagtgatatggggacaactggaaagacaataaacaggcagtaaaaagttaaaggagtaggacaccttcaccagcatagaaacaacaagcaggtcagtactagagagaggttaaacaaaaagcccaatttaaaaatgggcaaagcagcaccgggcgcagtggctcaaaacctgtaatcccaacactttgggaagccaaggtgggtgaatcaaaaggtcaagagatcgagaccatcctggcaaacatggtgaaaccccgtctctactaaaaatacaaaaattagctgggcgtggtggcgcgcatctgtaatcccagctactcgggaggctgaggcaggagaatcgcttgaacctgggaggtggaggttgcagtgagccgagatcatgccactacactctagcctgggtgacagagcaaaactccgcctcaaaaaaaaaaaaaaaatgggcaaatgaattgaatagacagttcccaaaagatatacataatggataatggacaataagcatatgaaaagatgttcaatatcactagtcatcagagaaatgcagatcaaaatcacaatgagatgccacttcactcccattactatggccattagcaaagaaaaacaacagaaaataacaagtgctagcaggaacgtgaagaaactggaactcttgtacattggtggtaggaatgtaaaatggtacagctgctgtggaaaacagtatggaggttcctcaaaaaataaaacactcttgaattgatgattgtggatccagttcatggtagcattattcacaaaagccaaaaggaggaagaaacccaagtacccatcaacaaatgaatgaataaacaaaatatgctatatacatacaaagaaatattattcaggctttaaaaggaagcaaattctgacacattctatgacttgtataaattattgaaaacattaggctacataaaacacacacacacacaaaagaacaaatattgtttgattctacttatatgaaatatttagaacagtcaaactcatagagacaggaagtagaatactggttgcgaggggttggagcaagaggatatggagaattattgtttaatgggtacagggtttcagtttgagataattaaaaaatttctagaaatagtggtaatgattgcacaataatgtaaatgtactttatggcaatgaattgtatagagtactttaaaatggttaaaatgataaattttatgttatatattactcattaatcctaattataatcttaaattatgtaattatacttatactatataaatgttaatcttaaattatacataattattaatcttaaattttctttctctatttgaaagaagagaacatattatggggagtgtagtgagttgaaaaatggccatcctcagaagatatgtccacatcctaatctctgaaacctctaaatgttacacaatttgggggggaaaaatacaatttatgcagatataattaagttaagaatcttgaaagcagaagatcatcctggatcatctgagtgggccctaaatccaatgacaagtgcccttataagagaaaggcagagagaaatttgaggtagatagacaaaaaagaagacacagggctgggtgcagtggctcacacctgtaatcccagcactttgggaggccaaggcagacagactgcttaagctcaggagttcgagaccagactgggcaacatggtgaaccccatctccacaaaaaaaatataagatttagccagccatggtagcttgtgcctgtagtcccagctacttgcggggctgaggcgggaggattgcttgagcccaggaattcgaggctgcaatgagccatgttcacgccactccagcctgggtgacaaagcaagaccctgtgaaagaagaaagaagatgatgatgatgacacagacactcagaggaaaatgcaatatggagatgtaggcagagattagagtaagacaactacaatctaaggaaaacaggattgcaggcagccaccaagagctggaaaaagtgaaaaatagattatcctgtagagccccttgagggagtacagtcctgccaacactttgatttcagacttctggtttcccaggctaaatgaagatactcctctatgccattcaccactgtgttaaatccttgcaaggaatcttccaacaggtggtgtcagacaaacacaggtgcacatacactaagacatccaaggtatctacaaatacctacacagcagggactgggagatggaaggtgtgttaagtgtgttgggtgtggtattactcaagtctcaccactacagagaatcagttttccagaatttctcaagcaaattttattattaattgagcaggaaaggaggacatggatgcttttctcttttttggtgttgggtttttttaaatattaaaaaacggttaactaagtgttcactcttcacatgtggacataaccacattttttgtctctttttttaaaatcctttctttgtgaaaaaagtagtgccatgggatttccaatgggagagagctactgtgttttactttttgatatgcactataaagaatgatcttctaacccatgtctgtttttacgctgcctatactaaagcatttgttgcatctatttaaatgctatgtttctccaaaaagggaggtggaagccagttggaaaatatggtgggttaaggaaaagactcttcaggaaaggatagcattatttttgaaaacatcattcatcaaaaatgactccttatgtttgaaaatatctgcagggctcctttatttgtaagtaggtagtgtaaggacacagagatagagacctttttttaggctaaaataattctttttttttcatactttaagttttagggtacatgtgcacaatgtgcaggttagttacatatgtatacatgtgccatgcgggtgtgctgcacccattaactcgtcatttagcattaagtatatctcctaatgctatccctccccactccccgcaccccagaacagtccccagagtgtgatgttccccttcctttgtccatatgttctcattgttcaattcccatctatgagtgagaacatgtggtgtttggtttcttgttcttgcgatagtttactgagaatcatgatttccaacttcatccatgtccctacaaagaacatgaactcatcattttttatggctgcatatcattccatggtgtatatgtgccacattttcttaatccagtctatcattgttggacatttgggttggttccaagtctttgctattgtgaatagtgccacaataaacatacgtgtgcatgtgtctttatagtagcatgatttatagtcctttgggtatatacccagtaatgggatggctgggtcaaatggtatttctagtcctagatccctgaagaatcgccacactgacttccacaatggttgaactagtttacagtcccatcaacagtgcaaaagtgttcctatttctccacatcctctccagcacctgttgtttcctgactttttaatgattgccattctaactggtgtgagatggtgtctcattgtggttttggtttgcatttctctgatggccagtgatggtgagcattttttcatgtgttctttggttgcataaatgtcttctctgagaagtgtctgttcatgtccttcgcccactttttgatggggttgtttttttcttgtaaatttgtttgagttcattgtagattctggatattagccctttgtcagatgagtagattgcaaaaatttcctcccattgtgtaggctgcctgttcactctgatggtagtttcttctgctgtgcagaagctctttagtttaattagatcccatttgtcaattttggcttttgttgccattgcttttggtgttttagacatgaagtccttgcccatgcctatgtcctgaatggtaatgcctaggttttcttctaggatttttatggttttaggtctaacgtttaagtctttaatccatcttgaattaatttttgtataagttgtaaggaagggatacagtttcagctttctacatatggctagccagttttcccagcaccatttattaaatagggaatcctttccccattgcttgtttttctcaggtttctcaaagatcagatagttgtagatatgaagcattatttctgagggctctgctctgttccattgatctatatctctgttttggtaccagtaccatgctgttttggtaccagtaccatgctgttttggttactgtagccttgtagtttgaagtcaggtagtgtgatgcctccagctttgttcttttgggttaggattgactcggcaatgcgggctctttttgggttccatatgaactttaaaatagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcatgtcccttgtaagttggattcccaggtattttattctctttgaagcaattgtgaatgggagttcactcatgatttggctgtctgttattggtgtataagaatgcttgtgatttttgcacattgattttgtatcctgagactttgctgaagttgtttatcagctaagggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttatggagagtttttagcatgaagcattgttgaattttgtcaaaggccttttctgcatctattgagataatcatgtggtttttgtctttcgttctgtttacatgctggattacatttattgatttgcatatattgaaccagtcttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgtcaggctttggtatcaggatgacgctggcctcataaaatgagttagggaggattccctctttttctattgattggaatagtttcagaaggaatggtaccaattcctccttgtacctctggtagaattcggctgtgaatccatctggtcctggactctttttggttggtaagctattgactattgccacaatttcagagcctgctattggtctattcagagattcaacttcttcctggtttaatcttgggagggtgtatgtgtcgaggaatttatccatttcttctagattttctagtttatttgcatagaggtgtttgtagtattctctgatggtagtttgtatttctgtgggattggtggtgatttcacctttatcattttttattgtgtctatttgattcttctctcttttcttctttattagtcttgctagcggtctatcaattttgttgatcctttcagaaaaccagctcctggattcattaattttttgaagggttttttgtgtctctatttccttcagttctactctgattttagttacttcttgccttctgctagcttttgaatgtgtttgctcttgcttttctagttcttttaactgtgatgttagggtgtcaattttggatctttcctgctttctcttgtgggcatttaatgctataaatttcactctacacactgctttgaatgtgtcccagagattcttgtatattgtgtctttgctatcattggtttcaaagaacatccttatttctgccttcattttgttatgtacccagtagtcattcaggagcaggttgttcagtttccatgtagttgagtggttttgagtgagtttcttaatcctgagttctagtttgattgcactgtagtttgagagacagtttgttataatttctgttcttttacatttgctgaggagagctttacttcctgttccaaaatgtggtcaattttggaacaggtgtggtgcggtgctgaaaagaatgtatattctgttgatttggggtggagagttctgtagatgtctattaggtctgcttggtgcacagctgagttcaattcctggatatccttgctaactttctgtctggttgatctgtctaatgttgacagtggggtgttaaagtctcccattattattgtgtgggagtctaagtctctatgtaggtcactcaggacttgctttatgaatctgggtgctcctgtattgggtgcatatatatttaagacagttagctcttcttgttgaattgatcccttcaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattttgatgttagctggttattttgctcgttagttgatacagtttcttcctagcctcgatggtctttacaatttggcatgattttgcagtggctggtaccggttgttcctttccatgtttagtgcttccttcaggagctcttttagggcaggcctggtggtgacaaaatcactcagcatttgcttatctgcaaagtattttatttctccttcacttatgaagcttagtttggctggatatgaaattctgggttgaaaattcttttctttaagaatgttgaatattggcccccactgtcttctggcttgtagagtttctgctgagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccgtcactttcaggtacacagtgagatgaagatctggtcttttcacatagtcccatatttcttggaggctttgttcatttctttttgttctttttctctaaacttcccttctcgcttcatttcattcatttcgtcttccatcactgataccctttcttccagttgatcgcatcggctcctgaggcttctgcattcttcacgtagttctcgagccttggctttcagctccatcagctcctttaagcacttctctgtattggttattctagttatacattcttctaaatttttttcaaagttttcaacttctttgcctttggtttgaatttcctcctgtagcttggagtagtttgatcgtctgaagccttcttctctcaactcgtcaaagtcattctccgtccagctttgttccattgctggtgaggagctgcgttcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtgtgttggagtttgctagaggtccactccagactcggtttgcctgggtaccagcagcggtggctgcagaacagcggattttcatgaaccgcgaatgctgctgtctgatcgttcctctggaagttttgtctcagaggagtacccggccgtgtgaggtgtcagtctgcccctacttgggggtgcctcccagttaggctgctccggggtcaggggtcagggacccacttgaggaggcagtctgcccattctcagatctccagctgcgtgctgggagaaccactgctctcttcaaagctgtcagacagggacatttaagtctgcagaggttactgctgtctttttgtttgtctgtgccctgcctccagaggtgaagcctacagaggcaggcaggcctccttgagctgtggtgggctctacccagttggagcttcccggctgctttgtttacctaagcaagcttgggtaatggcgggcgcccctcccccagcctcgctgccgccttgcagtttgatctcagactgctgtcctagcaatcagcgagactccgtgggcgtaggaccctctgatccaagtgcgggatataatctcctggtgagccgttttttaagcccctcggaaaagcgcagtattagggtgggagcgacccgattttccaggtgccgtctgtcacccctttctttgactaggaaagggaactccctgaccctttgcacttcccgagtgaggcaatgcctcgccctgcttcggctcgcgcacggtgcactgcatccactgtcctgcgcccactgtctggcactccctagtgagatgaacccagtacctcagatggaaatgcagaaatcacccgtcttctgcgtcgctcacgctgggagctgtagaccagagctgttcctattcggccatcttggctgcttccccaataaaatcaataattcttaatttactcttaaacagagattgtcatgctttatgtgagttaaatttccagaaagttgacaagtgcctccaattatctccttaaatcacatttgacataaatcttccaaaatacactatttatttacacatctttttttaaagttataaacattcagtattgcattgcatagaagtaaaaattcttggtttgatttctattttctttcctttgcctgattcaagaaatcatcaggtacttctcctgctgtccacagagtgatccatacagttctttccttacccctttccctatgctgaacaacaggtaagcaaacacaaagggtttttacaggttacgcctgtactcccaactactcaggaggctgaggcaggataattgcttgacccagggaggcgaagattgcagtgagcctagatggcgccactgcactccagcctgggtgacacagcgagaatccatcaaggaaaaaaatacaaaaatttgctgggtgtagtggtgtgcacctgtagttccaggtattcgagaggctgaggtgggaggattgcttgagcctgggaggttgagggctgcagtgagctgtgattgtgccactgcactccttcctgcctgggtgacacagtgagaccctgtcacatggatggaaggaagggagggagggagggagggaaaagaaaggaaaggaaaaaagtaaagagaaaagaaaagaaagagggaaggaaggacggaaggaaggaaatgatactatttattcatctcctgatttaaaatatatacatatatatacatacttcctaaggctgagtgcactggcttacgcctataatcccagtactttgggagaccgaggcaggtggatcacttgaggtcaggagttcaagatcagtctggccaacatggtgaaaccccgtcactactaaaaatacaaaaaattagcttggcatggtggtgcgcacttgtaatcccagctacttgggagactgagctgagacaggagaatcgcttgaaaccgggaggcagaggttgcagcaagccaagactgccaccgtactccagcccagacaacagagcgagactttgtctcaaaaaaaaatatatatatatatatatctatacacacacatatatatacacacacacactcacacacacacactctctctctctcacactcacttcctaaaggcctgagaaaaagagaagactgatctcctcaaaagtatgtggttaactgaattcaaaactaaatttttttaactattctatttatctaactgatcaaaattaatttggtggtttcatatttaactttataaaataaactgagttttaatttaaaaaaatttgtttcacttaacattctgattagacttactcccatttgccactactcactaattttaatctcatagctgaatataaatttataagcacttttatccctctcctgtttaaaagctttatatgtttcaatgtgtacatcatcatttccctttactaaacagataatcattactgtctaccacagtgaagattcggtttacatatactacaagtttctttggggggaagaaaaagttgtatggaaactaacaaatttggttaactccttgccatcaaacaaatccagtgtttttaatagttcttcttattagaaaatttctccttgaacatctatattccaaatattccttattctgcccaggaatgataaaagaaataatcaatctctgacaaactgataaactaaagcatataaaacaaatgacctcagacttaacacctttgaaagacccattctcaaataactgcaaatttccaatttaaccactttcattttctaatttagtgccatctttaagttcttcgtatccctcagactatgacaccctaaatatatgtcctacaaaaaccttaatcagtgaaaaacagtattaatttgtggccacttaaggagaagcaactccattctaaattatccaagctcaaggcatctctttttgcccctaatttttgctggcctaagcaatactactttacaaacaggcctggtacctaaacacggtaaaaggctgagaaaatgactgggaaaccaaatcccagttcactcagtctacaaggcagcaccactgttctggagtgttcctaattatatacagctagtgggcaggcatagtggaaagggctagaactctgtgaggatgaatgcaaggcatttcagaaagactggctagaatcctcactccaattaggcaataccaccagtggctgggcaccccactatagatggaggctggggaaactcacccaccacatcctaactttgtctctaactttgttctagatagccatgtatatgtagtaaattgtatcatttacttatattaaaataactatcaggttttttgcctgttatcagctgtggggtcttcatgtcaatcacatctttgtctcattgtggcaactttgtagattattgattacctcattagcctatatgtctaccaaaacatggctggaaaacaaaactttaaaaattgaaatcttacctaggttaccatatttcctgctactctggaaaacttagagggttcagattttaaatcagtaattataatattgtgattacatggttttaaaatgtcttatttttgttagccgctcctccacttgcactgagttgggatattaacacagaggatatttctttggtgtctaggcaaaaacacagaacaaactgagttcatatctcagttctgccactgacaagttatgtcatcttaaataacataatcttatccatttcatccaatccacccaatggaggataaaatatttatttcacaaaattactacagtacaaaaaaaaatgttggtaaaaaacttcaatatttcactcacttaccatagtgtcatatcctaccagctttctcatatcttaactaccactttatctcctctctaacctcctgagattctgatttaatctgtttagggtagggctccccacatgacggctatgcagcaagcatggagaacactacctattctttgatcaccccatttccttacactctctcttttctttccagactgtgccctgttagtaaccccttgaactgtctctcagcagcatccttaaattccctatagccccatccttctaagacactcattcattaaaacccaaaccctccatatcaaggccataatgcattctactgcacagcagagcacactaccataggaaggcccacaaaccaggattaattacactatactttcccaattaccaattttagctgggccctcaacaatttttctctcttggacagctctttctttcattgccctcactataccccccacaaaactactgtaaaccttgatgaaacagtaaagtttattaattctattaaatttctacacttgaatatgtatttttaatattctacattgacaaaatggaaaatatgcataaagcacttccccacatatcaaagaacaacaataatctgaaaaaaagcagttgtgtgactgagctgcaagctaaataaactacaaggctcttttcaaagaacatcatttttacttgaagaataactaacagaaaactaaggttacacagacttgggtatttgacagacattttctcaaaaaggaaccaagtgaacctgtcatttcaaggaaaacaaaaggcagtacttgttaccagtgataaaactatctgttacatgatctcaacagcttccaatacttgcagttcaatactctactttgtaagacagctcacaaacacaagaaaagttaaataatgatattatttaaataggaaataaactatattatgtttggaaatgcacgaggcaacacttgattaactgtccaaagaactggactgtgaagaaattgcctatatacaaaatatgaggaaaaagagaaatttacttgggcgatagctgtcaagaatggctctacacaggcataaaatccaagttgggacttgaaaaactggtaggatttagatttaaaaaaaaaaaaacagtgagcaaggcatcctaggaagtttgcaatacaggtatatttttttctaaaagaaatattattttcaggtatatttttaataatgtataatgtattcattcaaactctcaggtaatattagaagatccttaaaggaagaggccacatattacaattctctgctatctgagcacaggatcaaatttaacatgttgaactatttggttggaaaaataagatttacacagggaagaagcagaatagtaataatggaagtcctaagttaaatcccagctcttgtacttacctaggttgccttgggtaatttagtaaacctcactgattcaaactcaaatacacctactttgaggatcaccctacaaacatcctaactaaaagaaccacagataactaatgatcagagatgaaataagactttgtgttcctgtttttatgctgaccttgttgtttttcaagttattttcaaacaattgatgcatttttatctttcatttaccaaaaggaatttatatacaccaggaagatgatacatattgtatacaattacattactcaaagaactctaggctgggcacactgctgtaatcccagcactttgggaagctgaggtgggcggatcgcttgagcccagaagttggagaccagcctgggcaacatggcgacaccttgtctctacaaaaaattagttgggcatggtggtgcatacctatagtcccagctactctgcaggctgaggtgggaggatcacctgagcccaggaggtcgaggctcgagtgagccatgatcgcactactacaatccaggctgggtgacagagtgagaccttatctcaaaagaaaaaaaaaaaaaactctctttaaaatgtttcaatacagcagacagatttttaaatattttctgtataatacactgttacctatattatcgaaatttaacccacaatggcattataatatcagatgtaattccaatttattcttcttcagatattctaaaatatctgaatttttatgcattcttcctctttctatctatttacttcacattcctccagccaccatgatattatcttctcttttctacaaatacacacatacatacactcctcccctcattcctacatccttattgagataactacagccactagagggcaataagtatacaaagatcagtgtacctatttatgatgatgaacttatctatatgattcacatagtaataaacctaaaaagtatatcatcacaaaccctgaaacacaggcaattagacttgaatatgcaaaatatatatttcaaactcaaaaattatcctgcagagttcacagaagcatataatgatgttcaaaaaaggaattccattttctcagcatgcattcattaaaaaaaattagccgaattcctttatatgtgcatagtaatattagaaattaggattgcttaataccatcctcagaccaaagaagagaaaaggcagaaaaaaaaaaacacacagtaaggtataaatcacagagtgggtaaaaaagtgagaaatgattacttccaactctttcactaccacaatcaagaaaacaataaactgaagagcaaagaggatttaccaaccctttcttctattgaaaagcaagcaaaaattttacaagtatatttttgggggaggagaacagtgatggtagagatatacaaagccttcagttcttttctcacaattaagaatgcagaaggaagagaagttaacagttactaatctttaagaggtaattttaccatttttaaaaagaatacatttaaatgaacttatttagtttatatttacttacattgacattacaaaacggcaacacttatataaggctaacattttcagcaaaccataattttcttaccctcattggatgtatatcagcataaggaggttttccttcagccatttctatagaagtaatgccaagggaccagatgtcggccacacagttatagcctatttcttgaatcacctcaggagccatccaaaatggagttcctattacagtattgcgttttgccattgtatcctgcaataatgttacatagccataaatgctactacaaaagcacaaaggaaatctgtatgccaaacatacttttaaaaaatgttaaaacctccaatgccacagattatatcagaaattgactattttgctaaaatttcaactagttatgacatacttaggaattccgaattctgaaaataaccaagagtccacaggtaacttatccacactaccatcattaaacacagtcattaaagatagtgctacaatgataaaagctacagaaatgagctacgtagcttcccttttagaacatttaagcattttgattataagatatattttcacattcaatcaccctaaattataaattaaataatactcaaatttggctcaattatggttccttctccacaaaaattaaaaaactacacatttctttccattccccctcaaaaagtaattgaagtttagttataatcaaatctgaacaaattagccaagtgtttagaaaaccattaaagttaacttactgttaactgaccagccactccaaaatctgccaattttgcatgtccttctgtattgaggagaatatttccagcttttatatctctgtgtatttttctcataaagtgcaaatattctagtcctttcaatgtagatttaagaatggttgcaatttcatcttctattaactggaaagaaatatttttaaaaccataattaaaatgccacgttagataaaatcttacgaaagagcactagtaacaagtatgtctttccgtgtgtgtgtgtgtgtttttttttaagagaccccactctgttgcccaggctacagtgcagtggtgtgatgatagctcactgcagcctaaaattcctgggctcaaggcatgctcccacctcagcttcccgagtagctagaactacaggcacatgccaacccaataggctaacttatttttatttttgtagagatggggatctcgctatgttgcccgggctggtcttgaactctttgcttcaaacaattctccttcctcagcttcccaaagtgttgggattataggtgtgagccaccatgcctagccacaagtacttctttctaatgaccgctaaacctccaggaaaatgctaaaggggtaaataatcgagaacctcttcttcccacaataagctttcttattacacattttactaatgaaaggatgatcaaatttctctctttaagattatcagtatcagcagggcgtggtggctcacacctgtaatcccagcactttgggaggctgaggcgagcagatcacttgaggtcaggagttcaaaaccagcctggcccacatggtgaaacctcgtctctactaaaaatacaaaaattagccaggcgtgatggcgtgcacttgtaatcccagctactcaggaggctgaggcaggagagtcacttgaacctgggaggcagaggttgcagtgagctgagatcacatcactgcatgccagcctgggcgacacagcgagactccatctcaaaaaaaaaaaaaaattatcagtatcattcctaaagcaaacaacatatctcaagaatcagcctgatataaggaatcataatagtgatttcccacatcttctaatactgggagggcactatcacagctaatatctgttctgaaaaagtaaattcagatacttcccctgagatatttcagattcttgatgaaaatgaaaccaacagctttacataaaggaaagtaaatgagggagggaggcttgcaatgaatcttctgcgagaagctcctacaccaatgccactcctaacccttccaagttctggacttctgacctaatattgagaactcagaagaaaaaacgtcagagaaagattaggaaaatggaaacacaagcaaagactatcagaggagggaaaaaggggagagtagagaaggccgaggaagagacggatgggaaagaaagaaaatcttcttaacagttgtagcagtagagccactgctatctgtaccaggcaatgtgctaagagttatgcatgcattctctcatttattcttaaaacaaccttgtaaggtagtgtgatattatgaaatcacaggaaatatttggtctttgtaggttcttggcacaaaatctcctaagaccctgtgaattgactgagtgagtgagaagttgaatcaagatattttatctttgttttctcaccctctcacaagagtgagaggggctgtcttttgtcattcataataagctcctttcaaccataccagaatttatactgatcaggtgactcttggtgggagcctagatagcttcaggatgggagctggttgccgaaaaaaccaaccaagtgattagatgtttggaaatttctgcctgacccctgacttacgggagggctgcaaggagagagggggtagagatttagttaagcacaaatgtccaaagacttaatcaatcatgcctatgtaacagaatcaaccataaaaattctaaatgattagggactgctctcaagcttatattctatctataagcaacgggataatttgatagaaaataggataacacaggaaaatgtctgtgaaaattgctatgaggacaacaatagagagctactgatagagaacgactgagaagctactttagattgacattcaagaaggcccaaaagacattttactgaagtctaaatgatataatggggccaaccatgtgaatggctatctgggaacatacactccacaaaaaggaaaaaaaaagattaaaatatcttgattcaacttctcaaattttctaaaacactgaagaaaagagaacacttccacactcattttaagaggcattattctgatatcaaagccagacaaagttaccacaaaacaactaagaccaatatcccttatgaacattgatacaaaaatcctcaacaaaatatagcacactcacttcaacaggattgtaacaggttatacactatgaccaactggaatgtattcctggaatgcaaggttgattcaacatacaaaatcgaacaatgcaatacaccaccttaacagaatggagaagaaaccacatgatcatttcaaatgaaaacagaaaaagcatttgattaaatttaacttcttttcataaaacacacaactaatatgaatagaaggaaactatctcaccatagtaaaagccatatacaaaaaacccaaagtaaatgtcatactcaaagcagtaagactgaaagcttttccacaaagatcaggaacaatgaaaggatgctattaggttggtgcaaaagtaatcgcagtttttgccattttttttttaaagtaatggcaaaaaccgaaattacttttgcaccagcctaatacttctgttacatatagtactggaggttctagacagagcaattagggaagaaaaacaaataaaggcatccaaactggaaaaaaagaagtaaaattatctctgttcacagatgatatgatcatatatgtagaaaattctaaagattccacaaaaaaaacctattagaactaataaatagggatggagacaagacggctgaataggaacagctccagtctaaagctcccagcgtgagcattgcagaagacacatgatttctgcatttccaactgaggtaccagattcatctcactggggagtatcggaaagtgggtgcaagacagtgggtacagtgcactgagcatgagctgaagcagggcggggcatcacctcacctgggaagtgcaaggggtcagggaattccctttcctagtcaaagaaaggggtgacagatggcacctggaaaatcaggtcactcccaccctaatactgtgcttttccaatggtcttagcaaacggcacaccaggagattatatcccgcgcctggcttggagggtcctacacccatggagcctcgctcactgctagcacaacagtgtgagatcaaactgcaatgcggcagcgaggctgggggaggggcgcctgccattgcccaggcttgagtaggtaaacaaagcagccaggaagctcaaactgggtgcagcccaccacagctcaaggaggctggcctacctctgtagactccacctctgggggcagggcatagccaaacaaggcagcagaaacgtctgcagacttaaatgtccctgtctgacatctttgaagagagtagtggttctcccagcacacagctggagatctgagaacagacagactgcctcctcaagtgggtcactgacccccaagtagcctaactgggaggcagccccaagtaggggcagactgacacctcacacagcccggtactcctctgagacaaaacttccagaggaacgatcaggcagcaacatttgctgttcaccaatatccactgttctgcagcctccattgctcatacccaggcaaacagagtctggagtggacctccagcaaactccaacagacctgcagctgagggtcctgacagaaggaaaactaacaaacagaaaggacatccacaccaaaaccccatctgtacatcaccatcatcaaagaccaaaggtagataaaaccacaaagatgcagaaaaaacagagcagaaaaactggaaactctaaaaataagagtgcctctcctcctccaaaggaacacagctcctcaccagcaatggaacaaagctagacagagagtgactttgacaagctgagagaagaaggcttctgatgatcgaactactccgagctaaaggagaagtacgaacccaggcaaagaagttaaaaaccttgaaaaaaaaattagacaaatggctaactagaataaccaatgcagagaagtccttaaaggacctgatggagctgaaaaccaaggcacgagaactacgtgacaaatgcacaagcctcagtagccgattcaatcaactggaagaaagggtatcagtgatggaagatcaaatgaatgaaatgaagtgagaagagaagtttagagaaaaaagaataaaaagaaatgaacaaagcctccaagaaatatgggactaggtgaaaagaccaaatctatgtctgattggtgtacctgaaagtgatggggagaatgaaaccaagttggaaaacactccgcaggatatcatccaggagaacttcctcaacctaccaaggcaggctaccattgaaattcaggaaatacagagaacgccacaaagatactcctcaagaagagcaactccaagacacataattgtcagattcaccaaagttgaaatgaaggaaaaaatgttaacagtagccagagagaaaggtcgggttacccacaaagggaagcccatcagactgacagctgatctctcggcagaaactctacaagccagaagacaggggggccaatagtcaagattcttaaagaaaagaattttcaacccagaatttcatatccagccaaactaagcttcataagtgaaggagaaataaaatactttacagacaagcaaaggctgagagattttgtcaccaccaggcctgccctaaaagagctcttgaaggaagcaataaacatggaaaggaacaaccagtaccagccactgcaaaaacatgccaaattgtaagaccatgaatgctaggaagaaactgtatcaactaacgagcaaaataaccagctaacatcataatgacaggatcaaattcacacataacaatattaaccttaaacgtaaatggactaaatgctccaattaaaagacacagactggcaaaattggatacagagtcaagacccatcagtgtgctgtattcaggaaacccatctcacgagcagagacacacataggctcaaaataaaaggatggaggaagatctaccaagcaaatggaaaacaaaaaaaggcaggggttgcaatcctagtctctgataaaacagacgttaaaccaacaaagatcaaaagagacaaagaaggccattacataatggtaaagggatcaattcaacaagaagagctaactatcctaaatatatatgcacccaatacaggagcacccagattcataaagcaagtcctgactgacctacaaagagacttagactcccacacaataataatgggagactttaacaccccactgtcaacattagacagatcaacaagacagaaagttaacaaggatatccaggaattgaactcagctgtgcaccaagcggacctaatagacatctacagaactctccaccccaaatcaacagaatatacattcttttcagcaccacaccacacctattacaaaattgaccacatagttggaagtaaagcactcctcagcaaatgtaaaagaacagaaattataacaaactgtctctcagactacagtgcaatcaaactagaactcaggattaagaaactcactcaaaaccgctcaactacatggaaactgaacaacctgctcctaaatgactactgggtacataacgaaatgaaggcagaaataaagatgttctttgaaaccaacaagaacaaagacacaacataccagaatctccgggacacattcaaagcagtgtgtagagggaaatttatagcactaaatacccaaaagagaaagcaggaaagatctaaaattgacaccctaacatcacaattaaaagaactagaaaagcaagagcaaacacattcaaaagctagcagaaggcaagaaataactaagatcagagcagaactgaaggagatagagacacaaaaaacccttcaaaaaattaatgaatctaggaactggttttttgaaaagagcaacaaaatagaccgctagcaagactaatagaaaagagagaagaatcaaatagaagcaataaaaaaatgataaaggtgatatcaccaccgatcccatagaaatacagactaccatcagagaatactataaacacctctacgcaaataaactagaaaatctagaagaaatggataaattccttgacacatacaccctcccaagactaaaccaggaagaagttgaatctctgaatagaacaataacaggctctgaaattgaggcaataattaatagcttaccaaccaaaaaaactccaggaccaaaaggattcacagctgaattctaccagaggtacaaggaggagctggtatcattccttctgaaactattccaatcaatagaaaaagagggaatcctccctaactcattttatgaggccagcatcatcctgataccaaagcctggcagagacacaacaaaaaaaaaagagaattttagaccaatatccctgatgaacatcgatgcaaaaatcctcaataaaatactgacaaaccgaatccagcagcacatcaaaaagcttatccaccatgatcaagttggattcatccctgggatgcaaggctggttcaacatacgcaaatgaataaacataatccagcatataaacagaaccaaagacaaaaaccacatgattatctcaatagatgcagaaaaggcctttgacaaaattcaacaacctacatgctacaaactctcaataaattaggtattgatgggatgtatctcaaaataataggagctatctatgacaaacccacagccagtatcatactgaatgggcaaaaactggaagcattccctttgaaaactggcacaagacagggatgccctctctcaccgctcctattcaacatagtgttgaaagttctggtcagggcaattaggcaggagaaggaaattaagggtattcaattaggaaaagaggaagtcaaattgcccctgtctgcagatgacatgattggatatctagaaaaccccatattgtctcagcccaaaatctccttaagccaacaggcaacttcagcaaagtctcaggatacaaagtcaatgtgcaaaaatcataagcatttttatacaccaataacagacaaacagagagacaaatcatgagtgaactaccattcacaattgcttcaaagagaataaaatgcctaggaatccaacttacaagggacatgaaggacctctttaaggagaactataaaccactgctcaatgaaataaaagaggatacaaacaaatgcaagaacattccatgctcatgggtaggaagaatcaatatcgtgaaaatggccatactgtccaaggtaatttatagattcaatgccatccccatcaagctaccaatgactttcttcacagaattggaaaaaactattttaaagttcatatggaacccaaaaagagcccgcactgccaagtcaatcctaagccaaaggaacaaagctggaggcatcacactacctgacttcaaatacactacaaggctatagtaaccaaaacagcatggtactggtaccaaaacagagaaacagaccaatggaacagaacagagccctcagaaataatgccgcatatctacaactacctgatctttgacaaacctgacaaaaacaacaaatggggaaaggattccctatttaataaatggtgctgggaaaactggccagccatatgaagaaagctgaaactggatcccttccttacaccttatacaaaaattaattcaagatggattaaagacttacatgttagacctaaaaccagaaaaaccctagaagaaaacctaggcaataccattcaggacataggcatgggtaaggacttcatgtctaaaacaccaaaagcaatggcaacgaaagccaaaattgacaaatgggatctaattaaactaaagagcttctgcacagcagaagaaactaccatcagagtgaacaggcaacctacagaatgggagaaaatttttgcaatctactcatctgacaaagggctaatatccagaatctacaatgaactcaaacaaatttacaagaaaaaaaaaacaaccccatcaaaaagtgggcaaaggatatgaacagacacttctcaaaagaagacacttatgcagccaaaagacccatgaaaacatgctcatcatcactgaccatcagagaaatgcaaatcaaaaccacaatgagataccatctcacaccagttagaatggcaatcattaaaaagtcaggaaacaacaagcgctggagaggatgtggagaaataggaacacttttacactgttgatgggactgtaaactagttcaaccattgtggaagtcggtgtggcgattcctcagggatctagaactagaaataccatttgacccagccatcccattactgggtatatacccaaaggattataaaacatactgctataaagacacatgcacacgtatgtttactgtggcactattcacaatagcaaagacttggaaccaacccaaatgtccaacaatgatagactggattaagaaaatgtggcgcatatacaccatggaatactatgcagccataaaaaatgatgagttcatgttctttgtagggacatggatgaagctggaaaccatcattctcagcaaactattgcaaggacaaaaaaaaacaaacaccgcatgttctcactcataggtggaaattgaacaatgagaacacatggacacaggaaggggaacatcacacaccggggcctgttgtggggtgtggggagtggggagcgatagcattaggagatatacttgacattaaatgatgagttaatgggtgcagtacactaacatggcacatgtatacatatgtaactaacctgcatgttgtgcacatgtaccctaaaacttaaagtataataaaaaaagaactaataaataaattcaacaaagtagcagtatacaaaatcaacccaagaaaatcagatatatttttatacattaccaatgagcaatctgaaaaggaaactacaaaaaaaattctatttacaatagaaatagaatttctttattttaaagaataaaatacttaggaattaatttcaccaaggaggtgaaatatctgtacaatgaaaactacaaaacactgctgaaaaaaaattttaggacattaataaataaaaacctatcatatcttcatagataagaaaatttaatgtttttaagatgcccatgctacccaaagcaacctacagattcaatgtaatccctatcaaaatcccaatgatgtttattgcagaaatagaaaaacttatcctaaaatttgtatgaaatctcaaggggccccaaaacaacactgaaaatagaagaacaaagctaaaattctcatagttcctgatttcaaaacttattacaaagctatagtaatcaaaacaatgtgatattggcataaacacagacagatagatgggaggaacagagtagaaaacccagaaataacccttgtatatataatcaaattattttcaacaagagtgtcaagaacattcaataggaaatgaacagtattttcaagaaacagtgctggcacaactggatatccgtgtgctaaagaataagtagaatccttacctagcaccatatacaaaaattaattgaaaatgaatcaaagacctaaacataagacctaaaactataccactcttgggaaaaaataaaacagggcaaaaacctcatgataccagatttggtaatgatttctcagatacgaccaaaaaggcacagagaacacaagaataaaacagacaaattggacttcatgaaaattaaaaaaaaaaacctgtgcatcccaagacaatatcaacagagtaaaaagacaacccacagaatgggagaaaacatttaaaaattacgtatctgataagacattaatatacagaatatatagagaactcctaaaacttaacaataaaaaaatcaaattcaaaaatgggtaaaggactcgtatggacatttctccaaaggtatacaaatggccaagaggcacgtggaaagatcctcaacatcaccaatcataagacaaatataaatcaaaaacataatgagataccacttcacacccattatgacggctattatcaaaagacagaaaagaacaaatgttggcaaagaagtagagaaattggaaactttgtgtatagctaatgggaatgtaaaatggtacagcctctgtggaaaatagtatgaagattcctttaaaagttaaacataaaattaccttttgacccagcaattccacttttgggtaaatactcaaaagaattaaatgcagggtctcaaagaggtgtttttgaacaagtttcacctcacgatgaacgtacacccatgttcatagtagcattattcacaatggctaaaaagtggaagcaacccaaatgtcattcgacagacaaatgaataagtaaaatgtggtagaaacatacaatggaattttattcagccttaaaagggaaggcaattctgcaatatgctacaacatggctgaaccttgagtacattatgctaaatgaagtaagtcggtcacaaaaaaaggcaactaatgtatgatcctgcttatatgaaatactcagagttaccaaaatcacacatctagatagacagtagaacagtggttgccaggggccgaggtagcacacaatggacagttagtgcttaatgggtacagagtttcagtcttacaagatgaaaagagttagggggatggataatggggatgcttacacaactttataaatgtatttaatgccactgaactgcacacttaaaaatggctaagatggcaaattttgtttatgtgtatcttggcacaataaaaataaaactgagggggggaaatgccttgattcaagaaaaagctcaccatatttgagttgaataaagaaggctgaagtttaatgcaccagaagactagctctagatgagatctgagagacaggcaaggaccagatcatgtaaggctttcctggccataggtaagcagtctggattatctgaaaattccggtacttccaggaatttattctctccttcagactagatggtctgacttgacagcgcagagaaagcaagcaccatactctaaagctgcaccatccaacagagtaaccactaaccacacatggctcctaaacatttgaaacgtgggtattctaatttcagttatgctataaatgtaaaatatacaccaaagatcaaggcttagtacaaaaagaatgcaagctattttgttaaaaattcacatactgattacccactaaatatttacatattatgttatgatattaatatattaatgttgaacatataaaatgttaatgtttaatatagtaagtattaaatatggtatttcatattatataatattgttatttattaatatgtgtgatacattatgaaagttaatttcactttttttaatgtggctactcaaaaatttaaaattacatgtggcttgtgtttcttttggacagtactgcactagaaagggtccacaagaatgttttgtgaacactttgttcactgatgtatccacaatgcttggaactatgcctggcgtacagatagcacttgataaataatgaatgaatgggtacagacttgtcgatacaaaaagaaaggagacaccttcatctgatgttcccaatctttctaagttagtggtgtgcagccaaatgtgggggagtgggaggtaggagtgtgtttagggccaccataatggaccactacagacggtgggcaaggtggtggtgctgtcatgtgcacctagcttttctcgtctgtcctcatcctccactctttgtataaagactaaaaagcttggggtgttaataaaggcagcatcagcccataaaattgtgtcttatttagttacttcagtacagacctttttagttacctagacttcaatttttatctcttaacattctatttccaaccaataagtcactaattttctattaactctgatttgttatctctgctcctgtaccctatatatcactgctctactaaagaatgttcagaattaaataaactgactgtacttcagggtcttaggatctgtctgattttaatgctataaagccactggacaaatccacagcaagtctaaaggaggattttccagggatattatactaattcatgaactgtctggctttgctcaatgacttgaaagggtcattccaactctatgattctatgttatcaaagtatcttcatgtagaggcaatcttcactaaataaaattctcactcatttgggcatcaatctatgtgttcatttagtaaatatattcttgactggctctaccacagcgctgatactcttcaaggtgctggatatacacggacagggaaactgataatcccagtcctaatgagcagacaagaatatctgagggcataacctgaatttggctctgaactgttaaaggtggagagtgcagatctgaagtttatacagcctctctttcattatgcttccctttggtaacaaatccctcccactacttcagagagtcaatgtcttcccattcgcttcatatcctccttaatcaaaaaatgatgcaatatccagtcattcatacaagtacatgaatagagcttaatttaaatttattttaacaacccaatttagtattaaggcttataagcagtatctgtactttaagacttttaaattcaattatgaaatgaaaggttcctatccctcaataaaatcactttaaacaacaataaacaggtggagaaatattttctagaacgtaaaggcatactgttgtcttaaatttttatatttatttacagtttataaaaagtattttatgtgatttctctacttaagtaagtaagcagaaacacttattattattccttttaacagacgaggaaacgaattcagagaaattaaatggactaccgaatgtcatacaactactaagtagcaaacctcacatttcttcaacaatcaatattacttccatcccaccactgccagatgtcacaaacataaatatatgaattagtctaatataagaaaaactggggccaggcacggtggctcacgcctgtaatcccagcactttggaaggccgaggcaggtggatcacaaggtcaggagatcgagaccatcctggctaacacagtgaaaccccgtctctaccaaaagtacaaaaaaattagccaggtgtggtggcaggcaccagtagtcccggctgctcgggaggctgaggcaggagaatggcatgaacccgggaggtggagcttgtagtgagcatagatcacaccactgcactccagcctgggtgacagagcgagactccgtctcaaaaaaaaaaaaaaaaaaagaaaaactgggggttttgagacttgttctaagtgtgatattcaaaatatctgacagtcattaaagcaaatgtctaattagaacagttgccaaccacaataccaaccaatcaaaacagctaccagtggtaaacaacagtaagaacagataccagccataaataggcagtaaaaaaaaatcatccctgaatatcagacagagtacctgccccagctcagcattcaaatttaaattattttcaatggtatgccagccaaacaaaacaaatatacctgttaatgaattgtagaagtaagcacactcacctggccaataatttttttgattcctttcaccctgagtacattaatgggtggctttatgagcattttattgaaaacagatgcttaattctgctaaaacaaatatataaatcaaagatttaaacattttaaaaatacttagaagaaaaccaaagtaagtttcaaatcactaagcaggaaagatagtttctaatcaaaaaaagcaaagaaagaattatgagaacttattagttttgtctacacaaaaacttaaaatacataagcttagaatacatacaaggttctacataaccttagaaaactcagaaaaatagccagttatggtggcacaggcctatagtctcagctacccagcagactgaggtgggaggatcacatgagcccaggagttcgttcaagtccaggctgggcaacatagtgaggcctcgtctctaaaaaaaactaaataaatttttaaaaagaaaaaaatagtcatagcaagatattaatatatataattatttatttagaacatagagctcatataaaaccttcagaaaaacaataaaatctcaataaataaacaggcctaagaaatgaatataaaattcacaaaactaaaaaaaagagctaattaacatacatggaaactactaaactgctctaattatcaaagaaaggcaaattaaaacaataaagtaccaaatataaaattaccccaggggttacaatattgctgtgaataacagcacatatataaccagaatgtaaaccagagtgtaaaagtgacataagaattcagaagtattttccaagaagcactaggaaacattgatccactgaaaaattatttattgagcacctactctagatttaatttttttttaaatctctaacctaacctcatggggctccaatctagcaggaaatacagacttagagactcataaatgatcataaaaagctctttcaaagtgaaacataaccaaaaaggagtgcaattaattaggaacagatagaggaagtggcattaaaatcaagctttaaataaaaaaagtagctcactatccagagaaaggaaagactactaatagagtaactcaaataatgaactaaagaatagaaatataacaattataaaatggcactcagaaaccaagtaaggcccagttttcttccttccactacaataagaaaaatgacaaaaagcgatagtccaaatttcagccttgtaccaaaacggagacaaatcttagcaaatttggaagataaatgtttacttggtctcttttaaatatcaatggtgccaaatgaactttggacaagagaaatatctgtatcaaggtttaaggtactctacaagtattgtgtgtcactaatggaaaaggaggagagtggaaggaaataagaacgtatacttagtggacaccatacagcaggttctgatctagatgtttatatcatgctcatttcatgtcatttggacatatgttaacctttttgttattaaaaaataaagaagttgacagtcattttcctagatagatggagttttgttttcaaataatctctagctgttttaacaaatttcattcacatataagcacagccaattaccaaaagtagctagatttttatttggcaacaaagagaactacttctttccattgtgacataaaatttaaagcagtacctttctcatatctgtaagacttttcatgaggctggataggtccatacccaactatttcaaaatggtcagatttatactgaaaacaccaagagggagaaaacacatgagagaggatctgcttcatatagaagaaggtaatgtaagaattcagctccaagatggaaaagcgttagatccattctcaaatcacagctagcacttccttcagtggtatctgttaagaatcccttaaaacaaacaaaaaaaaaattgtggacaccattgattggaatacaaaatattttatcaacagaatacttcatttgtggatttaattaggttatcctcaatacattacagatttcatttcatttaggtcactatacaaatggtgcgatgtcatttttaaatcctctgaatcacattttatagtctgttttgctgtatttttttaaagaagggtggtagagagataataaaccatgaatgaaatactcagcaatcagggataaaagtaagacatttatagctgagctaatacgttaaaagatggaagtctacatctggtttcaattggtatgaattcactggcaaatttaagaagaatttcattgtacgaaaacaaaaagatggttttgataggctttagtcctctggttacttttgtttctttagtcacatgattagtataataatatgatacatttaatatgtcactgtgtatatggttttgataaaaatacacccaccaacttgtctcaagggcacatgcacaaatggttttaaaatacatatactgccttaatgtttttagatcagtaaaaatgaattcaagtgaggttttaagttcacacaaaattaagaattttaattttctaataagtctttcgcaatgttagctaaacaccttttggacataattacttatgcatataaaatgacgcattaattctacatttaatacctattagatagtaaggatacaaaaaattagacatacgccccccttttcaaatgccataaatagataagtacaggtacttcatttaagttttactttcataggcacttgcataaggtcttaaaaattgatcgaaactcaccaatgtaatccttacacagtcttttaaggcctggatcaaactttgcctctttcaagaaatcaccctatattcctcgagtcaggattaatctatccagtgttaacaatggtgataacaataacagcttgcatttattgagttcttactagtcagccactccacaggtttcatttcatttaacacccaaacagaactgtagaaggtaggcactaacaaggatttactgaaagtctgttacatgatcactgtcttcatgacactcagaattttgtgggaagggaataggaacaattaattacaatactaagcgatgcctgcaacaacaggattagcaataggagcactccaggacagcagttcttaaagctgattatgcataagaaccagtactcttaaaatccaaaccatctaatacaacatttaaggccttgaatgatacaattcctgccagcctcgaccatctaccttaccattctaccactcaggaagggcttcacagagatgacttttgagctgactctaaaagagtgaacaaagtttatcaggtgaccaaagagggaaagatacataaggcatgtgcaaaggcactgagcataaaaatacataaagtgcattaccaatgaatagttctttgtgtttgaacatagtgtgtatggtaaaatagtgcaaaatgggaagtcagattagggccaaactgttttacacacccacatatttttaagtggaaagatgacatgatcatatctgaacttttaggaagaaaactctgacagcaggctctcagacaaagactaaaaggaggaaaacagaagtggagaatttaataataaaataattcgtaaaaataacagtagtagtagtaggagtaatagtaacaggtctataaccttgcttagaatcctaagagagacttgtgtggtagaattaatagtgaacaccttaagcaaaattattcagaagacgaagaagagtcagaccatgcagagaagccaaaaggtgccaaaagcaaaatccatctttcctaatttacgtaggtcttaaagactatctagagtcttttcccacaactgaaagtgccttagcactaaagaatcatatattgcttagttagcatcctctcagttctcccaaaaaattgttataaaaaatgaacatgtcctttgactcagtaattccatttcattaatacatccaatgaccacaacacaaatatgccaatacctatgtacaaaagttccctgcagctttgagtgtagcaataaaacattaaaaagttagaagtcactttcatccaggagactgaaaaaaatacattctgttacacacacataagacctatatgtactggtatgggaaggtatctaaaatatatcagaagttgaaaatgaaaaacggtaaggtataaaacatcacatatggtattaatcccttgtgtaaaacaagatatacatacatatgtggtgaaagaatccacaagaaattaactgacacaacctcaaggaagtaaaattgaagggtagatgtgaagacattaacttcctcttttgtacccttttgtattatttgaaatttttacaatgtgctcgtgttatgtttttctctataatttatataattaaaaggaatgaagcagttaaaagtacactctagttaaaagtacagataattatgcaacgcaattttagaagatctccatataatactgttaaaattagaaatttgccatccaaggaactaactttccatttcctggaatattaacttatatatatttcttgatttcctaagattaaacaaaagtaagataagacacaatgatcttttcatatgttttttctaatgctgaagaatatccactatttcaacaaacatcatacaattcttaaatcacttgtgatttaaaactaaataccactttttaaagtttttaccttaacagtaaaaagtggcaatttacatttgtatagaactttacaggttacagagtcctctgacacttaccatgtttttttcccacaagaaaacactgatgtaggtaaagcaagtaatatgatattagatcaatttcaggattaggaaactgaagctgagaggagttacacaatgtacccagggtcacagagctaataagtaacaacccaagcactgaagcttggtcttcctgctccacatccaaagggctttccactaaaccacatcactccaaataaccactgttacagcgtgctatggggtcaggcttctgacagggaagaagggctcactacagatctggcaatgacaggcagtctgcctgcagaggaatgtacaatacaaaaataaagtgtatgaaggtgggcctgactgacgaaagggaagtagaactgggagaaatgccaagaagaataacaaaggtgaaaactgggcaacttaccaataagggaagccaaggaaatacctttgtaaacttaatttacttagttaaggtagaagggatagtctatgtaggggactatatattataatgtggaaaaatcataaagtgtttataattcaatcaaaagatttagaaaagatgtaatgaagcgtgatgtgtatgctgtatttaatcagagattacaatgtggcagcacatgactgccatgaaaattttaatggtctaatcccacaatgcatatcctgttaatgttgtggcttagaactttaagaggcaagtgtgaagtacactcagaactcatactcactccatgggacacccgaaataaggagcaaaaagtatcactttctacacaaaagaactcattctcctaagattctagtacagcactgatcattagtacccactcagagtcagaaaatccttgtaagaacgggccagggacaccagaaataacaccaggatcaagccatcctggactaaagagaaccatgggtctttccactgagtactttccaggaaaatcctttagcaaacatttactgctgacctagcaggaacaggctccttgagaaacatcaaccttactgtcccttactgtgacagaaggaaaaaagagatgggacccaaaagctttgactcaatgtcaccagatgtatcttccacagtttaagattcattttgtgagctattttagagtttttaaattattgtcctttattcctggtgtgttttgaagtttagtaaatatatagaaacatctattattttttgccagtctagcactcatttgctcttctcctgctaaacatattctgatttccctctaggaaatcactacttctccattctcagaccatgtatttctggtagtcaagtctaccctagctccagattgaacatatgacctaggtctaagtcaattactaaatcacattgtaatggccacaatgatttgctcagagaagggcacatgacccacgcagaggcacaagattatcactcttttctgctggatttcaactagaaagatataacccagggaactgctggcagacatcttgtaactgagggaagagcttgtgtgagtgaggccaagaaagaggtatcagaacaaaaacatgaattcaagtaattcctctcaccctgaatcaagccatgcacaaactaactttgcaatgagcaagggttatgtgaacaaataaattccctctttggcttgagctggcttaggctgggttttctgtaacttataaccaaaagttgaaactgattcagtaaacttgaagtaaataccaaacaggagaagttcttggaaaagaggtttgtgtaaagcacaaaccactgactaactccagaaatgctagaggttattccagatgtataacagctttagatgtctgatctattttctactttctggcccatcaaaaaaagggatacaataattggcggaaagaaaagtagaataaacatattttttaaaaggaacatgcacagtcatttttttaaagtctcctgctgccttcattttcctactagcacctcccctagctagtttgtcattgtattcatttgcatttgatttctcattttacggaactctcagatgtttcagtttccattcatttttatggcataatcaactcacacaatagttaccaaaaccctttacagaaaaatcaatggtttcgagaaacttggtgaatatgtagcaatttctgaaatacttaaatctcaaaagtaatacttaagcttacatgtaagattttatctgatcattcatcaagcttcatattccaacttcttaacaaccaaaatttctccctgccccctcctcctctcctaggataaagaatacacacattaaattggggctcccaggtatcctggatgaggaaaatactctgggaaaaacagcacagctgttcagttaactcccttctaccctcacaaatctatttcattccacccccctaaagaagagacttgaaaatataaaatatccaaggttataaacaataaaaaaagttatggaatttgtccagaaaaacacaaatcttctgttcaacacaaagtacatacattaggaaaaataactagaatattttaaccattattcgagagggcagagagaggttgtctttcatgaaatctggattgcacatgtctggcaaggaaaaaaaagattaataatctatcacaaagccccacaactagtgattcaaaatgaaagctttcactacttacaccatatgtaaatatatatatatacaagctgcttataatcccttgatctgcagagaaagagaactgatactctactgtgaaaatggtcagtgggtacacattttaaaatcctttcccacatgaaaagattcctgaaaaagagatcagaagacaacagaaaagcactcaatatatatggagttgtaaatccagtatgaaccagtatctattacacaaaggaggaacatgcaacaaagtgattaggaaagtcaaacatgaattaatctaataacacaaaggtaaatataaaccccaaagagcactttattgaacagaaatccacacatatcaaaaagatgtctactattaacaatgacatatcaagcttttaaactccaaattaatcttaataatcaataatgcaaacttgatatgcccttaccaagaaaaaaaagtttgaagaagcacttaacatcaaggcagaacatatacatatttttaaaatataacaaaccaaatgtttaccataaaggctattacatgcaaggtattgattctaagggcacttggataaaatatgctagtatattttgaatagccactgcttgactcttttatttatttggttatttggttatttatgtatttatatgtttattgaggtggagtctcactctgtcacccatgctggagtgcagtggcgagatctaggctcactgcaacctctgcctcctgggttcaagtgattctcatgcctcagtctcccggcagctaggattacaggcgcatgccaacacaccaggccaatttttgtatttttagtagagacggggtttctctatgtcagccaggttggtctcaaactcctgagcccaagtgatctccccgcctcagcctcccaaagtgctgggattacaggtgtgagccacctcgcccagccaccaccgtttgattctattaaagaaactaacactgtacctaaaaatgtgaggtctatgttatggaatgtatactttcttcattaacaacaataattcaaagtaccaaagtaccaatggtgaatactaagattctatccttggttctatagttctctgcattcttctacccaaatacatctggtagatgatcatgtccaaaatgcaaagacacttttatctacctaagtgagatgataggataaggatgacaatgtcaaaagcaaatatatatagggccacttatgtgccaggtgttattctttaaatacatgtaatctttataacaactcatatcttgtcccatatatcagatgaagaaattaagtcacagagaagtttaaaaacttgcccaagttcagagaggtagtatgtagcagagccaggattcaaatcctggcagtctggctccacatttcatgttctcagctcaattctagtcttcagctataattccaatcctttctttccatatcactacttaacctccatatgtttccatttctcatctggaaaatgggtcattaatagttcttacctcatagagttctccaatcctcatgaggattaaatgccataatatacataatgtatttagaaaagtacctggcacataaaagtaatacatatttctgttgttattttatctaccaaatgtctgtcactggagttgagaaccattgttctaaaactgtaacagtgagaatttaccaagcagaatagtcttaatgtgcccttacactggtaactaaagaaaactggactttctcaattattttcaatataaaacaagtccaccaccagccttcaagaaaatatacaaatcatttaagagttgctatcttcagtctggaatttcttctccattattttgtgttccctcacacccacccaatattacagaaatagatctcatcctgataaaggtatatagtgaaaatgtctcttatatatcaaactgaatgtttatacaacttttaagacataaaggccaggtgtggtggctcatatctgtaatcccagcactttgcgaggccgaggtgggtggatcacctgaggtcaggagttcaagaccagcctggccacatggtgaaaccccatctctactaaaaatagaaaattagccaggcatagtggtgcatgcctgtaatcccagctacccgggaggctgaggcacgagaactgcttgaacatgggaagcagaggttgcagtgggccaagatagtgccactgcactccagcctgaacaacagggcaagactccgtctcaaaaaaaaaaaaaaaaaaaaaaacacctgtgtggtattttaatgtaattctcatctatacagctggatgctgggtactcttgaatcagaatactactcccagagtttggcttcacgaaagagctacaaagtgtgaagactgagggaactacaaccatcctttaacccagggactaacgctgatcgacatttaaatatgcttctattaatagttttctgttgtgacaacactcttgcacaggccccactatacaattgtgccaagatttctcaaaagtacagaaggaggaggaaaaccactggatagagcctagagtacatacatattcaacgacaggagattatcaaattactctttgaagtagttgtactaatttaaattcctaagagtatgatagcatatagagtatatataaggcacaagtgagtacaataaatttggaagcatttctatggagaaggtcataaccaagagcagacaaagaagtgatctaccaagtaaaccccagaaggactccaagcttagaaccatagggtagggagagcaagagggaaagggagttcactttttcacggaagctgtaaagaagaaaatggaacaagagttggctccttgaccccagtctgcccctgctcccatgtacatgcagattacatgaattctggcatttatccccagatcaaaaaaaaggggaaagggttcctctctaaagaaattcagggggccgggcgcagtggctcacgcctgcaatcctagcactttgggaggccgaggtgggaggatcacgaggtcaggagatcaagaccatcctggctaacatgatgaaactccgtctctactaaaaacaataccaaaaaattagccaggcgtggtggcagtagcctgtagtcccagctactcgggaggctgaggcaggagaatggtgtgaacccgggaggcagagcttgcagtaagccgagatggcgccactgcactccagcctgggcgacagagtgagactccgtctcaaaaaaaaaaaaaaaaaaaattcaataaaaacctgttgtaggccctttcccttaaaagctagctcccaacccattcaccctaatattatgcctgtcagtcaaaaggcattgtcccagtgcttacggtgagacctgagcagccttccagtcccaagggcaagaccagaataaataaaacaaggaaatccataaccctagaagaaacagaaatgattcaggaaacagacaatagcatttatttaaaaaacgtattattcttaaagcaatttcaaaagcttttctatccatgtcagcatcaatatgttatgaaaaaggaataatcaaaagagttcttgtaattaaaatataactgctaaaataaaaagttcagttagaaaagtcagaaaataaagcaaaataaagcaccccgcctcctccaaaaggcaaaaagacaaaaagagacggataatctaagaggaaaaacaaattcaggagattcaacctttcaataaagaaaatagaaattttccaaagctgaagacagacaattgtttatatattaaaaggaactactgaatgctgagcataactaataaaatggactcacatctaggcacattcttgtgaaatatcagaaacgtcaagataaaaagaaaactccagaaatttccagagggggaaaaaacctacaaataagtaagactctgacagccattagcaacactagatgttagaagataaatggaggaaagtctcaaagctctgagagaaaattattttcactgtaaaattctacgtaggctatcaaccaagcataaaagcaaaataaagacattttcagatatgcaaaggctcaaataataattgaccccttattcttgtatcatgaagaagacagtttaggaagaatacaaaacaaaggtaaaaaccaagaaaacaggaaatatcctttttttaatggtggcactaacccaagagtcaagtgaaaagaaattctaaggatacggctataaaacagacctcaaagcaataagtccacattagaacaagaaatcaggaagctccaaagaaatctcaaagaagaatcacatacatttcaggaaataaatacactgagtaagaagctcaaagatattaccaaagggataaaagatgcatacattgcttttttcaaaataacaaaaaaagaaaaaactcccagaaacagaaaattatataacaacatgatcctaacatagagccatcaacctaaaatgtggcaatgattttgagtaattaattgtgagaaaagtaaatccatttagaccacatgctgggaacattcttctttgggtaacctaggggtacaacactggatatttagagacagaaataaaatttgagcatatcattgtttcctcttccaagatgttctttgccctctcttctctgacttactcatttattcattcactctctcaatatttactgagcacccatcctaggagctaaagataaaacagtgaacgaaaaaagaaaaacacctgcccttttgaagcttatattcaataactcctattctttcaagaatctgctaaagcaggagtccccaacccctgggtactggtccatggcccgttgggaactgggccacatagcagcaggtgagtggcgggtgggcaagcattactgcctgagctccacctcctcctgtcagatcagcagcagcattagattctcataggagaataaaccctattgtgaactgcacatgcaaggaatctaggttatgcactccttatgagaatctaatacctgatgatctgaagtggaacagtttcatcctgaaactatcacccccatccgtagaaaaattgtcttccatgaaaccagtccctggtgccaaaaaggtcgaggaccactgtgctaacggattctctcaccaatgaaactttttctaaattgttaggctatgtgcatctccttttttcctcctaaagaactctaactctttgcaaaacagaatttggctttttacatacctattacctcatctagtgtgtgaagaatgcaagacagcaacatttattagttatttgtacttctagtgaacagcactgggcctaaatcaataaatgtgttttgaacctttccattcaaccaaaatgtaaataaaactgctgtattcatccactctcacactgctataaagaactacctgagactgggtaatttagaagaaaagagatttgattgactcacagttccacaggctgtacaggaggcatggctggggaggccatggagactcacaatcatgacggaagggcaaaggggaagcaaacaccgaattctcatggcacagcgggagagaggatgaagggggaagtgctacacactctcatgagaactcactatcacaagaacagccgggggaaatctgcacccatgatccaatcacctccaatccacctccatgatccaatcacctcccaccaggtccctccccgaacactggggattacaattcaacatgagatttgggtgggaacgtagagctaaaccatatcaactgacaagtaaaatgtaaagcactaggcaaatgttacttattacttaacagatgaggacactgaagtccttgtcagttgaatgatttgctacagaccacaagactagtctgtagaagaaccaaaactaaaacccatattgctgaaagcctgggttcatgccgtttctcctatactaggttgaatgaaaacaagtagtcaaatcaaaaaatgggcctaaatgggaaagaataaccttaggcattttcttagaatgtttttaagtatacaataaacatccaaaatatagactctatttcttccatatgtcaagacatagctttacaattatgtaaagatcatttggaaagcctctaatcaaaaatctaacctatcttttaagagcttcaatttcacagagttatgcatttctactctgcagtatatgtttgaaatgcataaatgtttcgagatgtttaacggcatttaatataatataaattggtttttaaaaaatttcttcatgggaaaccttcaaaacttactaccacaaatatactaaagtttttattcttttaaaacttgaaaacacttgactcctcaaaaaaaaaaagctcatattaccttacacaaacaacaacaaaaagctttttcatgagtcacagaaggcctatggttaaaattatcaagatacacatttttaaaattaagcaaaaaattaaacagacacatatataacttttgtaaaaatcagggaactaatgaaacattctggtatttcacacatgccaaggttactagtaagcatactttttatggcttgtctttggtatatgaccatatttgttcagcaatccacattattaataccgaatagtagccatgcaaattataacttatccacaaaaatataacactgaataaagaggtagggtaattttatattcacaggacaagaagccaaaaaattggctgtttcagctcaacatttatcaaaggcttgtaggtgccaaaagctattctaggcacttggaatatttcaagattaatatattaaaactcctgggcaactgcaactactcttctcccaaacactaaaagctgactaattaaatgtaactcccatatataggataccatgactgggttatctacaaagaagtttcatcaaacttaaaagatagtttaaaatactgtgaaaaaatcagttactgaatgtgaatgatacgaggacttgagctgtgtttgtgagtctgatcacaaaaatcagaaatttaagtcacatatactattttatagagccccaaatacttaaaaaccaaaaggactcaatgaatactaatcttacagtgatttttactcataatgtaaccagaagagtcagagaaacttttatcacccattagaatacaggagttttacctttttcctaattctagtaccactaccattaattaccacaattcgttaccagctcaagtgccaactctgtgatctggcccatgttgagtaagaatcagcacttaaatagacaaaatctctaccctttacaactcagactcagttacaatcactggaatatgtctaattaacccacaacttaattctatgccttcatcttttcctacatgtttcccaaaggaaaagtatagatcagattttgaaggtccttctttaatatctatgctgacaatcagataatttgttttatgacttttaaaatatgtgaagtactcatataactattagcaaactgtcaagcaataaaacataaaaaaaaggccaacagaaacaacaaacagcaaagaacaggcacaaaaagaacatgaaacagccaatacaaatatgaaaagatagcctacctaatagtcaaaataaacatcatcatcacagtaaaaatagcatttattgtgctttctttatgtaagagtgaatatgcaataaacacccaattaattaatcaatgaattactaaatagacaacaaactacctgagaaaataagcaaattttcaaataagaggtaacattttcagctgggccttcatggatgcaaatacactaggcaaagactgggggtagggataacactaaaagaagtgcagaggatgaggcaagggcatacatataatcaccaaaatatgaagccagttcttattctaggagccagttctcattgtaacactgaactggaaagtacctgataaaacagtgacaaggtatgaaactgtacaggaagaaaggaggtaatacataaactctgtttatacatcaggctaaaaaatttgaacttaaatgttttatttaaaagacatgtaacttaattggacttgctctttcctgtgccttttattttcaattttcaaggaaatatttgttcaaaaatagacaatagtcaataattcagaatcaagaacgctttacccctaataagatttctttcaaagacaagcacaattccacacacaaaataaatatgttacttaggtggttctccaagacttactactcttaaaacaaattaaaaatttagaatctattgtcaactccctaaatcatcacataattttgtttcttctctataataaatgaagctcactatatataaatatgtacaaatagaatatgcaaattatacatagacaatatccagaaagtttctaataatgtaatctaaactgtccattactctgagaaagcttactattaatgtggttaatatatgtagtatatacataatcaaatgaattataaagttaaggtctcacatcagaacaggattatgctgtcacaacaacatccatctgggtccacttgagcaccaatccaaccttgttctcaacctatattttatagtttttattaacaatttaaagataagcacaaaacaatttcagtaatcatgtttttatatctttttttagatttataaaggttaaagctgtcaataaagttttacatccacagatcatacatgaattcatttaagtgaatataataataagaaaagtcaattcaagggctctacctgacatacccaaatgaacaagagtaaaaagagatgcaagcaaatgagtaaaccagtatctgagatactcactccaaggaaaaggccccaaacataaagcatgagtttcaaggacaagataaaactcctaaaaagagattaagagaaataaatggggtactaggcaagaataatacaaaatgtcacacaggattattaactggattacaaaaaaggtacatgaatagaaaataaataagcaaatgactaattagtaaaatcaaggaacagggtcagaggagtaacaacggtaaaaactgctatggtgaataacaaaaatatatgagatacagcattcttagatactagcattagccgactagaaaatataacagcaacaaaagatcattcacattagcagtaaaaatgacaaagctcctagaagcaaatcaaatttaaaacgtatataattttctttttcttttttttttagatggagtttcactctttcgcctaggctagactgcagtggcgcaatctcagctcattgcaacctctgccccgcaggttcaagagattctcctgcctcagcctccagagtagctgggattataggcacctgccagcacacccagctaatttttttgtatttttagtagagacagagttttgccgtgttggccaggctggtctcaaactcctgacctcaggtgatccacctgccttggcctccagaagtgccaggattacaggcgtgagccaccgcacccggccgaatgattttcaagaggatttaaaaatgcatttaaatacaaaaaagaagaactgaacacaaagatattctatgatcatgcattggaaaatattagttaacacaaattatgagttaaatgtaattccaatcacaaacccagcaagactttttgtggagcttgacaacttattctaaaacttatgtgaggccagacacggtggctcatgcctctaatctcaacactttagatgaccgggtggatcaccccacgtcaggagttccagaccagcctggccaacgtggcgaaaccctatctctactaaaaatataaaaattagctgggtgtgatagtgggtgcttataatcccagctactagggaggatgaggcacaagaatcacttgaatctgggaggcggaagttgcagtgagccaagatcacgccattgcactccagcctggggaacaagaacgaaactccgactcaaaataaaataaaaaataaaataaataaataaataaaacttataagagagatcaaggaaaacaaagacaagggaattgcatcccaaacatcaagcacgccaccatataattaagaacatatttctggatccgggagccaagatggctgaataggaacagctctggtctacagctcccagcgtgagcgacgcagaagacgggtgatttctgcatttccatctgaggtaccaggttcatctcactagagagtgccagacagtgggcgcaggacagtgggtgcagcgcaccgtgtgcgagcctaagcagggcgaggcattgcctcactcgggaagcgcaaggggttcagggagttccctttcctagtcaaagaaaggggtgacagagggcacctggaaaatcgggtcactcccacccgaatactgcgcttttccgacgcgcttaaaaaacggttcaccaggagattatatcccacacctggctcggagggtcctacgcccaaggagtctcactgattgctagcacagcagtctgagatcaaactgcaaggcagcggcgaggctgggggaggggcgcccgccattgcccaagcttgcttaggtaaacaaagcagccgggaagctccaactgggtggagcccaccacagctcaaggaggcctgcctgcctctgtaggctccacctctgggggcagggcacagacaaacaaaaagacagcagtaacctctgcagacttaaatgtccctgtctgaacagctttgaagacagcagtggttctcccagcacgcagctggagatctgagaacgggcagactgcctcctcaagtgggtccctgacccctgaccctggagcagcctaactgggaggcacccccaagtaggggcagactgacacctcacacggccgggtactcctctgagacaaaacttccagaggaacgatcagacagcagcattcgcggttcatgaaaatccgctgttctgcagccaccgctgctggtacccaggcaaacagagtctgtagtggacctctagcaaactccaacacacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagtgcctctcctcctccaaaggaacgcagctcctcaccagcaacggaacaaagctggacggagaatgactttgacgagttgagagaagaaggcttcagacaatcaaactactccaagctacaggaggaaattcaaaccaaaggcaaagaagttgaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagacgaaataaatgaaatgaagcgagaagggaagtttagagaaaaagaacaaaaagaaatgaacaaagcctccaagaaatatgggactatgtgaaaagaccagatcttcgtctcactggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttaaaatgaaggaaaaaatgttaagggcagccagagagaaaggtcgggttacccacaaagggaagcccatcagactaacagctgatctctcagcagaaactctacaagccagaagacagtgggggccaatattcaagattattaaagaaaagaatttttaaaccagaatttcatatccagccaaactaagcttcataagtgaaggagaaataaaatacttaacagacaagcaaaggctgagagattttgtcaccaccaggcgtgccctaaaagagctcctgaaggaagcaataaacatggaaaggaacaaccggtaccagccactgcaaaatcatgccaaattgtaaagaccatcgaggctaggaagaaacggtatcaactaatgagcaaaataaccagctaacatcataatgacaggatcaaattcacatataacaatattaactttaaatgtaaatggactaaatgctccaattaaaagatacagactggcaaattggataaagagtcaagacccatcagtgtgctgtattcaggaaacccatctcacaagcagagacacacaaaggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtagagggatcaattcaacaagaagagctaactatcctaaacatatatgcacccaatacaggagcacccagattcataaagcaagtcctgactgacctacatagagacttagactcccacacaataataatgggagactttaacaccccactgtcaacattagacagatcaaccagacagaaagttaacaaggatatccaggaattgaactcagctgtgtaccaagtggacctaatagacatctacagaactctccaccccaaatcaacagaatatacatttttttcagcaccacaccacacctgttccaaaattgaccacatagttggaagtaaagctctcctcagcaaatgtaaaagatcagaaattataacaaactgtctctcagaccacagtacaatcaaactagaactcaggattaagacactcactcaaaaccactcaactacatggaaactgaacaacctgctcctgaatgactactgggtacataatgaaacgaaggcagaaataaagatggtctttaaaaccaatgagaacaaagacacaacataccagaatcgctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcgaaccagaactgaaggaaatagagacacaaaagactaatgaatccaggagctggttttttgaaaggatcatcaaaattgatagactgctagcaagactaatgaagaaaagagagaagaatcaaatagaagcaataaaaaatgataaaggggatatcacgaccgatcccacagaaatacaaactaccatcagagaatactacaaacacctctacgcaaataaactagaaaatctagaagaaatggataaattcctcgacacatacaccctcccaagactaaaccaggaagaagttgaatctctgaatagaacaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaattctcccaaactcattttatgaggccagcatcatcctgataccaaagccgggcagaaacacaaccaaaaaagagaattttagaccaatatccttgatgaacgttgatgcaaaaatgctcaataaaatactggcaaaacgaatccagcagcacatcaaaaagcttatccaccatgaccaagtgggattcatccctgggatgcaaggctggttcaacatacgcaaatcaataaacgtaatccatcacgtaaacagaaccaacgacaaaaaccatatgattatctcaatagatgcagaaaaggcctttgacaaaattcaacaacgcttcatgctaaaaactctcaataaattatgtatcgatgggacatatctcaaaataataagagctatctatgacaaacccacagccaatatcatactgaatgggcaaaaactggaagcattccctttgaaaactggcacaagacagggatgccctctcaccactcctattcaacacagtgttggaagttctggccagggcaattaggcaggagaaggaaatcaagggtattcaattaggaaaagaggaaggcaaattgtccctgtttgcagatgacatgattggatatctagaaaaccccattgtcttagcccaaaatctccttaagctgataagcaacttcagcaaagtctcaggatacaaaatcaatgtacaaaaatcacaagcattcttatacaccaataacagacaaacagagagccaaatcatgagtgaattcccattcacaattgcttcaaagagaataaaatacctaggaatccaacttacaagggacgtgaaggacctcttcaaggagaactacaaaccactgctcaatgaaataaaagaggatacaaagaaatggaagaacattccatgctcatgggtaggaagaatcaatatcgtgaaaatggccatactgcccaaggtattttatagattcaatgccatccccatcaagctaccaatgactttcttcacagaattggacaaaagtactttaaagttcatatggaaaaaaaaaaaaaagagcccgcatcgccaagtcaatcctaagccaaaagaacaaagctggaggcatcatactacctgacttcaaactatactacaaggctacagtaaccaaaacagcatggtactggtaccaaaacagagatatagatcaatggaacagaacagagccctcagaaataatgcttcatatctacaactatctgatctttgacaaacctgagaaaaacaagcaatggggaaaggattccctatttaataaatggtgctgggaaaactggctagcgacatgtagaaagctgaaactggatcccttccttacactttatacaaaaattaattcaagatggattaaagacttaaacgttagacctaaaaccataacaaccctagaagaaaacctaggcattaccattcaggacataggcatgggcaaggacttcatgtctaaaacaccaaaagcaatggcaacaaaagccaaaattgacaaatgggatctaattaaactaaagaacttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaagtgggcgaaggacatgaacagacacttctcaaaagaagacatttatgcagccaaaaaacacatgagaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttgatgggaatgtaaactagttcaaccattgtggaaggcagtgtggcgattcctcagggatctagaactagaaataccatttgacccagccatctcattactgggtatatacccaaaggactataaatcatgctgctataaagacacatgcacacgtatctttattgcagcactattcacagtagcaaagacttggaaccaacccaaatgtccaacaatgatagactggattaagaaaatgtggcacatatataccatggaatactatgcagccacaaaaaataatgagttcatgtcctttgtagggacatggatgaaattggaaatcatcattctcagtaaagtatcacaagaaccaaaaaaccaaacgctgcatattctcactcataggtgggaactgaacaatgagaacacatggacacaggaaggggaacatcgcactctggggactgttgtggggtggggggtggggggagggatagcattaggagatatacctaatgctaaatgacgagttaatgggtacagcacaccagcatggcacatgtatacatatgtaactaacctgcacattgtgcacatgtaccctaaaacttaaagtataataataattaaaaaaaacatatttctgttgcagaagcaggcaaataaatctctgctagaacagacagaccaaatatagagacaaatatatacataactttagtaggacaggcttataagccagttaaaaagggatagaaaattgtgttaggacaattagatttccacacagaaaaaaaaaaaagtgctgtatacccctatctcctatcatatacagaaataaactccagctagattaaagatgtaggtaaaaagccagcctattgcaagataagagtgacaccatttcaaagcaaaaccaccataatgacaggagtttggctccagcagcaaggtctttaaacaatgcctgtagcatagacaacccctcataaagatgtttatctaacctctccagtggtcatgagtagcaacaaagtctgaggtgtaaccagctgcatatgttttaccaaaaaagcttgctatataaaggatattttcgggagggtggatgtgggaatacaccacctcttggccacccaaaacattatttctgtttgttagtctgtaataaatgtttttttataagaaactggatttgtcagtgtctttcttcagctctcagctcccttagcctttgggggtagctttgcatatgtttgctcatagcagaacagaactgctaataacaaaacttgtactatttgaaagagttccacttctggtagtgataaactagataattcagaccactctcctgcttaaagaactaaaatgtctggagaaaatacatttaaaagtctatgttaaggctaatgaagacacacgagcagtgtattttgtctgaaaacaaaatattaaaaaaagaaaaaagaagaggtaagcctagcaataagggctgcttttccccaagaggcatctatcaattatggaacagaggccaagaggctaataagcagagcagaccttttgactgacttacaagatgagaaggtcaaagactggaaatcaaaacctaccgagaaactgagaagccctataatgccaaaggaccatatcctagatgtaaaggaggatcaaccctcaaaagtacagtcatgtgtcacctgacaacatggatacattctgaaagacatcattaggcaacttcatcattgtgtgaacatcacagagtgtgtttacacaaacctagatggtatagcctattgctcctaggctacaaacctgtgtagcatgttaccgtacagaatgctgtaggcagcagcaacacaatggtaagtattcgtgtatctaaacacatctaaacatagaaaaagtacagtaaaaatacgatactataatcttatgggaccacaattctacatgcagtccatcattgatagaaacatcattatgtagcacataactgtactgaagcccagattcaaattatctctaaccccaattgaattaagtgatccaggattgctagttctagccaccagatagaaacaaaaaccttaagtaaaatacgtcaacattcagaagttcaaataacctctatcacgttttacgcaatgtctagcactctatcaaagatcacaaggcacagacaaaaacaataaaaaacaagagaaacaatataaaatagaaagagacccacaggagattaacatttaaaagattagcagacagaattagactataattaatatgttctaggatatgagcctaggcagcgaagtgagaccctatctcttcaaaaaatcaaaaaaattagccaggcatggtaccacacgactgtggttccagctactcaggaggctgaagtgggaagatcacttgagcccaggaggccggggctatagtgagccatgatcacaccactgcactacagcctgagtgacagagcaagaccctgtctcaaaaataaaaataaaaaataaaaataaattatgttcttggatataaaatacaagatttctggataatatctttaaaaggctaaaaggaatcactaacctagaattctttacccagcaaatatactgttcagaagtgaagtgagggtcagacatggtggctcacatcagtaatcccagcactatgggaagccaaggcaggagaattgcttgagaccaggagttgaagaccagcctgggcaatatagccagaccccatctctacaaaataaaattgttttaattagccaggcatgatggcatgctcctgaagtcctagttactcaggaggctaaggctggaggatcgcttgagcccaggaattcaaggttgcagtgaactgtgatcacaccactgcattctagcctgggcaaaagagcgagaacctgtctcagaaaaaggaaaaaagaaaacatgaagtaaaataacaacattttcaccaaaaaaaaaaaaaaaaaagacattatcatcatacccaccacacataaggaaatactaacagatattcttcagacaactgagaaacacagaaagaaataaagaacaataaaaagcataaatatatgagtaaatataaacatttgcaatacaaaataagaataacaatataaaataacaagaattccatgtgctatttaaaatgtatacagaatttaaagaaacaaagcagatcacaaaaaaaacaacagaccatacaagctcttaaaaacaaattgccatattcttaggaaaagattgtttcatgaccatgaaaacaattactagagtgagttttacacctgtttaatcaaagacgactgttagactcgtcaaatttttgaaagccagtcagtcagtaatagtcatgcttctgaaattcagacaatcaagagttaacactctagtgaacaaaggcctacaacatccagatattttttaaataggatgttacgtatctttatattattaaccttaacaataatggtactctttttggataataaataaatgaagaaaaatgtccttgcactagaaaagaaagatacaaatattcttgagacttaataggagctgtcatcaaggcaacactcagaaacaatatacctacagctcctgatcaatctcttgtgcagctctgggttccttttcatatatggaaattagactcttaccatgccatcccagaacccagggtacctgttgtgtgagcgtaacaactatgttattccaagtgtacaactccccaacatgctcagtggactgtgtcttataacaaagaatatgaatggataaaatctttcctttgataactgacaaagagttttctgaagataatgatctgatccatacctatctttaagaactatagtatgtcttcacagttgtaattattggcaacaagcattaaacttcttggatcaaatacttcatatctactcaaaattgtaacattaacacttaaaactaagaaaatagagatgtttaaaattttccatttcacacactacttcatattcctacctgataactttaaataccaaatgcactgagtttagccctgaaatgagtttaaaacaattctctaactgggatataattactttccactgaagcatttttctgccactcaagaatcatctgatttacataaatgctagttaagcaccatagaaattctaaaatatatcattagcagaatgtcacagatcacttaatctactctgtcaaaacagggattatttcaacttctgtttcacttcccttaaaagaaatcctatttactttcttttctctaacagggaaaaaaaattagtaaaataaacttacagtgtacttcccaaatcaaactttaaaatgattctggttaactacaaattgactgaagtattttttctgaatgtattttactgaaacatggctgacaacatataataatgttactgctacagaattacaaattatttcactgattactcttcctattcaagaaaaaaaggtcactttggtccatacaaattgtccaaataaactagatgtattactagcttaaagtaaacaattttgtaaatagcacttctagttagagttaaaacataaccataaaaagcttttattaaacaatacatttcactaagctaaatttatagaaatatatatatttctatcactttcacacatcctgacaatatttgggaaaataaatacaaaaatgtttttttttaattcagaagtatataatttcttcaaatattccagccataaattataatacataaaatttaagatacgtaaataccatgaatattataaactttaaataaaattctagccataatttatgaaactcacattattaaacaacacacacacacgctgattccaaatgaagaagagaagtaccatggtagtttctctgtgacacaccaaaaattatcctaataaataaattaaacaatcatgtaattcctaaatttgttacagaaagatatgtggctggttctcacacctcctactagatatctttacaccacttaaaaccttttcttttttcatgctattattttctgtgtaacaaaataccaactagtcagattctaaaatatcaatctttagaaatgatattagcaaaacaattttaaaatacttactgtcttgtttcgtaatctaattatgtctgagacagagccagcgccacagtactccataacaatccagaggtctgtattcttaaaataactgccatagtactttacaacatatgggctaaaggaaaatacataaacaattaaatttagttaattcccaaagaaatttttttcttaatcccaatacaaagtattttcaacatttcatactgttccaataagttaaataagtaaatttctattgcacatcaaattctcaatatctggagttcaccaactatgcataattaggctttacttcatggacgaaatttaacaggattacaaaccagaagaggcccaaatgttttgagtgattctgaagaaaataagacttcattttggcaaagaacttactacttaacatgaggaacaaatgaaaatttttccctttaactaaagcattttaaatatgtcttctaaaggattttgcattcagtcaaatattaatcaactcgaaaataatctatatttccatgaggccaaaaagttattttaaattttctttcattctggcttttgaaaattctagagaaaaaaaattataaatttttctgcttaaatttatagaattaaaatattagcaatttaatttctaaactgaggtcttacgtcttccagagcagaataaactatgtttatagccaagctgtcttcaggaagatttagaaagggacaaatgaccatcagcaataatgtatattatggataaactacatatagtgatgtatgagaaatctaacctatctcaaagaggcagaatatcatattcaaaaaatgcatagagatagaaaatacaagacagcagaaactaaataggacacaactttaatgctacaagagctcaaatgaggaaataacattggaatcatccaaagagaactttgtggaagggagtgggatttgaatgagattttgaaagaaaagtttaaactccaaaatgtagatggagaagagggataagaaaattctagaaaagagaaagaccatgaataaaggtacacaaatagaaagggaaaaaccaagtatggcatgtaagaggacaacttgttcaaataaatacttctatctagtaatagctacaatcaaaaacagtagccattttgctgggcacaaatgtaagataaatatgacagaaaaacaaataagcaaaaaaaaaaaaaattgaaagtacaataaaagaacacgtagagactctatcaattgtggaggttaagagaagactgtcagggaagacttctcagtacagcctttaaaattttagctatgctctaacactgaggcagtaataaacagcctaccatccaaaaaaaaaaaccacccaggaccagatggacttagggccaaattctagcagatgtacaaagaagagctggtaccatccctgctgaaactatttcaaaaaattgaggagaaggaaatgctccctaactcatcctatgaagccagcatcattctgataccaaaacctggcagagatacaacaaaaaaagaaaactttaggccaatatccttgatgaacattgatgcaaaagtcgtcaacaaaacattagcaaaccaaatccagtggcacataaaaaacctaactcaccacagtcaagtaggctttctctttgggatgcaagattggttcaacatatacaaatcaataaatgtgattcatcatataaacagaactaaagacaaaaaccacatgattatctcaatagatacagaaaaggctttcgataaaatcagacatccattcatgttaaaaactctcaacaaactaggtattgaaggaacatacctcaaaataataagagccatatatgaaaaacccacagccaacaatcatactgaatgggcataagctggaagcattccccttgaaaagcggcattaagacaaggatggactctctcaccattcctgtttaacatagtattggaagtcctggcaagggcaatcaggcaagagaaagaaataaaggtcatccaaataggaagagaggaagtcaaactacccctgtttgcagatgacatgatcctgtatctagaaaaccccatagcctcagcccaaaagcttctcaggctgataagcaacttcagcaaagtctcaggatacaaaagcaatgtgcaaaaatccctagcattcctatataccaacaacagtcaagccgagagccaaatcgggaactaactcccattcacaactgccacaaaaagaataaactacataggaagacagcaaactagggaggtgaaagatctccacaaagagaactacaaaacactgctcaaagaaatcagagatgacataaagaaatgggaaaacattccatgctcagggatagaaataatcaatatcattaaaatgaggctgggcactgtggctcacgcctgtaaacccagcactttgagaggatcacttgaggtcaggagtttcagatcagcctggccaacacggtgaaacccccatctctactacaaatacaaaattagctgggcatggtggcgcatgcctgtaatcccagttacttaggagggtgaggcaggaaaatcacttgaactcaggaggcggaggttgcagtgagctgagattgtgtcactgcactccagcctgggcaacagagcaagactccatctcaaaaaaataataataaaaaataaaaaaataatatataaacacacacacacaaacacacatcattaaaatggccatactgcccaaagtaatttatagattcaatgctattcttactaaaactactatttgagattcggcacagaactagaaaaaactattttgaaattcatatggaaccaaaaaagagcccgaatagccaaggcaatcctaagcaaaaagaacaaagctggtggcatcacactacccgacttcaaaatacactacagggctacagtaaccaaaacagcatggttatgatacaaaaaaagacatacagacaaatgaaacagaataaagaactcagaaataagaccacacaactacaactatatgatctttgacaaacctgacaataacaggcaatggaaaggaaaaaggattccccattcaataaatggtgctgggataaccagctagccatatgcggaagattgaaactggacccctcccttattatcatgttcaaaaatttaactcaagatggattaaaggcctaaatgtaaaacccaaaaatataaaaaccctggaagacaacctaggcaataccatccaggacataggcaaagatttcacgacaaagacacccaaagcaatcacaacaaaagcaaaaattggcaaatgggatctagtaaaatcaaagagcttctgtacagcaaaagaaactatcaagagagtaaatagataacttacaaaatgaaagaacatttttgaacaaactatgcatccaataaaggtctaatatccagcagctataaggaacttaaacagatctacaagaaaaaaaaaacaaacaaccccattaaaaaatgggcaaaggacatgaacagatacttttcaaaagaagacctacatgtggccagcaagaatatgaaaaaaagttcaacatcactgatcattacagaaatgcaaatcaaaaccacaatgagataccatgttacaccagtcagaatgactattattaaaaagtcaaaaaaaaaaaaacagatgctggcaaggttgtgaagaaaaaggaatgcttatatactgttggtgggagtgtaaattagttcaaccattgtggaagatagtgtggcaattcctcaaagacctagagacctagagacagaaataccattcaacctagcaatctcattactggatatatacccaaaggaatataaattgttctattataaagacacatgcatgcttatgttctttgtaactagcactcttcataatagcaaagacatggcatcaacctaaatgcccatcaatgatagactggataatgaaaatgtggtacatatacacaatggaatactatgcagccacaaaaaagaacaaagtcatgtcctttgcagagacatggatggagctggaggctattgtccttagcaaactaacacaggaacagaaaaccaaatactgcatgttctcacttataactgggagctaaatgatgaggacacatggacacacagagtgaacaacacacactggggcctatcagaaggtggaaggtggaaggagggagaggatcaggaaaaataactaatgggtactaggcttaatacctgggtgataaaataatctgcacaacaaacccccatgacacaagtttacccatgtaacaaacctgcacatgtacctctgaacttaaaataaaagttaaaaataaataaataaataaataataaaaacatcagtcatctaaaaaacaaaagtttaaaattttcccattataattaaattttatattaaaaacaaaggcaataaatacaaaaaaaaataactatgtcttgaagtcaaaggtagaacagagtggttggagctgaagggcctgaattcaaacctgttttatccccactgctactccgttacctcttgcacagacttgctccccactggtctccttgtcttagttttctcccctgttctagtctatgctacatacagttgacaaggtaccttactttaaaacaaaagtaaaacaagctgatcatactgctctcctagttaaacaaaaatactctaacagctctccattacccaaaggaaaagctcttaactgcttcatatcgcatacaagttatttcagagtctaccttgttacccgtatctctgattactctccatctcataccttaaatttccagacacactcagctttgctaggtcttgggaattgaaagtatgtatttggagttcataaatgttcactgaaccatttaagaaaagtgcttgtttacaaacaaatgaaactaaatacagacttagaactgcaacatatgagaaacaaaaaaaaaaattctttacatgtactcctttaaggtatggcgcctatgtggaaacttttatagggagtagcgttcctacacctggctgtgcatgagagccacctgtgacccaagcccacactcctttgaggttctgattcagtaggtttttaaaagctctaccggtgactctgacatagacccagagttaagcttcactctaccagtgaatagactgtatatccttcaggggaaaaaaaaaaaactctctctctctctctttttttttctgaagcagaatctcattctgccacctaggctggagtgcagtggcaccatgtcggctcacagcaatgtctgcctcctgggttcgagtgattctcgtgcctcaacctcccaagtagctgggattacaggcctgtgtcaccacgcccagctaatttttgtagttttggtagagatggggttttgccatgttgaccaggcttgtcttgaactcctggcctcatgtgttctgcctgcctcagcttccaaaagtgctgagactataggtgtgaaccaccatgcccgccaaaaaaaaattctttaaatatgaatgttctcattcaaaattttgaaaagtgttaagtaacaatgaattgacgattatgttcactgaaaagcatacaaaaaaatgtacatttttcttgccatacacactaatcagcaatgctaagggtagaagtgacaactcatgaaaattaggaattctaacctgggcagccacctgaaaacacagccctatctctccataagagtaagtcaagagaaaactttggcaaaacgtaaaattctcttcaaaaaaataattcatggcccatctaacacccacgtaagtagatggatccaagtccaacacctctataacataaaacatggcctcactaactttaacccagcaaagtatttaagcaactagaactaaacagccacatgcattcactgaccctctactcgggccaggcatttcaccagatgttcagtatgcactagtgaaacacacattcacaatttggaccctcataccgaatacactagcatgaatatacaggaattaaggaagtaaactcacaaataaatatgattactaaccatggcaagaaaagaagaaagggtgctataagataaactggctgtgactttattttgtattcaccatttctgcaaataaaattgctcctagttcatatgaaggaatggaatgcattcatattccatggtagcctctgagacttggaaggcactggagtatgtgaaaaacctttgaaagcagataagtgagctttaacaataaaatgtcctttctccactgaactgctgtgaattacaaaatccacagattggaaaagaaagaaatgcttaaactccagagttcatatgtatacagtggccatcctctgacactttctaagtcagcaccttttatactgtaaagcacttattacatcctgcaaggactttgtcattgacttttatctgcctcccccagaagaacagaagctccataaagataggtaccaatctgtctcgctttccattttatcctcagtagctctcttctcctatatacaaactaaagaagcaggccgggcacggtggctcatgcctgtaatcccagcactttgggaggccgaggcaggcgaatcatgaggtcaagagatcgagaccatcctggccaacatggtgaaaccctgtctctactaaaaatacaaaaaaaattagctgggcgtggtggcaggggcctataatcccagctactcaggaggctggggcaggagaatcgcttgaacccgggaggcagaggttgcagagagacgagatcgtgccactgcactcctgcctggcagaagagtgaggctccgcctcaaaaaaaaaaagaaaaattaaaattaaaaaataaagaaagaaagaaaagaaccaacgaataaataaatcacacaaaaaactaagacaggacctaatttaggactctccaagggaataatatttaagctaagatgcaaaacttaacgagaagttagccagataactaagcactaagaactgccctgcaaaggccctgaaagacagaacaaatcacggtcaaagaactgaaagattagcgggcccaggataaagtgagtaaaggatacagtagaacataatggagttgcatatgtaggcagaagcctgaccatgaagggcctcaaaaccaaggtaaagagactgggctttatttgaaatacagaaaaaaaaatcagtgaagaattttaagcagacgaataacatgatgtaaagtttctgtggttgctgaatgaaagctagattgtagggaagcaaatgtgaatacagagagaccaattaaaaagtaatgttagtccatgcagagattatagtaagcatatctttttattttctgtattcttgatgctttggtatctgggaccttgctaaaactgaagcgactgcccctctcagggtaagctaattcctagagacagcaaactaactcccatggaaggatgtctttcatatgcacaccaacctatctaaagcccaaacctccaaccacctctatggttacactctagggtcaacttttcacctgcccaaattgccccagggccaggtaccagacaaccagagaaagccctatgccccagaacccactcaaaatactcaaagtagccaatcctaaacctgtttaccctatctcacctgtcccttcccagggaaaccacacaaacattcttgtccacttcttcccccctctttctctgcctcctaactgactctggtacttccccgtggagcccctgtgacacagcacgcctccttctcttgtgagctgtatatataacaatatatcttttccatagcaatagtctcttgatctgttggcctcatgatatgtgagtaataataaagcatactttttttttttgagacagagtctcgctctgtcgcccaggctagagtgcattggcgcgatctcggctcactgcaacctctgcctcccgggttcaagcgattcgcctgcctcagcctcctgagtagctgggattacaggcacccgccaccatgcccggctaatttttgtatttagtagagatggggtttcaccaggtcaggagttcgagaccagcctgaccaacatggtgaaaccctgtctctactaaagatataaaaaattagccgggcctggtggcatgcacctgtaatcccagctactcaggaggctgaggcaggagaatctcttgaacccgggaggcagaggttgcagtgagccgaggtcgcgccattgcattccagcctgggcaacagggcgagactccatctcaaagaaaaaaaaaaaaaaaaaagcctaccaataggctcagacagttcaagacctgagacttctaaactcaagtctatttccattaacacagatatgcattcaaattcacatttatttatctttttttttaagtaattcaaacaacaaatattcactgaacaagcctactagcagaagctagggagaaaaatggaaaaacattagactagtgacaaagaagaaagggcagtccaggcaatggggaacccctgaagaaatttatataaggaaataatacaatcaaactagcatttaaacattatcctgagcaggattgtcaaggatcaaacatgatgttgttcattctagccagcaagttaactaactacaattatttagatgttctaacatctgtttttaaaccagcatgttgattattaaaggttagggaagaaggggagagagtttcactcaaaacactgtaacactctagtgttatatacaggcaaatctataagatattgcaggtttgattccagaccacctggataaagcaaatatcacaatacagtgagtcacacaaatttttgttttccagaaagaaaccttggatcaggcagattcatagctgaattttgctaaacgtataaagatgagctggtaccaatcctactgaaactattgcaagaaagctgaggaagagagactcctccctaactcattctacgaggccagcatcattctgataccaaaatgtggcagagacaaaatgaaaaagaaaacttcagaccaatatctctgatggacataaatgcaaaaattctcaataaaagacctgcagaccaaatgcagcagtacatcaaaaaactaatccaccacgatcaagtaggctttattgctgggatgtaaggttggttcaatatacacaaatgaataaatgtgatttgccacataaacagaggagattttgcaaaattcttgagggtcctaagatttttggaatgggcaatgaacactggcttcaacttaaagtcatgagaggcatcagcccctaacaagagagtcagcctgtcctttgaagctaagcagtgacttctctctagctaggaaagtcctagatggcatctccttccagtagaaggctgtttcgtctacattgaaaatctgttgcttaatgtagccaccttcatcaattatctcagctacatcttctggataacttgctgcagcttctatttcagcacttgctgcttcatcttgcacttttatgttatggagacagcttctttgtttaagcctcatgaaccaacctctgctagcttcaaacttttgttgcttcctcacgtctctcaaccttcatagaattgaagacagtaagggcattgctcgagattaggctttggcttaagagaatgctgtggctggtttgaacttctatccagaccactcaaactgtctccatatcagcaatgaggctcttccactttcttaccactcatgtgctcactggagtagcacttctaatttccttcaacaacctgtcctttgcattcaagcttggctagctgtttggcacaagaaccctagctttcagcttatttcggctttcaacctgtcttcctcactaagctaaatcatttctagcttttttatttaaagtgagagttgtgtgactctccctttcacttgaacccttacggaccattgtagaattactaattggcctaatttcaatattgtgtctcaaggaataggaaagcctgaggaaaggaagggagatggggcccacggcctagcagtgggacagtcagaacacacacgacatttatcaatttagttcaccatcttacaaaggtgcagttcgtggcacctcaaaacaattacaacagtaacatcaaagatcactgatcacagatcaccataacagatataataataatgaaaacgtctgaaatatgggaaggattaccaaaacatgacatagagacatgaagcaagcacaaactattggaaaaatggtgctgacggacttgatttgctcagtacagttgccacaaaccttcaattaaaaaaaaaaaatgcagcatctgcaaagtgaagaagtacaacagagtaaggtatacctgtatataaattttaagcaatgcagaaagttttaattcagccatatgcctaagaattttgactaagccagtatatggacttgcaggttgtatcagaacccagcaattctatacacagtcatccctcaatatccatggcgaactggttccaggaaccccacagataccaaaatccatgaatgcacaagttccttatattaaatggcacagtatttgcatataactacatacatcctccagtatactttaaatcatgtctagattacttattacacctaatacaatgtaaatgctatccaaataattgttatactgcattggtttttttttttattgtttttttctattgctttttttctcccaatatttccaacatgcagttagctgaatctgtggatgcagaacaagcaggatacagagggctaactgtagttttgttacattttttatttttattttttaagagacagggtatcactctgtcacccacgctagagtgcagtggcacaatcatagctcactgtagcttcaaactcttgggctcaagtgatccttccacctcagcttcccaagtaaccgcaactataaacatgcacacacccggactaattttttttattttttgtacagacagggtctcactacgttatccaggctgctctcaaattcctggcttcaagtgaccctcctgctttggcctcccaaagcactggaattacaggcgtgagccactgtgcctggctagttttgtctcttttaaagaggagtaagcagctatgtctttgaaaatttcactgggtggaagaaccaggaaaacacaaaggaaattacagactacaccaggaagcagaggtgaaatatgatgccttaataactagcatgccaatcatgagccacattctatgcctttctcttatgcatcttctctccatttcatcctcctgtctcattaattttttccttcccctatttaacgccttcaatccaataaaatgacgtatcttgttctcgttttcttttttttgagggggtggggggcttctgggcttcctctcatctcatacctaatgatcacatcctttccatttccatcttcactttacagctccctacactctttatcctaatggtcctcctctagtatcacaactcaaaatagaaagagtattaaaaaaaaatgagaaaaaccaaaggggaaaaatggaaaaaggactacatactcctatctaattgtaccttacttaaacactatgcatgatacaaattatacggactgaatcattacgtttaagcttcttataaaaatccaaatgttctattcataacacccaaaatatggaatcaatctaagtgtccatcaacaacatcatataattaaataaagaaaatggaatactatttgaaaatactgcttgaaaggtgactttttctttttttttttttttgagacagggtctggctctatcacccaggctggagtgcagtggcatgatctcaggtcattgtaacctctgcttcctgggctcaagcaatcctcccaacctcagcctcccaagtagctgggactacaggcacgtgccaccatgcctggtgaatttttgtattttttttagagagagagttttgccatgttgttcaggctggtcttgaactcctgagttcaagcaatctgcccacctcggcctcccaaagtgcaaggattataggcatgagccaccacatacaatcaaaaggtgactttttaaatagtaacttgaatttcattctaattgaagaaaaccatatatagctaaaggtatactttttaaaagtcttcctaatatgagcatgtgataattaaaatactaaagaaatggctatttttaattacatcattttcatcaacatcttactataatcttagtagtgttctataacttagtatggtaatacagtgtttttacaaaggcaatgtggatattctattaaaactgagctgtttccagcataaatctcaatcacacagcaatttatttcttggcccacccaaaactgaatatacaaattgccaaagttcaaattgctgatacaaattgccaaagttcatcaataatcctccaacatggtgattttgaaacttttgattttttatttatttatttatttatttatttgcctcagaaacagtgttcaaatggaatcttatctagaaacatgaggaaatagaacaggtaagaatgtagaatactctggtagaagccaaggggtgctcagtgacaccctgaacaggccagctgaaaatgctctatttcaccataagagttatctcttctctttgcccagcaaatctaactcatcaatcaggactcagctgaggtatgacctccctgggaaaactttccctgaacctccaaacatgaggtgttagatatctcttccaacccacatacttccccatatctatcccatcacagctgttaccacactgtgtactgaaacagcctacccattcgtctgtttcttccagctgagtgaaagtctctctaaagcctcaaacccattcttttttgtttcttttttttgttttgttttgtttttgagatggagtctcactctgtcacccagactggagtgcaatggcacagtcttggctcactgcaacctctacctctcgggttcaagtgattctcctgcctcagcctccccagtagctgggattacaggtgcctgccaccacgctcagctaatttttgtatttttagtagagacggggtttcaccatgtttgccaggctggtctcaaacttctgaccttgtgatccacccgcctcagcctcccaaagtgctgggattacaggcgtgagccatggcacccggccgagacccattctttgttgtatctcttgtgagagcacatcaggcctacacttaggagtaggtggtactcaatacatactagttgaacaggtaaaaaggggataagtgtgtgccctgattcataacaacatatttatctttgtttagatatgaaaagttccttctctgcatataagcaccaggagggtagggactatgtcagttgtgattaccttgtgtacatattacctgccacatagtattgctaaccagctgttgcctctactcctaggaatgccttgagagtgcttcactttgaactgttggaatctttttacaggcattgctttcttcaacactggccctgaagtagggtaaatgtgggttcttattgcatctcagtcactaactagcagtgtgattttgggcaattcatgtaaaagctctaggtctcattttctgtatctgcaaaattgtttttaaatatgctttagcactagaagacttttcctcaaataaaaatttcaaaagagtcccatatataaaaaagataaaagcaataatgaggttctcattctactcaattcttcagtgaagaaaatgcccctagaagtaccttcttagagcagggtatgatttgaaaacactaaactagctgacccacagaagttgaatctagcactaatattctatgatttatccatttaataaatactcattaaatgtatactctgtacctggtactgaactaggcactgcacattcagcaataaacaaagcagatgggctccctgagatatttatgctaacatgtagtattcagcccattattaaatattcacttaaaatgaacaaaaaaagattaaaacaccacctctggtccttttatagagtatagaaaacaagacaatttaccaaattcacaaatagctgaatgtattaagaaaatagttaaatttcagaaatgcatatctcattttccctatcaaaatttcagtgtattatttgggaatttttcaattcatactgttttcttccaatcatttttatgctaatttcttaataacacatttacattaatactagttattggtagctaaaatctaagtttctccctgtcatttcctaattgtttttctttttcttttttttttctttttgagacagagtctcactctgtcacccaggctggagttcagtggtacaatctcagctcactgcaccttccgccttccaggttaaagtgattctcctgcctcagcctcccaagtagttagaattacagtcacctgccaccacgtccagctaatttttatatctatttagtagaaatggagttttgccatgttggccaggctggtgttgaactcctgacctcagatgatccacccacctccgcctcccaaagtgctgagattacaggcgtgagccaccatgcccggccctaatttattttttactagtcctatcttttagcattttaggatcttttaaccaactaattttttgatccttcgcaacttcatacttacaatatgaatttgacagtaaaatcttaaaaggcagaaaccatttttcatcaatatttgcctcagcatttatttcattcaacaaatatttgagaagtacctactatgtgcaaggcattctgctataaagtggtacaaaagttctagaattctataacatttccttctcattgtattctttacttttctttccctttaaaagcttaaagtgcataacaagaataagtacctgatttccctggggttccctcaatctgtaatgctcttccttgtactcctcatacataccacaccctttcattcattcatcaaaaagtatactgctaggcgctgaacaggtgctaataaagaaaaatatatggttcctttccttaaggaatgaagagaagaataaagatagtgatgacatttcagaaggaaaatctacaagactcagtatcatctgaagtatcataaaaaggaataaagatgattctcagccttgctaaaagactaagtagatgatgatgcctttgatacacaggaatttgaaaggcttgtctggaatgtttaaaactggttttagaatgttaaatgtgtaattccctctggatagtctagttgagttgcccaaacagaaattattaaatagaagtactcattagtatctgagtaaccattatgtggcaggatccaaggacactgagtaaaatacaatccccgaactcaaggaacttaagacttagatgatagagaatacaagtaaacaggcacttaaaagagaaactcaggtaagagactggaggtgtaagcactagatggaacatgaaggaccttgtatgccactcttaggagactggatttctcgaggcaatggggaaccatgggttttaaacagggaatgcttgattacatttgcattttggaaagaacgctctagcttcaaggaagataatgggttggaggaggcaaacaaagtgaacaaataagatgctgttgcagaaatctgaacaagatttgagggaagagatatgtaatagtaatatttgagaccctgactttcctagacaacactcaaagtacaatgctaatccttgaactatttttaaccataataacaaaataatactcgcatcaggcaagtataaagcatacctggtggccgagcactatgctatctcatctcttattctatatcaaattgtgggaaccacagttgaggaatgtatctttttttttcctataaccacttgaatttcacatgctatgggaaatatgtaacataatttaaatatacagcatattctaaagaaaagcaaaattgaacagatccaagcagcaaagttcctctaggattatgcaatcacttcattagccaaaaagcttacaatctatagatcctatgtattgttaggagtgaaagctttccataaatctctaattacagggccctgaattgataaggggagacaatgtgcccagactaccctgtgtcaccagctctaagtcacacgagacaatttttacaaataagactgaagttgaaggtttctgggaaagccccttccctgcttcttcttttcttcctcctgcctggaatgtagacataaagctggggctgtagcagccctgttgtagccatgagataataagcatgaggacaaagcacatgctaacgatgagagagtacaagaaaagaagactgagacatggctgttcctttgttgctgctgtactagcagactttttgttaagggagaataataaatccctctgtggttaagtaactttaggctaaacatagtcataatttatatactctgaatcccttatagaataaagcctaggctacttcacattgcataagatgcttctcaccatcagctccatttaactatccaacctcatttcattctgttctctgtcccatactttccattccaataattctaaatcttgtcagatgagcacaccccaatgagttgtttttacctttctacctgtcatccccttgactctcccttatcactccatttcttcacccaattaactcttcgtcagcattccagatttcctggctccactggctgaggaagatgccctgccttcttcttttcacattaccccatgcaccagtcactacaatgagtgtgctatattacagctatttatttatatatttgtcttcccaactacactactgacccctcaaaaagaaaaaagtatcttagttcttttggcattcttagatcctggcacagtaccgggtcaactggggatgctcagtgaatgttgaatgaattagatttacataaaacatgacttcttaattagtaaaagtgattacataatacagactgttaaatgacccctttaacatcaaaaactcattctcatccataaatttgtcctaaaaaagtccaggctatagtgcagtgctgcaatcatagctaactgtggccctgaactcctgggctcaaacaatcctcccgcctcagcttcccaagtagctagaactacaagtccaagctaccacctggataattttttcttttttggtagagaaagggtctcactatgttgctcagactggccttgaactcctgggctcctttaccctcgatgctctggcctctctaagggttgagattacaggcgtgatctaccacatccagcctcatttctgcttttaagcagaaaagctgcaaagagctgtaagtcctaaagacacttgacaaagccatcctcatctgccttaaaggattaatctcacttccaatgggaagtcagaaatgaaaactaggccaggcatggtagctcacgcctgtaatcccagcactttgggaggccaaggcgggtggatcacctgaggtcaggagttcgagatcagcctgaccaacatggagaaacccatctctactaaaaatacaaaattagccaggcatggtggcacatgactgtaatcccagatactcagggggctgaggcaggagaatcgcttgaacccagaaagcggaggttgtggtgagccgagatggcgccattgcactccagcctgggcaacaacggcaaaaccctgtctcaaaaaaaagaaaagaaaaagaaatgaaaactaaacagatgatcaaagaataaattttgttatattttattagcaaaactcgtcaaaacaagggtaagcaaagaaataaaatctcttcatacctgtcacattgctgcattatggaaatttctttgattatttcctgaagatctgattcaacaggtacttgtttaattgcgacaacttgaccggattccttgtgtattgctttaaatacacttccataagacctaaaagaaaccaagacattatttttttcctatcaaacatcgtaactataagattaaaagtctactatgagttttctgtggatagtcttttctagtttaaaacactatttaaatgattaaaaaatcaaagtaaacaagtaacaattttaaaaggtaatgaattatatcttagctttattgcttcaactacagacttaaaatagtcaagttaacatataatgagtagctatttttcttatgaatgaaagaaacagacttgcgtttggtcaactcaaacaaatgcagcattaagaagatataaatggaaattaaaagaatgaaatgtagattaaaaatagccaaagcctcaaattaggagaaaaggctgatctcaaggaaaatgacccccagaatatcaaaaagtcacacttctgttcagagtaccttaacagttaaaaccctcagctggggaccatattaacatcaaagttagagaagcaaggaatctgcagccatctgcttctacctgatttacagatccaaggtctctttttaaaaagttcctttcattaccttttcctcaagagaaaaactacaaactcacaggtaaataaaatgaggaacagggtctaatagtcacttgcccaaaacctgtctctgctacaactcctgaaactttgccaactgaatattcacgtgttttaaaaagcaaaaacaaagaaggaagaagccatttgtaccttagtatgaacttaaaaacgaggttaaacactactatgtactgagttcttactataaaccaggtcctatgctaggtgttttacatgcattatgaaattcaaccctcacaatcataaggaaaaacactattatcgtcattaaaagatgagaaacagaccagtagggccagaattcaaacacattcccaccccaaaaatcaggtttttctcaccatatttttctacagaagagaaacaagagcaagccaatggaaaacatcgaatgtttcctaatattagaaatctatgcagaagcccttccaaatttataatcttttaaaataagtgaaaaagagacaaataagtgataacgcggctacttcaataaaatacattttatcctctcctctgtttctttgggctctctgaagtcatttaatttggtttggtacccaaagtcacattgggctgggtgtgggggaatgtatgtgtgtgtatctccccttgaaagccatatgtgtgtatgtgtgtatattccctcaaaagctaacatagaattcagtgctagatcatctactgtcaattaggcaacaccatcactcctttctaaggactcctcagcactacgaaagagaagctgcaatccccacttcccagaatccccttccctgaatggttcctcattaaaagtctgccagtgagaaaaacacgtatgtgtgaatgacgaaaggagaaaccatttttctccagatacagttgtagcagatggactgacagatatgaagtgcacagcagcttcctgctgagcttccaacagccaccactgctgcagactgaggtagttggtgggagtttctcaagactgcaggattccagcagattcccagagagcttttgagaaacacccacttcagtgcttcaggctgagatcttcaatgctgacttcgaccttcaacctttggcaacagttttcatgaactttgcatccctggcccctccacaattcatttgagctcctaacttcattactaaattcttcatatctatagagtacatacagtagcttatcttttccttgatagcaatatagtttttggtagaagaagtgtttccaagggaaagaatcttaaagatgagaatcttgaattagttctttcttagatgttgatatggtttggctatgtcccacccgaatctcatcttgtagctcccataattcccacctgttgtggtagggactcagtgggagatgactgaatcatgggggcaggtctttcccatgctgttctcatgatagtgaatgggtctcacaagatctgatggttttaaaaatgggagtttgtctgcacaagctctctctttgcccgctgccatccatgtacgatgtgacctgatcttccttgccttccaccatgattgtgaggcctccctacccacgtggaactataagtcaattaaacctctttctttcgtaaattgcccagtcccaggtatgtctttaccaacagtgtgaaaacagactaatacagatgtgtagacagtaatgacttcaatacaagtaacaaatagtatactgatggtctatggcattcagtggcaaacagttatttaaattatcacccttagttgcctggagtctaagcaaagctttaaaagaccaagtagctgtatcaatacaatgtatggtgaaaataaagtataaggactatagaatgggctgctgcctctgcctgcactggaaaagttatagaacaaacacagcaagctaaaggcttaaatgtccagctcaagactgagagaaccagaaaacttctgaatttcttaattcttacagaaacagggttgagatttctgaaaaacaaactctaggtatagtcttactggaagttgaattacatttcaagttgaattcacatcagcaccaggtctgttatgttaaagttaaggtatctaacaataaagagaagtacctagagaactggtattaggacatttagatagattctcattaatctgagtaccttgaatccccaaatcctatcaagcctcccttgataccaaaagcaactctgccctcctgtctgagaaaattaaccttacaatgcctgaagactctatctacctcctgaggcagtcacttttcagcagcatgcagtggtcctccagaccactccaccaccacttattgcttccagacccaaagttatactcaactcccatagacaccagggagacaagtataaaatttaacccaagcagctactattcacactaaaaaagttgcaagattttgccaatttttatcagaaccctaaagaatatgtgtgagaacaaattctaagatttccagagaggaagaaatgtactgatatggatgcaagaccagaaattccagactcagcatgttagctcaaacagttgggggtgtccctaacagttgctcagccagttaactgaaacctggactcaaaagtggcccatattaagtgagatgctaagtgagcctcagtacacaccaaaggaagcatatcaaaggctcaaggaaatgggatactagaatggatatatattataagtgccatgctcacatactccctaactatgttgacaaaaagggtccagaggataccagcatcgaccaaagctctattagtgcaggggaaagatgacaaatatgccaacagtgaaactggctccttgagtttaatagataacaggatcccagcacaagagaagtggcaacagctattcacctgagacaaagtgggaacagttaccataatgagtaacaaagcaaggctgaattacagttttcttttattgtacatttaggtcttgatattaaagttacactagcttcatttaaaaaaaaactataattaactgtcctttaaacactgtataaaacagtgtttaatacagtggaacctttctggaggggaggaggtgaaatacacacaacataaaattcactgttttaaagtgtatgattcaatggcatttagtgcattcacaatgctgtacaaccattatctgtatgtagttccaaaatatatagaatctgctttctgtctctacagatttatctattctagatacttcatataaatgaaatcatacaatatgtgaccttttatatctggcttcttccttcacttagcataatattttgtaggtccaactacactgtaaaatgtaccagtacttcactactttttatggctaaaaggtcactgtacagacatatcacgttttgtttattcacctgggatagcagatggacatttgagttgtttccacattttggctattgtaaataatatgctatgagttggtacctttataattaacagttatttaatcatttctctatcactggctatatcttccttcttattccaaatcttctgtattttctattttctttagtcaacattgtaagaggtttaattattttactgatctcttcaaaagcttttatatatacaaacatatacgtatctttttttttttgagacagagtcatgctgtgtcacccaggccagagtgcaatggcacaatctcggctcactgcaacctccgcctcctgggttcaagcaattctcctgtctcagccttccaagtagctgggattacaggcacatgccaccacgcccggctaatttttgtatttttagtagagatggctactctactaaatgacaatatggtttcaccatattggtcaagctggtctcgaactcctgacctcaagtgatccacccacctcggcctcccaaaatgctgggattacagcgtgtaagccactgcacctggcccatatttatcatttctaattttttttctatctcattaatttcagctttttctttaattcaatcttcagtttcttttggtatgtttcataatttttctaagttctttaagtaagcactaagtttattttttgcctttctttgttagtctaatgaaagaatttagaactaaaacttttaattagttttgctatattccatagatactggcacaatgtgttctccttttcattgttttataatttataatatcctcttcaatcaatgggttacttcagattatgtttcctaatttctagttggtgtggattttgtcatattataattacttatttctaatttagtgagtataatcagtgatatggtttgcatatttgtcttctccaaatctcattttgaaatgtaatccctaatgttggagatggaacctgttaggagacgtttgggtcacaggggcagtttcctcatggcttggtgctgtccttgagatggtgagttttcacaggatgtgcttatttaaagcggtgtggcaggccgggtgcagtggctcgtgcctgtcatcccaacactttgggaggccgaggtgggaagatcacctgaggtcaggagttcaagaccagcctggccaacattgtgaaacctcatctctactaaaaatatgaaaattagctgggcgtggtggcaggcacctgtaatcccagctactcgggaggttgaggcaacagaatcccttgaacccgggagaaggatgcagtgagccacgatcacgccattgcactccaggctggatgacgagagtgaaactctgtctcaaaaaaattttaaaataaaaaaaaataaaactgcgtggcacctcccctgccctatcttgctcctgctctcaccatgtgagacatctgctccccctttgccttcttccatgactataaccttcctgaagccctcaccagaagcggatgccggcaccgtgctttttgcagtgtctgcagaaccgtgagccaattaaatttttctttataaattacccagcctaaggtatttttcttataacaacacaagaacagcttaatacaatcagaaaatgtgacctgtaaaaatctcttattttttagaatttgtaacttttcttttatcaatggtcctttgaacatacaccagaaaagcaggtctgcaagaatatatatgcatagttatatagacatacaggtactttatatatttttactttatatatatttacatttctataaaatcaagtgtattcatcataatgtttaatccctctatgtcctttctcttttttctattatatctgtccaattctaaaagagatacattgaaatctcccatgcaattatacttttattagatgcctctgacatcactaatagcttttctgtcataaatttagctgccatgttgtctgacatgttttgttataaattgtccttgatattgctacctaatatatctctttatttagttgaaaccttttaaactttaatgtatctaatataaatattgctactattactttctgtttttttatttgtatgtttatctataatatttttataagaaatatccttataggctatgcacagtggcccacacctataatcctaacaatttgggaggccaaggaaggaggatcacttgaggccaggagttgaagaccagcctgggtaacatagcaagatcccatctctattaataataaataaatagccttatatttccattatttgttttacttgcatctcctataaacagaatataggtagatttcgcatgttcatttactctaacagtttgtcttttaatgggaaaattaacatttactgaaaagtacacttgattttattccttccatcatgttcagcttatttttattttttatttatttatttatttatttatttattttttgagacggagcttcgcttgtgttgtccaggctagagtgcaatggcgtgatctcagctcaccacaaccttcaccttccgggttcaagcgattctcctgcctcagcttcccgaatagctgggattacaggcacccgctaccacgcccagctaatttagtatttttagtagacatggggtttctccatgttggtcaagctggtcttgaacttccgacctcaagtgatccacccacctcagcctcccaaagtgctggaattacaggcgtgagccaccgcgaccggcctagcttattattttaccttttcattttctctatttccttgtccttgttcttgctgatctataagcttcttttaattctgttttgtacctttattattttggaaattctcctatactttgccattccattaaatgctccctacctttctctctgctcaaaccggcacgtttctctactgttattttgaaatcatgtcaactattcttctgcctatataaactgtttccctcactaagatattcttgtcatatcaagacaaagactacttaccttttccaaaataaaatgagcctcaagatctaaaaggatggccttatggtcacttgcctaacaaagtcaaaaccttcaaacgtattaataagaatgccgtaagggatgaactaacaaaactcttaaacatcatttcacagcacatttcttgcttttcccttatatatatatatggcctactttctctgaaaaaacactattaccagatttagcacaaactaatctttaaaattcagtatcacctgccaagtttaattactattaaatactattcaattcatacgaatatactctagttgaaagattaacatcatataatattttttaaattgttctgaaattatttacatgctttcatactttttgtacttacccttctccaagcttctctaatacatcaaaaacttcttcaggctgcttagtcaaactgtcttcactcagcttttttagtttactgatttaaaaaagaaagaagaaagaaaatattttctttaaagaccttttacaaaatttttaatttttaaaattttaccaagtttttaattttattttaatatattcagaagactcaaacaatataaaaacatacatagtaaacattctcctttcaagccctgttcctcatgtgcccagcaacacctccaaaaataatcacttttattagttttttgtgaaacctttatataaatatgaatacatattcttaattcctcccctttgaatatataagaagcatatacacacccttctgtataaatattgtcatgttgtctactgttttctcttgacaaaactatgttagagatctttccatacaggttaatcatccataatccaaaaatctgaaatccaaaatgctccaagatctgaaattttttgagcaccaacatgatacccacaatggaaaatgccacacctgacctcatgtaatgagtcacagtcaaactgtaagcacataacacaatttaaggaaaaaagatcctccccagcccccttcagctctgacatatcttttccatgcatgcacagattctcccacccaagcacatccaaagaagggtaataaaatggcacaggtacacgccagacgcaccaatgataggttccccacgatgccccacacggagccaagactgtgcattactcactgtgggtttttttgcttattctctgctttgttggataaagacaatgttgaaaatctgagtaagtgacagaaaaagaggaagcatttatgcttatctctagccaaaaagtcaagctgctggataaactggaaagcagtatgggaaatgtcttacaaaagagcatggtgttggaatgaccaccatatacaacctgaagaaacagaaggataaattgttgaagttctatgctgaagtgtcaatgaacagaagttaatgaaaaatttttcttaattgcagaaaaccaaatgaagatctcaaatgtgtactgaaagagtaaatctgtcagcacggcagagaaaacatactacttaatggtatggtgctcatgaaacaagcaaagatatatcatgatgaactgaaaattgaagggaactatgaatattcaacaggctgattgcagaaatttaagaaaagacacattaatttttcaaagatttgtggtgaataaagcaactgctgatcatgaagaagcagaaaaattcattgacaagtctgccaaggccatcactgatgaaaatctgacaccagaacaagtctataatgctgatgaaacatcacagtttagtgttagttccccagaaagactctgactacagcccctacaggataagaatgccatggacagagtaactgtcctgggaggtgctaatgcagaaggcacactaagtgtaaacctgctgtgtgggaaagattgggttcattattagactaacaaaaaggcatgggtcactagggacatcttttctgattggtttcacaaacattttgtagcagtggttcaggtttgctgcagggaagctggactggatgatggctacaagattttgttattccttgacaactgttctgctcatcctccagctgaaaaatctcattaaatataatgtttattccatgtacttttccccaaatgtgacttcattaattcagcaagtgagcagggtatcctcagatcaataaagaataaaaataaaaacactttcttgaacagcctacttgcagcagtgaacagaaatatgagcgtggaaggttttcaaaagcagttcagcatttagaatgctgtatatgctattgtcgatgactggaacacagtatctaaagacacagttgtgcatacctggcacaatctctagcttgcaactatgttcagtaacgatgatgaacaaggcaatgactttgaaggattctgtatgtcaagataaaaaaaaaaaaaaataggccaggagcggtggctcacgcctgtaatcccagcactttggaaggccgaggcggtggatcacgaggtcaggagaccgagaccatcctggctaacacggtgaaaccccgtctctactaaaaatacgaaaaataagccaggcatggtggcgggtacctgtagtcccagctacttgcgaggctgaggcaggagaatggcgtgaacccaggaggcggagcttgccgtgagccgagatcgcgccgctgcactccagcctgggcgacagagcaagactccgtctcaaaaaaaaaaaattaattaaaaattttaaaaataaataaataaaaataaaaaggtgtttgacttccttacatatacaaaaaaataccttcagagtctgtcagtaagttggaagaaatggatatcaaataagtttttaacattgataatgagtctccagttgctcattcattgaccaatggtaaaatagcagaaatgggctgggcacggtggctcacgcctgtattccagcactttgggaggccgaggtaggcgtatcctttgagctcaggagttcgagaccagcccgggcaaacggcggaaccctgtctctattaaaaaatacaaaacgtttggtgggcatgatggcacatgcctgtggtcccagctacttgggagactgagcctgggagatggaggttgcagtgagccgagatcacgccactgcactccagcctgggtggcagagttagaccctatctcaaaaaaagaaaaaagaaatagcagaaatggttctgaatcaaggttatggtagtagtaatgacaatgaagatgatgttaacattgcagaaaaagtgccggaagacaacatggtgtgatgggcttattttaggactagagtgcattcttaacagaataggaaatcacgtcactttataacatcaaagagagacttctaagacaaaagccactgttaatgaggcagacgattctcgaggaaacattttaaaaagccatccaagcaatggggaaaggattccctatttaataaatggtgctgggaaaactggctagccatatgtagaaagctgaaactggatcccttccttacaccttatacaaaaattaattcaagatggattaaagatttacatgttagacctaaaaccagaaaaaccctagaagaaaacctaggcaataccattcaggacataggcatgggtaaggacttcatgtctaaaacactaaaagcaatggcaacgaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacgatgaactcaaacaaatttacaagaaaaaaacaaacaaccccatcaaaaagtgggcaaaggatatgaacacacacttctcaaaagaagacatttatgcagccaaaagacacatgaaaacatgctcatcatcactgaccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagacagtgtggcgattcctcagggatctagaactagaaataccgtttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggtacatatacaccatggaatactatgcagccataaaaaatgatgagttcatgtcctttgtagggacatggatgaagctggaaaccatcattctgagcaaactatcacaaggacaaaaaaccaaacaccgcatgttctcactcataggtgggaattgaacgatgagaacacatggacacaggaaggggaacatcgcacaccggggacggttgtggggtgggtggagcgggcagggatagcattaggagatatacctaatgctaaatgacgagttaatgggtgcagcacaccaacatggcacatgtatacatatgtaacaaacctgcacattgtgcacatgtaccctaaaacttaaagtataataataataaaataaaataaaataaaataaaaaagccatccagcagaatgtttccttatccctagcagacctatttcctggcccctcagctgcttctgatgtttcttctcaactaaaaaaaaaaccacacagtgtataatagtaacctttcaatcaaaaatcagcatcataggtgaaaactaaaagcctgccgttgtttgttgttcctgttgtttaaaagctgatagaggtattctggtaatgccactgtgctgcttcattaccctgaacatattttttttccactgtattaatgttatgccatattttttgcagttaagtacttatgcatgagcaagtataagaaaatgattgcttatcagtagcatgtaaattcagagtcagaaatgaaggtgatgccaaacaactccacagactgtccacatgggtggctgagatagtgacacctttcctttctgatggttcaatgtatgcaaactttgtttcatgcagaaaattacttaaaatattgtataacattacctacaggctatgtgtataaggtagatacaaaaatttcatgtttggccttgggtcccagccccaaaatatctcattatgtatatgcaaatactccaaaaaacaaaacaaaacaaaattcagaaatctgaaacatttatggtcccaagcatctcagataagggattctcaacctgaataaagcatcaatgttcttttttacagctgcatcctattcaattacagagatatagcatatcttacttgcccagtcttttgcttatggacatccaggttctcttttgatatgataaacaatgctgcactgagtaaccttatatataagtcaatgaatgaatgaatgaatgaatgaatgaatgaatatatataaacttatatataagtcaatgaatgaataagtcatgtgctagtatatatgtggaataaattcccagaaatgaaactgagaatacagacacattcacacacacataaatataaaagtagatatgctgacaaataagtatataatcatgtaataatataattttaataatgtagtataacataagatcactattgtcataactatatggtaattattaaaattattgattacattatggtatattttacctattataattatatgttatataaatatatatacatatacactgatttcagcaagttgtcctccatagagtttgtactaatttattctccaacaagtaatatatgagagcccttctttcccacagttccatcaatagggtatttaatgaaattatttggattttagccaatctgtgatgaaaacttattagctcagtgtagacttaacttgtattattatgagtgaagttgaccatcttttcatatgattaagaagctaaatcacctacttgttctttgctcatttttccactgggttttcggtccttttcttatgtgtatacaaaggaaactagcccttttttcgagattataaacattttcatttggattttgacttcacttataagcttttagttttgcagtctatttgattttttgccatataaaaaatgtcattattttatttttgcaaatgagtggatggtaatgccatttactaaggtaagaaacacaggggaaaaaaaaaacagtctggaggggaacaagatgggctcaattctagtcatctaaaagtagatttccggtaagcaactggatttacaaatctcaggagagatttgaactagaaatataatttttggtgtcatcagcacattgcttaaagctttcagaagagacaaaatcatcaagaaaatgtctaagaaaaaataagagtcaaacacaaaacacatatcaaggaaacaccaatatttaagaaatgaggtcatgaagcacaagaaggtaatatttggctacatcaaaagctaccaaaagtgcaagcagcttgaaagtttaagtatccattgtagaacttccacttctagccaccaggtttatgacaggaagcagaattatctgtcagctgcaaatagctacaaaactcaacaaaatgtaagaaactattttcagatgctggctatcaggcattccagaactggatatactgaggtccccaagagaaggagaagaaataagatgagccctgccatcgcccaggctttagatctagagactatgtcagactgtagcacaggaaaagaagaactcaaagagaaccaagtaattttgctgagttgaagaaatagagcttagagtttggtgaggaatcaaggcaaatggaaattccattacagagtatcgggagaagggagctatgcagggaaaaggttcagcaatctatctagaggtttccatgaaatgccaatctgtgcatgcttacaaaacactcctcaaagcccagcaaaaccagtttcttaaggcgaaaaaaaatgaccagggaggaataaaaagcaaaattcccagacaaggcaatttatcacaaaatatcacaaggcagggaatctttcccactatccagagttgaaagaactccacgaatacaaaggtcattcagaaaagaactcagaacagcattattttagaaaggagattatattaccaaaagataaaggatattccagattctccctagaggagcttaaaaactaacctcaaaagcatcaagccaaaccacaagacaacttgcttaactgcctaccagaacgagtctgtaacttcttaagcaaagcaaaattcaacattcacaaatgtaaaattaacaatgtcaaaaaaataaaaaaaaaaattattaaacctatgagtaatcaggaactataactcataaagagaaaaattagccaataaaacagacccagaaacgaggtggtgaaattgataaaaatcttaagaaaacctcttatgaatatactttcacatactcacagatgttaaaggaaatggaaggtagggggaaagataaatggaaatttaagagataaaaaataaaatatttgctttcgttgctgcagcagacgctgtgagtattttcaatgcttcagaagaggcttgcctctagtgtcctccgctgtggcaaaaagaagatctggctggacaccaatgagaccaatgaaattggccatgccaactcctgtcagcagatccagaagctgatcaaagatgggctgattatccataagcctgcgactgtccgttcctgggctcactgccaaaaaagcaccttggcctgccagaagggcaggtacatggtcataggtaaacaaaaagggtacagccaatactcaaatgccagagaaggtaacctgggtgaggagaataggaattctgcatcagctgctcaaagatactgtgaatctaaaaagactgatcgccacatgtatcacagcctgtacctgaaggtaaaggggagtgtgttcaaaaacaggtggattctcatggaacacatccacctgctgaaggcacacagacccacaagatgctcctggctgaccaggcagaggcctgctggtctaagaccaaggaagcatgcaagtaccatgaagagcgcctccaggccaagaaggaagagagcatcaagactttgtccaaggaggaagagacgaggaaataaagctccccttctcttgtctgtacatagtggtcttggtgattatacagatcaatcattaaaataaaacaagcctttatctgctaaaaaaaaaaaaaaatctgaaatataaattttgttgaataagattaaaaggagattagacagtgcagcacaaaagatgaaatcatttgaaaaggaaaaagtgttatttaaataaaggaagaaacaaaaagcctgagtcccacatgaaaaagaaacaaatgggatgggaagtaaggaaagaaaagtaaggaaaggaaggagggaaataaggagaaacattttccaaattttatgtaaaccataaacccacacagatgcatcaaattcaacaaatttgaaaagataaaacacacaaagagagaaagaaggagagggagagagagagagagagagagaaccaaaatatattatgatcaaattgctgaacatcagtgagaaagaatactaaaagtagtcacaggaaagacatataggcatatctcagagatactgcaggttcagttccataccgcaacaataaagcaaataccacaataaagcaaataacacaaaaatgtttgttttcccaggatatataaatgtttacactatactgtagtctattatgtgtacaatagcattatgtctgaaaaaacaacgtacataccttaatataaaaataatgtttgaggtgaaggatacccactatgccctgatgattgttatgcattatatgcctgtatcaaaatatctcatgtacccaatatatacacctactatgtacccataaaaattaaaaataaaaaagattttaaacactttattgctaaaaatgccaatgatcatctgagcctacaacgagtcaaaatctttttgctggtggagaatcttgcctctatgttgatagcttctgcctgatcagggtggtggttgcaaaaggttgggttagctgtggaaatttcttaaaataagacaacaatgaagtttgccacatcaattaattcttccttcccaaaagatttctctatagcatgtgatgctgtttgatgcatcttactcacaagtagaactttcaaaattggaatcaatcctctcaaaccctgccactgctttctcaattaagattatggaatattctaaatccttttttatttccaagatggcagattagaggcttttagtgggcctcattcacttggaaatagcaagatagtgtacaaaggccaactctgagagctttaattcacaaaggaaaacaggaatccactggaatcgtgacagacacctcagatccaaggaagacacacaaacacaaacagcccctattatggcatccaattgataaaagtgagggaagcccaagtatgcaagacagtcagaaagcctccctctgtgactcacttttccactggagatctgagcaacccaggtcaagaaagagcactttgtttcttctaagccctggatctaacttggggacaagctgatttggagatgctgtgagggacagacactcggaaaagctactggcatttcccagacccaggatggagagcaggacactattttaaatgtgggtgcatgcaagtcaaccattctttggcaacccagtagcatggccacataggcttctggctctggagcaggacagaggtcttcacagccacactgtagttagtgcctcagcagtaggtgctgggattgtgctctcctccactgcaggtcaaggatgagagaagagctgctacagctattgtttctcctggacaaccagacttcaagccagatccagcttagcaacctggaactggtctgcatgtgccatgattggttgccacagcctgttcccctgtggtgcagcagggccctctctgctctactccctggcaaaaatccaggcatttggagcaactgtttgcctggacaagcaggctgaaccacctcacccttcatggatatagatcatggcacagtggaggcctctctgctccacatgcaggcagatctagagctattcagagcaccccctcacctgcaaccgcagtctgagttgccttacccttcctgtgtgtgcatagattgtggtacagtggggccctctccactccacatggagacagatacccaggcatctaatgcacctgctcacatggactagcagattgagttgccccacttttcctgtgcagagattctgtgcaggggggccctctctgctccatgcccaggcaaatctccaggcattcagagcatctgctcacctgaatcagcagcctgacttgcctcacccttcctgtgcagagatcctagtgtagggaggccctctctgcttcacactcagacagatctcccaggcattcagagcacccactcacctggatcagcagcctgaactgctccatccttctatacatagattatggtgcagcaaggcccttccactccattgcccaagaagatctccagatattcaaagtacctatttgcccaaattggcatattgggccatgccactcttcctatgaagagatctgggtacaggcaggccctccctgcttcatgcccaggcataactccaggcattcagagcacctgcttgcctggttcagcagcctacatcaccccaaccctcctccgcagaaatcttagtggtggtggggtggcagggggaccctttccacttcatatccaggcagatgtccagccatctggagcacctactcttcaggattaggagtttaagctgccacccatccctgtgcagagaacttagggccaaggaggtctcccagcttcatacccaggtacacctctgggtgcttggtgactacccactggattctccctatgcgctgacacttgtgcttgccactggagggtctggcggtgagcctgcccagtccagccctgcatatctttccctctgccccctcagggctgagcaggaaactcagactactgtacactccacaaatcagcccactgcctgaggcaacggagagctgctcccagtaaacaaggatcaaatatatacccagtcacactggcaacacctggctcttacccataagcttataggccaaactacacagcccaatataaaacctgccaactgaagtgcataggactataaaaacaaagccaaaagactctacacagcattatttccactcacaacccctaaggagtaggggaaagggaaagaagaaaaaaacaacattgtaagacaagaaagaaaaaatcctaccagtacgaaaataattacacaaattagcagtgccagtgtctccagatgggaagaaaccagtacaagaatactggcaccatgaaaaaatctgaatgtagtgccaccacagaaggatcacactagctctccagcaatggtccccaaccaacaaggacactcagaaatgacaaagaactcaaagcatgggttgcaaggaagctcagagatccaagacaagattgaaaatcaatactaaaaaacttcaaaggaaatccaggaaataagaggtaaagatttttaaaagaaatcaatcagagcttctggaaatgaaaaaggtttacttaagaaatttcaaaatataactgaaagctttatcaatagactggaccaagcaaaagaaagaatttcaggccaggcatggtggctcatgcctataatcccaacacttgaggaggctgacgtaggaagaccatttgagccaagtagcttgagaccatcctggaaaacataaagagaccgtgtctttccaaagaaatttaaaaattagctgggcatgatggtttgcacctatcgttctagctacttgggaggctggggtgaaaggatcacctgagcctgggagttcaaggctgcagtgagccatgatcacatcactgcaaaacagatgaacaaaaggaaaaaagaagaaaggaatgaaagctgatcttttgaactaacccagtcaacaaaaatagaggaaaatgaacttttaaaattgaacaaagtctttaagaaatacaggattatgtaaagcgatcaaacctataaattattagcattcatgatacagaaagagaaaaagcaaacaacctggaaaatatatttgaggaactaactcaaaaaaatttccctaatcttgctagagtagtagacatccagatacaacaaatccagacaacaactgtgagataatatacaaatccagacaacacttgtgagataacatacaaaatgaacatcaccaaggcatatactcaccaggccgtccaaggtcaatgtggtgcggtggctcacgcctgtaatcccagcactttgagaggccaagacgggcagatcaagaggtcaggagatcgagaccttcctggccaacatggtgaaaccccgtctctactaaaaatacaaaaattagcttggtgtggtggtgcatgcctgtagtcccagctactcgggaggctgaggcagaagaatcacttgaacccaggagctggaggttgcagtgagctgaggtcgcaccactgcactccaatctggcaacagagcgagactccacctcaaaaaaaaaaaaaaaaaaaaaaaaaaacaagaactgaaggaagagatatttaatgaaatagatagcataaataaaaaaacttcaggaaacaatggacacatttacagaaatgcaaaatgctctggagagtctcagcaatagaatcaaacaagcagaagaacgaacttgagagctcaaagacaaggtttttgaattaacccaatccaacaaagacaaaggaaaaagaataagaaaatatggacaaagcctccaagaagtctgggattatgttaaacgaccaaacctaagaataatcagcattcctgagaaagaagataaatctaaaagtctggaaaatatatttgggggaataattgaggaaaacttcccagccttgatagagacccagacatccaaatacaagaagctcaaagaacacctggggaattcatcacaaaaagatcatcgcctagacacactgtcatcaaattatctaaagttaagacaaagaaaagagtcttaagagccatgaggaaaaagcaccaggtaacctttaaaggaaaacctatcagattagcagcagatttctcagcaaaaactttacaagctagaagggattgcagccctgtcttcagcctcctcaaacaaaacaattatcagccaagaattttgcacccagcgaaactaagctacataaatgtcggaaagatacagtctttttcagacaaacaaatgctgagagaatttgccactaccaagccagcattacaaaaactgctaaaaggagctctaaatcttgaaacaaagccagaaaacacatcaaaacagaacccctttaaagcataaatctcacaggacctacaaaacaaaaatacaatttaaaaaacaaaacaaaacaagaaaaccaaggtatacaggcaacaaatcgcataatgaatggaatgatacctcacatctcaataccaacgttgaatgtaaatagcctaaacattccacttaaaagatacagaactggccgggcatggtggctcacgggggtaatctcaatactgggaggccgaggcaggcagatcacaaggccaggagttcgagaccagcctggacaacatggtgaaaccctgtttctactaaaaatacaaaaattagccgggcgtggtggtgcgcgcctgtaatcccagctactcaggaggctgagacaggagaactgcttgaacccaggaggcggaagttgcagtgagccctgattataccactgcactccagcctgggtgatggagtaagactccatctcagaaaaaacaaacaaacaaacaaacaaaaaaaaaaatacatatataattgcagaacggataagaattcaccaaccatctgctgccttcaagaaacacacctaacacataaggactcacataaacttaagctaaaggggtggaaaaagacattccatgcaaatggacaccaaaagcgagtaggaatagctattcttataccagacaaaacaaactttaaagcaacagccattaaaaaagacaaagagagtcataaaaggccttgtccaacaggaaaatatcacaatcctaaatatatatgcacctaacactggagctcccaaatttataaaacaattactaatagacttaagaaatgagacagcaactataatagtgggggacatcaacactccactgacagcactagacaggtcatcaacacagaaagtcaacaaagaaacaatggatttaaactataccctggaacaaatggacttaacagattatacagaacattctactcaacaactgcagaatatacattctattcaacagcacatggaactttctccaagatagaccatatgagaggccacaaaacgagcctcaataaatttaagaaaactgaaataatatcaagtactctctcagaccacagtggaataaaatggaaaatcaactctaaaaggaaacttcaaaatcatgcaaatacatggaaattaaataacctgcttttaaatgatcattgggtcaaaaatgaaatcaagatggaaatttaaaaattcttcgaactgaacaacaatagtgacccaacctatcaaaacctctgggatacagcaaggcagtgcttagaggaaagtttataaccctaaatgcctacatcaaaaagtctgaaagagcacagacaatctaaggccacacctcaaggacctagagaaccaagaacaaaccaaacccaaacccagtataagaaaggaaataaccaagatcagagcagaaataaattaaattgaaacaaaaaaaatacaaaagataaatgaaacaaaaagctggttctttgaaaagataaaataaaattaatagaacattaacaagattaccaagaaaagaagaaagaaaatccaaataagctcaattagaaccgaaaagggagatattacaactgataccaaggaaatacaaaagatcattcaaggctactatgaacccctttatgtgcataaactagaaaacctagaggagatagataaattcctggaaagataaaaccttcctggcttaaatcaggaagaattagataccctgaacagatcgacagcaagcagcaagattgaaatgataatttaaaaattacaaacaaggcacctgggaggccgaggcaggtggatcacctgagatcaggagttcaagaccagcctgcccaacatggtgaaaccctgtctctacttaaaatagaaaaaagtagctgggcgtggtggtaagcagctgtagtcccagctactcgggaggctgaggcaggagaattgcttgaacccgggaggcagaggttgcaatgaggcgaaatcgcgccattgcactccagactgggggacaagaaggagacttcatctcaaaaaaaaaaaaaaaaaaagtccaggactagagagattcacagcagaagcagaagtctaccagacattcaaagaagaattggtgccaatcctactgaaactataccacaagacagaaaaagaaggaaccctcccgaaatcattctatgaagccagtatcaccctaataccaaaaccaggaaaggatgtaaccaaaaaagaaaactacagaccaatatccctgattaacatataagttaaaatccttaacaaaatactagctaaccaaatccgacaacatatcaaaaagataatccaccatgatcaagtgggtttcataccagggatgcagtgatggtttaacatacacaatgtgatgatacaccacgtaaacagaatcgaacacgaaaatcacatgatcgtctcaacagatgcagaaaagcattcaacaaactccaacatccctctatgattaaaactcagcaaaatcagcatacaagggacatacctcaatgtaataaaagacatctatgacaaacccacagccaatgtaatactgaataggaaaaagctgaaagcactccctctgagaactggaacaagacaaggatgcccactctcaccactcctcttcaacatagtactggaagtcctagacagaccacttagacaagagaaagaaataaagggcatctaagccgggtgtggtggctcacgcctgtaaccccagcactttgggaggctgaggcaggtggatcacgaggtcaggagttcgagatcagcctggccaacatagtgaaaccccgtctctactaaaaatacaaaaacttagttgggcatggtggcaggcgcctgtaatcccagctacttgggaggctgaggcaggagaatcacttgaaccccagaggcagaggttgcagtgagctgagatcgcgccattgcactccagcctgggggacagggtgagactccgtctcaaaaaaaaaaaaaaggcattcaaatcggttaagaggaagtcaagctgttgctgtttgctgatgatatgattgtttacctagaaaaccctaaagactcccacagaaagctcctagaactgataaaagaattcagcaaagtttccagatacaacattaatgtacacaatcagtatctcttctatacaccaacagcgaccaagctgagaatcaaatcaagaacttaactcctcttacaatagctgcaaaaataaataaaatacttaggaatacacctaaccaaggaggtaaaagacctctacaatgaaaactacaaaacactgctgaaagaaatcatagatgacacaaacaaatggaaacacatcccatgctcattgatgggtagaatcaatattgtgataatgaccatactgccaaaagcaatctacaaattcaatgcaattcccatcaaaataccaccatcattcttcacagaattagaaaaaacaatcctaaaactcatatggaaccaaaaaagagcccacatagccaaagcaagactaagcaaaaagaacaaatctggaggcatcgcattacctgatttcaaactatactctaaggccacagtcaccaaaacagcatggtactggtataaaaataggcacatggaccaatggaacagaaagaacccagaaataagcccaaatacttacagccaactgatattcgacaaagcaaacaaaaacaaagtggggaaaggtcaccctattcaacaaatggtgctaggacaactgacaagccacatgtaggagaatgaaactggatcctcatctctcaccttataaaaaatcagctcaagatggatcagggacttaaatctaagacctgaaactataaaaattctggaagataacattggaaaaactcttctagacattggcttagtcaatgatttcatgaccaagaacccaaaagcaaatgcaataaaaacaaagataaatagctgggacttaaactaaagagcttttgcacgacaaaagaacggtcagcagagtaaacagacaacccatagagtgggagaaaatcttcacaatctatacatctgacaaaggactaatatccagaatctaaaacaaacacaaacaaattaagaaaaaacaaacaatcccatcaaaaagtgggctaaggacatgaatagacaattctcaaaagaagatatacgaatggccaacaaacataggaaaaaatgctcaacatcactaatagatcaagaaatgcaaatcaaaaccaaaatgcgattccaccttacttctgcaacaatggccataatcaaaaaataattgatgttgtcggggatggagtgaacagggaacacttctgcactgctagtgggaatgtaactagtacaaccactatggaaaacagtgtggagattccttaaagaactaaaagtagggctgggagcagtggctcacgcctgtgatcccgacactttgggaggccgaggtgggcagatcacctgaggttgggagttcgagaccaggctgaccaacatggagaaaccccgcccctactaaaaaaaaatacaaaattagctgggcatggtggcgcatgcctgtaatcccagctacttggaagactgaggcaggagaaatcactttaacccaggaagtggatgttgcggtgagctgagattgcaccattgcactccagcctgggcaacaacagtaaaactccgtctcaaagaaaaaaaagaactaaaagtaaaactaccatttgctccagcaatcccactcctgggtatctacccagaggaaaagaagtcattataagaaaaagacacttgcacgcaagtttatagcagcacagttcgcaattgcaaaaatgtggaaccaacctaaatgcccatcaatcaacaactggataaagagactgtatgtgtgtgtgtgtgtgtgtgtgtgtgtgtattacatatgtgtgtacatatatgtgtatgtgtgtgtgtatgtatatatatgatggaatactactcagccataaaaaggaatgaattaatggcattcacagcaacctagaggagattggagactattattctaagtgaagtaactctggaatagaaaaccaaacatcatatgttctcactgatatgtgggagctaagctatgaggacgcaaaggcataagaatgacacaatggactttggagactcagggggaaagggtgggaagcggataagggataaaagacgacaaattgggtacagtgtatactgctcaggtgatgggtgcaacaaaatctcacaaatcaccactgaagaacttactcctgtaaccaaacaccacctgttccccaataacttatggaaattaaaaaaaaattttaataaaaaaatggagaaaccccatctctacaaaaaatacaaaaaattagccagatgtggcggcacaagcctgcagccccagctactcaggaagctgagatgggagaatcacctgaatctgggaggttggagccgaaattgtaccactgcactccagtctgggcaatcagagtgagacagtctcaaaacaaacaagcaaacaaatacttctagacctaggaaaagacttaaacaaccatacataataatgggagacttcaacagcccactgactaatgcattagcctgaccactgaggcagaaaactaacaaagaaattctggacttaaattcaacacatgatgaattggacctaacagacatctgcagactacttcatccatcaaccactgaagatacactgttctcgtctgcacatggaagatactacgagatcaaccacatgctcggccataaaacatgtctcaattaattcaaaaaaaaaacaaaatcataccaaccatactctcagaccacagtgtaataaaaataaaaatcaataccatgaagatctctcagaaccacataattacatggaaattaaacaacttactcctgaatgacttttgggtaaacaattaaattaaagcagaaatcaaaaagttctttgaaataaatgaaaacagagtatcaaaatctctgggaagcagcaaaaaagtataaacaggaaagtttacaacactaaacacctacctcaaaaaatcagaaaaatctcaaatcaacaatctattatatctagaggaactagaaacaaaagaacaaactaaccataaagacagcagaagaaataaaagcaaagaactaaatcaaattaagaccaaaaatacaaaggatcgatgaaacaaaaagttggttttctaagaggaaaaacaagaccgacagactgcaagctagattaacaaaagaaaaaagagagagaagatccaaataagcacaatcaaaatgacaaaggtgacaagcaaccaatgccacaaaaatacaaaagttccttagggacaattatgaacactcctatttacgcaaactagaaaacctagagaaaatggataaattcttggaaacccacaatctcccaagattgaatcaggaagaaatagaaaccctgagcagacatcagtattgaattctgaaattgaatcaataattaaaaacttatcaaccaaaaaaatccctggaccacatggatttacagccgaattctatcagatgtacaaagaagggctggtatcaatccttctgaaactattccaaaaatcaaggaggaactcactgcaactcattcgaaggatgcatcaccctgatacgaaaacctggcaaagacacaaagaaaaaagaaaactacaaaccaatatccctgatgaacataagacacaaaaatcctcagtaaaataactagtaaaccaaggctcggcacagtggctcacgcctgtaatcccagcactttgggagcctaaggcaggtgggtcacctgaggttgggagttcgagaccagcctgaccaacatggagaaaccccggctctactaaaaaacccaagttagccaggcgtggtggtgcatgcctgtaatcccagctactccagaggcttgaggcaggagaatggcttgaacccgggaggcaggggttgctgtgagacgagatcgcgccattgcactccagcctgcgcaacaagagccagacaagagcaaaactccgtcgcaaaaaaaaaaaaaaaaaaaaaaaaatatatatatatatatatatatatatacatactagtacaccaaatccagcagcacatcaaaaacttaattcactgtggtcaagtaagtttcattcctgggatgcaaggttggttcaacatatgcaaatcaataaatgtgatccaccacataaacagaatttaaaataaaagtcatatgaccatcccaacagacatggaaaaagctttcaataaaatccaacatcccttcatgataaaaaaaaaaaaaaaaaacctcttgaacaaactagacatcaaaggaacatacctcaaaacagtaagagccatctatgacaactccacagccaacatcatactgaataagcaaaaaatggaagcattccccttgagaactggaataagacaaggatgcccactcttagcacccctattgaacacagtactggaagtccttgccagaacaataaggcaaaagaaagaaataaaaggcatccaaatagaaaaaggagaaggcaaacaatatctcttcacggaaaatatggttctatacctagaaaacctgaaaggctccaccaaaggctcctggaactgataaactacttgagtaacgtttcaggatacaaaatgaacaaaaaccagtagcatttctatacaccagtaacgttccagctgagagccaagtcaagaacacgatcccatttacaatggccacaaaatacaatacaatacaatacaatacaatacaatacaatacaatacaatacaatacaatacaatacaatacctaggaatacatctaaccaaggggatgaaggatctctacaaggagaactataaaacactgctgaaagaaatcagagatgacacaaacaaatggaaaaacatttcatgttcatgaagtggaaaaatcaatatcattaaaaataaaaaacatttcatgttcatgaagtggaaaaatcaacatcattaaaatggccacacagcccaaaggaatacacagattcaacactattcctatcaagctaccaacatcattttggacaaaactagaaaaaaactattctaaaattcatatggaaccaaaaaagggcctgaacagccaaggcaactgtaagtaaaaaggacaaagtcagagatatcacattacccaacttcaaactatactataaggctactttaaccaaaaaatcatggtactggtaccaaaacagacacatagaccaatggaactgaaaagagaacccagaaataaagctgcacacctacagccatctgatcttcaacaaaattgacaaaagcaatagggaaaggactccttaattcaataaatggtgctgggatagctgactagccatacgcaaaagaatgaaactggacccctaactcaagatagattaaagatttaaacagaagacctcaaactgtaggaatcccagaagaaaaaagaggaaacaccattctggacatcagccttgggaaagaatttatgactaaaagcaattgcaaccaaaaaactgacaagtgggacctaattaacctaaagagctgcttttgtgcagcaaaagaaactctcaacagagtaaacagacaatctacagaataggagaaaatatttgcaaactatgcagccgtcaaaggtctaatatctagaatctgtaagaaacttaaatcaaaaagtaaaaagcaaataatcccattttaaaaatcggcaaaagacatgaacaaactttcatcaaaagaagacatacaagtagccaaacatatgaaaaaatgctcaacatgactaatcataagagaaatgcaaatcaaaaccacaataatataccatttgtaccagtcagaatgacaattattaaaaagtcaggcctcggatttctggactgatagtgagcactggcttcaacttaaagtcaccaacctcaccagtccctaacaagaaagtcagcctgtactttgaagttttgaagccagccactgacatcttttccctagctatgacagtcctagatgacaccatcttccagtagaaagctgtttcatctacattgaaactctgttgtttacagcagctacactcatcgattaccttaactagatcttctgataacttattgcagcttctatatcagcatttgctgctagtgggtggtttcttggcccacctgaagggcagacagcttttgcttctacttgcccatcagaaacatgattttttgcctggagtcagaatgaaaaatattcctatccttcccccatcagcagatggcttttccttctctctctctcccttaggacaagtatatcatgtgcaaggattggaagacaatatttttaaactcaatcctccccagtttgagcttagatcaaggcaataagaatcaaaatcccagaagcctttctggtatgtcattacacatcactttgaaaggtgcatgccaaaactgagagaaagtaagataactgactgcaaaggaacacaacacaactttttgaggtggtagaaatgttctaaatcttgatttgggtgagttacaggattatacacactttgtcaaaactcatcaaactgcacacttagagaacatgaactttattatataaaaatattaatgatcctatcttttaaaacttcagccagtttttctagtagaaattgacaagctggcaatcttagagtttgtgtattttcttcaatgctgctcagaactctgacagtagaatttgtccagagttagcattttccaggcagatgccacagaacaacaatgatataagggagttaaagatattagcaaaagaatggttgatgaaatagaccgagcagagaaagaaattttaaaagagggaggggaactaatgagcagggagaggaataaagtagaaacattttgtgaacgattaaagagcatattcctatagaaagagaagcaatcttttttaaaaattgacaattgtgccttagaaatcaaagagacttcaccttcatggctaagctcaagatgaagccatccacatgatacagcaatagaggcagcactatactaacaaatctcattaatattaaaccaaacaagtaatctaatggctacattattctccaggagtaaaaagtttgcttcaaggcagctcataatctggctcactttaaacaaataagtcaaagatcccccaaatgaatccagtaaacacgagaattttctatatttctatatttctatgtcaatataaaatacacatacaacacaattttctattttcctgacttggcaaacacaatataatgtacagagtttcatctgtctttgacatattgtgaattttaacacctcagaatatcatcataaaggtaatgtttttaatcaaaggcccccaaaaacgttattcttgactgagtggctttagagcatgtactcttctagttgcttgggaattttgtggagaacaagttacccacaaagtacctctcctggaagttaaaacagaggatttcttatatgcttaggcagacatactctagaatcatctttttaaaataagcaactagcaaatgcaatctggttttcctattgctatgttttggatatgtcccctccaaaattcaggtgctgaatctaaacggtcaatgtcatgtattaaaaggtggggtactttcagaagtttgaggttatagtgagctatgatcatgccaccacactccaacctaggcaacagagcaagaccctttaaaaaaaatcaggcctttaagaggtaattaggtcatgagggctcctcacctcgtgaatgggattaagaccctaatgaaagagatttcacccctgtcctttcacaatgtgaaaacacagcattcctcaccaccagaggatatagcaacaagacactatcttggaggcagagagcagcccttattggacaaccaaacctgctggcagcttgatcttggacttcccagtctttagaaccatgagtaaataaatttctcttctttataaattacccagtctatggcattttgttacagcagcacaaacagacttaagacatctatcatttgactatctcattaagtttaggcaagagcataatctcctattatactggcaatggaaatatactgaatcaaagataaaagcaatcatttttaaacattagtattacatgcagtgcaaaaacccaaagtgacggcagtcttacattgccaaagccatcaaaaggggaaggagagggaagaacagcagcataagctgctggcagaggcagggaaagacaagcagaaaggaaagagagaaagagacaaagtcagagagacacaggggaagagacagagagaaaaagagggagtcacagagaaagagagagacaacaaagaagtcaaaaagaaagggagatagaattagtaaagaaaaaagcagtgtaccctattcctttaaaagccagggtaaggttctgtctacccagccaaggtatattcttcttatgtggaatgtctacctatatctgcctccccactaactggaccggcacctgcaccttagtctttccaagttccaacattaacattgccccaggaaatcagaccctatcagtacccctcaaagctcaagtccatcagcacagagccatacaactaatacccctacttaatagggttaggaatggctactgctacaggaaccggaagagccagtttatctacttcattatcctactaccacacactctcaaaggatttttcagacagttttcaagaaataatgaaatctatccttactctacaatcccaaatagactctttagcagcagtgactctccaaaactgccgaggcctagacctcctcactgctgagaaaggaggactctgcaccttcctaggggaagagtgttgtttttacactaatcagccagggatagtacaagatgccacccagcgtttacaggaaaaggcttctgaaatcagacgcctttcaaattcttataccaacctctggagttgggcaacatggcttctcccctttctaggtcccgtggcagccatcttgccgctactcgcctttggaccctatatttttaacctccttgttttgtttcctctagaattgaggccaccaagctacagatggtcttacaaatggaacctcaaatgagttcaactaacaacttctaccgaggacccctggaccgacctgctggcactttcaatggcctagagagctcccctctggaggacactacaactgcagggccccttcaaagcccctatccagcaggaagtagttagagcggtcatcggccaaattcccaacagcagttggggtgtcctgtttagaggggggattgagaggtaacaacgtgctagcagccctcactcactctcagcacctcctcggcctcggtgtccactctggccacgcttgaggagcccttcagcctgccgctgcactgtgggagcccctctctgggctggccaaggccggagccggctccctctgcttgcgggaaggtgtggagggagaagcgtgggcaggaaccaggactgcgcgcagcactcatgggccagcacgagttccgggtgggtgtgggcttgatgggccccgcactcagagtggccagctgatgccgccagccctgggcagtgaagggcttagcacccgggccagcagctgcggaaggggcaccgggtaccccagcactgccggccctcccgcgctgagctcgaattcttgccaggcctcagccacctccccacagggcagggctcaggacctgcagccccccatgccagagccccccccaccaaggtgggctcccgtgcagccggagcctccccaacaggcgctggcccctgctccacggcgtccggtcccataaaccgcccaagggctgaggagtgcaggcgcacagtgcgggactggcaggcagctccacccgtggccctggcatgggattcactaggcgaagccagctgggttcctgtgttgggtggggacttggagaacttttatatctagccaaaggattgtatatgcaccaatcagcactctgtgtctagctcaaggtttgtaaacacaccaaccagcactctgtgtctagctagaggattgtaaatacaccaattagcactctgtctagctcagggattgtaaacgcaccaatcagcaccctatcaaaacagaccaatcagctctctataaaatggaccaatcagttctctgtgaaatgggccaatcagcaggatgtgggtggggtcagataagggaataaaagcaagctgcccaagccagcagtggtaacccgctcggtccccttccacactgtggaagctttgttctttcgctctttgcaataaatgttattgctgctcactctttgggtctgcactgcctttatgagctgtaacactcacctcgaaggtctgcagcttcactcctgaggccagcgagaccatgaacccaccgggaggaatgaacaactccagacacactgctttaagagctgtaacagtcaccgcaacggtctgtagcttcactcctgaagccagcaagaccacgaacccaccagaaggaagaaactccaaacgtgtccgaacatcagagggaacaaactccggacacaccatctttaagaactgtaacactcaccacaagggtccacagcttcattcttaagtcagtgagaccaagaacccaccaattccagacacattaggatatgccttttttttttcagtgacatccaaattctctagcacttcaaaacagtaagcttgttgtatctcatttttgttgtttcctgttcaatgtaagaatttccagccagaaacagtggctcatacctgcaattccagcactttggaaggtcgaggtgaaatgactgcttgaggccaggaattcaaaactagcctgggcaatgtagcaagatcctgtctctacaaaacattttaaaattagccaggcatagtaatgggtgcctgtagtcctagctattgaggaggctgaggcaggagaatcccttgagcccaggagtatgaggttatagtgagctatgactgtgccactgcactccagcctggactacagagcaagaccctgtctcttaaaaaaataaaaaaggaaaaaataattctgtcaaaatttttcctagctctcaatacaaagttttctaaatcttgaggggaggtgaagattctgtatagaatagtctccattttctccaaattcttcctaattttttataatttcaagaataagttacatttcaaattataccacagataatgctaatatggtgataaattatttaatattcttatcatttagagatgcatgctacaagttaagaacatatctaagattaacttcaaaataataaaggatgcagtatatataggggaatatattatgtaagattggccaaggaattaataattgttgaaactgggtgatgaatacatataggttcactttctcaactttgctaaactatgtttaaagttctccctaataaaaagatttttaaagagtaaacaataggtattaaatctaattaaattgttcttagaaataattagacacaaaaaacagtattaattgtaaattatttataacaaaatttagaaggaaattaaatgtccaaacataaaatattaattagttatagaacactcattccatgagataccaagtagccactaaaaatcatgttgcagaaaactcattgatataaaaagaattcacaatatacttctaagagaaaaaaaggcaggttacaaaataatatgtacagaattgaaccattttttaaatgtgagcatctgtgtgtgtatgtgcgtgtttgcatatgtgtgtatttctgccaaatactgacagactttgtttcattcactgctttatccccagcacaaaaaactgtacctggaacataataagaacaatacatacttgttgcaggtaaaggttttagaattccagacaacagggtttcccttggggtatgattctctctacgcttttgtttcatacggtttctcaaataaacattcagttttttctgttattgggggaaaacctttaaaattgtatctcacataacaaaattaaaatttatttgcctgattcaataattacttcatgaaatgcattcaataaaatcatcttatacactgaaaaaagaaaggcctcttctatactttgaatgaataaactggccacggcaatcagaaatagtaaaaacaggccaggcatggtggctcacgcctgtaatcccagcactttgggaggccaaagcaggcagatcacgaggtcaggagatggagaccagcatcctagctaacatggtgaaaccccgtctctactaaaaatacaaaaaattagccgggcatggtaggggacgcctgtagtcccagctactcgggaggctaaggtaggagaatgacatgaacccaggaggcggagcttgcagtgagccaagatcgcgccactgcactccagcctgggcaacagagtgagactctgtttcaaaaaaaaaaaaaaagaaaaaaaaagaaaagaaatagtaaaaacaataacctgttaatcagtcttatccctgtgagtgaattctgctgctgagcaataacataaccttactatctttaggaaactaatacttctaaaatgaatctttaaaacgggtacaaaaaattataaaatcagttttaaaaaattagtccattatattcattcaatacacacttactgaatttgtagacaataagttacctgctagggtaatccaaagaaaattaagttgtagcccttgataaccaagaggctcccaatctagtgggaaagatagatgaataaaagctaaatgaaacataataataaaggtagctgacatttattaggttctttttttggcattgtgctgacacttaacaagcattttctttcttttttttttgagacagagtctcactctgttgcctaggctggagtgcagtggtgcaatcttggctctctgcaacctccgcctcccaggttcaagcaatcctcccaactcagcctcccaagtagctgggattacaggtgtacaccaccacgcctggctaatttttgtatttttagtagagatggggtttcaacattttggtcaggctagtcttgaactcctggcctcaagtgatccgcccacctcggcctcccaaagtgctgggattacaggcgtgagccaccacacctggccaaacaagcattttcttatttaatccctataacaatctttttggtagttactacgatattctcagtttttagataagaaaacgttaagacttaaatgacttcctcagtcacttgagtaataaatggcaaaacagaatcaaaccaaataaaccctgtcccagatacaatatagtgtctctcattattaggatgctagtaaacaccaaagtggactctatcagttccatcagttactatcaagtataacacaatagtcaccttttttaaggtagatatccttttggaagtcttcccaagaatttcttatcttcaactcaactagttatctccactttgaaatacactattacaaccattaacctatgagcctctagagcacaggattcagtagtttctcttctcccagtgctatacaatgtatgcactcaagaaatattaaacagatgaacttttagcttcttttatgcttcctaaattccaaatcactatgccatattacataatagttggtctaggtcaatagcaatttcatttatgttattaggaaaatgtggtatgagagaatcagagaataaaattctgaagtgctaaattatggtggttatgctaatggcggaacactgctgactgtataagatgaaccaagatactcttcctccagggacttcttcctaatcttctaaatgtcctataagccaaattttataagagaactggaaatgtgcaaaactagggggtagttttgtttcttgcaaaaatctggtgataaagatctgagctaaaaatagcgagaatgatgggaaataattcaagagatatttcaaaagcagaatcatttctcactacatgcaagacaaaactcataactaactgcggaacctaagaccttctcagtcatctcatttctgtttcctacagcctagccagagtgaactacttcttaaaggtcctgaattctcacataacattttaaaactcccacaataactgtaatataggccgggcgcggtggctcacgcctgtaatcccagcactttgggaggccgaggcgggcagatcacttgaggtcaggagttccagcctggccaaaatggtgaaaccccgtctccactaaaaatacaaaaattagccaggcatggtggcgggtgcctgtaatcccagctactcgggaggctaaggcaggagaattgcttgaacccaggaggcagagttgcagtgagccaagatcatgccactgcactctagcctgggcgacaagagcaaaactccatctccaaaaaataataataataataataataataactgtaatataaaaagcagatagtgtgcagtcacttgtatgttacataagaaatagacagtagaacacaggaatgggaaaggcattcaaattttgtgttggaaaatgaatgaatgaagataatgcaggagaccttcataactgatttgagaagggactagcagctatctcttcatgatgagataatacaggccctacctctatatcaccattttctcttacaacatgatcttccccttctctctgcctgtcaaaattaaccacctccttaaagacacaatcaaaaattttctctgggaagtttaaagaaatcacctcctcacttctaccactgtccccacccatccacacaagcacacacacatacacaaagaactagtcccactgtctactatggtcccacagcacttggcacctgcctcattgtagtacttagtacagtgattcattattcctttcattattatgtactgtatgagaatatcactagagctagaatatgaattccataaagatatggatcatgtcttatctagcctatttccattaaatacctaccacagaacctcacacactactgtttaaataacatatctaataaataaatgaataaacaaatgaaaacaaatttgctaactcctggagacctaaaggaacctcaaaatgtctgtgacttaaaacatgcctttatgggaaaaaaaaaatatatcttcctatataaacgcttatggctaaccatgacctgcttcaacttaaatcagttttgctaccacagcaataaaaaatacacatatatggctagaagtcgatgcaaaggccaaaagcatccctaccagggctgaaatggccaatggggatattccaaattttatggttgcaaaatgacccaattaatcttagatttcagcaaagtatacatgctaactgaacaaagacaaaagtcactggagctcaagtcattattccaagtgactctaagctgttagtccctgtgttaatggagcctgttaaacaacccagtattagaaaacactggagctcagagggagcatgctaccccatgcacatttcccaagtatcctcacaataaacttctattactgaagataatctatgtacttctctaccttgagtcttaagagacctaagtaacagtaaataatataggaaaccaagcagaggaaagaatcacacaccaaatgtgaactggaaaaagtgacaacgccaattagtaaagattaggtgggctgaacacggtaagattaggtgggctgagcacggtggctcacgcctgtaatcccaacactttgggaggccaaggcaggcggatcacaaggtcaggagatcgaaaccatcctggctaacacagcgaaaccccgtctctactagaaatacaaaaatttagccaggcgtggtggcgggcacctgtagtcccagccacttgggaggctgaggcaggaaaatgccgcaaacccaggaggtagagcttgcagtgagccaagatcgtgccactgcactccagcctgggcgacaagcgagactccgtctcaaaaaaaaaaaaaaaaaaaggattaggtagaaggtgaggattcagttctgaacataatgcctttaaggagacagtaatcaaatatttgggtttttggttttgggggtttctgttttgttttggagacagagtctcattctgttgcccaggctggagtgcaatggcatgatcttggctcactgcaacatctgcctcctgagtccaaacaattcttgtgccccagcctcccgaggagctgggattacagaagcacactaccatgctcggttaattttttgtatttttagtagggatggggtttcgccatgttggccaggctggtctcaaactcctggcctcaagagatccagccacctctggctcccaaagtactgggattacaggtgtgagccactgtacccgaccagtaatcaaatgttatttaggagactggaaatagtgaataagactgagtacaaaaattccaagtctcaaaagtatttgtgggtcatttcaatcaaattgaagccattagagtagataaactcaccaaggaaataactatgcaaaataaataaataaaggaggaaaagatagaaaatgcaaagtcactgtcaattatgcactgtgaagatcagttcataaccgaacataaagcaggcagagaaacagaggcaacaggagaatcaaaatgccagagaaaacttcaagaaacagatatgaggaatgttaagaacagagaaaaagtttctggtcttgccaaaacaataactaatttgcaacctagagtagtttcattaataaacaaggcctgaccatgttggaaggctgaaacagaatacactcgtagaaacagatttttaaactggggggcaaaagtgtgattacaggaataaagtcctaagagctatgaaaagggacatgttcaaaggtcagataaaaggaagaagagaaaaaattgtcgtgtgacagaagcaaaaattatgtagaacaataatcaaatgaaattaagatgaaagtacataaggcagcacctcttcctaacagccactgtatttcaatcttctctaagaagtagcagaaagcatctgtgttaaattatatgaaaacatgagggcaggacaggaaagaaagtgtgaagtgagaggactggagctgtttctgaaaagtctgcaaacaccaaaacacatgaaacagctcagtcagtcataaaaggccttacggcagaaaaaatgaagggactatatttggtcctctttctttattttctctgtttccaaccttggaacagcagtttgcaagtttgtggacaggttgtaacttctgctaaggatgtctcttcagttttgaagagactcaggaaaagttcagaagaaaggagagagctgtttatgattggctaaaggcttttttttattattgtggcagaatatacacaacataaagtttactattttaacatgtacaattcagtgatccatacattcagctcttgtgcaacaattactgttatccatttcccaaactttttcatcatctataatatggtgatctagtaagaaattcctggcacactgcccctaaaacctttggaatttcccgaatgataagggtggaagaattatcttttgctattcataataagtccctttcaaacatatttgagcttatgctaaagagatgactcttggtaggcccctacaaagctgcaggggagtgggtagggaagctggtcacccaagaaatcaatcatgtgattacatagtcagaactttcagccccacctccagggaggggagaaggactagagactgacctaatcaccaatgaccaataatttaatcaatcatgcctacagggtgaagcctccataaaaaccctaaatgatgggactcagagaatttcttctggatcgatgaacacatccacgtgctgaaagagtgatgcaccccaactccatggagacataagctcctgcactggggacccttccagacctcaccctatgtgccttttcatctgtatatcctttataataaactggtaatagtaagtaaagtgtttccctgcattcaatgaatcattgtagccaatgactgaacttgatttgtagccaagtcagaagtaccagaggcctggggcttgcaactggcatctgaagtggtggaagtcttatacaactcagtccttaacctgtggtgtctgacactcactccagggagatagtatcaaaattgaattaaatgctaggacagagaactgagagctgtagggagaaaaccccatgtatttggtgtcagaagtcttataagtgtagaaaaagttttttatcatctccaaccaaaattctatacccattaaataactttccattttccacttccccatagtcccgtgtaaccactattctactttctgtttctatgactttgactattctagtggaatcatacaaatttgtccttttgtgtgtactttgcttcagttagcataatgttttcaaggttcatccatgttgtaacatgtatcagaattttatccctttttaaggctgaataatattccattgtatatatatataccacattttgtttatccattcatccgctggtggacacgtgagttgcttccacctttgggctgttgtacataatgctgctatgaatataggcacacaaatatcttgagaccctgctttcaattcttttgggtattgcattaatccgttctggcgctgctataaagaaatacctgagactcggtaatgcataaagaaaagaggtttaattggctcatggttctgcaggctatacaggaagcatagcagcttctgctctgcttttggggaagcctcaggaagcttccaaccatggtggaaggcaaagggggagtagcacttcacatggccacgtggccagagcaggaggaagagagagagatggggaggtgctacacacttagaaacaaccagatctcgtgagaaccctatcacaagaccagcactgtgggatggtgctaaaccattcatgagaaactgctctcatgatccaatcacctcccaccaggtcccacctccaacactggagattacaatttgacatgagatttgggcagggatacagatccaaagcatatcaggtatatacccagaagtggaattactgagtcacagggtaattctatgtttataatttcttgaggaattgctacactgtttcccacagtgggtgcactatttcactctcctaccagcaatgcacaagggctccaattgctccacatcctcaccaacacctgtgattttctgctgtttttttttttaataatagtcatcctaaagactatgaggtggcatctcattgtagtttccattgcatttccctgattactagtgatgtcaagcatcttttcatgtgcttattggccaatgtatacattttctttggagaaatctctaagttccttgcccactttttatttgggttatttgttttggagaaaagcttttaaagagagacacagaggaaagctttctgtacaatcagatctagctctctagtcaaaaataattggtgatatagtttgcatgtttgtcccctccaaatctcatgttgaaatgtgattcccaatgatggaggtggggcctagtaggaagtgtttgggtcatgggggaggatccttcatgaatggcttggtgttgtccctggcgatgagtgagttctcactctattaattcacaagaaagctggctgtttaaagagcctggcacctcctcttctctcttggtccctctctcttcccatgtgacacacctgctcccccatgccttctgccatgaataaaatcttcctgaagtgtcaccagaaactaagctgatgctgctgccatgcttgtacaacctgcagaaccatgggccaagtaaatctttcttcattaattacccagtctcaggcattcctttatactagcaacacaaaacagactaatacaattggtatctgccctctagatcttttaggaaactaatcatggagaagaggcactggcaagagtgctaacccagcagaagagaaaaaacttccacccctgagaacagagatttctttttcataaagtgccttctacctgatttcagctctgtaactgtcaatctctttttctcttctggcagatttccctatccactagagcataggttttaatgaccacactgctggtagctgtatcactactaatagtagctacttaatgagtcataagtgttactgctatgtgctaggcatgatccttcatctcatatgtgaaatctcatttaaaattaagtcctactaatgatgccgagaagattatcatggttcttacacaaggatgatatgcaaattcattaagtgttccatttaagaaaagaaaaaagaaaaaaaaaaaaaacctcttgtaccctagcagtttcatcttgaatactgttaaaaaaaaaaaaaaatacatctttaaaacacatgaaaggttttcatcctttagtccttcaatgtaacattattaaacgatgtcaaaaagtctcaaagttagcgttaaataacaagcattttctaaattatacattgaggagtctgatcttgaatccacaaaataaaacatcttttctacatcaactacaggaagtacatttttacctcaaactagtaaaatgaaaggttttgttgttgttttttgagacgaagtcttggtctgtcacccaggctggagtgcagtggcactgcagcctccgcctcccaagttcaagcaattctcctgcctcagcctcccaagtagctgggattataggtatgggacaccatacccagctaatttttgtatttgtagtagagacagggtttcaccatgttggccaggctgttctcgaacttctgatctcaagtgatctggccacctcaacctaccaaagtggtgggattacaggggtgagccaccatgcctggccattttttttttcaatcctgctcccttttgccttttaaaagctcaacattttataaatatttagcaaatgtttagctctgaagtaataaagttgatttttcttaaaaaattcaactagaactagaagtgaacatcgtctttttatactcttagaaagttatgtgtttctcatgaaaaaatgttcaccatcactggccatcagagaaatgcaaatcaaaaccacaatgtgataccatctcacaccagtttgaatggcaatcattaaaaagtcaggaaacaacaggtgctggagaggaagtggagaaataagaaaacttttacactgttggtgggactataaactagttcaaccattgtggaagactgtgtggcaattcctcaaggatctagaactagaagtaccatttgacccagccatcccattactgggtatatacccaaaggtttataaatcatgctgctataaagacatgcacacatatgtttactgtggcacaattcacaatagcgaagacttggaaccaacccagatgtccatcaatgacagactggattaagaaaatgtggcacatatacaccatggaatactatgcagccataaaaaagggtgagtttatgtcctttgtagggacatggatgaagctggaaaacaccattctgagcaaactatcacaaggacagaaaagcaaacaccgcatgttctcactcataggtgggaattgaacaatgagaacacttggacactgggtggggaacatcacacaccagggcctgttgtagggtggggggagtgaggagggatagcattaggagatatacctaatgtaaatgacaagttaatgggtgcagcataccaacatggcacatgtatacatatgtaacaaacctgcacgttgtgcacatgtaccctagaacttaaagcacaataaaaaaaaaaaaaagaaagtgatgtgtttcttcaaaagatgctgacgacgtcagacacactttttaaacagtttggaagctgtcttcagagacaaatgctttacaatcaatatttcatttaatcttcacaaaactcaaggagaaggtagtatataacttccattttacgagtaaattcagacagaaaagctaaataacttgcccaccactgcatttcagtaaatggcagagctgagattagagccaacatctatcggactctaaagcaccagctcttaattgcttcactttctatcattgttttgatagcaaaatagatgtaatctgatgatctcatagtgtatttacttttataaaacagtattaaatttatgggggtttaattaattattggcaccataaagacctgaaaccacctaagaaaataaatgctctgcaatagacagaagagcttttttaattatatgaaagtcttgtttttcaactctatcataccatttcctcttaagttgggctctttgcccaaaagtactctaaaattataattttctggcaaggagttttaaaagaagctgaaattttctcttcttccttcacccttggactctaatttttattatctaagaattttctccacttatcataaactggaaagtgatatgatttctttacatttcttgtaacaaacctatacaaaattaacaaacactgcaacatactccctatccctaagacatgttattacattcgctttcttaattactaattactcaaaaatcacaaattcagaaaatatagacaaatttgaaaatgctctaacatattcacgtcctattaaaataaatttgaaaattccctaacatattcatgttctagtaaaataaaaattaaaaataattttattagaaatatggacacctataaggctcatacattttaatccagttcgttgtaagtattctgaaataaccatacctagatttgagaactaaaaaaggcaactgaatctttaattgatttttttcttctttttgagacggagtctcactctgtcgcccaggcaggagtgcagtggcatgatctcagttcactgcaacctccacctcctgggttgaagcaattctgcctcagcctcccgagtagctgggactacaggtatctgccaccatacctggctaattttttttgtatttttagtagagacagggtttcaccatgttggtcaggctggtctcgaactcctgacctcaggtgatccacctgcctcaacctcccaaagttctgggattacagccgtgagccaccgcgcccagcattttttttttttttttttgtcacccaagcgcagtccaagctggaatgaagtggtataattacaagtcactgcagcacaacctcctaggctcaagcaatcctccaacctcagcctcccaagtcactgggacaaaggcatgcgccaccacgcccagctaattttttgtttgttgtagagacagggtctcaccaggtcacccaagctggagtgcagtggtacaatcacagcctgctgcagccacaaccccccaggctcaggcaatccttccacatcagcctcccatgtagatgggactacaagcgtgaaacaccacacctggcaaattttttttatttttagtttactttagtttgagacagggtctcactctgtagcccaggctggggtgcggtggcatgatcatcgctcactggaacctcaacgtcccaggctcaggtgatgctcccacctcagcctcctggctgtgaccacaggtgtgcaccaccatgcccagctaatttttgtatttttttgtagaaaccaggttttgccatgttgcccaggctggtcttgaactcctagactaaagcaatctgcctgcctcggcctcccaggtgctgggattagtgcatgagctactgcacccagcctaaaatctgctcttatcaacagtggtgttatttgtcttggattattttattttctatctttttcatttaaaatgacactaggtcatctgaaatatttagtggtgagaaaaaagtaagactgggtattaggattatagtgggtcaaagagcaaccagagcaaataggaagaacataaagataaaagtctgctctgaatagtctatatcacgtaatttgaatttatatatgcccaatttctgactcaaacttagaaaataaatgtgtagtggagagactatccagagaaaagagctcaaaaccaccagtgtcatcacttttggcagaatatccatagtttgaaagaaaaaatcagttatcctatctatgaataaaatgctattaaaaataacaggatattagttattaggatattagtctccaggttaggatcttgaaatatcatttcttactaagagaaaccacggctttttggagaaatggatgattccagatctaggacaagaagtatacaagatgggccccaaatatcacagcagacaacaaggaaactatcaaaaaccactagggtcatgttatctcctgaagagactcccactaaccaaaggtgagacaatttgcgcttcagtgaaagtgattccaatggattaaatccatcaagtatgtttaaatccatcttctcataatggcatttaaaagaaaaaaaaatggccacctttggagaaagacagggaactaattcgttatcttgaaaacttgtaaataaaaggaaagaatcaaacatttatcctgtctttcctttatcaacagtaccactgggtaactaaacagaagatgaggggaagttactttttataaaaacattccaattaataaatgaaagcaaaatgatgtatttagaatttcattatattgcaacacccactaaccatccacagccgctaacatcacaaaaaagaaagacaattagacattatgatattcccatggtcttgccaaaccccatctatatatatatatatatcacaatgcctaagggatcgaacttgagtctgctccatctctggatccagctgcacgtttgcagaaaatacagaagacaaaggaacatgttgaactgacctatattaagcaatcagcaaaatccaactctgggaaactagtacaaacaacctgggttctccaacaggaaaaggaaaaggatggaggactaaactaaagattaaaagtgacaactcatatcaaaactgctttttgggctgggtgctgtagctcatgcctataatcccaacacttggggaggccaaggcaagaccacttgagcccaggagttcaagaccagcctaagcaacatggcaagaccccatgtctacaaatacacaaattacctgggcatggtggccaatgcctatagtcccagctcctcagaaggctgaggcaggaggatcccttgagcccaggagggtcaggctgtagtgagctgagattgcactactgcactccagcctcagtgacagggcaagatcctgtctcaaaaaacaaacaaacaaacaaacaaacaaaacacaacctagagacagtgtttccctcttgttgcccaggctagagtgcaatggtgcaatctcagctcactgcaacctccacctcctgggttcaagggattctcctgcctcagcctcccgagtagctgggattacaggtgcctgccaccatgcctagctaatttttgtatttttagtagagatggggttttgccatgttggtcaggctggtcttgatctcctgacctcaggtgatctacccacctcggcctcccacagtgctgggattacaggtgtgagccaccgtgtctggccaaaacttactatttcttaatcatcaagactaacctacagtatctagcaatgcacatttgggttattactacacaagtcaggaaaatgattacttatagggaaaggccactgtgatctatttctcaacctgaggggtgattacaaaggtatctgccttataataattcaccaagccatacatgtgttctgtactaatgttttattttgcaataaaaagattttttttaaaatagcaggttaccagcacacctgaacatgtcaacacctaaaaacggctagatatgttttccattctctactctaactgagtgaaaacaataggataaaaatagaaatcaggccgggcatggcggctcatgcctttaatcccagcactttgggaagccgaggtgggtggatcacctgaggtcagtagttcgagaccagacaggccaatatggtgaaaccccatctctactaaaaatacaaaaattagctgggtgtggtggcacacgcccgtagtcccagcggcttgggaggctgaggcaggagaattgcttgaacctataaggcggaggttgcagtgagccaagattgcaccattgcattccagcctgggcgacagagcaagactccatctcaaaaaaaaaaaaaaaatagaaatcagtgtgcatcatttcctccctacccacttcctcttctaaaggaaccacttaatatcacattttaggccaatcagattcactttcttgggattatgaaattccaagaaagagactatagatatccaaacctgttctcccggtctttcctcattccccaagttgtttcaattcaaaacataggagccaggattgattctttttttcccctcattccccacatctagtctatcagcaagtccttcatttataactccaaaatatcgcaaatctctcaacttctatctccactgactctaccatctcaaatcacaaactattcaaatagtttcctaacttgtttctcttttattcttaaccctctacaatctactctacccaaagcagccaaaaggatgttttaaaaacataaactgcttaaaaacctttaatgacagcacacagagctctgacttaaatccaaattcctttccatggccggcatcattgaatccgtgcccatctctctgagctcatctctagccactgtcctcttctccaatccaggcacactggtgtcatttcaattcctcccacacattaagctctttcccacctccaggccttctcatagctttcccccctgcctggaatacttttcccttgctactcacatggataacttctcaatgtcaggttacaacttaaatatcaccttctcagagaagcctctgccaactgccctattaagcaggtttcaccatctttctctacacactacttatatctttcatagctcaagctacaacaagagtgtatgttatatgagggcaaagaacccacctgtttcattcaccaatgagcatctggaatgtggaaaacaattaataattactgaatgtatgaataaatgaggaaatgaatgaagtaaaggccgaatgccaattttgccatgagtagtgatcagtaagtaaagaaagccagttttcagaaagaacagagcaacacaacagagaacaggagactatgtggcttggttccataaacagagtcaagaaaattagctgccaattataaattataaatgtgtgtgtgtgtgtgtgtgtgtgtgtgtgtgtgtatcaagatagcagaaacatctgaaaaatttactcaattcacctctatactaagatgtctggtattatataaatctataaactaattcagaactcaaaataatactacctaaactaattatcattaatgttaacactttgtaattctcattttgctatgagtcatttttcaagatatactcctatgatgtactttcagaaattcaaggtaatcttcatgtcgatattcacggtatgtatgcaaacaatgaattttttttgttgtttttttgagacggagtctctgtcgcccaggctggagttcggtggcgcaatctcggctcactgcaagctccgcctcccaagttcacacgattctcctgcctcagcctcccaagtagctgggactacagatgcccgccaccatgcccggctaattttttgtattttgtttagtagagacagggtttcaccatgttagccaggatggtctcgatctcctgacctcatgatctgcccacctcagcctcccaaagtgctgggattacaggcgtgagccaccgtgcccagcccaatgaacgtttttgagacagggtcttgctctgttgcccaggatggaatgcatccacacaatcatggctcattgcagcctcaatctcctgagctcaagcaattgtcccacctctacctcccatttatgtaaatgtgtgggtctgtactgagtctcagtatcaatgaatttttttttttaaatgttgaaagccagtaatatatgatggcctgaagtgttcctagagtcaactaaagactgagtttctctagttgacatgcaacagaagtttgtttaccggaagtattgcaaattttattgtcgcactccctctctccaagaaggaagagccaactgactattcccatcagcacggcctaaagcaatcctaatcaagttaatgccaccctaaattaaccaagaaaagccaaagggaagacagcagatgctttagggaccaagttgttaattcagagatgctcctgtttggttggttcttttccccttggactaactactttgaatattttgtccacttgcctacctctagaattggaaattttccctagggccttcctctgagtctgctggggtttttttaagagttcttagagttcatcttctcaaagacaactccagctctctatttagtcaatctctctgatatacacacaattttactttccaacattccaaggaaacataaattagaaatatacacataaaatgacatccacccctcttctccctgcaataatatctttgtgatattcctactatctacttaactggtgtgttgctttctctcacccacttccattcataagcgctgagagttatctgctatctctctccattcctaattcctggcctgagatccgggctacagatgctacaagttgatgtgggctcttcatgctgaagaattcatgagtactttctgcttaactcctctatattctcaacccgatccctttgctttttctttccataataatctgttttctgatgggtaatccatccaaacactcatttgcccttatgaaattagtgttttctagctttccatttgcgtgaaggacccctaacatatgacttcaaccttcaattttatttcccccaaactaccctttcacactattaaaaataataataaaaaattgccacagaatccaactatagcttaaattaaagaactcacctgtcttgagagtaagtatgcttcaatagcttattcttttactatccttttagtgttttcattgttcaatgctaacctgccctccaaccataccttaatcaacgaattacacattttaaataactactaacactataacctatttgaggaacaagcctatctggtaaagtgtctcactccagcagtgatattctgtcctctctttgacaagtattaaatatattttcatgctgcccacctgtctatcatagagacccacctcccttctatgaaggttccacctggtgaagagcccatgttttctggtcatttacctttctacctatcaaagctggactattatgtggtcatttttctctcagctagcagttcccctataaaaaatccaataaattcggctgcgcggtaactcaagcctgtaatcccagcactttgggaggccaaggcgggtggatcacgaggtcatgagatcgagaccatcctggctaacacggtaaaaccccatctctactaaaaatacaaaaaagttaacctggtgtggtggcaggcgcctgcagtcccagctactcaggagggtgaggcaggataatggcgtgaacctgggaggcggagctcgcagtgagccgagattgtgccactgcactccagcctgggcaacagagcaagattccacctcaaaaaaaataataaaataataaaataaatccaacaaattccatctaaccaaaatgctaattaatgatcatttaataaaggagtccccaactcctttacagcacaatacagtggaccagtactggtccatggcctgttaggaaccaggcaacacagcaggaggtgagctatacgcgagcattaccgcccttgctctgggctccagctcctgtcagatcatcagtagcattagattctcataggagtgcgaaccctattgtgctgtgcatgcaaggaatctaggttgcacgctccttatgataatctaactattgcctgatgatctgaggtggaagtttcatcctgaaaccatttcgcccccaaccaaaccatctgtgcaaaaattgtttcccacgagactggtccctggtgccaaaatggttggggatctatgatttaatgaatttcccttcccagagggaaatccttttaataacgactttggccagcttgggcaacatggcaagacctcatctctacaaattaaaaaaaaaaaaaattaggtatggtggtgcgtgcttgtggtcccagctaatcagggaggctgaggtgagaggatcacctgagcacagggaggtcaaggctgcagtgagccatgattgtgccactgcactccagccagggcgatagagtaagacccaatctcaaaaaaaaaaaaaaagttaaaaagaaaaaaaaggacttctgaagacctcagtgacaagtatgttaacgaaatctaaggaatctaaaaactactctggtacctcaagttggtgacatgggtgaccacatctattgcctatgtttaacacaaaccttgttaaggagaccaaatcaatgaatatgagggtgagaggtgccttaaaaatcatctaggtctctgagtcatgattcttgaactgggctacacactggaatctccaactcccagaggagaagaagatgcccaaagaagcaaatttcaaagtcagtgacaaggccaggcctaatacccatgcctaacattatgtgttgatatgtgtacatacatacatatatatatacacacacatacatacacacacacacatacacacacacatatatatgtaacatactaaaaatataaaggcatgtatgggaaggacaaatatccaattcatgtcagtgattaccttttgggggatgggaagggagtgtaattgagaagaaatacacatggtggcttcaaatgtattggtaatatttttattaatatttcttaaactggatggtaatacctaagtatctattaaattaggctctgttcttttttctttttgttttgtttttatttttatttttgtttctttgagacagggtctcactttgtcatccaggatagagtgcagtggcacaatcatagctcactgaaacctcccactgctgggctcaagcaatcctcccacctcagccccacaaagtgctgagattacaaggcgtgcaccatcgcagtaggccctcattatcttctggatatctaaaattttgtaataaaatagaataaaaagatggtatataatcaaatgtatatcacattaggaattcagtgaaatatctcaggctagaaagtactcagaaaacatacttgatgaggtaggctttgatggaagaataaaacatagattattcttcaggcaaaaagtaacacaaacttttctaaaggaaaaatgtgaataaaggtaaagctgggagtacccacagcctataacataaataaagaacaacgggggccaggcacggtggttcatgcctgtaatcccagcactttaggtggccgaggcaggtggatcatctgaggtctggagttggagaccagcctggccaacatggcgaaacgttgtctctactaaaacacaaaaatgagctgggcgtggtggcgcccgcctgtaatcccagcctctcaggaggctgagggacgagaatcgcttgaatcaggatgccagaggttgcagtgagccgagattgtacccctccatctcaaaacaaaacaaaatagttttgaaaaccactggactaaagcgtccagctagaaggtactgctgcaattcaaaagtgagggtcataaaaccatggaatgggttttatggggtagtactcttgagaaagaaaacagaaaaaattaatccaccaactttttaatagaaaatttgataggctatagtgacaaactagatgggataatgaaagagtaagacctacctgaaaaaataaaaaatgccaactgagcagcagcttctagtcatacttgaacatcaacgacatcgataaggccatgtaaaagtcagcactaaggaagtgttattcaaggcagaaaagcaaaatggcacttttataaggattaagagcagaataagcaacagagaccaggagattacagaaaaagaggaccactacatcatggaatgataagaaagagagtttcaaaaagagccatcactgtatacaacaagagggtgcacagcctttgtagccaatcagatgcagaattctggcactttctccacttgaccaagttatttaacgtctttgagcctcatataataaggaaaacataagttaacaactaacactgttgaacacataggggcttcaaatatatttgtcaaattttatttcttaagctcagtcgtgatacataaatatttattaaattagtccccattatcttttgttgtttttgttttgtttttgtttttttgagacagggtctcgctctgtcccaagtgctttacatatcacctcatttaatccccacaatacatttcacagatgaagaaattaaacttagaactagcataataagtagcagagccaggattactatttcttaggatttaaataatgtatacttaaatttcctggcaaacaggatgacctcaaaacgagtagctatatttcattattaggagataataatcaataggggcaaaactgccagtaattcctgtcatagccttccatgtggcaaactctctcaacatcctcatctataaattaggattaatgcctataatccaatctactccatagggttgctgtgaggattaaatattatgaatatgaaaattctataaaaaatgttgagacattcaaatatcagggattgctgtcacatatctttcgccttcaaaaatgcttttgcggcatttttgttcactacttcaaaataagactctgaataagctaaaaataagtctgttaaaagtgcaaccaccactttgaaaagtataaatcaccacagaattgctgcctacacctgcccctgactcctccaggttctctaatgtctccacaagggcaaggattctcttacacctataatgaaactctgataacttacagtacagctaatcaatagagagctgcacttcaattcagagttgttcaaactggactactgtgttttctcagaggtgctccttccagttcttccagaaaagaaaaaagtgcccaattctcttatattgtattaaaacggtgcccaatgagtagaatgcaggtaacttacaaaatgctagaaaagaatctatcaattgacttgctcaagtgctctgacagcaggtcccttttggaaactccttcacgaccccccctttttttcacctgaacagatggcttccaggcttcaaggctcacatgtctagtcacacaattcacaatagctcccaaagttcctaacttttcaattatcccatgttcttgaacacacctttcatctaaagatctctagctgtcaaagcatacgaactctttaatcttcacaacagcactatctgagagattactatccttattttataagttaaaaatgaaagactgaggttaaatattttagcaacatcaaacaattcgttaattcattcttggggagagaggaatacatattatgaacttctgtcaatggacaacctagatttggcttcctaagatcattgcaaatattagctcaaacacatcccactcttgtatgcatacatttccaacacaggtgtcaaagattaaatataaactattaataacagtaaataccataccaaagcagcactatttttacacgcaaaactatattgggggagggggttctaatttaaacttcccactgtcttgcatccataaatacttttgaacttgagggggaagggggaagaacacctgtcagagcagcacatccacaatgttttacagactgtgtagctattaatatttaattcctcccgccccgggaggtcaggccgcagggagcccggcgctgcccacccgactttccacgcgccaggcctgccggccgcaggggaggctccggctcccgctcccctcaggtcccctcgcccgtggacagacgcggcgggacactcggacccgcctcccgacctcagcgcgcccggctcggggcccggcgggcggggagaggctcgcagcagggcctggcctagccacccccgccccgcggccgccggcgccgcttccctccttcttcccgctccccgattcgttacctcttaggcgccggcggctgctccatggcggccggggacagagagagggacctggtggacggcgaaggccgaaaggaggaaaggagccggggcaccggccggccgagcctagggcaccacagagggaaactctgggaactcggaccaactttcccgtaactccgcggcggatctccctcccgcttaggagcgcggctcctcccgccccgccccgcccccggccgccccgccccgcccccggccgccccgccccgcccccggccgccccgccccgcccccggccgccccgccccgcccccggccgccccgccccgcccccggccgccccgccccgcccccggccgccccgccccgcccccggccgcgccggccgccagcctgcggcggcggcccagagaaggtggacggagccgggcaccgcggcggggggcggagcctgccgcggcctgggttggcgggcggggccggtgccgcggcgggtgggcggggccggggacgaaggcctggctggccccagagccccgtgaccgggaaaaggagaaggttccgctagagctagggggcgaggccggagccgctctaggctggggaagggcaagtccctctgagctggcccagagctccgcccctagcctgccctcactacggtttgccctgatccaatttgactcatttctttggctttcccaacgacacatcctaacatcgtgtgaatccgtttgaagtattactttctcactgcccacgcttccctctctagttctgtttataattatcggttatgttttcccccagccatttgacatgtgtaggccacagtactagggatacttctggaaattcttgtttgatttttattgtggacaagctcctcgctacatttcacaataattacatctaattaccgagaaaataattcgtacagtgagatctctcggtacaccaaattcagttgcactgggcccttgcagctgtcccattgggtaacctggcaagcctgtcacaaattatgctgccaggaagaatactcaagaaaagtttgtttcctcccctctttggtcctctcccccaacctgattccagcagccctcatcccattgtaatctgaccactgcatgcatccatattgtgggtatacttttaaccttaaattccatatatacctttcacataacaatatacagctgctacatgagtttacttgtttttgtcagaaattgtcaagatgggccgggcgcggtggctcacgcctgtaatcccaatactttgggaggccaaggcgggcggatcacttgagctcaggagttcaagaccagcctggccaacatggtgaaacctcgtctctactaaaaatacaaaagttagccgggcctggtgatgcgcctgtactcccagctgcttgggaggctgaggcaagagaatcacttgaacccgggaggcagaggttgcttttaaccttaaattccatatatacctttcacataacaatatacagctgctacatgagtttacttgtttttgtcagaaattgtcaagatgggccgggcgcggtggctcacgcctgtaatcccaatactttgggaggccaaggcgggcggatcacttgagctcaggagttcaagaccagcctggccaacatggtgaaacctcgtctctactaaaaatacaaaagttagccgggcctggtgatgcgcctgtactcccagctgcttgggaggctgaggcaagagaatcacttgaacccgggaggcagaggttgcagtgatccgagatcgcgccactgcactccagcctgggtgacagagcagaccttgtctcaaaaaagaaaaagaaagaaagaaattgtcaagatgtagagttacatagaattttcttggaggttagaacaataaatatgaagagaatgttaaataaaggaaaccaatttgaagagaatgttgaataatgtgaatatttgcccaaattaaacttgactattagcagctaatacaagtttagtttagtcctctttttgcattattttaagtttcactatgtaataaacttacactattttcaaaccattatattctttcctaaatttagttattttaagaccattcatttttgaaactctaattctgagaacaagaaaaagggttttttttgttttgtttttttgagacaggttctcactgttccccaggctggagtgcagtggtgtgatcatgcctcactgcagcctcaacctcccgggctcaagcaatcttcccacctctgcctcccaagtagctaggactacaatgcccggctacaaaattttatacttgtttgcatttattaaagatccacagtctgactgttcagaaataacaggacaacaacaattttaaaacctaaatatttaaaatgttaaagctgagaagaatctttgaaattactccactctaacccccccaactctcatcttcacttccatgccatactcccagctttttttttttttctttcactcttgttgcccaggcttgagtgcaatgccgtgatctcaggtcactgcaacctctgcctccctggttcaagagattatcctgcctcagcctccctaatagctgggattacaggcacccgccaccacgcccagctaatttttcgtgtttttagtagagacagggtttcactatgttggccaagctggtcttgaactcgtgacctcgggcaatccacccacctcagccacccaaagtgctgtgattacaggcatgagccactatgccaggctcactcccatctttttgtgtttcatcagagaaacctcttgaggaaggctgggcgaggtggctcacaccttcaaccccaacactttgggaatccaaggcaggcagatagcttgagcccatgagttcgagaccagcctgggaaacatggtgaaacccatctctacaaaaaaaaaaaaaaaaaaaaaaaaaaaacaaaagaaatagctgggcatggtggcatgcacctgtagtcccaactactaggcttcagtgagccatgatcaagccactgcactccagcctgagcaatagagtgagaccctgtttcaaaagaaagaaaagaaagaaagaaagagagagagagggagggagggaggaaggaaggaaagagagaaagaaagaaagaaaataaatgatccctgaattgttttaccaacagcaatctccagggagcctttcccagtcaaaccaccagcatcatcacccactatctgtcacatttaagttgtgatagagatactgtcttgtatatatgtccgtagtaccctgtgttggcttttgtatgaaacttgtcacactatattgaagttctgtttattaggctgtcatcccaacccaactatgagttgattgaaagttgagccatatctttattctctataccttgcatagcaagtgcctgataaatcgtaagggcactgggctggatagcatccttttggtcctgcagattcattctccatccttttccatctgctctctgctctgagagctaatatgtatggctgacatcagaagccccttggcttatggttgggtctgatgatagacccagcaagagatcatctgagggagaaaggagggtgaggtcagactattggatgccctggttcccttcctgtgaggtgacctagggctagctgtgttccagagaatcatggctctttgcaaggcaaactactctacctaattattcctccttccccttgaccctttgggcctgagtatcatggctgctctgctattccctgggtttcttctctatgtcctatgttcccctaacctcaatcctcaactgatgctttgtaaattaaactcttttcaattgacactaatttgattgcaccttctaaagggcttatgatcttgactgatacacccataaagaattgtggaagtaggaggaatactatcagaaaataaatttctgaggtctttcctcaacttgaaaagggagaagactaataattatcatacgactccaataggatcagacactaggcctccattttctcattaaaccctgaaaacaaccttgtgaagtagttatttccattttataggtgagaaaactgaggttcaaaagtgtgaaaggagttaccctaggataaacagaatgtctgtgttctaatccaggcctttaagactccaaagctggaacttattccactgtagatcagtcaacaaatatttattgagcacttaagtatgccaggcactgttctaggtgctggatattcatcagtaaagaaaagagacaaatagacaaaaatccctgccttcaggggatttacattctggttggggaaacataataagataaaaaagtacctaatgggtcatgttagagattgaaaactggtaaggaagaaaagtgaaatggaaaaagggaatataaagtggaggggaagaggccggacgtggtggctcatgcctataatcccagcactttgggaggccaaggtgggcggatcacttgaggtcagcagtttgagaccagcttggccaacatggtgaaaccccgtctctactaaaaaaatacaaaaattagctgggtgtggtggtgggcacctgtagtcccagctactcaggaggtcaaggcaggagaatgcgtgaacctgggaggcagaggttgcagtgagccaagattgcgccactgcaccccagcctggacaacagagcaaaactctgcctcaaaaaaataaaaagtaaataaaaataaagtggaggggaagggatgaaattcaggtaggatggcaaaggaaggcctcaacgagagagtgactaaggaagtggaggccagagccatgcagatagcatgaatgtgaggccaagggaatgttagaatgtgaggccaagggaacaataagtgctaaggcccagaggcaggactgtgcctggtgtgttgtgtgttactcaataaaggaattgtttttctcctgaattacttagaagaagaaaaaaaaatgcttcaagcttctgttttactttgtctgttgaaaaccaacctgaagattccaggaagaaagcatagaagtcaccattcaaactgcaaataagaggcagcagcattcatgaacaaaggaaagctgcaggaacatttgagatacaggtaagggtcacccagcttcacttaactgtgaaagtaaggtaatcggccaggcgcggtggctcacgcctgtaatcccagcaccttgggaggccgaggcgggcagatcacgaggtcaggagatcgagaccatcctggctaacaaggtgaaaccccatttctactaaaaatacaaaaaattagccaggcgtggtggtgggcacctgtactcccagctactcgggaggctgaggcaggagaatggcgtgaacccgggaggcgaagcttgcagtgagccgagatagtgccactgcactccagcctgggcgacagagcaagactctgtctcaaaaaaaaaaaaaaaaaaaaaaggaaagtaaggtaatctgtttctgcttccaacagctccatttggaatcgagattaaatatacactttaattatactagcaaacagctgattacaattctcagttgagtgctctaagagaaatgggaaagaaatctgcaatttgagatccagtgcctttgaataacaaaaagcatacgttctttgtaactgaatacgtacaccaccatgtttaaaatattaagatagaaacatattaaggtaaaaatttttccttgtcatactagttgcagctattcattgaaactacaactttgtatttctcttaggctggagtgtagtgacacaatcaaagcccactacaaccttgaactcctaggctcaaggaatcctcctgcctcagcctcccaagtagccgggactataggcatccaccaccatgcccagctaagtttacttttgagttttgtagaaacagaggtctcactatgttacccagactggtctcgaactcctggtctcaagcaatcctcccaccttagcctcccatagtgctgggattataggtatgagccgccatggccagcctcatttttatatttgttggaaaaataatatcaattaacaaatgttaattaatcttttctgctataataaggaacagtttggggaagagagaaatcactaatcaaatatattgtgtaggtttttatttgcaggaaaatttggaaatgttttccttcaagaggtaactttacaaaacattttctcttgatctgtttctcttttctaacttagttttatagttagtttgaaactagcatgttgcatttgaatttaaccactgtcctcctttatcataacaatcttaaactattatttaacttgtttctcagaccacactgtgaacctcttgggaataaggacagtatcttcttcctatttgtcatgtcaggagtctagcataactattagctacaagtaacaactcaaaatgatttttaaaacaagaagactagaaggaggtgtttctaggtttgaataattcttcaatttacttccatttcttgttgttgatttaagaatcacaaggttcataaatttggagtggagagctttatttgttgtaaaaggttgcagcctgcaggctggccatcccacaatctgggaagcatagcctctgtcagaaaccggaagcaggcattttaaagaaggaagaatgagacggattggctaagtgtacatattcaataggttatagtgcctccttttcgtgaaaaaaaaaaaatatatatatatatatagatatctatatatatattcacaaaggcagacactcacatgcacaataagcaaacatgcatattatatatgtcccatgttcactttggggtggagatttaacatttacatgcattaaaattaagctatatacttcaaaaggtgaaaccgaagacacagaggcatcctgtgtgcatcctctgtaaatcagccacaaccaatccatggtggtcacttaccagaaaggaatgctggtcagttgtattgtcaaaaccacaaaaaaaggagtccagcaagtctttcaaaaggaatagttcctgtttaactcaggaaagaaagtctaaaggcaattagcaagggaagaagtataatgaggtatgtctgaccgcctatcctgtcatggctgggaatttagtttttaaggtttctctggggtccccttggccaagggggggtccattcagttggctgcggggcctaggatttaatttctatttctcactgctctgctgtgcacagcagacctagttgtctcctcaaactatctccctcccctcagaggacaaatatggccaccaatgttccaggccttacatggagacatgacaatgcccagcaccagaagataattagttatttctgaatacaacttttataagatggtaggaaaagtctattccagaagcccctctgcagacttccctacatgtcctattggctagaaatgtgtcacagacatgttgatgaaaaatgccaaactgtgtaaaatatttgaagaggtttattctgagccaaatgtaaggacaatgacctcaggaggtcctgagaatacgtgcccaaggtggttgggttacgcttgattttacacactttagagagacagaaactacaggcaaaaccataaatcaatatacataaagtttatattggtgtggcctggaaaggcttctcaaagttggggggtgcagggggagggttccaggtcataggaggatccaaagattttctgattgacaattggttgaaagagttaagttttgcctaaagagttcaaatcagcagaaagaaagtcttgtagttaaaataaggggggttatgggagccaaggttcatgttatgtagatggagcctccaggtagctgacttcaaagggaatagatggtaaatgtctcttatcagatatttaccagttaaatctctcctggatcaggaaaagatatggaaagggaagaggattctctagagaaagtaaatttttcccacaagagacagctttgcagggccattccaaaatatctcaaagaaatatatttgggggtaaaaatactttgatttcctttagggcctgttatttgtcatgtgatgtgaccagaggcagtttggagttggtatcttattgctataaagagtctgttctgtcaatctgaggattgctattttaatgttaacactggtcagttgtgcctaaactctacttccttcataacctgaactagtttttcaggtttctttggaatcccttggccaaaagcgggtccatttagtcagttgaggggggttagattttatttttggtttatagccccatctctgacaaagaaaaggggataaccaaaacctgttacgaccatttgtgattcaccccatggaggtgggtttagagttgaggctgggactagacttccctgaagtttatggcaaagagaaccatgcagagaagaactgagaaaaaaaaaacctttatctgagggatgtgaatctttaaaaattatcaagcccattgagacagcaatcacattctactcccctgcaaccacctgtttagctatgtattcatctcttaaaactgcttgctattgccacaagtagctataagtgtacctaataatgtagcaccagacaccataagccacactttatagttgaacaatgtatagcaaatcaatagcttatgttattttaatatacattcttggcaatggaactgcctcttctttccctttaaaattctacttataactgctgctaactggagtgcatattcatggcaacttgaatctgtgctcccaggctgcaatcttccaacttgacccaaataaactctctacttatattaattttgtctccacttcttcctttaggtcaacagaacaaaattggaatccgattatgtagaaaaaatggggaaattgtaattagacaacagactacaatgtctgctacacataagtactcagaacgttataatcaattaatacatgtttgttggataaatgaatggatttccaagcaaagaaaacataaggaggctaggaggtccaagatcaagggcctggcagattcagtgtctggtgaaggccaacttcctgattcatagacagccattttcccccgtgtcttcacatggtagaagaggtaaacagcttcctcagacctcttttgtaagggactaattccattcatgagggtagcccttatgacttaatcacctccagatgccatcaccttcaggggtaagatataaggaatttaaagagacaccgtaattcataaactatatattttgtcaaccttaaatgatgagattcagaaaatatgattaagtatagagtttactccagcccaaagcttgagaatgaccttctgatgaatagcagttacaagtggggtgtaaggaaaaaagaagaggcaattcctaaattgttaccaggaatttacattgaaataacataagctcttgattggctattcattttttgtttgtatcacaaagttcaggaacataaagatagtgggtgaggcagctagacaggaacaaaatgcttttacacagttgcccctgggcatgggttggaagaggcatgactgaagttccatactcatgactctctgggcctaagagagtcattttgcatacctcacatagctcagactactctgagctatttttcttttctcataagagaaaatgagtatgccatttgtgattttgtttcttctcaactctagattgatccttcattgcctgctctgttaaaatagagctaggtcctttaagtaatttttctttaccagatggcatgatggtaaactttgtcagtggacagcactggagagacattgcaaaagaaaaaggtttccttcctggtgggcatatgttccctctgcaggctcctgcacccagggctgcttttctgggtcctactaaatgggcaacttcaacattgtccagccaggtcctgcaacacatgtaccttcatcagcctttggttcctgcagtgcagagcagcaacagcacccagtggccaacagtttccttcccaccacaccccactcctccctcaggcaattttgctaccgagtgcccgcattgagacacctcaccatgaacagctttcccagaaacctaagaggaagatttctgcaaagttccagaaggaagatttccagcaagttctgtcagcatggcactacagtaacttctctgccattcagtgagacacagctgtgtcctcttcaacaaggtctggatctcaatcctggggggcctcttccttggatgctctagctcagccccagggaggagtagctgttattcctgttgtcttagtcagttcaggctgctataacaaaacatcataaactgttggcttataaacaagagaaatttgctgggcatggtggttcacgcctgtaaccccagcactttgggaggccaaggtgggcagatcacctgaagtcaggagttcgagaccagcctgcccaacatggtgaaaccctgtctctacctaagatacaaaaattagccgggcgcagtggtgggcgcctgtaattccagctacttgggaggctgaggcaggagaatcacttgaacccaggaggcagaggttgcagtgagctgagatcgcactattgcactccagcctgggcaacagagtaagactctgtctcaacagaaaaaaaaaaacccacaagagaaatttatttctcacagttctggaggctgggaggtccaagatcaaaggtctggcagattcagtgcctggtgagggccaacttcctgattcatagacagccatctttccccgtgtcttcacatggtagaagaggtaaacagcttcctcagacctcttttgtaagggacaaattccattaatgagggtagccctcatgacttaatcacctcccaagtccccatctccaaagtcaccaccttcagggttaggatttcaacatatgaattttggaggaaaataaacattcaaacaatagcacctatattctttagaggtgtctttgcttcttactagccaatcccttgttactccagtcctcagttatagttaataattctttatattaaacttttcctgttcaaataactgtggtctctatctcttgtggtttctgtatcagattggaccttgactgagacagagagtaatagcaaagaatcccaggccccactataaactcagaaaaatgatttagataagatcagattgatttcactttcagttcaacacataattatctacatcagcagatctcaaacttttctgtctcggtaccattttacacttttaaaaactatggagaagcttaaagagcttttgtttatgtggattatatttatcaatattaagaaattaaaactgagaaaattttaaaacacaagatacataagcacacatttcattaggcatcagatcaatgatatcattacatatccatgtggcatctggaaaactccatcatacactcatgaaagaaggagactgaaaaaggcaaataatatttaaaccttgtttttaaatagttttgaccttgtggaccccttgaaatggtctcagatacccccggaggtacctggatcacactttaagaactattgatctaaactaactttatataaacacaataactaagacctatgaagggaaaatatagaaaatatggcccttgccctctcagaactgcttagttgaagatatagagtatatattcatgaaagagtaaaataacaattcaattctgtatgtaataaactatcagtaagttctatcattcagaaaagtgctgtagttcaggctgataacaggctggagctcagcaaaaaaaaaaaaaaaagaaagaaagaaaaaaatggctttcattttataaaattcaccctccttatacagtagttacaaggagaaaaaacgtttcctttatgtacaaacctaagttccagaacaagctgaagatctctcaaaacacagcaatgattggctaagacactaaacacagccacagagctaaggaagagaaaagaaccaacactaagaatctgaaagactccataagatgaagccctttcatagtgagtctttagttacattgatataaggaaacttgtccaggtatggtgactcacatctgtaatcccagagctttgggaggcccagacgggaggatcccttgaggccaggagttcaagactagcctgggcaacatagtgtagacccccatctctaccaaaaaaatgtaaaagtcaactgggcatggtggcacacacctgtagtcctagctacttgagaagctgacatggaaggatcacttgagcccaggagtttgaggctgcagtgagctatgattgcaccactccactccagcctgggtgacagagcaagaccctgtctaaaaataagtaaattagtcttggtgtggtggctcacacctataatcccagcactttgggaggccaaggtgggtggatcacttgaggttaggagtttgagaccaacctggtcaacagggtgaaaccgtgtctctactaaaaatacaaaaaaaaaaaaaaaaaaaaaagtcagatgtggtagggcacacctttagtacgagctactcgagagactgaggcagaagaatcgcttgaaccctagaggcagaggttgcagtgggccaagatcatgccattgccctccaacctaggtgacaaaatgagactccatcaaaattaattagttaaaaaatatataagaaacctaaactctataaactaatgtttcttgctttaatcatttttctttatatatttttgatctttcaatttctttttattcctgcctgtggcctctatgaataatttctaatgtgtcttgactgaactaagcagaaagaagacttgtttacttctaggcgaggagagttagggaagtaagaatacccctagataaatgtgtactggtggcatcagttaatgctgttggaaaacagggcaatgaggcctagagcaggagcgaaaaaagaggagaggtagatgcttagtagacagagagaagctgcagtaaactcagctgccctaaggccagtctgagcatgtgatacattcaaagtaagctcaaattcaattgcaaaaagtttggaaagatgaaaatttttactaaaaatctcacagaagtgccgagggaggaattgtatgcatattaacacagcaaaacttcccaaaaatcctctttaccggtctttttccctaaagttttcctgaaaacctgcccaaataacttctccaaataacttcaccaaactctcaaggttattccattttctcatactcacccttctctccctccccgcaatcccgcccccaccctaccatcgaggccgtttaccttccttggctattacttcaagacctttcccccaacacacaaaataataatttaaccttcttctttgtttttgttttgtttgtttgttttgtgtgtgtgtgtgtgtgtgtgtgtgtgtgcgcttgtggcttttttgtttgtttgatttttgggggggggcggtttgagacaaggtctcactctgtcacccaggctggagtccagtggtgtgatttcggctcactgcagcctcaaattcccaggctcaggtaatcctcttgcctcagcctccggagtagctgggactacaggtgtgcatcactaggcctgacgaatttttacaattttttgtagcaccagggattcccactatgttgcccaggctggtcttgaactcctgggctcaagcaatcctcctgcctcggcctcccaagtggtaggactacagcatgaaccaccatgcccagactaacctcttccttaactcaacatagatggagagataagaaatgaaggatccttccttcagtgggtgggagaagtaaagggagaaagactgaatattcaaactttaatatttttgttcctttcaaacattctttttaccaacatttattcattaagttgccagacacagataatgaagtgtggtccctaacctgacactatggaatatccatccccattacaatcttctttttgctctttctttggaattcctttccaaagggagtgattcccttacaaaaggtaattttttgcttaataaagtgattattttacaaaaaattatccatggaatacttttacgtggttaatttccctcaggtatttaaactacgatttcaatctcagtctttaggagaaagagggtaagatgactgtggcttctaaaatttcctttgaaacaaagtcaaagatattaggaaagttatctcaggggcaccttgcgaataaatcatcatccaagggttttgagtaactcaaaagtaaaaaaaatagatttttctgccatataatcagttgttataaaataccgtcgacaaagaactgttgaattatctctttatatttagccacaaataaggggagaaagtaatagagaagggtctgaacaccacagatttatgcttagtaaatggaaattattttgaaaaaaataaagagtaagggcattaaaaatataggctgggtgccgtggctaacacctgtaatcccagcactttgagaagctgaggcaggtggttcacttgaggccaggagttcaagaccagcctggccaacatggtgaaaccccgtctctactgaaaatacaaaaaattagctgggcatagtggtgcatatcagtaatccagccactcaggaggctgaggcacgagaatcacttgaacccagtaggtggagtttgcagtgagccaagaacgcaccactccactgcactccagcctgggcaacagagtgagactctggttaaaaaaaaaaaaaaaaaaaaagaccagcctcggcaacatggtgaaaccctttctctacaaaaaatacaaaaattacctgggtgtggtggcacctgtctgtagtctcagctactcaggagactaaggcaggaggatctcttgagccctggaggtggaggctgcagtgagcatgatcacaccactgcactccagcctggggcaacagagtgacaacctgtctcaagaaaaaaatgtatatatatatatatatatatatatatatatatatatatatatatacacacacatacgttttatatatatttatatacacacacataacttattaattcctatctgtattaattgcctattgccgaatatcaaattatccccaaatgtaaccatttaacatttattacctcctagtctctgtaagtcagaaatccaggtgcaacttatcaggacccttcagttcagggcctctcaaaaggctgcagttgaggcaccagccctgtgtctctcccaaggctttagtcaaggtgatggccagggccatagtcacctcaagatttaactgggacaggatccacttccaagctcattcaggtgtttttggcaagattcagttcctcatgggtgctgaactcaagacttctgttccttactaccagttggcctttgagaggcccctcaggtcccagccatgtggccgtctctagagggcagcactcagcatagaggctggcttcatccaagtgaacaagtggagagaagacaagagagcaagcaaaatggaagtcacagtcttttgcaacctaatcagagaagtggcatcctattatttttttctctgttctatcaggtagaaacaaatcactatgtccagcccacactcaaagagagaggattacacagagcttgagtaccaagagataacttttgggagggagggatatgttcattgtcttgattgtggtgatggcttcacaaatgtgtatataaatcaaaacttatcaaacaattgatgtacaataaactgcacttgaattatgtacagtttattgtatgtcaattatatctccacaaagctgtttcaaaaataaagcattattttatctgtgtgcaaaactgaggttctttaaagcaggaactatttcaataattctaccatttcaccttaagaactctaaaaaaagaaaaaaaaagtacagggtctagcatggtggctcatgcctgtaaccccatggctttgggaggctgaagtgagaggattgtttgagcccaggggttggagattacagtgacctccactgcaccccagtctgggcaaaaaagagagacctggtctcaaaaaaaaaaaaaaaaaaaaatttaaaaatgtaaaaaataaaaataaaaagtttggacttgacagttctatggaaaatggaaaaagatgaaaataataatagtaataaaaaatacaaggttgtctactgcagactataagaaaaataggacttcaacaatcaggaaagacaaagtatctttctaatccagtggctctaactttagtatgcattaaaatcacttggagaatctgcatttctaagttttcaggaaatgttgatgctgctggtccagagaccatactttcagaatcagtgttctagttcatcagcaataatcaactagaaattgggaaagaaaaagatagcattcacaaatataacaagctccataaaatacatagaaataatccaaaagaaaactatataaaacctatatgaattttaaaaaaaatagtgaagggcatgcaagaagctctgaataaaagatataccatgttcctaaatgagacgatgcaatatttaaaatttttaaattctccttgaattaatatataaatttagttaactgcaattttttaaagtctcaaaaggaccttttacagaatttaacaagttaattctcaagttaaaatggaaaaggaaatacataaaaagagccaatgaggttttgaaaaaatgagcaattaagagagacttgtcctagcaggtggcaaaacatggaataaaaccatggaaattggccagccttacacctataatcccaacactttgggaggctgaggcaggcagaccgttagaactcaggagtctgaaaacagcctgggcaacatggggaaatcaagtctctacaaaaaaatgcaaaaaattagctgggcgtggtggcatgcgcctgtagtcccagatactcaggaaactgaggtgggaggatcacttgagcctgggaggttgaggctgcagtgagccttgatcacaccattgcactccagtctgggtaacagagtgagatcctgtctcaaaaacaaaacaaaacaatggaaattaaaacagtgtggtattggctgggcacagtggctcatgcctgtaatctcagcacttggtaggccgaggcaggtggattgtttgagctcaggagtttgagaccagcctgggcaacatggtgaaacctccctgtctctgtcaaaaatacaaaaaaaattagctaggcatggtccttagctaattagcacgtctgtggtcccagctactcaggaggctaaggtgggaagattgcttgcgcctgggacgtggaggctgcagtagccaagatcatgctaccatgtactccagcctgggtaatggagtaagactccctaaaaataaataaataaataaagtggtattaacttagatatagataaattaatatatataatatataataaataataagcccagaacataaccatttttatctggaaatgttgtttatgataaagtgacattttacatcacagagaacagatcactcaataaattaggatgaaacaggtgactttttggaatacataaaataaagttagatctctgtttctataactctgcatcagttaggcttctttatattgcaagcaattgatgatccagcccaaactgccttactcaacaaagggcccatttaactgaaagaccctgaaatagagcaattccaaatttaggatttgctttgagttggtggctcagtactgacatgaaagacattggagtttttgtttattcacttgttttatgttttctttttctgcctcttcattctgacataggcagtgtcagctgcttcctaagacttcaatggctgccgaatttgccaagctccaaatcttacacaaaactgccccaaaggagaaaaatactatcttttggtagctcctttatataagaaggagaaacctcctcttccagaatgcttccacaacctcttcttgtcattggctcaaactgtcggcttgaccattccctagcaggcaatgatttagtttacgcctgaaacaacaactggcttatctgaataaatctttgtggaaagagggatggaagccgtgcctggtggctcacgcctgtaatcccagcactttgggaggctgaggcgggtggatcacttgaggttagaagttcaagaacagcctggccaacatggcaaaaccccgtctctactacaaagacaaaaatttgccgggcgtgatggtgcatgcctgtaatcccagctactccagcgctttgggaggccgagtgggagtatcgcttgagcccaggagttcaagtccagcatagccaacaaaatgggactgcgtctcttagaaaaatgaattaattaagccaggtgcagtggcacattcgtcctagctactcaggaggctgtggtgggagaatcacttaaacccaggagttcaaggctatggttgtgccactgcactccagcctgggcgacagaacagaccctgtctctaaaataaaataaaatttaaaaaggcattttgtttagcaagtaaaaaattgtgagccactatgcccagtcctaccttttttattttaaaattataaaacagccatgggcttcaaggagaccaaactccttcccattacatgagaagaaatcttaattagactatgtccaaatctaaataatttcattatctttgcaataattggttcagctatgggaatatgatgtcattctagccaataagatgagaagaaaggaaatagaagagaacacagcctgcaagggggctgacagtatcccaacacagcttggttttgtgtgtgtgtgtttttgttttttttgagacagggattggctctgttgcccaagcagaagtgccttggtgcaatctcggttcactgtaacctctacctcttgggctcaagccatcctcccacctcagcctccccagtagctgggattacaggcccgcaccatcatgctcagctaatttttgtactttttgtagagatggggtttcaccatgttggccaggctggtctccaactcctgagctcaaggtatcctcctgcctcagcctccagagtgctgggattacaggtgtgagccactgtgcccggcccaaacacagtcttaaagaatgtcaatgattattgctagcatgatcagatggttattccaactgcagctgttcttctaaatatgcactggggcaaaatgctacagcttcagtcactggtatacagctttggagctaggaagtgttttttctactttccaataagcaaagtacaccagaagcactttgctttcacgtgacaaaaactgacaatggttggagcagagcatcccagtggcaatgacttgagattgtcacttagttccttctggatccctggacttgctctggttcttatcctctctgagaccctattctatagtttttgcctcgattctatggctacatcatggccctctaataactttctttttttacttagagttcatttctgttacttgcaagaaccctactagctataccgacttatttttttaaaccacgtatttatttcactgagtttttgttttgcattcagttttataatatatttatcaattttatgtcttatgtgcttacttgattttgttacatgtcagcagttcttttctaccacaacttcctcattcttaaattcttaagttttgacgagtctctcaatgtaatagagctcatctttaagaaacttttcagacagaacacatagatggtctaattctgagatcttttataactgagaatgccattcttttgacatcacacatgacagcactcccaccctcagtttctatgggtattgctttattgttttatggtatttggtgttactcagaagcctgaggccaatctgatatttttccgctgaaagtaaccatttttccacgttcatatacttggaagttttctcatatgttttcttattatttctgcttcctttgttatttttacctttataagttctacacagttagtctggactcttgcagttgctaatgacagaaaatcaacttcaaattgatcagcattcaattgtgggcaaaagaattcattgaagccagtttaagcagagagatacttactaaagtgtattaacttgctgcagaatgattggaagacttgtagcaggaggctggactttcaggaactcctggagctacattgaaatctacctcagcaaagttgctgctaccactgccgctgcaccactactgacttaaagaccaggctgcctttaagccatggtcaagaaagttgccagagtaggaagttgctgttgtcactgctggttgcacagagctaggaactgacaagacatcagagcttctgacagctgctgcaaaagcaccaaaatgcctctgccactgtgctgctggaatagccacctcataggacccataaccctcttccaaatctcattcagatgcatctatgtgatggatgctacatcccatgcagaaatcctcactgcaaaggtctatgggtaatgtagacttccatcttccagcctctgatgtacacgaagtctcattagtatggggttggagcagtattgagtgaaccaattgatagtgtctgccacactcactagaataaaacaaatttgttcacccatgtccctgggaaggccaaggaatagagctgactctagaaacaaatggaagcaaaagttcaaaccatgacacaggcattctttctctcttcctatttttcagttctgattttattcatttaactaacatttattaagcaactactatgttccagacactgttctaagtgctgggatgccgcagtgaacaaaacatacataagtctttgcccccttggtcctgttttctgggagagctttgttttctggcagattatttgaaaatggcagcaaaactagttcccagtagctccaagcgtataggttacttagtgcttgaaatatcacaagaagaaaggtttttcctcccccaaagccctataaattccacacaataaaaagattctaattggttttattatatgatgtatccaagaccaatcaggtattgaggggcatgtaccatatgtccactggatgtggagagactgttcccaaacacaaaaggtgctgaaaccacaaagatagagttgatgtccgtttcattcctaaactattcaggatcctacacacacacacacacacacacacacacacattttcatatactttaaaaagtgcccccccatgacaatgcaaatttttcttccacaaatgaaaacacactctctttctccccaaaagaagaaacctcaaaactcatctagtcaccatattgtgctctaaagtcccagaattttaggtctagatatgactcttcatttaataaccaatggataaattaaaaatataggctgggcacagtggcgagtacctgtagtcccagctactcaggaggctgaggtgggaaaactgcttgaagccaagagtttgaggttgcagcacgctatgattgcatctgtgaatagccactgtgctctggcctgaatactcagttttgcaatatatgaggtgaatcagaagaccacaacaaaacctcttatttgaaaactgagagccaatttccagtggccaccattctatagcatatacctgtgctgctaaaagaaaaagtaaggagtctgccctagcagtagggtgaatcttgcactgtcaactccatgagctagtaaccaaagccaaagatctgccaggtcctgaattttgaacccgaacccacagcccaatggctttttctctttgccacagaccttgatgctgtgcccatacgcctcgctcttggtttaactgtattgttcctggctgtgtcccaacaccccaagatccagtagtctttctcagaccacatcccagtggttgtctttagtagcagaattactgtcacctttgtagtgctgagaagtaacagcaggaggtgtctggaggaggcctgggggtcaagcttctaccacagccaggatctttttccctctttttttaaaaaaaaggtttttttttgtttgtttgtttttacttttaaaaatatttcttcctaattatgtgcttacttaaccccagccagttttatcttctgcaattcccacctgcctaccttacctctcactaactttagctccaggttcaagtagggaatagagtccttagacttctccaaatgcacatgatcagctgcttcttagttatcctacaggtatctcagatatcttgctggttacagacagaaagggcctctccacagagctatatgtcattccccttcagcatgctgtttattcagcatgctgtttaggttaaagccttcttgtttaaaaaaacagttgtatagagatataatttccatgccgcacaattcactcatttaaagtgtaaagttcaatgactttttaatatcttcacatagttgtgcatccctcaccataatccattttagaacatttttatcactccaaagaaacctagcactcacctctcaattccctcatccctcccagtccctggcaactactaatctactttttttttcttttttttttttgagacagagtttcgctcttgttgcccaggctggagtacaatggtgacttctcagtgctccctgcaacctccgctttctgggttcaagtgattctcccacctgagcctctcaagttgctgggattacaggtatgcgccaccatgcctggctaattttgtatttttagtagagatggggcttctccgtgttggtaaggctggtctcgaactcctgacctcaggtgatccgcctgcctcggcctttcaaagtgctgggattacaggtgtgagccacacatctactttccgtctctacagatttacctattctggacatttcatatgaatggaatcatataaaatgtggtgctttgtgactggcttctttcatttagcataacattgtcaaggttcatccttgtggtagcatatatcagaacttctccttttattgctggataatattcctttgtgtggatgtactacattttcctcaaccattcattagttggtggacatttggttgtttcttactcttggctattatgataatattgctgtaaacattcatgtacaagctttgatgtggacatgtgtttgcatttcttgtggaatacctaggagtggaattgctgagccatatgccaatagcatgtttaactgcttgatgaaggctgtaattttcttgaaattattaaaagcagccaggcacagtggttcaagcctgtaatcctagcactttgggaggccgagacaggcagatcacgaggtcaggagttcgagaccatcctggctaacacggtgaaaccccgtctctactaaaaatacaaaaaattagctgggcgtggtggctggcacctgtagtcccagctactcaggaggctgaggcaggagaatggcgtgaacccaagaggcggagcttgcagtgagccgagatcacgccactgcactacagcctgggtgacagagtgagactccatctcaaaaaaaaaaaaaaaaaagaaattcttaaaagcataaaaaatcatcaacttattccaatatctgtatattttctacaagtcactaaagcactagctatagaaggcacatgatcagatttctcaaatataacatgtgtggttaccctataatccaagtgttcagttcttagatggggacagaagaatccttattcccacttacatacctcaactcacccagttcttcatgttagggcctaagacttgctgcactccacttctagttaccaatatttatcttatgattgcaagtaaaccaaacagttaggtctcacataactgagaagtttgggagacctgacttcagatatagatggatgcaagggttcaaactgaatagagacagatgccagctttctacttttcagcaatcctttttctgctttggcttaattctcaggtgagcttgctctgcttgacaacaaaagtgctcttagaagctcataatttcagataccaaaagagatccgtatcaatctcttcataaattgctaactggccctccttggaggtgggggtggggattatttttactccttgttcaatttccaggtccaaaggaatagggtggtcagcctgggttacaggcccattcctgtggcaggaatcagggggtcaaatgattgctatacacactaggtatggcatgagaggttactgaaaggaaaatatgcctgcaaaacagaaaagaaacaactgttcaacactttctgtatctattattcaatctcataattttcatttttatctctttatcacttttatgggtttcctatgaaatgtttctcaaatttgccctatacatcatttattcggttttctgcaaggtgaagtctataattcaccttccgcactttggtttctgtgtagatttaaaaaaatgatttacgtatttattatttatttaattaatttttttagagatggagtctatgttgctcaggctgtagtgcaatggctattcacagggacaatcatagcacactacagctttgaactcctggactcaagcaatcctccctcctcagcttcctaagtagctgggactacagtcaacatgccactacacttgtatttaaatgtttactgtgagtctcctctgctctgggtattgggctgggacaaggaccctgtcttcagagagattactgtctaatggaggaggaagccaagaagcagaaaattacaataagatgatatgattaaggtaagctcatggggcttacaagcgcacagcacagacatccaacccagcttgggggtagtcagaggtttcctaaaggaggtgacatctttcaagaatgagtattgattacacagggaatgagggccaaagaaggaagggaatttcgggtgttggagcagtatgtacgaaggcatgaagatgtaaaagggcctgtcatgaaagaggaacaccagtgatttcagtgtgactgcgacgtgcagtgcgtggtgggcagcaagaatgaggctggtgaggagcacaggggccgggtcatcaaccacacctgtgtgcctgggggttcagagtttaacctggggcagtggaagggtttaaacaggagagtgtcatgatcagagccgcattttagaaaggcagctccagggcccttcagaatcaagaagattgtccaagagattactgcagccacaatggtgagagagggtgaggaactcaattatgaaagtgtggcaggtgtgtaaccttcacatgcccagctccttcttgtgattaagtcagaagctcacctggcatctcctaggagattttctctgctctcctagaaagtgatcttcatatagctaaaacctcctcacctttaagcatctgagctcaatgctcacattgagatgtcacatctcaaagaggccttcaccattctagggaagcaacacccccaaccatcagcactgacttaagtataatttccatgaggacagggagtcatctatcttactgttctctgtactccagagcccaaacagagtaggagcttaagagcatgtgtttagtgggtgaatgtcgaatgaactgaagccattctcatcttcaggcaatgtgcggaagttcctcgagcccacgctagtatagagaaaggctcttgtggcaaggtcatggttgaaaagacagaggttgcagagtcagaggggccttcagatatgaccattctctgagcatcttatcttgccttctgtgttactacagctctactggcctgaagtgtgttccttaatgtaatcaacaattagctctaaggagtatgaaactgcatttttgtcaaaaactatcttcctcaactacacggaaaaatccatttttagagtgaagaaacatgaggttaaaaaaagaagaagagaaggagaagacagagaaggatgaggaaaggagggtgaggaggaatagaaaaaggaggggtagggcatggtggcttatgcctataatcccaacactgtggaaggtagaggcaggagaatcgcttgaggccaggagtttgagaccagcctagtccacatatcaggcttttaaattttttttgaagataccttgtctttacaaaaacatttttttaaacagtcaggcatggtggtgcaaacctgtagttctagctacttagctagaggctaaggtgtgaggatctcttgagcccagaggttcgaggctgtagtgagctatgattgtatcactgtactccagccttggaaacagagtgaaatctgctcttaaataataaataaataaatgaaaaagaaaaagaaagaagaaggcagagccaagagacagaaagacaagagaatgatgtatagcattcagctacatctcttagactttgcaattctatgaactaacaagttgcctttggagctaagctaattttctttttttttttttgtaacagagttttgctcttgttgcccaggttggagtgcaatggcgtgatcttggctcactgcaacctccgcctcccaggttcaagcaattctgtctcagcctcccgagcagctgggattacaggtgcccacaccatgcctggctaatttttgcatttttagtagaggtggggtttcaccatgttgtccaggctggtctcaaactcctgacctcaggtgatccactcaccctggcctaccaaagtgctgggattacaggggtgagccactgtgcccagcctggagctaagctaatttacactggctttggggactttcaagtaaaaacaccctgacccagttaataataaatcaaataatcaatctatccctatacctatctactaatatgttcttcaaggacatagttgacaattcactcttctgatttaatttcctttatcttttctactctcatcttttccttgagatttaaaaaaaagccagagggtggaaaaaactttgcaggggcaattctcacagtttatttttgtgtttctctcaaatctccttacatgtttatgtaagatactactgtgggtctcatgttatccacagaatcttaaaagggattattagcatagctgtggctttctccctttaaaataaaccccatgttacttggaatttgtattcctcaagggaccattttttccagatacacatcatactaaatactttaatcaaatgtgtaatcaaaaatattttccattttacttcttttattcatttaatggatttatgttacccattctttttggaagataattaacttggaataaaggctcagcttttatattccaaaatatgaaaaaaaatttcttctttctgggacatataaaatgtcaatctaattgtgcattgtttggtatagtcatgtgtagttctaaggaatatgaaattatatatatattaatattaaattaatttttcctagggtatcactctcacgcttaaaagaatttggtatagggtatgacttgagcaggttgtatagatctttttagggctctcacattatttcaattatcactaattgaaatacctaattatttcattacctaatattgtcagataggtcccacatatctgtatctttgagtcccatggcaccaagctcaggagtggttcctgccttcaacacagttcagaaaaggtcttggattgaggcagaagttggttcagtaccagggagtgagctctgttcttactgctggtctctggtctgtctgcctaagccttggtctgtgttttcttctattgctgttttccttcccctgctttgcacacctcctcgttcttactttccctctgggtctagtttcccactggctctattttatggctggtcctgacttctctgctaatgcacattctggcttctattgctccatgggttgctgacccctgactgctttttaatccatccaggtcttgcatctagccacactcatttgtgctccacaatgctagtgctgattcatcacatctgtcaacacttagagataatgaagtggggaagctcagacagaatcaggaaccaaaagaaagatacaaactactgaaactgactccagaagaaatagaaagtctgaatagaactatatgtcagaaagatgaattaggaattagtaatgaataattagtttgtaattttttataatgctcataaagaaagacccaggcccacatgttatccccactgaattctaccaaacattccatgaggaataccaatttttcacaaactcttccaaaaatagaagaggcaggaacacttcccaaatcattctgtgagatcaatattacctagatatcaaaatcacaccaacataccacaagaaaactatagaccaatatctcttatgaatatgaatgtaactaggcaagaaaaagaaataaaagacattgagattggaaaggaagaagtaaaactatatttatttatttatttatttatttttgagatggaggcttgttctgtcacccaggctggagtgcaatggcatgatctcggctcactgcaacctctgcctcccgggttcaagtgatcctcctgcctcagcctcctaagtagctgggattacaggtgcccaccacaatgtccagctaatttttatatttttaatagagatggggtttcaccatgttggccaggctgatctcgaactcctgacctcaagtgatctgcccaactctgcctcccaaaatgccgagattacaggcatgagccaccatgccgggcctaaaactatttttaaagatgatgtaatctcgtatatagaaaatccttagaaatccactaaaaaattacagttaacaaatgaattcagcaatgctgcaggatacaagattaatatacaaaaattaattgtatttttatatacttgcaatgatcatttaaaaataaaattataaaaaactcatttacaataaatttaacaaaaaaagcacaaaacttatactctgaaaactaaaaacgttctgtaaagaaattaaagaagatctaaataaatgaataaaatgtcccatgttcatggatcaaaagacttaacattgttaacatgttactactctccaaaactgggcacggtggctcacacctgtaatcctagcaatttaggaggccaaggtgggcagatcactttgaggtcaagagtttgagactagcctggcaaatatggcgaaaccccgtctctactaaaaatacaaaaattagccaggcgtggtggtgtgcacctgtaatcccagctgctggggaggctgaggcacaagaatcacttggacctggtaggcggagattgcagtgagctgagattacgccactgcattccagcctgggtgacagagtgagacgctgtctcaaaacaacaacaacaacaacaacaacaaaatgttaatactctccaaactgatctatagattcaatgcaattccaatatcatctcacctgacagctttgaacaaatctacaagctgattcttaaattcatatagagttcaagggatccagagtagccaaaacaattttgaaaaagaagaataaagtaggaagactcatacttcccaatttcaaaacttactacaaagcaacagtaatcaagacagtgtggtgcaggcacaaggacagacatatggatcagagagtctagaaataaatttatatatctatggccaatcaactgatttttgacaaaagaaccaagatcattcaatggggaaagaatgtcttttcaataaatggtgctgagacactggatagccacatgcaaaagaatgaagctggacccttacctcccactatttttaaaaattaactcaaaattggttagtgacataatagaagagcaaaaactataaactattagaggaaaatataggggtatattttcatgaccttggattcagccatagcttcttagatatgataacaaaagcaagagcaacacaagaaaaaatagatatattagacattgtcaacattaagaacttttgtgttgaggggcttgtatctagactatataaaggaggctttcaggctgggcacagtgactcacatctctcacatctgtaatctcaccactttgggaggttgaggtgggaggattatttgagatcaggagtctgagacaagcttggccaaaatgatgaaaccccatctctattgaaaatacaaaaattaggccgggcatggtggttcacgcctgtaatcccagcactttgggaggccgaggtgggtggatcacctgaggtcaggagttcgagaccagcctggccaacgtggcaaaactccgtctctactaaaagtacaaaaattagctgggcattgtggcaggtgcctctaatcccagctactcaagaggctgagggaggagaagtttgaacccaggaggcggaggttgcagtgggccgagatcacaccactgcactccaacttgggcgaaaagagagagactccatctcaaaaaaaaaaaaaaaaaaaaaaggccatgcagtaatggcaggtgcctgtaatcccacagctactcaggaggctgaggtctcaacctgggaggtggaggttgctgtgagctgagatcatgtcattgcactccagcctgggtgacagagtgagtgagactccatctcaaaaaaaaaaaaaaagagttctttcaacttaataataaaaagccaaataacacaattttaaaatgagcaaatgtctgaatagatgtttaccaagaaagagatacaaataaatggccaataagcacatgaaaaaatggttgacatcattagtcatcaaggagacgcaaactgaagccacagtgagataccatttcacacagtaggatggctagaataaaaaagtcaaatagcaattaagtgttagcgaagacgtggaaaaattagaactctcacacactactagtgggaatgtaaaatggcacaaccactttggaagacagtctgggtgctcctcaaactattaaacataagattaccataagacccagtgatttcactattaggtatatgcccaagagaaataaaaacatctgtccacacagacacttgtattcaaatgtttgtagcagcattattataagagccaaaaggtggaaacaacccaatgtccatcaactaatgaacagataaatgaaatgtggtacatctatgtaattaaatgttactgggccataaaacagaacaaagtactgatatactgccataacatagatgaaccttgaaaacattacagtaagggaaaggaaccagtcacaaaagactacataccataggattccatttatataaaagtccggaatagagaaatctataaagaaaaaacctggattaatagttgcttagggcaggggaggacagggggaagacagtgagagagcagatagctaaagaatagggggtttcttctcgagatgatgaacatgttctaaaattgactatggtaatgcacatatttgtgaacgtactaaaggccaccgaatcacacactttaaagggtgaattttatggtatgtgaattatatctcaataaagctgttaaaaacaaacaaacaataaccaaatccacccaagggttgtatttgatgacttttcagaacattaaaaagctttgaacatctagtgcagattcctgaaagtttagcttcatggatctgtttattttgcaattaatgaaggttaaaggagcattctccagcctctcgaaaactgttacttgggagcttagaatttctagttatgaatctatgcacaagaacagcacctgtcatgtctttcaaaggaaaatgtatttgccttattaacaaatcaagagtactaagtttctatcaaaagagcagaataaaaaaaagattaaatggcttatttgctcattgtttagagaagtatgctagtgaataataggtttaaacttctgtaagagttactagcatttcaagttcttaaaaaaggaataatgcattaaagtccatttaaaacttctaaaagtgacatcaatgaccataaaatagaagctgaatgagtatttcaagttaaaattatttactagaccaactactggctataagcaattaaactaaatacagaattattgagatggggataagaagaaaataaaaatgtaaatcattttattacaggattaaaaaaagctgatgaaagagctgtaacaatattttgataggaggagaataacagaatcagttagaagcaaaactggagaaaggagaaaaggaaaagaaaagcctgtgtgaaatatttaactgggtgttgaaaaatatgataattttgataggctcactttttaaaactaattttctcacatgtttaccaatggctggatgtgcaaatggacaacaattttttatcttgtaataaaatgaattttaaaaatataaggtagggccaggcacagtggctcatgcctgtaatcccagtccttgggaggccgaggtgagcagatcacttgagatcaggagttcgagaccagcctggccaacatgacgaaacccagtgtctactaaaaatacaaaaattagccggatgtggtggcatgcacctatagtcccagctacagtatatacatacatacgtatatatatatatatatatatatatatatatatagagagagagagagagagagagagagagagagagagacagagagagagtatatagtatatatacataactcctgacctcgtgatccacctaccttggcctcccaaagtgctaggattacaggcgtgagtcaccacatccatccggtaatttttttttaaactctctcttgtacctgtatcttatgtttaaccgaaaaaggttgaaaattgagttgctagacttaatcattattttccctggctgaagggatagtgggaggggtcaagcctctaaaagggagatatctgggccaggcgccgtgactcacacctgtaatcccagcactttgggaggccaaggcgggtggatcaaaaggtcaagcgatcaagaccatcctggccaacatggtgaaatcctgtctctactaaaaatacaaaaattagctgggcgtggtggtgcatgcctgtagtcccagctacttgggaggctgaggcaggagaattgcttgaacccaggaagcggaggttgcagtgagccgagataatgccactgcactccagcctggtgacagagcaagacagcaagactccatctaaaaaaaaaaaaaaaaaaagcaatctctgcacactggcagcaatgtgaataaataaaaggactaaggattactgaatatttgtcagttaaagaaaagccaactcagtgtctataagaataaatcattcttgactattctttcagaaggaaagcaaatttacagagaaaggggagaaataatgaatttatttgatttttggaaaaatctttgaaaaattttcacaccaatagctattccttagttgagttagcctagggtttcactatgagaaaagaattaacatcaaggtagtagggcagagacattattaaatggagaagtgtaaattgtggtatttcctgaggaagcaattctgggtcagtccaatttaatggtttattatgttttggaaaagacagtaaaatctctacatttgaaaatgatactacatttttatggggagtgagatgtcaaaatgacaaggataaactaggcaaagcgaaaacagcagacaattttggcctatatataagttaacaagcacattagtgggaaaatcatccaagctctagttatacatggatttgattgctgagtcacaatggggcacaggaatctaggcgtcactgaggctgctttttaaagataccccaatgatctgttgacatttaaaaaatcagcacaaggttattggaaacaaggcaactgacattgttgattttcctatccatgaacaacatagctcttatgactcctctcagcacatttggctccgagacccagaagcatgaatagaaggagctggccatccagggcatgcttttctaccctgtgcaatcatatcacacagcatgaccatgcttatgtataaggacagaatgtgtgttggccacatcactggtaagaacccagacagcatttcttgggctctgatagtcaccagaaaatggaaggacgtttattgagaagttacaacgtgaaaggcactctgctgggtttaggaaggatatgtagataaattagacagtgtgcttacctacttgagctccaagcctactcagagaaataaaactattgcaatatggaggagttggtaattatgctgagaggtgtggttgtgggtgttcagaggaaagcgaaaccaaattctgtcatttattcatgttagttcaactaacatgtattgagtaccactattcattcatgtattaatcaatatttatttactactatgtgcgagccacttttctaggtgctgggatgtagcggtgaaaaagacaaggtccctgttctcatgaagttaagacagattatttttaaaggatcaaaatagatgtgataacatgaaatagataagtgctatgaagaaaacaaaacaaatggatgtgatggagtggctggaggttggtggttcctttatatggaatcagaacaagtctcccagagaggtgacgtctgatacctgttgattagaaggagcctgctgtgggaagacgcccaagaagagctttctaggcagagggaacagcaagtgtgaaggccctaaggtgggaaggagcttggtgtgcttgaaaatcagaagaaagaccagttatagctcagcaagcctggagaagccagacagacaaggctggaagaagaccttgttcttccttttgtggatccctcaaccctcatagcccaacagaaaaaaagaacatgtcagtaagtacatgataacgcgcagattgcacagatttacaaaggagatcaattttttttaaatgtgaaacaggagtgaaagatcataggttatgaattatattttcagaaagaactaggagcataatgctgaggaagagggactatggacactatggaccagcatacgacaaacacacaaaaatctggacacggggtggatgcggtggctcatgcctgtcatcccaacactttaggaggccgaggtgggcagacaccttgagtccaggagttcgagaacagcttgagcaacatggtgaaaccccatccctacaataaaataaaataaaaaattagccaggtgtggtggtgcatgcttgtagtcctggctactggggaggctgagttgggaggattgcttgaacccaggaggtggaggttgcagtgagccaagatcacaccactacactccagcctgggggacagagcaagactctatcccaaaagaaaaagaaaaaatctggacactaggctaagaataagctgtaccgtgggagcagaagcagctgcagaagtgggcaaagagggtactgtccagggctgggacaggggctgcaaggctaagctccttacactacagggtttgaatgatccctaaaaggtcaatcaaatccatcttcttttccaccagaaacctctcaggactcactctggggaggtgaaacactttacatgtcattaacatgtcacgtcttgcaatgtattcttagggctttgtttctttggattttttttttttttttttttttttttttacagagtctctgtcgcccaggctggggtgcagtggtgctatctcggctcactgcaatctccgcctcccaggttcaagcaattctcctgcctcaggctcctgagtagctgggactacaggcgcacgccaccatgcccggctaattttttgtattttagtagagacggggtttcacagtgttgcccaggctggtctcgaactcctgagcttgggcaatccgcccaccttggtctcccaaagtgctgggattacaggcgtgagccaccatgccaggacccatttatttggatatttagtcttcaagaggtctctgttacgagagaatggcagcaccttggtatgaactttaaatgcaattatagtccctccatctttataacaaggcaagagatagtaatgaggcacttgcagcttttgaatcagaacagagtaaagagattgctttaaggaggcagcattcacagccttgtgaaccaggtacactgttcatggacttgcctcattgtggaacctagagaaaatttattatttgaagtcccagtttcctcatctgaaagaatgtcagcctgagagatttgttacagagatttaattggataatttaaatgaaagtgcctgccagattcagtaaatgtgcaggggtcttttttcccactcaaacctgtggccccaattcacccaaatccttgaggcccactctgggtggggaatagggagtccacagaccctaaggagaaagggcagaaagaagatgagatcattaggagaagctggtactacttacgaggcattgaattgaggaaagatgtgtgaaaaatgaaatttatcttcattccaaaaaggattctgagaagagaaactctggaacttctggagtaatgcattttctcccttcttaatgcaggaagctaacacagacattggtttcaagggtgttaaaatataatagggctaaaatcatttattgccaagattttgataacaaaatccaaacataagaactagcaaccccacttgcaagaatttaaaccaagttaagctcaaatcaatgcacagtatatccaacacgggaaaacattttttacactgcctgacctgggattccagcaaacaatcttcagctatgtaaattcataggcccttttaataccatgttagtctaggttcacatcaattgtttcttgccaggaaaatgggtttttcatttggagatggctcaatgccagaccgaacaggactttttagagacattggaactctcaaatatcaccagtcacagtcaatgcaatttcaagctcatgcgattttagttcatgcaatcatttgaagaactgagaaggcagaaaggagggcgctggtatcagagggattgcaaaatctattgaaatggcatctactgaagaaggagtcaggtgacctatgtgaggctcttagttctattaataaaccaaggtaggacttaattggatgaagtgacagatgtctagtatttttcattcttaaggtacacacaacaggttcaaaccagcctagtagagattcaggcattcacttggtggattggccaatttagtctgaggcaaggaggcactcccaaacataccagactccttggaaatatgttaagtggtactgatgatggccagggctgccaaggatgtcaaatgtatttaaaagtgagtggagcccaagcctgctgccctctgggtggagacatggtcgatttcaggaggatatggttccttttttatggtgtgagcaggaggtccccagccaaggatcttacctgacacagacaacatcaagataatatgaagtatgatagagatgcagctcttgtctttgtgaaaatagtgagactggtgttatcattgataagagcagcatttgcctttttgttttattttctttgtttaattttcttttaggaagggcagtacaacattgagctgaaggcagactatcagctagattccctggatttcaacactggctctcccactggctaaatgaatgatattaggcaagtcacttaaccttcatgtacctcagtttccccatatataatagagataacagtagcatctacctcaaagatttactttgaggaattcataaacacacacatgctcacacacacacacaccacacaaactgtttagagcacgcctagcatgtggtaattaataaagttggttattatatttctgtgtggttgattaaaaaataatacatatttgctataaaacaaccagtatacaaaaaaattttaaatgaaaacaacccattaccatccatattctcactatccacaggcaatggcaacattttgggaaagaagtacaaggtagaaacaaccatttaactatgtaatatttattctttccttcttccttattaaccacaccttgattttgttgtgggtagcaaactatattttccagccttccttgcaaataagatcaggcatgtgactaatttatggcaaatggaagttgttgggtggggcttctaggaaagctccttaaaaaaagtctgaatcaggacgggcgcggtggctcacgcctgtaatcccagcactttgggaggccgaggcaggcagatcacgaggtcaggagatggagaccatcctggctaacacagtgaaaccccgtctctactaaaaatacaaaaaaaaattagccgggtgtggtggcgggtgcctgtagtcccagctactccggaggctgaggcaggagaatggcatgaatcgggaggcggagcttgcagtgagcctagattgcaccactgcactccagcctgggcgacagagcgagactccttctcaaaaaaaaaaaaaaaaaaaaaaaaaaagtctcaatcagctggattttattccattttgtcatcaatcttcctccttcctactgtctaaaacatgggagtgatggctgaagtttcagcaatcaacttgtaaacctgagtataaaaagcacaccatggggatggtggaatacaaaacaagaacgactaagtctctaaggacattatagaacagctgtatgcaccaggaactgcttgctatcttctggatctttcatttggtgagagaaaatctcttcttgttgaagccactagctattggtaatgtctgttttcatataactaaactagattcctgagtacttccattgtctctaccttgtattaaatcctctgtttcccaaaccacatggtttcctttttcttggttgattcccctgtgttggtgtagcatatcccaggtaacttcatgagaaatgtacatcacaggcaaactttttgagatttaagagtttaggtaaaatacttgtttatctgctacatcaaaggtcagaataacagtagcttaaataagatagaagtttgtatctgtcacataacactctgaacataagggcccaaggctaatacggtaaactctggcctattctattactactttcatcttcaacaagcagctttttgtggtccatattggctgcttccactccttctattacagctacatttcagtcagaaagaaagaagaggtagaaaaagcaatctcctttctctttaggacatgggccagaacttgcacatatcacttcagctctcatcccactttacagaacccagccacatggtcacacctagatgacaggaaggatcagaaatacagtcttttgcagggcaaccaatagaagccatacagcatttattactgtagaagaagaggccaggcgtggtggctcacacctgtaatcccagtgctttagaaagccaaagtgggaggaccacttgagaccaggagttcaggaccagacagggcaacatagtaagacctgtctctacaaaaactttcttaacaattaggtgagtgtagcagacccagtttgaaaccaggttaattttgccagagcttgtgtttcttcccctatacctctcagcctcccaacataagcaatccaaaatggccatatagtttatgccatatagtttactacttttttttttaaagatagggtctcactctgttgcctaggctggagtgcaatggcatgatatcactgcagcctcaacctcctgggcttaagcaatcctcctgcctcagcctcccaagtagctagaactacaggtgttcaccaccacacccagctaatctttaaaaatatttttagagatggtgtctcactgtgttgcccaggctggtctttgtcctcccaccttattcccccaaagcactaggattataggcatgagacaccatgtccagcctagtttgctatttttaaagcacaggtcatttctcaggggtactctctaataaagttatacgacgtgcctttaaaatagcagtaggccaatgccattggctgtggagtatcattatggacatcaaagtccatctaagtctatattacgttgcaacacagtggagtatcaaagccccgttagtgccctgcagtggtcactgtgtgaaatagcccactaggttttctgcaaggcctgtcgcctgcccacagggcaacacatggggctgccccagactgtttcttcctcctggccacacagtcctgcagtctggagtgggcagaggctctgcaagcaacattcctgggatgcaggaccatgtgccccgttgctgtatgttgctgcctgcacactgtggctgctgctttcttccctatctacaccctacagtttttagaccatcatgctcagatctctcaggcatgttgctgatggagcagaaattccaaattttgttaagttctcaaagcacctcctgttgagagagtgtgtctagtttttgaattccacctatttggaatctgcaaactgagtgttcattttgcagggtcagtagtggccttacatcatcaacaataaacattcgctgaaagcctcttatgtctagggctgtgggcagctacctatgtagtgtaattggatctcctctagaatcaggctctcaccctgtgactgcttaatgtagtctaggaggttatgaagccctcaacccagctgaatagagacattaattgacccatgactaaccagcttttgataagatgcttccctgtggcaagatgtggggctgctaaatttcgttgagacataggtagtccaaggcacaagcactctggggtggtgaggcattgcagtaggaagaatacaaggtgagtaggaacgctggaaagagtttattgaatacgtaccgtgtgtcagatgttctctatacattagctgctgtaagtcaggctccccaggaaacagattctgaaatggaggtctgaatgtagaggttcattgggaagtgatctcagcaccagtgcctgagaggactgaagtaaacaggattgggcagaggaaaaagtggaagaatagcacagctgcaatagaggtttcaaccaatcctcctaccggtagctggtccttcagaggtgtcctaagtggaagggagtgggccttcttgccctttctacacacaattgataagtcatcagatgccagatgcccctggggaggggcagaattttggacttaataccttcagctgaaggcaacttctggaagaggctcagttgtgaactgttaacaggtaactctcttgacaggaggggagggaggggaagagtgccttgatcctgaaagggtgatctgggcagcacaccacgacatccactacattatattatttcatccacaggacatcctatgaagttgtcattataattaccattttaaaatggggaaactggcctggcgcagtggttcatgtctataatcctagcacgttgggaggctaggtgggtagattgcttgagcccaggagttggagaccagcctgggcaacatggtgaaaccctgcctctacaaaaaatacaaaaattagttgggcgtggtggcgcatgcctgtaatcccagccatggcaggctggggcaagaggatcacttgagcctgggaggcggaggttccagtgagccgagatcgcgcccctgcgttccagcctgggtgataggagtgaaaccctgtctcgaaaaaataatttttttaaaaggggaaactgaggcttgggatgtttatctaacttgtctaggctcacatagctgggttagattgactaaaacctccatatgctttctactacactaccctgcctcagaaaggaaaaaataaggcagggagggcatggaaaaaaaaaaagctggagacagcttcacccactgcacaattttgtcagaaatggatcagaagatgcagattacagagtggttatgagcacagtctctggagctaccctaactggtttgtatctcagcttcattgcttaccaaccttcggcaagaatttaacctctccatgccccagttttctcatttgtgaaatggagataataacagtacatgcctcacagggttattacaaagcttaaatgaaagaataaatgcagcacatgccagggcctaggacagtgccaggcctataataagcccctggtaaactttagctactattataacattcccatttatggtaactcttttgacagcacaggaaatactctctttaggggctctgctgagacttgcctaacatttcaaagaatgatgcctgtctctgagcaccacacacagcctcatcaccagtgaaggctctggatgttccatggatctgaataattttaaaaacccagcttttaggtggtcagggtgactcctgaaatacgaaagggaacaagtgccaaccacacctacacctccaatgtataatcctggaggcagaataaataaaagaaaactttaaaaaaacagctccttattgtctgccaaacaaaataccttttactgaagtcaactttttagaaatcttggacagtgcatgagtggaagctattcaattctcaaagaagtctcagttgagttttgtaatccaaatcccacagccgaaggagaaagatcattaaccttattgctgcaatttcaccaccacttcccctggatagcaacactcagggagttaaaccctcagtgcatgtttcttaggtgtgtggcccatttgttactgtgtatcccccagccccgctggagccactcagtgggttctgccacagctcagttctgccacagctcagttctgcctaccatgtagccatgtgataaaaggacttggaaatttaaatcaatcactcctttaaaaaataattcttaagaagaaaatcatttaaccaagcatagtgggttaaattgtggcctccaaaaagatgtatccatttggaacctgtgaatgtgaacttatttagaaaaagggacctagtgcagtggctcgtgcctgtaaatcccagcattttaggaggccgacgccggcggatggcttgagctcaggagttcgagaccagcctgggcagcatagtgagaccttgtctctactaaaaataaaaaataaaaaaaaatagccagctgtggtggcgcatgcctgtggtcccagctactcgagaggctgaggtgggaggatagcttgagcctgggaggtcaagcctgtagtgagctatgatcatgccattgcactccagcttgcatgacagcatgagaccttgactcaaaaaaaagaaagaaagaagaaagagagagagagagaaaaaggaaagaaggaaggaaggaaggaaggaaggaaggaaggaaggaaggaaggaaggaaggaaggaaggagagaaagagaaaatagaaaagaaaaggagtctttgttgatagataagaatctcacgctgggtctggtggctcttgcccgtagtcccagcactttaggaggctgaggctggtggatcactcgagcccaggagttcgaggccagcctggccaacatggtgaaacacaatctctaccaaaaatgcaaaatttagctggatgtgatggctcacacctgtaatctcagctattcagaaggctgaggcacgagaatcgcttgagcccgggaggcagaggttacagtgagccgaaattgtgccactgcactccatcctgggcaacagagtgagaccctgtctcaaaaaataaataaataaaataaaataataaagaatctctagatgtaatcatcctgaataatatgggcaggccttaaattcaatgataggtgtccttatagagaatggcagaaggagatttgagaaacacagaaaggaaggccatgtgaagacagaggtagagattaaagttatgcagccacagctaagggatgcctggagcccccgaaagctgggagaggcaagggaggattttcccctagagacttcaaagtgagcaccgtcctgccaaatcttttattttatttttttaaaatttgaatccatttatacagacttatcatacatttcagaaatactataagaaaacagaaataaatatcattgtctttgaagaagattttcttttttttttctttgctttgggataatatattttttcttttttttattattattattatactttaagttctagggtacatgtgcacaatgtgcaggtttgttacatatgtatacatgtgccatggtggtgtgctgcacccgttaactcgtcatttacattaggtatatcttctaatgctatccctcccctctcccccaaccccatgacaggccctagtgtgtgatgttccccaccctgtgtccaagtgttctcattgttcgattcccacctatgagtgagaacatgtggtgtttggttttctgtccttgtgaaagtttgctcagaatgatggtttctagcttcatctatgtctctacaaaggacatgaactcatccttttttatggctgcatagtattccatggtgtatgtgccacattttcttaatccagtctatcactgatggacatttgggttggttccaagtctttgctattgtgaatagtgccgctataaacatatgcgtgcatgtgtctttatagcagcatgatttataatcctttgggtatatacccagtaatgggatggctgggtcaaatggtatttctagttctacatccttcagaaatcgccacactgtcttccacaatggttgaactagtttacactcccaccaacagtgtaaaagtgttcctatttctccacatcctctccagcacctgttgtttcctgacttttcaatgattgccattctaactggtgtgagatggtatctcattgtggttttgatttgcatttctctaatggccagtgatcatgagcattttttatgtgtctgttggctgcataaatgtcttcttttgagaagtgtctgttcatatcctttgcccactttttgttggggttgtttgattttttcttatacatttgtttaagttctttgtagattctggatattagccctttgtcagatgggtagatttaaaaatttttctcccattctataggttgcctgttcactctgatggtagtttcttttgctgtgcagaagctctttagtttaattagatcccatttgtcaattttggctttcgttgccattgcttttgatgttttagtcacgaagtccttgcccatgcctatggcctgaatggtattgcctaggttttcctctagggtttttatggttttaggtctaacatttaagtctttaatccatcttgaattaatttttgtataaggtttaaggaaggggatccagtttcagctttctacatatggctagccagttttcccagcaccatttattaaatagggaatcctttccccatttcttgtttttgtcatgtttgtcaaagatcagatggttgtagatgtgtggtattatttccgagggctctattctgttccattggtccatatctctgttttggtaccagtaccatgctgttttgattactgtagccttgtagtatagtttgaggtcaggaagtgtgatgcctccagctttgttctttttgcttaggattgtcttggcaatgcgggctctttttggttccatatgaactttaaagtagttttttccaattctgtgaagaaagtcattggtagcttgatggggatggcgttgaatctataaatttccttgggcagtatggccattttctcgatattgattcttgctatccacaagcatggaatattcttccatttgtttgtgtcctcttttatttcattgagcagtggtttgtagttctccttgaagaggtccttcatgtcccttgtaagttggattcctaggtatttattctcattgaagcaattgtgaatgggagttcactcatgatttggctctctgtttgtctgttattggtgtataggaatgcttgtgatttttgcacattgattttgtatcctgagactttgctgacgttgcttatcagtttaaggagattttgggctgagatgatggagttttctaaatatacaatcatgtcatctgcaaacagggacaatttgacttcctcttttcctacttgaataccctttatttctttctcttgcctgattgccctggccagaacttccaacactgtgttgaataggagtggtgagagagggcatccctgtcttgtgccagttttcaaatggaatgcctccagtttttgcccattcagtatgatattggctgcgggtttgtcataaatagctcttattattttgagatacatcccatcaatacctagtttattgagagtttttagcatgaagggctgttgaattttttcaaaggccttttctgcatctattgagataatcatgtggtttttgtctttggttctgtttatatgatggattacgtttattgatttgcgtatgtttaaccagccttgcatcccaggggtgaagccaagttgatcgtggtggataagctttttgatgtgctgctggattcagtttgtcagtattttattgaggatttttgcattgatgttcatcagggatattggtataaaattctctttttttgttgtgtctctgccaggctttggtatcaggatgatgttggcctcataaaatgaattagggaggattcactcttgttctattgattggagtagtttcagaaggaatggtaccagctcctctttataccgctggtagaattctgttgtgactccatctggtcctggactttggttggtaggctattaattattgcctcaatttcagaacctgttatttgtctattcaaggattcaacttcttcccagtttagtcttgggagggtgtatgtgtcgaggaatttatccatttcttctagattttctagtttatttgtgtagaggtgtttatagtattctctgatggtagtttgtatttctgtgggattggtggtgatatcctctttaacattttttattgcgtctatctgattcttctctctttttttctttattagtcttgctagtggtctatctattttgttgatcttttcaaaaaaccagctcctggattcattgattttttgaagggatttttatgtctctgtctccttagttctgctctgatcttagttatttcttgccttctgctagcttttgaatatgtttgctcttgcttctctagttcttttatttgtgattttaaggtgtcgatttcagatctttcctgctttctcttgtgggtatttagtgctataaatttccctctacacactgctttaaatgtgtcccagagattctggtatgttgtgtctttgttcttgttggtttcaaagaacatctttatttctgccttcatttcattatgtacccagtagtcattcaggagcaggttgttcagtttccatgtagttgagcggttttgagtgagtttcttaatcctgagttctagtttgattgcactgtggtctgagagacagtgtgctataatttctgttcttttacatttgctgaggagtgctttacttccaactacgtggtcaattttggaataagtatgatgtggtgctgagaagaatgtgtattctgttgatttggggtggagagttctgtagatgtctattaggtccgcttggttcagagttgagttcaattcctggatatccttgtcaactttctgtcttgttgatctgtctaatgttgacagtggggtgttaaagtctcccattattattgtgtgggagtctaagtctctttgtaggtctctaaggacttgctttatgaatctgtgtgctcctgtattgggtgcatatgtatttaggatagttagctcttcttgttgaattgatccctttaccattatgtaatggccttctttgtctcttttaatctttgttggtttaaagtctgttttatcagagactaggattgcaacccctgctttttttttttgttttccatttgcttggtagatcttcctccatcactttattttgagcctatgtgggtctctgcatgtgagatgggtctcccaaatacagcacactgatgggtcttgactttttatccagtttgccagtctgtgtcttttaagtggagcatttagcccatttacatttaaggttaatattgttatgtgtgaatttgatcctgtcattatgatgttagctggttattttgcccattagttgatgcagtttcttcccagtatcaatggtctttacaatctggcttgtttttgcagtggctagtaccggtttttcctttccatgtttagtgcttccttcaggagctcttgtaaggcaggcctggtggtgacaaagtctctcagcatttgttggtctgtaaaggattttatttctccttcacttatgaagcttagttcagctggatatgaaattctgggttgaaaattctcttctttaagaatgttgaatattggcccccactctcttctggcttgcagagtttctgccaagacatccgctgttagtctgttgggcttccctttgtgggtaacctgacctttctctctggctgcccataacattttttcctttgtttcaactttgatgaatctgacaattatgtgtcttggagttgctcttctcaaggagtatctttgtggcattctctgtatttcctgaatttgaatgttctgccaactcctttatgtcagacttctggcctccaaaactatgaaagaataaactcctgttgttttaagccaccaagtttgtgacaatttgttacggcagccacaggaaactaatacaccaagattggccaactcaaatggatagtcttgtttcattgtttcctttataacccatgttttatatatctatatctatctatatataaacatatatatatatgtgctatccatcaaaatgtttataattttttttgtttttggagacaagttctccctctgtcacccaggctggagggtagtggtgagatcatagttcattgcaggcttgaactcctggtctcaagcaatcctctcacctcagcctccccagtagctgggactacaggtgcacaccatcacatcctgctactttttttttttttaaagatggggtctcactatgttgcccaggctggtctcaaactcctggccttaagcaatcccctcaccctagcctcccaaacagctgggattacaggcatgagccaccacaactggcccttgtttatgatttttaaatatattcagtaaattaaaaatacaagtcataaacagtatgatccaattttgattttgaaacaatacatgacaactatccattacccagtgagtgtttgcactacatatttttctgaataaataattagaaggctttaaacccatatagtatcaatggataggtcccagatcttattctcttgtccagatttgaggaagtcacttctgagattgagccagtcttcctcaattatgtggaaatattcagttgttttcccatcaatagacccagaccagagatcaaaaactcaaatatctatagtagccaggcagaaatattctttaaggatgttggtaccatagaagacattcaggtatcttaggtactgtggcaaactggaaagaacattcttgtcttgagttggagctccagctcatccccaactgcctgttgtcacagggaagtcaggctgaatgttaccaaatcttctgatttttaaagaggtactggaaatttcagtttttatatgaaaacttctgttttttaaacacaagcatctaattcacattctcttaaaacatttttcaggccaaataaaatccagaagctcagtcctttaagtttccacttgggatttagaccttcataaataaagaccatttcattcttcccagaggttaagaaatccaggtttcagaacacaatgcctaggcttctttgttggaagagacatggaaaaattcctctcattctttgctgatgagcctacaaccttgaacacaagacacagttaactctgtaatcaagttattctgccacgtgaaatttttcacaaattgtcctgctaagtaaacactgtgccaaatatatggtgtatctcaatgcatggtagatcattatcacaatgattagtatgagttttctcctcctcctttggatagtccaacagtagagataggggtaggataatgtggtacccaggaaatggtagaagagcctttatttctcaggccatcacagtagcagatgcttattgaccaagcctgcagggtctgttcaaaggcaaaggaccctattctctccattatgcttagtgccaagcagagtcataggaaacttccactgtggcactaaaggcagtggttcttggtgttcagtctggttccccaggaccactgctccccattcccatcaaatgtccaatcccttctggggtacaacatgggagcagctgttccacttagcccccttcagcctttggggtccctctacttcttggataatctagcacgtttaggaacctagggcttgagaggttggggaaggaaaagccttttaatgacaccagaaaacaaaagcaggctcacttgattgcttgaagtgggtcaaagaccaagagagaaaaattctacttattgttttcatgttttcttactgtaagaaacctaagagaaattaatctctcaatggatccagccaccacattatcatattcaggagaaatgtccctaaattccagacttttgagtctgccctagagtcagatctctgtctgccatttgagaagctaacaagccaagtagtgcccaggaatgtccataataaaccaaaggcataggcaagagaggcagagaggcatttgtgttgggaaggaccacaggaacactctcactacactgcggctccacaaagctttattctcctgcccaggtctagaggaaagtctcttgaggccaggatattatagatgacttctaggactggaacaatgacttgctcctagtagggctcaataaacttgttgcttaatcgtttctaagaagctgtgcgaaagtgagaaagcctcagtctctctgtttcagcttctccaaatgtgactaacagcagcaaccctgtctattgctgagaactgctgtgcagatgaaaacagacaaatatatgtagttttaaatgtaggcaatgtgcttgtaaatttgcattttgaaaagctagaaatgcccttgagtaaactgccaactccttgcagaaaagataaagaaaattttgttccgcccagaacaaaaagatcctggctattccattaaaacatagccttgcagtgttatctaagaatttgttacacactttgtaagctttgttagctagactgattagatagataactgtgattttgaactatgacatctattccaaaaggttttagaaacaacatgcattactatgtaactaaagattcaaagtaaacaggtcttttaaggtttatctaggctatgtaatgacaatacaaacgggcattttgataacaaagcagtattaggtcagcacttacaattcaatgtgagtctggaatttaaaataatgggcagtctgacatcctccatattgtctctgttctagctcaggagactatacagtctacttttcaaactccaaagcttaaggtgttagaacaaatgccttcaactgattgtttagacttttcactcctaggctcacttaaaaaaaattagcagtaatactatgttaataaattcagtcattccatgtgttttttttgtttgtttttttggttttttttgagatggagtttcgctcttgtcgcccaggctggagtgcaatggcatgatctcggctcaccacaacttccgcctcccgggttcaagcgattctcctgcctcagcctctcaagtagctgggattataggcatatgccactacacccggctaattttgtatttttagtagagacggggtttctccatgttggtcaggctggtctcgaactcccgacctcaggtgatctgcccacctcggcctcccaaagtgttgggattacaggcatgagccaccgtgcccagcccagtcattccatgttttgtgagggaaaaaaacttgaaaaaatattgaaataattattatgtagtactttaaaaatgttttccagacacttttaagacaataataaaataaaagaattatagagattgaggaaacctaaaagaaatagtcactggtctaattttacaaacaaagaaaccggccccagagttttgggtgaactgacctgctcaaactggtgttagcaaatcataaccaaatttgttgcaacaacagcaacaacaacaacaaaagaaaatcttttttttttttttttgagtcttgctctgtcacccaggctggagtgcagtggtgtgatctcagcttactgcaacctctgcctcccaggctcaagcaattctcgtgcctcagcctcctgagtaactgggattacaggtgtgagccactatgcccagctaatttttgtatttttggtaaagactgggtttccccatgttggccaggctggtctcgaactcctggcctcaagtgatccacccgcctctgcctcctgtcagatatgagttctaaatttctttacaaagaatcaatatgtcagtatgttcaattatttgccttctacttttaaacttaacttcctcataaagcaacctttttggattaactgctccaccctgactcatttcaatcacctgcaccaccctgactcattctgattacctactccacccagacaaattccgattaccagctctgtcataaccatttttcccgccaaaccactcaccccgtcactctctttaaattagccaatcggaattagtttagcctgtgcagtctaaccctagccaataggggaagaacacagcagcaggggccacgtgtgtcagggataagaacaccttcccctttcttgtccagtgtgcgctcaccattgctccatttgtaagggtgcacccttctctagaagtaacttgccttgctgagaattaaaaagaaaattttatattcgagtgctatttcttttgtagcaccaaaactttatttataacactcccaaagtgctgggattacaggggtgagctaccactcctggccaaaaaagtctattgatagagaattattttcttttttctttttttttttttttttttttgagatggagttttgctctttcgcccaggctggagtgcagtggtgcgatttctgctcactgcaacctcggcctcctgggttcaaggaattctcctacctcagcctcccgagtagctgggattacaggtgtgagccaccgcgcccggccataaattggtgtatttgtgtatgcacacttggataccaaaatccacggatattgaagtccctaatataaaatggcatagtattttcatataacccatgcacatcctcctgtatactttaaatcatctgtagattacttgtaacatctaatacagtgtaaatgctatgtaaatagttgttataccatattgtttggggaataatgagaagaaagcaaaaagtctgtacatgttgagtacagacaactttttttctgaatatttttgatctgaggttggttgaatccacagatgctgaacccacggatacggatggctgaccacggttgttactctttcacttcgaggcatcaggttttatcctttggatttagacaggactaggatatccatatcaattttaattccattacacttctgtcaattcaatttttttcagtaaactgttattaatacattttacatatacttttatcaaaactgggtgctgaggaaagaatacattcaagtcttggaaaatacctgccacaaaacctaaagagctaatcctctatgtcaatccaatcagccttatttcactttcatataaagcctgactttttcttttttttctcaaaaattaatcagtgtgcaataactttgtttttcaattcaaattaatgtattaattcatatctcaaaaacattgttaaaaacaactgagaaatatcttcagggaagtaccacataatattactaaaaaagattaaatcaataacatgataattaatatatcattttataacatgttattcaaacgtgctaagcaagataataaatcaatttgctgtttcaacaattttgaactcgaataagaaaatcacttgaatttgctttttgtctaacatcatttccatagtcaaaaataaatataaaataggctgggcacagtgggtcagcctgtaatcccagcactttgggaggccgaggtgggtggaacacctgtcaggagttcaagaccagcctggctaatgtggcaaaatgccgtctctactaaaaatacaaaagttagccaggtgtggtggtacatgcctgtaatgccagctactcgggaggctgaggcaggagaatcgcttgaacctaggaggtggtggttgcagtgagccaaaattgcaccactgccctctaccctcggtgacagagggagattccatctcaaaaataaataaaatacatataaaataaatgcaagtaataattcattagccaaaaaaagtaagaaatgtgcattaaaatgatctataacataaccacatttatttaagaatgtattccaatatcaaatggcaaatttcaacaaagcaaaaactttttcccaccaacgtgatactttgtaaaaatgtaatagaatgtgtgactaaacttttaggttatttgtgaagttagaggtatcataaaaggcatagtattcttctgaaaaatttagtttgatcaaactctggtgttcatttgttgagaaagaataagaaccaagaatacaaatcaaactccattaagaaaataaaaagacaagccacagactgggagaaaatatttgcatatctgataaaggatgggcaaaagacatgaaaagatctcacttcaccaaaaaagatatacagacggaaaataagcatacgaaaagaagttcaacatcatatgtcattagggaattacaaattaaaacaaaaaattagaaactactacacacctatttaaatagctaaaatggaaaacactgacaatacaaaatgctgatgaggatgtggagcaacagaaacttcagttcattgctggtaggaatgcaaatgatacagccagtgtgaaagtcggtttggcagtattttacaaaactaaacatactcttaattatgcagcaatggttttgctccttggtatcacccaaacttatgactaacccaaaacctgcatatgaatgtttagttaataaataacatatttatgccaataacatatagcatattattatttagttaataataaacatagcagcttcattctaatttctaaaacttgaacatgacaatgatttccttcaatatgtgaatggacaggctgtagtacatccatacaatggaatattattcagcactaacatgaaatgagttatcaagccacgaaaagacatagaggaaccttaaatgcatattactaagtgaaagaagccaaccccaaaaggctacatactatatgattccatctatatgacattctggaaaaggcaaaactatggagacagtaaaaggtcagttgttcctggagttgtgggggagagatggatgaacaggtggagcacaggagcatttcagagcagtaaaactcttctgtccgatactgttgtggtgggtatatgtcattagacatttgtccaaacccatagaatgtaccacacaaagaattaaccctaatgtaaactgtggactttagttaataataatgaatcaatattggctcatcaatcataacaaatgtaacatactaatgcaagatattaatcatcagggaaatgttgggagggggagaaacaagaagagatttgggaactctgtacttttcactcatttgttctgtaaacctaaaactgctctaaaaaacagtctgttaatttaaaaaatatcaaactctgtaattttgtttaaatatatgatcaaaatttccctatgaattaatgaaagaaaagtgtatgcattgctaaaaaaatccagaagctagcattttatttcttattaatcgaaagaaggaaatatgcaaaatttaataaataaaaatgagaattaggccaaagagggagaaggctagaagcttgaggccaggaggttgaggccatggtgagctaggattatgccactgcactccagcctgggtgatggagcaagaccctgtttctaaaaaaaaattgcttcattcaaaaaatatttttaaagatgagaattgaccatatttgaaataaatatttcatgatgatttgataatcaattctaactatattctttatgtaataatatacagcaagtccaaaataaataaaaaatttatccatgacttattcctgaaaaattgggtagtcatgaaaaacatttaaaatagtcagaatcattcacctattctgctttgggtgtttatagttgcttccctttcctttttaaaatttttttatttttaatttttgtgggtacgtagtagatgtatatgtttatgggttcctttctaatcaatgatacattttaggaataagtaattgaagaggtaaaaaataatcaatatttacatatacttaaatatattgacagtcactccttcataccaatatccttttttttttgtttttttttttttaggcagtcttgctctgttgcacaggctggagtgcaatggtgcagtctcaccttactgcaacccctgcctcccaggttcaagccattctcctgccctcagcctcccaagtagctggggttataggcacacgccacaatgcccagctagtttttgtatttttagtagagacggggtttcaccatgttggccaggctggtctcgaactcctgacctcaggtgatccacctgcctcggcctcccaaagtgccggaggcatgagccaccatgcctggcccaatatcctctttttttactcaccaggtgatgcattctttaacagctgccttatttagaggaaccactaggacagggccactcagattaaggaagaaagatgttaaacaacaattatcattactcctaccatcacactcaaccaaatatctcaataccaaaatggccatttctaatgctggttttactctcagaaataaggttttctaaatgagagtttctaagccttatctgggaaccacatcatcgtaggaaccttctctttggtgtcctaggagttctcatacccaaggccagcttgatttgggatggtgatgggtctttctttgtaaagtgagaaaaggcctatggtaagcacaagcacgttatcagcaagggttttgttttgttttgttttgttttttaagagaaaatattaaaagaaagttgaatgtctgacatggaatctctcaaaactatccaggcacgcttacgcaaaactaatttctctcctgttttccctctactgttctccttccacagctaagggggagaggggagtcctgaatctgattttttaaaaagtgcctccaggcaagtctgatgattaaccatccagtttggaaaccacccaacaatgtacattcattggggcttgatgaggtcactctccaccattcatcacattacttatggattaggctggcctgccagaaggaaaatacagcatattacaaaatttcatcgaaactatctaaatcactctcttgggctaaaatatctgcaaggaaatccaaacactcttctgtattactgaagtcctttgtttccaagtaacacatcaatttaacataaataaaaagaagaatttattttaaggacaataaacatctaaaggaacgcaacaccaaaactgctgcctggtctgaggagggactgcaaccaggcatttctttacctgtcttgcttgttttcttctccttgtgtgctccattcttttttcttgaagacagaggctgctccgttcctaaggcagatggtaatgccactgtccatgagttgtaacatttcctccactgaagagtctagctcagagagatctctccatcctttttccaaattcctgaagaagggacattgaatggcctatttggaataaaagattcactccttagttcagtcaactgaagccagaggggcagtcacatacaaatagggttgccggggatgacttcagcatgttgggaacagggaggggagagcaaaggaagcaattaagggagtcatcctgagaagagcaggagttctcccaaggtgtactactactacatcctgtaagctccggacagccaatgtggacaaggaaatcttccaaggtagcacttattagctactgtaaggaatgacgtcactgagcccttaccaccaagactattttgctgtaacttctagttttcagtaatgccattgataagttttgtgcccataggattctcattcctatatatgtgatctattttttcccctctctgaaagtcttcaggatatttctttatccgtgttgctctaaaacttcacgatgatattctaagatgtgagtctatttttatttattgctctgggcacttactcagggagccccctttttaatcttcattttaatttttttaaataaaaaatccccatttggaggtaatctcagactttttacaaaattgtaaatatggtataaagaattcccagattccccaaatgtaacttggtacataagcataatttatcaagactaaggaattaacaatacaatagcttatcctacagaccttatttaaattttgtcaactgtcctattaattttcttttcctggttcaggattgcagtggactgaatgcttatgtccccttaaaatcaatatgttgaaatgcgagcccccaagatgacagcattaggagctagggcttttgggaaataatcaggtcattatacgatttaataacacctctcctgtatagaatgtatcccagttgtaacttcagatttctccttgtgatttgattaatttgtctcccccattagaatataagtttcatgatgggagtaatcatgtcaggttgctttggtcaccattatattcccagtacctaaaatagtgtttagcacatattatgtcctcaatgaatatttattaaacaaatgaataaattcctttaaaacattttatgatgctgggaaccattgttaagagaattgtttttgcctaaaaactcaaagaacactgcaataccatcttccaggttccccgtgtggttgggcatggtgttgtaaaacagatgaaataaatctcaaacaaatgaactaccctgttaacaatgaggaatgtgttagccaaatcacctataactcattgtaactggccacattattatggagaatggccttagggacttgaacaaacttctcataacataccagagtctggtcttaccaggagtataaaatcaatgggtaattaactgaaccaagaccaggcctgcctccttgccccagcacagatgtgcactgatttcaagagggcacaatttatgtttcatggtgagtaaaggaggcttcagaccaaggacttgccaatgactagccatatggaagccaaactttaccctctcttttaaaagtgcaaagatggtgtcaaattcaacatttgtggcatttcttagagttttatgatttaggtttttgtttttgttttgttttgtgttttgttttgtttgagacggagtttcattcttgttgcccaggctggagtgcaatggcgcgatctcggctcacagcaacctccgcctcccaggttcaagcgattctcccgcttcagcctcccaagtagctgggattacaggcatgcgccaccaggccggctaattttttgtatttttagtggagacggggtttctccgtgttggtcaggctggtctcaaactcccaatctcaggtgatctgcccgcctcggcctcccaaagtgctgggattacaggcgtgagccaccgcagcaggctgatttcggtttttatttaatagaaaagcattgcatttatttgtaacagccaaaaattggaaacatttcaaatgtccttcagttgggtgaatggttagactgtggaacacctatatcatggaatacaactcagcagtaaaaaggaacacgttattgatatgcacaactcctccaatggatctcaagggaattatgctaagtgggaaaaaagccaatatcaaatacatattgtatgattccacttatataacattcttaaaatgaccagatgatagacatagagaacagattagtgatttccagaggttgggagtgagaagagggcgaaaggcatgactataaggtagcagtataatgaatctttatggtagaacagtcctgtatcttgattgtggtggtggttacccatgtctacactagataaaattgcacagaactatgtacacatacacacacacacacaactacatctaaaattggtgaaatctgaataagatctgtcaattgtaccaatgtcaacttcctaattctgatcctgtactagagttgggtaagattttggcattggtggaatctgggtgaagtatacacgaaacctccacatgacaggttgagcaatcctaatctgaaaacctgaaatctgaaatgctcaaaatctgaaatttattaaaacaaatgttcaatgcaatgtatttgcaagagcaaaacaatttaagcaatataaatgctcatcagtaagggatgagttaggccaattatttatatgcaatattaggataatatggaatgaaatgagggcatacccatgctaagctgttacaagtggttgccctgggagtaaagaaatacacattaactttttctttagatatttcaacatcgttatactacttttataatgtaaaaactaaaaatattgtgcccagaaaaagagagaaacagtcatttctcattatccataggagattggttccaggacaccctaaaatccacaaatgcttaagtccttatacataatggtggagtacttgcatataacctacacacatcctcctgaatacttaaaatcatcttttgggccaggcacggtggctcatgtctgtaattccagcactttgggaggcagaggtgggtggattacctgaggtcagcagtttgagaccagcctggccaacatggtgaaaccccatctctactaaaaatacaaaaattagctgggtatggtggtgcgcgcctgtaatcccagctacttgggagcctgaggcaggagaatcgcttgaaccaggaggcggagtttgcagtgagccaagatcataccattgcactccagcctgggcaacagagcgagactccacctcaaaaaaagaaaaaaagaaatcatcatttggttacttataatacctaatacaatgcaaatgtcacgtaatagttgttatggtgtcttttttagggaataatgaccaaaataagtctgtccgtgttcagtacagaaacaaccatccattttccccccgaatcaaaatctgaaattttctgagtgctgaaatgatgctcaaagaaaatactcattgaatcattttggagttcagattttttgattagggatgttcaactggtaagtataatgcaaatattccaaaatctgaaaaaatccgaaaaaatccaaaatccaaaacacttctggtcctaagcattttggataattaatactcaacctgtatttttgcaactttctgtgaatctataatggcttcaaaataaaaacttattttatgcaatataagttatttctagtaaaacaacattcagcatatatgtttgccttcatttacttctgaaatcccactaaatggagtaaagaaaagattataaacataaaagtatacaaccacacacccccaccccagtatgagaccatagaaatggagatgactgtaaaaatatagaaactggaaaatagatgtacatgagataactatttatagtaggtttctgtgaaaccgtagtagtagagatgaccccagagcaaggagcagtcagcagggatgactccattctggacaaggccactaagaagacctgttatgtaggcctggacaaagtaccacaaagccaagcagctatggagaacacatggctcgaggcattcgctggcctttctgtctctgaagcagttgcttagcaatgtgacaagatgccagacagttggagacccaagtaagtgttcacatgctggggggaagcagagggatggctgaatatggggctagtggtggatctaaagtctgaactattgggggccagacacagtggctgacacctgtaatcccagcattttgggaggctaaggtgagtgaatcacttgaggtcaggagatcgagaacagcctggccaacatggtgaaaccctatctctactaaaaatacaaaaattatctgagcatggtggtgcgtgtctgtagtcccagctactcaggaggctgaggcaggagaatcgcttgaacctgggaggcggaggatgcagtgagccgagattgcaccactgccctccagcctgggcgacagagtgagactctgtctcaaaaataaaaaattttaaaataaataaataaagtcagagctattgggaaaaatcaaatagcacaggggctgaggaagagtggtctcagtgcctccggtgtctgaggcttgctctgtggactagaagggagtagacaaacctgatttatagggccaaggttgggctggacacccccagtctaaatcaacagttttcaaactttgtaaagcagtggaacattttctccaaagtaaatcttaaataaaagtgtaaaccaccaaaacaaagtggggttgctctggtagcaactgcatccttgatttccaggcctcctgagggtcccacatccagatgttgaagcaaaaaggaattcaaaaatgcagtaattttctttattgagaagttaggttagaaacccaattttcaagtatgcaaattaactagaatgtctccagtctgtgttagatagaacctgaaaacggaaattttgaactagcacaccagtcaccatttccagtctgctctctcagcaggccccatggcccctgtaatttagctagttaaggcttttcctctggccaaacagctaaacttgagccaggtggacttaaacacatgaaccaattcagtttactgtctaaaaatgaaagagaaaagtctgccaggatcttctcctcgtccccacaaagttcccaagagcagaattcagccctcctcccctcccactacaaacacaggagagaggccagcccaatataacttaaaacagagcgaccctgcagccctctcagacaaattacatcaaaacaagtcaaagcaaatgcaactgtccttaccagttttgtaaaggaattgcctgggaaccattccttttcagacctaattaaaaagtcagttttgaattacagaacaagatggtatgagagccagtgttcaacaggcagaacaaacaaacatgcaaagataaaatgcatgggcttttacagagagctgctgccagcgacagcagaaatggctctctttcagccaagtctagggtgccctggaaaacttcatacctctccagggagacagttcccagaaacctccctcccctgcaaagcactcctataacaaataaataaactacatttcccaaagttctctttgctcaggcctggggctatattttaaaccactctgtaattgtcccccaccagaaaagcagaaatgtttaaatgtgacaaccttttgacatacagagttgactcagctcatttcaaatttcatcttatctccagtgtccttgggcatgttttaaaagataaaaataccaaatgtgaccaagatcgtcaaggtataatggaacaagggtccaatgtttttttaccctcaacgaatgcattatacttcatttagatcagcggtctcaaatattagcatgcgtcagaatcacctgaattcagggcttgttaaaatacagattgctgaaccgtacctccacaatctcagattcagcagatttggagggggtccgaagaatatgcgtttctagcaagttccaccggttctggattacactttaagaactgctctcagagattatctacatggtcaattccaaatctatcaagaaagaaggcacacagttactgatttctgcaagctttgaactagcagtatctttaaggagaagaccccagccatctctagcagtgtggggaagagtaaaaggcaaagcctctagttccggaagatccagaaactggcactgcctggtccagcattttcattttcccactgaggaaatgtaggcttagagggaatcaatttgtgcagtctcccagtgagtccgtggttgtgctgggacaaagtacccagttgtcctggcttccactccagtgctctggcccttgctggagtaaaatgggacacctgggcttggcaaggaacaaggacgccaacatgattctgattcatcccaatttctccacagccttctgccttttctctgcattggtaaaagtataatccccaacccaggaattttactctcgctttcgttcatgtcttcgtagcctaagacaggcagtcaaaatgggacagctgacagccacaacagcctttaattacaatatctggaggacacattaatgaatgtagacccatttatttacttttttatgtaccttgtctgtgcgacagcaagcaactagaatctcaggaaacaccaaccagacccaggcatcaatctgctactctgttattagaaggaaattagcctttaagaaaaattgtctaggcttaccaatcactcccaccagccaccaggggtcacataaatagaagttttcactggacctttctaattcacaaacctaccctcttccaccacaggccttggtagaacacataattcagcagcaagaatcccttgaagaagaaaagaaaacacctataaaactatatttttttctaattccagagacatgaaaccctttaggagtttaggccagggttcatgacaatccattatctgaaagcacagatgtacagataaaccattatttttgtaaagatacatcttctaaaacaccagtcagcttggcattgtgtttgtccttgaattgaagaacgatatcattttatcgtcctagccttgagcatggttatcaatgccagtaactaagaggcctaatttgaaagatggtcatgatgtccgacttacaaatgccttctactcagttaacagggactgctgaaagcaaatggcttatacattgttgcacaagtggaaaatctggcctcctaacagttgttaaatgtgccagctaagagcctctgaaggtcagtctaccagggctggggcagtgaccacagccacgtgctgcgccttttgcagctcagcaccgcatggtgcagctgttgtattggccaaagaaagtgctggcagccccgggagaaacagagacttaattcacttgcaggaactttcctgaaagagtcttttaaaaagcatttaaggcagaccaggtgcacttattttctttttaaatctcattgctttgtcaagtattctcgtttatggctccaacactctttatgtgcaacattaaccatcctttgttacattataaattataacgagaacttttataaaacatatttaatgataattcatgatttctaggtagattcctttagatgtataacatttaaatatccatggtatagcactcttgatatgtacatagcagggattgcaatttaggttgcctggggttttgttaaaagttttgtaagttgtgcagactttatctttaaataaaactgtgtgtgtgtgtgtgtgtgagagagagagagagagagagagatacacagtgcttagatataaacagtagtaaaagaaagctgattcaattcagtatgttacactgttaagacttccagctgtcaagtgcttccactataaacaggaggcgggaagaatgggatctagagggaatagagattgcataaaagtgaaacttcatgatgtgagggccgggggttggactcaagtcatcatctatttaggtgaaaactgccaataccctgaataattctaggaaatactctggtccttcactagactctgaaagtactcaggccacaaactctcccagtcctagcatgacaaaagacctccctatgccaataagtaaaaatgagtgccagagccatcctcaaaggtaaatatctggggtaggcagctgtttgcataatgtgattttaagtgtgacaagcacgtactccacccaaaaaaaaatctatgctatagacccaggtcacggatgcctgcaattctaccattagggagtatttccatcccagtcagagacttaggaatcatccttgactcctctctctccttctctgaccccattcaatcaatcatgaattcctccttcctagcttgactctgtccctttatcttcattccctctgacagtacatagttcaggtcaccatcgactcctgccaggatgactgtggttacctcctgacctgtctgtgtgcctccaatttgttctccacactgcaactgcaacaaatgtgatctttctaagatgcagatctgattatgacagtccccagattaaaaccattagctgggtcctcaaggccctcagaatgaagtccagattcgttaatggggtttacaagcccttatgctctggccatggctgaccactgtgggctctcctatgccactgcctccccgtcagtgcactcacctttccttagtcccttacttttgcttccaggcctttgtacacattgtcccctttgcttggtacactctccccgtttcctacctttgttcccaaagactgcatgaccctaaatttatccctactttagcactttcttactatgtaagctttatccatctgactctaattctttctgaattaggactatgtatttcacaaatgccagaactcttacttattcactactttatttccaggacctagcaaatacttgtctcatagcagtcactcaataaatatttgttgactaaatgaacaagtgaatcagtaaatgtcttatcttttattaacaacgttagcaattcacacttcagtgtgatttttcttactacagctctctaagaatatatttgagacggttaatgaaataaaggcagaattggctctggaaaaccaggggacagtataaaggcaatggttagccaagaaagaaaggcactgagaaggaaggtaagaacaggttctattgggattgcttagataggggtcctttctagataaaaagaaaatagcggctgggcacggtggctcatgcctgtaatctcagctctttgggaggccaaggttgggtggatcacttgaggtcaggagttcgagaccagcctggccaaaatgatgaaaccctatccctactaaaaatacaaaaattaaccaggcatggtggtgcatgcctgtagtcccagctactcaggaggctgaggcagaagaagtgcctgaaccgaggaggtggaggttgcagtgaggcaagattgcaccactgcacttcagcctgggtgacagagcaagacttgcgaagaaagagaaagaaagaaagaaggaaggaaggaaggaaagaaagaaagaaagaaagaaagaaagaaagaaagaaagaaagaaagaaagaaagaaagaaagagaaagaaagaaagaaagaaagaaagaaagaaagaaagaaagaaagaaagaaaaagaaagagaaagagaaagagagagggagggaggaaagaaaggaaagaaagaaggaaaggaaaggaaaggaaagaggaaggaaaaagaacttaaaaaaaaaagcaaccaaagcttgagttctgttcctgatttcatccccaaggttaccaccaagaaaggtggttttcctctgcatgggttgtacagtgaagtacccgcacttggcctgtggctccacccacagctggctcaatgactgtggcctgtgccatggagaagctgcaagaacaaggcagagtggactggacagtctgtgtcaccctggccaatttgaccaaacttatctagtcacagatggttatgaataattttttgcttatcacagcctttcggaaaagtattaaagtttcagcagcccatgcttcatgtattttcctccccaagtatacccttttacctataatcagtatagcggaaggataagatgtaaaatgtgttcactggtttattagtttgttatactactgacctcagtcaatcacccggtgatgtttctgggcaatacaaaaatatcttcttccttctatcccgtgatagggggtattttctaagcctcagacatgagcccccactttttttcctctctcttctttccttggtgaaccaattctacatactgatgatgcctaaatctaatacatccaccttgacctcataaacagaatccacccccacatatttcattgtctgtaggacattttcctttggacagctcatcaatcaattcaacaagcccaaactaccttgttatcttaccttcctccaaaaaaatatctgagccacagctgcaacatcctaactttttccagtacatcattaatctcctagtcacatgtcagaaaactcactccttccactagaacataaactgtcacctcatcaatgagggccaccttgactactccatttaaaatttcatctctatggccccagcattcttgattcccccttaaagtgctctgtttgttcccagcatttattgttttctagtatgctacataatttacctatctacttattatttctcattctgtccccaaatcttactagaatgtaagcaccactgaagacagagacttctgttcacagatatcatccctgtgcttataacagtgcccgacatacagtaagtgctcaataaatatttgttcaattaattcattcactctacaagtatatacttaatataacaaataatgtaacttaaaataccttactcctctaattggaatttacactctgtgaagtagaggtctttgacttctttgttcactgctgtgtccccagaatctagaatggcaccaggtagcaaaggtgttcaataaaaatctgttgaataaatgaacgaatggataggaactcattgagtaccttttagtaccaagtactaagtgaggtgcttggggattctagatattttaaataactaactatgatgcaatgggataaatataaataatagaagtaggaacaaaatggcatgggaactcaggagcaatggcactgaagatcattcttcacgcctgagtctgaaagaagacacagatgtttatctgctccctgtgccaggtaaagggccacaaagggattaaagtgtatggtatggcgcaatgtttctcaactgttatttccatatgagttacctggggactcttgttaaaacagactctggtttgatgggcctgaggtaagccctaagatttcacatctctaacaaggtgttgttgaggctgctggtcctcaaaccacacactgactgacaaatgtacacaactcggcacccatcccccttatttctttttactagactaaaattttgtctatgtatctaacactccctcctccagtatggagaggaagtggttctagtcccagctccagggttagactggatttgagcttggccaatcaggacaaggcattcttttgactgattactgggtgagaatgggaatgggaagtaaggatgcatgatctgtttaggggaaaggttttcctttctatgctgctgtccttaaacaaagaagcgtatggcttgatggctacaggcagccatcctccaacatgagaagcatgagcctcaagatgaaccgaatgccaagggtgctgagtggagagggggagagaacctgggtccttgatgatcacttagctgctgattgtgttgatcctggaatctactctacctctgatctttcaggtatgtgaaatgataaatatccttattgttcaagccaatttgaggtcaaggcttctacttgcagcagaaattatcctaatggttacatctgatttttgtttatttgtttagggaacaaatatttattgaatactactatgtcccaggcaccagaaaaataagacaggcataattctctaccctcgtaaaatttatagcctagatgataaattaatttgatagagttcaaatttctgagatgagcacgatttcattttaaattatttatattcttggatggggactacttctccctccctagccctgcccctgaaatagttctttattagtcatctctgccctagtacaactgccttcatcctaaaacagagctttgtctccttacgcttgaaaattgcaacagtaccctaacacccctctcagatccaatctacaaactagtaccctattaatcttcctaaagcatcaaattcacgagagaaaattctccagagaccctccattgcttaaagcagtgattttcaagcttgctttatgaaagcaaaaaactgtttcttcaaaagcaaaaaaggttattatacaaagtcacaatgtattaaatagacaaactagtgctgtgctgtagaagtgagggacacccagaatctcatcccctccccaaccccattcctacttcacttcccaacacacccacttcctgaggagtggtagagttcaactggtgccttcacttcacatagtttcacaaacagtagccttgtcatagggtaaaattaaaaatttccacttgtcattctattacctgcctctgttatctgcccacattcttgatttgaccaagtccagcctccccactacccttcaaacatacacactcaagtctttgcctaggctattacttgcatcagaaatgtctgggccaggtgcaatggctcatgcctgtaatcccagcactttgggaggcagaggctggtggatcacttgaggtcaggagtttgagaccagcctgggcaacatagtgaaaccccatctctacaaaaaatacaaaaattagctgggtgtggtcgctcatgcctgtaatcctagctactcgggaggctgaggtgggaggatagcttgagcccaataggtggaggctgcagtgacctctgatagtgtcactgctcttcagcatgggcgacagagaccctgtctcaaaaataaaaaaataataacaataaaaaaataaaagaaaagaaagagaaagagaaagaaagaaataagaaaagctgtgtgtccatgtctgtgtctatgcaaaacagatacacctccactagaaacctgaaaacaacatggaacacacactcccagcatccacatagcaggcatgaccaatcgatcccaatccatcagtctcacttcctctgagtttggtagctccacagtttgtttccatgcatcacatcagtcaaccactatcaatcctattatttaacacgcaaaagaaatgtctttttggccgggcgtgggggctcacgcctgtaatcctagcactttgggaggtggaggcgggcggatcacgaggtcaggagatcaagaccatcctggttaacacggtgaaaccctgtctctactaaaaatacaaaaaaaaattaaccgggcgtggtcacggcggacgcctgtagtcccagctactccggaggctgaggcaggagaatggcgtgaactcgggaggctgaggcaggagaatggcgtgaacccgggaggcggagcttgcagtgagccgagatcgtgccactggactccatcctgggtgacagagcaagactccgtctcaaaaacaaacaaacaaacaaaaaaaaagtctttttatcctctgcagtaaatacagcccttattccatcattttatggattcacattggcacttaattataaaagagtctgatgtgtgtgattccttagttcaattataaatgactggaggctaaggcctgtattttctcttctttcccctggatttttggctaagctgtagcctcttagcaggtattaaataaatacatacataatgaataaatgttgacaactattaatttgtgtcttctaaagcatactgatatgatcaccacaccatatcaaaacacgagacagccccttacagcttgaataactactttaggaatcaagaaatcagagctcttctgccccaggagcactgctaactagtcatgtggtccttttatcttctgggcctcggttttcctcacctgtaagaaggaacttgattatattatttctgagggtcaatattagggatgttcttcaggtttgctaggagaagaagcactcagattaccaggttgcctgtgggagtggagttcatcctccatgtccctagctgtattctgagttcctggacttcccagtcatggcctgatgccggaccttatggagaactggcacaacatttcctgccatggagtgtgactacccttctctgtgtgaaagcatcatcagtttattcctgtcaaacagactctgtcggtcgggtagagtttcacaacaaactctgttgaggcttttaacctcctgcatacctggcttcccatgattgtctttgcctaggacaccctggtctaatcagctagggccaaaacaatagggtcagtttcactcagggaatagtcaagccactttatgtagggaataactgatttgggtcatcattctcagaaaagggggctgtaggtgtggcataacctacagctccataaactcttttctctctctttctaaaatgttttatgagaattaaccaaatactgacaatcaatataaagagcattaagaaatgtgcagcatgaatgaaagattacattattcacttagcagtaatttaatctttctgcacagtagaaacgcatacagaaagacctagagaagaggctaactcacaaatggcaggaaaccaactccccaaaagactttttgggatccagagatcttaaacataatgtagtgttcctccagtatttaaaacgaaagaaatatttttaagagtacacagggagtaaaagtgttttataaccttctgacatgtagctaattcaaacacagcctgcctggtacgtgctcggccacagccagtaacaaaatctccagcctgtggaccaatccccagtcccctctcctaggatccagacacaagtgtgctttccagaatgggttggagtgtgctagcccacacatctcacttaagcagagaaatcaggggctgacccttgagtccaaggcctttggcaatggatacacttttataaatagaaagaaacaaaatatggcactatgttttcaactatcatttcaaaagcagatttaagaatgtcaggatcattactgttacacccagaagatagcacagaagatgccacaggatcacccaggcagcatttcatggggaaaggagcctagacttggctttcatacagccctaggattgaattcctattttgccttccccagtttgcaaaattttttgcaaagtgcttaatattaatagtagttaccattcatcaagcacagtaggccctccttatccatgggttccacatatctggattcaaccaacctcagatcaaaaatatctggaaaaaaattgtatctatactgaatatgcacagactttttttcttgttgtgatttcctaaacaatacattatattaataacaatgatttatatagcatttatagtgtattgggtattacaagtaatctagagatgatttaaagtatgggaagatatgcataggttaaatgcaaatatgacaccattttgtatcagggacttgagcatccttgcattttagtatccatggggagtcctgggaccaatttcccatgggtgctgggggataactgtactttattctgtgccaagggcatgatatgcataatgatatttactctttacaagaaccctgggaggtaaaaattattgggtctctgagatagtaaccttcccatagccagttaacgtgtaggagggaagccaagattcaaagccaggtctgaagctccttactgcctttcctattcatcctctctgagacttcatttcctcatttatagaatagctataataacacctcccttagaaaactgtagggagatttccattttgttttattgtaaacatgcctggaacatagtgattgcttaataactgttggctagtaatataaatgtatacatgaaatactgaagtcacaaaagggcctgctggccacagactggtttccttgatttccagtctgctatttatttatttatttttgagacagggtctccctctgtcgcccaggctggagtgcagtggtgcgatcttggctcactgcaccctccacctcccaagttcaagtgattctcctgcctcagcctcccgagtagcagagattacaggcgcccgccactacacccggctaatttttgtttttttagtagagacagggtttcaccatgttggccagccaggctggtctcaaactcctgacctcaagtgatctgcctgcctcggcttcccaaagtgctgagattacaggcgtgagccaccatgcccagccttcagtctgctttttaaaaacatttttttaagaagtctaattgaacattaccacaagcacaaaatgtagaattatatgaaatcgccccacatccaatcacacatatatagtttcccctccccagctttagtgaggtataagtgacaaaaattgtatatatttacagtatacaacttgatattttgatatatgtatacattacacatagttttttgtatattttcttctgctgttttcccacgtgtctttttttaaagattgttatagttttatattctttttttcttttttttttttctgagacagggtcttgctctgtcacccaggctggagtgcagtggtgcaatcttagctcactgcaacctccccccactgggttcaagtgattctcctgcctcagcctcccaagtagctgggattacaggtgcacgccatgacaccaagctaatttttgtatttttagtagagacaggatttcagcatgttggccaagctagtctcgaactcctggcctcaagtgatccgcctgcctcggcttcctaaagtgctgggataacaggcatgagccactgcacccggcctatagttttatattatattttttcacttagcattatcataaatatgaatatcataaataatatgaatactatgctacatcctatttatgcttagcatctttaatcacaaaatcagtgaaccattctggaatatttttttctcctttggatgagtttgggccctgtgtgagagaaatctagaatagaatcctcagctccaccacttatcaccacatgactttaggaaagttcttaactctctaagcctctgtttacttacttgtaaaatagggataatgattcctacatcagaggattattgtgaagattaagtgaggtaacacttgtaaagcccctatgcttttactattcacaataagcttttattaactctagctattcttaactagaggcttctccttcccccatccaaacagcattacttcacattttctgttaatcaatggctttagagaaatatgcttagagattacattggtttaagagagggagaggtgaaaggggagagaaaaagaaagcctgggagcgggaaggctctgctaggctctctgactgcacaccacacctgccttagaccttttcttgcaactcttgcaactgcaggagcagcaggggttcccaggctgaaattccattctcaggtagctcacagggcagatctggtcactgctgggatgtgtgggctgtgcccacctgctccctcaggcagcctcattccacactggctcccttgggatgaccgaagcctctgtggcctgggatagaggcagctggggaggtcagggcagctttctgtgttccgtgagagcttctcagttgtctgaaatcctcagccttcaaagtagagctgatccctacccagaaatgtgaaactgctgtgagtcaaataaatcattaataggcaagctgggaaagaatgggcagtaaagaagacaaagggtcaatcctaaccctcctcagaaggacggacttcacatgtgccctctacttccttactccattgcctgcaacacacaagatgctttttgctgcccaggaagtctccagaaacattccacacaattgagcactccctggttctggaaacactctattctcttggctgccatgatgtcatcctctcccgcgctttcttctgcttttctggatgttccatctctccctccttcgtctgccatttctcctctacttgacctctaaatgtcagagctccttacgggatggctttaagttctgtcctctttatgaactttccatctccctagatgacctcatccatttccatgatttgaaatatctaattctaaatttttatctccagctcagacttttctgagctctagacctatttgtccaataccatggatacacacatctccacttaaatgtctctaagatcttttgtaacttaacatttctgaaactcttgatcttaacaccccaatacacattcccccaaagtgtcccttcattcagtgctactctcctagtaaatctcagcgattcctatctgctcagtagttcaagcatacctgagacctagaagtcatctttgattcatcctcttccctcaccacgcccatccagttgatcacaaatctctctcaattcctcctctacaatatttcttgtgtcttcccactgtcaccgtcctggcccaagccttctcttctgatagctagctagctaatcaccctgagccctccatatggaaaccagggatcatttaaaaacatagtaaatggggtcatgtcactatcctacacaaaaatacttcaatggcttcccattgcacttaataatagccaatgtgtcaggcactttgcagagattatcatgcattacacaggtgcattatcttagtcttcacaaccctgtgattaccatcctattttacagataaggaaactgaggactggagaaattaatttgcccaaattgacaactagaacagtgtagagttaagatttgaactcagtcagtctgactccaaaacccaagcctctcaatcaccactgtcctgcctttcacttaagacaaaacccaaattccctaacataacctaaaagactctggcttctaccgcctctttagcaccatctccttctgcatctccatctttcagtgtgttctagccatgcgggtctcctttcagtgactctaataccctaaggggccatgaaaattatgtttactacaatttcattatagcacagggaaatggctaggatatgacattgaatgcactaaatgaaaacacataattgcttatatcatatatgcctgaatatgagcaactttgactattatacagtcccaagttatcctgatgaaaatattaaaacaattgagtttttatgggcaggtgatagaaaacttgaataaacttttagcaatggggatgatttttttttctaatgaatcccagaagagaatgctctttttagtagtcaaatcccagaagaaaatgctattttttagtatgtttaactgaaaaagcttatatttccacttcaatttaggaagttcttcttcttcttcttcttcttcttcttcttcttcttcttcttcttcttcttcttcttcttcttcttcctttttttttttttaagtggggccttgctctgtcactcaggctggagtgcagtgacacaatagcagcccaactgctgggttcaagtgatcctctagcctcagccttccaaacactgcattacagatgtgaaccactgtgcctggccttaggcaattatttttgacagaaggtatggaaactaatgttgcattataaagtcctcatcaaatatctcatacttaagcaaagaccccaaatcatagtttgtagatttactgcagctttcattcaaaatacgttttttatcatctgtcacacaggaaaaccctgatacctgatatcttcctatcagcctaaagaaataagaaacacaataggacagtgattatacttttaaatattagggagtttagagccccagatattctatatgcagaccactatgctcatgtttatgtcttttttttcttaagtgttagaaatgtttatttgtcaaaaaattatttaaaaatgggaggagtggagtaaaacaaggctaaatttcagctaatgctgtaccacgatcacaggtcagatataaaaaaacaaacaacacaacccccaatggtcctagcaatttcagaagattaacttcaatgttagagtccagaactaacagagaagagtaaaaggctgcttgccactacatggtcatttgaaagagaaaggagatgctgcaggtaggcagggagaagtattcaactcctagggaaagcaagataagaggggttccactgcacaggaaaaaggggatgccagcataatccttacctagggctgttcagaggctgagaatataaggaacagagtaaaaaaggctacagagactagtatcaggaggaaagaaaagtcaacttagaagaattaaattaagaaagaaaacatagttggtcacaaactccttttgtttactgaaacgtgaagcaatggaaacatcctggcaaaggggaccgcacggagcaagttctcatatatgcccgcagcccgagggttcagtcagcaattattctacctccagtttttaaaaggctgagtaccaggctcggtccatatagtgctcccgttcataccgggccatgtcgtgtagagaattccgtgtagctgctgaagcctgaaataactcactctctggcccataaccgtagccctctccaactgtggggagcatggctgcagcatgacgcggttccacaataggaggaagtggtggccggagcggcagccatagtagctgaagtggcagcagcacaagaacttggcaataggtatctgtcttagggattagcagaagtagagttgaggtggctggtcacagttgtactttggacttgaggcagatgggacatggtctgctctgcctagttacatgcagaagctgctgccgctgctgctactgcctcgtaagagcagacccagtatcgcttatagtagtggagtgctgcatatgcatcgttgtaatacctggattccccatagcccatggtgtaaggcgtgtgaactgctgcatattgttcattacactgctcagtaaagtctgccacacgacccgtacgatctactgggcactctttggaccagtgaccttctttcttacactgatagcagccacactggtctcccattccaggggcagtccgaagtcgggcttgtggacaactacacatgcattatcttgccttgaaactctgtgttgtcaaggcccctgacggtctcactgcgtcctctgaccactccatgtgtatgaagtgtatgaggacataatctttcacgatgtcacattcaatgactggaccatacttctcaaacttggcttgaagctcttggttggtacaagtgggactgatgttacccacgtgtaacttggttgacgctttgctcttattcttgctggcttccacgttgatgttcaccccatgaagcttgtaatgatgcaagttgtgtatggtatcctcagccgccgtcttgtcttctatgtgtacaaagccgtagttcttaatgatgtcacattccagcaccttccctactgcttgaaaagagagcggatctcctgctctgtggcctcctggggcaggtttctgatgaacagcttcatcatccggacaagcacctctgggtggcagcggcggaggtagctcctgcgtcagagagaaccctacaaaatcgtttgtcttgataaaagaaaaacttcagccgaattaaatttaaaagagtttaattgagcaacgaacgattcacaaattcggagccagagtaggatcagagaatccagcgcagccacatggtagaaggagatttatggacagaaaaaggaaagtgatgtgcagaaaacggaagtgaggtacagaaacagccagattggttacagctcagcttttgccttatttgaacacagttcaaagagttggctacatgtgattggtcaaaactcagagattggcacacgtgtgggctacggtctgtttacacctccacttgttatagttcattatgcacggagaaacctaggccaaaattaaaatatgtaaggaggcagctttaggctaaacttgatttaacaatcttaataagatccctgtccaaaggctcacatttctatagaagctacagtttttcaattccaaggataggtaaaaacagggcagcaccatgatctataaaatctagagttatggctcagagttagggccgtttcttggtgacattgtgatggtttagctggtctacaacaaatctatgagggcagaacttggaagtgttgactgccttcacggcatggaaggcctcagccctgtgcaccacagcgtggttgtgctcctgccccgtggtcagataggacacgcttgttcagtagtagttctcatggtctgcagcgcggccgccagtgcttccagatccactgccttccaggaatgccacagcaacagaggagggcagtcaggaacttggagcctggggctgcactcatcagacagccaagtcgttttggccactgatgcaaagatgaaatgtttaactatcttcttacaatatttaacttggtaatttagtttaaaatgcatatacaaaattgcaagtattaaaaaatgttatttttaaaaattgccttttcccactcacacatttcatgaaaacattttattcaaactttttaaaggcatgtttcatgtcagtgtcttccatcacctctaaagagatgttctctaccaattttcctgaccacctcatcttcacttctatccaaactatttgccacatagtacttttttcttaaaaacaaaaaaattattacaggctgggtgtggaggctcacgcctgtaatcccagcattttgggagactaaggagggaggatctgttgagaccaggagttcgagaccagcctgagcaacatagggataaccccatctctaccaataaaaaaaaaaaaaaaaaaattagccaggcatggtggtatgcacctgtagtcccagctactccagaggctgaggtgagataattgcttgagcccaggatttggaggctccagtgagccatgattgtgccactgcactccagcctgggcgacagagcaagattctgtctcaaaagcaaccaaaaaacaaaatttattacagaaaatttcaaacacaaatagaagtatatagaaatctcaaaaaaggccgggtgcggtggcttatggctgtaatcccagcactttgggaggctgaggctggcgggtcacaagttcaggagatcgagaccatcctagctaacatggtgaaaccccgtctttactaaaaatacaaaaaaattagccaggcgtggtggcaccacctgtagtcccagctactcgggaggctaaggcaggagaatcccttgaacctgggaggcagaagttacagtgagccgagattgtgccactgcactccagcctgggcgacagggagagactccatctcaaaacaaacaaacaaacaaaaaaataacctcaacaactatcaactcatggccaatgtttcgttcataatcctccatgccctccttcctgaattgtttttaagcaaatcccagatatcttatcatttcacccaaaaatatttcaatatgtatcccgaagagaaagctctttttgagaaatataactgcaatcacattatagtacctaaaaattaataatgccttcacatcattaaacatgtagcaagtgttcagatttccccaattgtgtcataaagttgtttaaattaggatccagactaggtccataacttgcatttagttgatatgttttttaattatcttttaatctatgggtgtcctccttcctctggctcttttttccttgcatgcaattcatttgttgatccgccctttagagtttcccatacctggaattttgctgactgcattcctgtggtgtcttgtatcatgttcctctactcccctttatctcctgggaaatagtaggtggctctggagactttatcacattcacattctatttattggcaagaatatttcttagcactttcatcaagaggctaattggttggttgtttttctttttgtgttattatagccattaatcatcactacctagattcactatttcagaaagggtgcaaaatggtgatactctgattctatcatttcttcttcatttattagctagaatacttctctaaggaaaaatgttctcttatcaacttttgattatcctaaggtgcagtcttcaggaaaggcaagataaatgtgtgattccttctttttattagttttcagaataatgggttggtttcctaacatccatcaagagtgacctaatgtctaggtattacttagttttctttttgggtgggcatgatggctcatgcctgtaatcccaaaactttgggaggccaaagtgggaggatcacttgagctcaggagtttgaggctccagtgagctatcattacaccattgcactccatcctgggcaacagaccaagaccttgtctcaaagcaaaaatggctgggcgtggtggttcacgcctgtagtcccagcactttgggaggccggggcgggcggatcacctgaggtcagttcaagaccagactggccaacatggtgaaaccctgtctctactaaaaacacaaaaattagccaggcgtggtggcaggcacctgtaatcccagctactcaggaggttgaggcaggagaaccccttgaacccgggaggcggaggttgcagtgagccgagataacaccattgcattccagcctgggggacaagagagagacttcttctcaaaaaaaaaaaaaaaaaaaaagaaaaacaaggctgggagaggtggctcatgtctgtaatcccagcactttgggaggccgaagtgggcagatcacttgaggtcaggagttcaagaccagcctggccaagatggtgaaaccctgtctctactaaaaatacaagaattagccaagcatggtggtgcgtgcctgtaatcgcagctattcaggtcaggtggctgaggcaggagaattgcttgaacccaggaaatggatgctgcagtgagctgagatcacgccactgcactctagcctgggcaacagagtgagactctgtctcaaacaaaaacaaaaacaaaaacttaattttgttttatcttatttgtgatatactactttttattttatacaggctcctggccgtggaatttttattataagctacaaccaaccagttataaactatcaggatagttgacctttttttcagtagataatcatattttatcgacagatgttgaatttttgagatagaattcacataccacgcaactcacaaacgtaaagtgtacaatccaatgttttttagtatattcacagatatatgtaaccatcaccacaatcagctttaaaacattttcatcacttcaaaaagaaatctccgtaatctttaactaccacctccttatctacccatcccctcccccaggcccaagtaacctatgatctaatttctgatctgtagagttccctcttctggactttcatacaaattgaatcatatattatgtggtcctttgtgactggcttctttcacttggcatgatatgttcaagggttatccatgttgcagcgtgtatcagtacttcatttctttctacagccaaataatattccactgtataaatatacaacatcttgtttatccattcatcagttgataaatgtttgggttgtttccagcttttggctattatgaatatagttgctataaacattcatgttcatatttctatgtggacatatgttttcattttgcttgggcatatacctggagtagaatatggtaatactatgtttaatcatttgaggaactgccagactttttttcaaagcagctgtaccattttacattcccactagcagtgtatgagaattgtgatttctccacatcctcaccaatattcatggttatctgactttttgtttccagccaacctagtgggtatgaagtagtatcttattgtagttttgatttgtccttctgtgacttataatgctaagcatctcttcatgtgtttattggtctcttgtacagctttcttggagaaatgtctattcagatccttttcccatttttaattggataatttgtcttttttattgagttgtaggatagataatttttctcatttgccacataggtatgtattaatataaccacttatactttttaaagtaatttttttaaacttactttgaaaatgtaaccaggacttaaagttgtgtagtaataacctcaggattaattattgactccatattaagttttttagtaacttttaaatattccagcagatgagctcaataaacgtgaagaactaacattggctgaagtttttttcaaactaacatgtcttccctaaacaataagttgttattcaaaacaaaatattgagaaggaaacttctatagtgtgatcaactttgtaaggacttgaacatatggtgactcttttctgaggaatatttttacgaaaatcctgtcttttattggatatatgtggtacattacagaatttacaactgtgttttaaaataaagcccatgtagcccgcattattggatgacattagtccctgtgcattactgctgggttgtgggagattgcagtgttaaatgacatcacacaggaagtgtttaacacagtctacgacctgcctgtgagaatatccttcttcaacttagactccagaggaaatgagtctttccactgaaaggtgttaaacatgtccctcccacggttacagtgctcaagagaaaactgactgggcagagagattatagccccagggagagcataggtgaatagcccactccagccagcttagtggtcagccatcgcacttagcaagggaaacagagctgacacatcacatggcttctggtgaggtccatatatagcaaggcaacaggccacaagcagttttgtggactgctggaagaaacacatgctggaaaaaggttaccactagttctttgtgaggaagaactagggtctggagtcagatgtcactgttcattttttgtagtttgttgcatgtaatcttgtaagcaaactctagttcttttcacaatgagcggattggtcgttctcaacaaattattgtcttcctcaagttctaaatttaaaaagctctttatgtatagataaattaggtagaccacaactaattgttaagtcaagattctgtttttgccatgatcaataatacatcagcagcctcccttacaaaattactaatgcagccacaaggatgtattactcatataaatattgtattgtatttatttatttatttatttattttggagagagggtcttgctctgttacccaggctatagtgcagtggcatgatattggctcactgcaacctctgaccccagattcaagtgattcttgtgcctcagcctcgcaagtagctgggtattacaggcacacgccaccatgcctggctaatttttgtatttttagtagagacggggtttcatcgtgttggccaggctggtctcgaactcttggcctcaagtgatctgcccgcctcggcctcccaaagtgctgggattagcatgagccaccatgtccaccccagaaaatattcttaatggaaatacaccaaaacaatcgtgttagtatattttgaatgggggccttataataagagtatttatcctactttttttctatttttctaattgtacataatgggaattttttaaaaaatgaaaactaataaaataaaaaataaagcttattcctaaatgattcaaatttgttagtttctatagtagtgctttccacccttgaaatattgaccaaaatagattacttccagtccaaataattaggttatagaaaaacattaagaatttgtctatacaacattatatgtgttgaggttttacagaactaagccctttttcctcacctgagtttaagaccaactgagagatagacacaagagtcagacagttgaagatcagaactttatcttgggccgggcaccgtggctcatacctgtaattccagaactttaggaggcagaggcaggtggatcacatgaggtcaggaattcaagatgagcctgatcaacatggcaaaacctcgtctctactaaaaatacaaaaattagcccgatgtggtggcgcacgcctgtaatcctagctacttggaggctgaggcaggagaattgcttgatcccgggaggaggaggtggcagtgagcaaagatcgcgccactgcactccagcctgggtgacagagtgagactgcatctcaacaacaacaacaacaacaataacaaacgaaaaaaaaaaaactttatcttgatcgctggtaaagctggattggagaacatggttttaaatctgtgacttacattttgccccaaattaaacgtgtctgcttggtcacaggaagagttggaaagccacaggctctcttcatagggatggaacgtgccccactaacaacactatgcagagaacagactaaaaaacatactctctgcaggcagccaggctaacagggaagtggagtccaagaggctgagtcatgcatgcccagttcttatgcccaaacaccagaggtagcgggggtaaagagagaccagggatgttactttaagaaaagaagtcttccattcagaactataagaccaagggaaatgaataatcctaacccacctgaagcaataataaatggtaaaaactccagccaggtaaccagggccatgtgatcctaagaaatagttttgagtggttgtgttttttttgttttttgtttttttgacaaagtctcactggttgtggtttatttgtttgtttgagacagggtctcactctgtcccccaggctggagtgcagtggcatgatcttgcctcatgcagcctccacctcctgggttcaagcaattcttgtgcctcagcctcccaaatatctgggattacaggcgtgagccactacacacagcccattttggctatttttgaaactaaattgattttaaaaattaggggttcacataaatggcaaaaaaaaaaaatcattaagcagaggaacctgttgtattttgaaaaacaaataagagctttcttttttaaaaatgtgcaataatattttcacttgatttatgcttctttcaaattccacaaattaaaaatgacttgcaaattaaaacaaaaattagaaaaacattgtcatgtctaacagaattctctctcccttctctaaacactacttagccagaaacagagaaataaaaacttctataaaagagggtagagaagctgttgtttgttctttaaaagttaattcagtgtgcaaagctggtaaggaaagcccatcctcttagctggagttgcataatcttcaaagaagagtccctggagagtcataaccagaaatgttggttcaacacacacacttgctgtgcaagactcctggccttcatccagactccttgggacaaggtgtccacatgcacctgaatgccgccaaggagatgccaggtaagaagattttcacataggtatttcagtgtacaaacctgttgcaccacatgtgcccactcaggtattaaactgaatccctttccacactgcaatgtgactgaacctgaggaaaataatcttccacaccaggcacaaatgaatatttctgcttaggagcaaccagaagtccaggagtgagaacagagttctccaaggcaattgcctctggcagccacaggctgagatacctggggtctgtctttactgagagaccttgaaacccttaagcctcttttggcctctattttctcatcgcaaaaacacggaggctggatttatcaggtgggaactgctttaagattctatgatactttagtttgtttctatccaaacattctcatggtaatccaataaattaaggtgaaatttattgcagtgattgattattcagttaaagccaattcaaaaaaaaaaacaaaaacccgagtttatcactatgcaatatgtccatgtaacacatctgcacttgtactccctaaatctataaagataaaaaatatattaaaaaaacaaaaaccagccaggtgcggtggctcacacctgtaacctcaacactttgggaggtgaggcaggcagatcccttgaggagtttgagaccagcctaggcaacatggcaatacctcatctctacaaaaaatacaaaaatagaggctaaggtgggaggatcgctcactcgagcctaggaggttgaggctgctgtgagttgtgattgtgccattgccttccagcttgggcaacagagcaagaccctgtcttaaaacaaaaaaatgaaaaaacctgtaagctacacttgtgtgcaagcacatgcctacacacacacacacacacacacacacacacactctctctctctctctcttcactcttaaaatacggggcttgaaattatttcagttgtttgttcacacaggcccaaattgctcaacactgggtttcatgttgccgctattgacatgttaattgtactggattgttttctgtcctctcaactgtcctcatctctctttaagcagaatggatttctaaacatgggtcctcaaaacaggatggtggagccagccccacatgcttgggggcatgtaagagctaaacgtgctgatatgctgaatatgtgcctgaaagatggatgtgacacaaggacaataaacagtggttgattgaaggaaaaattcctgaaaaattgaaggcaaatacatctttcactaaacagaatcaaattttatgtgttgtaggacaagtatccaggactacattttaaaaatgtaaatgtaaaaagaacactggatttaggtccaaattcatttctgctacttactgtgcaactttgggcaagatccttaagcactgtctctgagctttggtttcttctctaaaagtgtagattagacacccacctcaaaggaaagggtggttgtgatggttaatactaagtgttaacttgattggattgaaagatacaaagtattgatcctgggtgtgtctgtgagagtgttgccaaaggagataaacatttgagtcagtgggctgggaaaggcagacccacccttaatctgggtggacacaatctaatcagctgccagcaccactagaacataaaaagagagactggcctaacctcccggactatatctttctcccatgctggatgcttcctgccctcgaacatcggactccaagttcttcagttttgggacttggactggctctccttgctcctcagcctgcagacggcttactgtgggaccttgtgatcatgtgagttaatacttaataaactttcctatatatatatatatatatatatatatatatatatatagttctgtcctctaaagaaccctaatacaatggttttgaagattgaataggaaactataaaagtgcctggtatagtacttaatatacacaaaagtttttatttggatattaaaataattattttatcatttgagaaatctttttgaaatgcaaataataattaatgctgattgattgatatgtgtgtgtgtgtgtttgtgtgtgcgtgtgatttttaaaatggagtcttataaaaattttctccagataagacgtgttcatcattctgtcacacagggcacccaccactcagagaaaatatccatcctccgcccctccacacacatcaagttcttatccaaaagaagtttctcccttcctttttatgccaacatggttagctcatatttcctttactagtgaccaatatcattttacctatctattttaggatagcttttccagaaactatgaaaggcagaagaaaattcctcctgtttcaaagacctacaaagcagtagcagattcaccaacttctgctgcagatgctacaagaagcctttattcactgtctcaaatgcatttttttttcctgctttggcataaccctgcaaaagctaaggagagcaagtgtcctcaaaagaaagggagtgttaaaaccccgtttaaaaaaatacgaaaactggcccgtcgtggtggctcacgcctgtaatcccagaaatttgggagaccgaggcgagtggatcacttgaggtcaggagttcgagaccagcctagccaacatggtgaaacccgtctctactaaaaatacaaaaattagctgggtgtggtggcaggcacctgtaatcccagctacttgggaggctgagacaggagaatagcttgaacccaggacgcggaggttgcagtgagctgagatcacgccactgcactctagcctgggtgacagagcaagacaccacctcaaaacaagcaagcaaacaaacaaacaaacaaaaaaccacttcagcttctagcgtagtgctggacatgcagtgaaggatgccaaaaagtttaagaaggaaaatggaacaagcactgtgtctacagtcttcacaactgagacttagtttctcttcctgcagtgtaaatataattgccctccctgtctccactggttattgagaggaccacatgaccatgagtagcagcaatacattacctaagttattattattattgttattcatcatgcattcaacaaatactgagatcactgttctaggctctggggatatagcattaaatcatcagactaagatgtctgcccctcgtgcagcttcctaagtaattgtaagatatttttagtttgggaatagttctaagtagaaaataaacagagcaaagtaattaaaaacaaaacaaaacaaaacaataaacagggtggagatgggagtggttctaggttagtcagtcctttttgatggggatttgggagctgagtcctgagcaatgggaaagagccaatcatgaacagatgtggaggaggagcatctgttctgggaagagcatctgcacttcttcatgcaggttctgagttgggcatgagattgacatgtcaatggactagaaagacagcccatgttcttggagcacaatgagcaagggagagggacagaggatgaagtcagaaaacagacggaaaccagtgcatctaggtcatggtaaggattattccagaaatctgctgaaatgcagatgttcctgtttaattgccttgacacacaataggcacttaacaaatatttatattcattgatttcctacagacataatgtcttagataaatatgtgatctaacagtcatctaattgaccagggctctgagcaaatggcagatgtaccagcatagcctttttaaagaggacagtaatgcaggctgcattccagggagcagaatccagaggtgggcttctcatctgtaatggattgaacgtttgtgacccccaaaaattcatatctttaaatcctaacccccaatttgatgatggtatttggaggttagccttggtcacgaggatggaccgcttaagaacgggattagtacacttttaaaagaaacctcagagagctcatttgcactatttgtcatttgaggacatgggaaggaccagaaagaggccctcatcagacaccggatctggcagctccttcatctcgaatagcccagcctctagaaccgtgagaaaataaatttctgttgttcataagctatccagtctatggtattctgttataacaacccaaacaagctaagacatcatccatcttggaagaaaccgctcctatttcactgtaaattgcagattccaccaacaccctgccaaacaccaagaactgagctcaaggttagtgtcatgtcttctgggtgccaagacttcgaagccatctctggggagtgtgggagggaaaaaaccaacagctcaagacccattctctactcctttctagcaatgcaactttgagcaagtgaattacctagtaacaataaaggtaagtgttcatgtagtgctttctatagggcagacattgttctaaagaccttgtatgtattatctcattcagtctttaagaagggataataatagtgcctacttcataggctgagatgtgaattgcaaatcaatcaatgtttgttccctccccctttttctgtgaagactaaaatgtctgccttcaaaagcactagaagagataacgtgtatgaattgcttgctcgatagtgggtgcccaacatattatagctataataataatgatgttatcaagtctccctctgtgaagccctagtttagctggggggtcaaagccctgctgaatgacttgcaaaagtcaggtatttggggtatatcttgctgctaacttatcctagagactgattaagagcctggagcataatcaatgcttaacaaatattctttcctctctgctgagatccagaactacctgaaaaggtagctcagagaatacaacttagtatttattaactgtagaaaagaagatcgggtgtggtggcttatccctgtaatcccagcactttgggaggcctaggcaggaggaccgcttgagcctagaagtttgagaccagcctgagcaacatagcaagaccccgactctacaaaaaataaaaaattagctgtggtggtggcatgaacctgtggtctcagctactcagaaggctgaggcaagaggatcgtttgagcctaggaggtcaaggctacagtgagtcattgattgcaccactacactctagcctgggtgacagagtgagaccctgtctcaaaaagacaaaaacaaaaacaaaactttaaaaaagaaaatctaaacctttgtttaaggtgttactctccaatgttcaaattcatgcctcagcagagaatttgacaatcagaacatgaagaggggtcctggcacctctgtcagccacatcaggaccggcctgagagtaagaggcaataacagtgtcatggccaagcagaagaaagggttaggggagctggctaagggagatgggctcaaaacagtgagaatgacaccttgtaataaggcaaagaagtagagagtgttcataagccaagatttcgcaagcaagatctgcctgtgtaacagtttatgaaccctatattctgccatacatactgtaccatatccaacaggccccaggggataagagttgagggacccctcatatgcctcccttaccacagcctgccacaagatctcatcttagaagagggacattttgaggctaatgtctctatctccaaagacctctgtgaaatgccaaggtctgacttgagagaggtaatacatctgtccattcacctacccacaaatcagtgtgttgtcttagtagataagccagctctcatgttaggaaactaagagtagagttcagagataggacacaaatcagaaaaaccgctgtcagttctaaaacaggccaaaaaataacaataaatctgaggtttaaaaaaaaatcagaacaatggttgcctaggggggattgactgagaaggtacaagaaggaatcaggggagggggaaattctatgttgtgatagggagtaagttacatgggtgatgtatccatttgtcaaacttggaccgctaagagcccaagaactgaatatttcaatgtacgtaaattttaccttaaacaactcttaagaaaaataataatgcaatggaagagtggaggaatagataatatagagatggcagaatgagatgggtacatgagtgttcattatactattggatttactttgtatatgtttagaattttccatgataaaaaagctaagaaaagtcttaggagcagcagcaggtaggactggggaccaggaaggggctctgtgggatgaggaccgacacagtcaaaggactgcatggggaatacacaaaaatgttggggggagggaggaaggagccttttgtcccctgcacatttcttgtcaaatttaatcccacgtgttatatatgcttttgccttatgaatccaatctttttccatttcattttctaactgcataaaagaaagctaatattttcatgtgtttgcacaggccactgtattaatagttacaagcttcctaagaggagggcaactagaaggttacaacgtggtttaaatgtgtcccaggccagccctgctcataccaagtgagagaacttcagaggagagggacccacaaacctaaactgaaattgcttaagaaacttccatatgtagattgttgtattcccagaaatgattctcatcacacaaaaaaattggaggttggggtaggttagtgaatagtcttcatgtgtagatagatttctccaccaggggatagagctgacagaacgaggcctgcaaactcatggaaattagcagtaatgagacataaacagtcaaacctcaaaataacatctctggcctttagaatcaacacagctctcctgtcagcctgcacctggcccgtccggctgggtctgggagccagtggggttttaggccccttttaacagctgccaaaagcacattactcatggccgggaagttggccttttatgttgccacaagtggtgcagccgttgtttggacctggcggagtccattgtaggtttttctcagggatggggctttgttctttgatttttccagaagctctagtttgttcaaatgttacccatgtgcagtttgcaagccccccatgctcctgtgctggcctacagccatgctcactgcctggcagcatcctccagcccctggagaagcagggcaagaggctgaggttagaacagcagaaggttacaacctcaccctaagaaactgtttgacctgccttgtcagggtccaggttcttaacacagtgcaaagagctgggaggaggcaaattaacacaaaaactgcctcttacaggcatacctgtgaaactacaaaaaagcctaattgtaatacctctgtttgaaatacacccttgaaataagttggttggttggttgagtggttgggtgggtgtatctagttaaaagaatccctatatctatttagttgataagatcttttctgggtttctaagctgcagatcagcctggtgcaaatggatttagggtgaaatcctggtggaggtcattagtatctggtgatgatatgctcacaatattttagtgtaattatttgtctactatctatttccccttttagactttcagttcttcaagggaaggagttgtgtctatcttattcactgctctatcttcagggtctggctcagacaaaaccttcaaaaaaaaaaaaaacataaaactctactgcatgaatgaatatgttgaatcttgagagcttgtctggaggttctagcaggggagctcagctactctgtacccttgaccgaaggccggtcctcctctgtcggagatggtcatccacttcaactgagcgcacagcttcaggagagaggcacatggagtgctgagggaggaaggggacacctgcctagccagccagatcagctgaattaatcctggtggtcaataagatgacagatgtcacagccagatcacccttgcatgcaaatatgttgaatctttaatgttcaagttgttacagcctatgatggcctggaggcatttcatactacactgggtcccttgtggcaaactttgttagctgggtatccacagccatttctttcttttctttttcctttctcttattttatttttttgttttttgagacagtctcactctatcacccaggttggagtgcagtggcatgatttcggctcactgcaacccccacctcccgggttcaagcgattctcctgcctcagcctcccaagcacctgggactacaggtgcgcaccaccaagcctggttaagtttttgtattttttagtaaagacagggttttgccatgttggccaggctggtcttgaactcctagcctcaagtgatccacccacctcggccttccaaaatgctgggattacaagcataagccaccacgcccggcctatcaacagtcatttctatctcctttctccttctcactacagaggttggaaagcacccttgcagctaggggtagccagttctggccaataaggcttaagagggaaactgctggcgtatttctgggagagatattttgttttctgattaaaaaaagaaaaaaactcaaataaaatcactttctggcattgccctttcttccttcttcttgctgtgaatgtggactgtaaagccagacactgtgacagtcatcttgcaaccagtagtgacaagcatgaagaggaaaatgcaacacctaactaaggattgtagaggagaaataaaaatattctgggttattgggcttcagagagtcactgaatcatctctggaaccacctacctccagccttcttattaagtgagataacaggaacatctgtaatgtttgagtcacaattagtctcattttattttctattacctgcatttgaatatttcataactgggacttttcttacttccacattagatacatggacagcgatggtgttttattcagcttgttattcctgcacacctagctcagaacctggtacatagtaagagctcaaatattattaaacgaatgaacaaacaaaacaggaaacaaataaaaagggattcagaagtttatttattgctcttctattatatacaaggcactgctgatcgctgagtgagggctgttcttagaatttattatttacttgcatatttaaactatagtatttataaggcattggttacaaactattgtaattcttggctcttgtcctttgatttatataaattatggtttatcaaagtacatgctgtttgcttattttcttaatgcacacatactcattcattcttgaagctttaagaaaagtaacttcctctatttcctctattatgtttattagcaaaccctttttatgaaatatggaaactattttttcttctttgaaattagttaaaattggttccgctgaggattgtcaaactctggctgtttgctgacctcatttcatgtagagcactagggtatacaccatccatggggtttcaaaatgtttgatgtttgaaacttttaaattaaaaagaaatgtggagccttgatcaaatggaaaggttttaaatatatctaaagcaaattgtaatgaagcaaaatgtatacttgcttacagtcaatgacccatgttagaagaaggtatgaaataaaaaaagaacagtaataatgcaaatattatgttaataagtctggggattgagtttgtgggagttataataaagtttcttttttcctttcacgctgttcttcatcagagctccagtgaaacaagagtaataaaatttccatcaacaggtggcaacacttgtattgtttgctttttagagtaggccttgattgcatttcagaacaaatgcattgatagttggcaaagatgaatatgatatttttttaaagcaaccaaatccagaaataacctcatgcaaacataaaatgaaaactgtgacagaagaaatcatgaaaacaaacaaacaaacctaaaccctagcactacttgtgaacatggcctgagaaaccccacgggcatgtccttaagcacagaacgacggagtctccctaggctagaacaacccagaagcccacagtacaagggtgaatggtcactcaaccagagatataaataagatggaataccctttagctattaaaagtgttgaagtctggggtaccctccaagtcatggaaatgtgtatatggaataaagtgaagtgaaaaaccagaacataaaactctgtgtatatgcaggttacagttttgcaaaaacgtgtgtgtgtgtgtgtgtgtgtgtgtgcgcgcgcgcgcgcgcgcgcgcgttgacaatgatgggagagaatttggaaccatatcaatagttttacgttgagccagccagttctttttatttttttccccctgtggaatttgtttagattcatgatattaaaaaggaaagaaaagaaaaaccatagcactaaaaccagtcattgtaccctgaaagagttgtcaggccttcttgagttcatggaggtttgcaggttcagagagtccatttgaagaaagcagagaagcatgaagacaaagattccgtttttgtccctgaaaattttgtggaggctgttccccgtccttggcaggcctctgccttcttgtttcttcacactgcagtttagatagcagggagaaccttgtctgtttaataagtttgtgaacaaagcctgattgcttcccttgtcaataaataaacattatctgcttctgtttctctgctaaattgagtttttgcttaccctaactggttatataaaggctttatgtacacaggaaaaagaaatgacaaggttgtgtaagcaggcagccctgggtagagttgtgaagtcagtacagtttatttctatgggctccttcttcttctttatgcatactttccctctttcaaaggcccagatggctcctgaaaccactatgctcatcttgcatcaacctcgtaaggaaccaatggatttcttcccaggattctttaaatcaaaacaaaagagggactagcccaaggaatgatcactacagactgaattttgggcatggaagtgggtttatatttgagaatgacaatcttaagtcataccacataggcaacagtccttgtaaaaagccagaactgaggaacaaacctgaggcacagtttaatttactggcttaccaccaaacaattaaaaggaggtaaactcagtattagaagctaggtctgcggaaagcagaaggtgcaatgagaggctgtgagagttcagaggaatgaggatgaacctctctttctcttcccataggatagtggagcctggacactgtgcccataaaatgcctcagaattgttgctggtgtaaggcacggtatggtaccaacaagaagggagaggacaaaatcctctgattttgaaataatgagggacaaaggagaaaactactcacaccaatgattcaaagctaggtttcctctgaaatgtcatcctgtaatgagaatgatgttaaagtccaaaactttctcaaaagtaaccacaagaaggtcagattgaccagacagagtgggtgctttggggcccatctgctcccaaagtcattcatcagactcaatgctacttctctctatgtgcagggctgccattggtctcctgaaaacccataagaaatttttgatctttctgttggctcaacaattctgatttttctgcctggcttattgatagtgattgctcacatttcaagtaaaaactgcaaaataaggcatccagacttgttgcatcacaaggcaggaaaagacaattactgaaaatctaaagagagatacgtgactattctgcaacaagttccttagctctcccaagatcatggagcagattggcagcagaattggagagaaactgttttctgtactgtatgcctcactcactcatttacctgagggactcaggttttgaggtaatagagatgccaaatccttagcactttactgtatagaaggcagctccatagccttcaatgtcaggaataaaaactcattcaaacccctctaattttaaagattttttcagcccccttttttcatctgaaagttgtattgttgttggcccaaacaccactttttgattgcccttgctgcttgctgtgaatgcaatctctaaagcactctgtttaatctttgaatcagctcaggaagatggaattaccatccctggaaaactgcagtttagtttcaaggaacccgctgcagctgcaacaataagatggaaatgtggtttggaggaggcaaggattaaaggtatgggattaggaaacccttgtttgccctagtgagttgaatgaccacataaatcacaggctaaacttggctctgctcagctcatattaaagtatgtagcatcagagcctcctcataatcaggatttgtcatcttgagtatcaggatggaagatgcagatgccaaagaggggccgggggagaagagaggatgagaaggaagtgaataattttggagacagtgactactattttgataggaaccagaatgtctgcactatttcaagaaccacatataaggacaaaagctgttggaaatgtgccttctaacttcaaattgcgcctgaccattagaacgctgataagggttggggggagagcagctggaactctgcaggctgcttgggtttcttttcgtgatatttattcctagatcacatttgcagctgcttttatctgctctttagaagttcttatatttggggaatcattcattgtgaaataaaaacctattcattgacctggaaatgtgatttattagtcagctacagaactagttgtctattaatgcaaacatatggaatacggaacttttcattctacccaagatgccacttatggaccctcaagtttatcataccccgtgatgcccccatattagtgccctgggctaagacattgaaaataatactctcttcaagagaaagtaaaacaatacacacacatgcacacacacacacacatctataatgcagtaatatggacagggaaatgggaagaggtttttgaataagaaccaaagccgtaaaagaataaccagcaaagaaaagacaacatacaaatgcagttgtaaaattaaggccgttaagaaataaggcatagccagatcttcttaaaatggggccaaagcacattgggatttgggacaacaaaagaggaagttagggcagggtagaggaaactgactccaggatagctatggcatggtatgttaggacacagcaagcttaggtgtgctatggtaccagctggcccaaaaccagtaggcaaggcaaggtactgagaagttccaggcagcagtggtgggtggttgtgtggtgacagtgagaactgcaggggcatggggcccgaatgcagactaggctgtgtaagggccacagccaggcaaaatgaagtttatagtgtgtcctagctctatgcagagccaggagttctaggcaggataaccaagcagatcaagctagaatcaagatatctagatgggcgcagttctgacagaatgagggtgatgagatgatacttccactttagggctacattaggcctgtggctcaatctctgaatgtgagatcatgctggcaatccaactttatttcaaatcatactggagggcagagctgaggctacctgtcttgttcagggttggaccatgtgttggccctatagtgttatttgtctgctcaacagtccttcctttgggaataacttttctgtgattcattgtggtttgggcattgccctcccagtgcaaaagggtgggactatgtctcagatctggccagtcagattcctttattccccaacctacagtgattaatccagagatacgcatatggcacaagctgagccaaatcttctatggaaggtcttctcctactactagtgtttattgagtgcttaccctgtgctgggaacagtttaaatgcttcagatgcattatctcatttaattatcatataatttgataaggtaatgctattattatcacccctttacagataaagaaactgaagcaaagatagagtaacttgtctaagatcatacacctaggtggtagagatagactgtgtaactaggcagtcttgtcccagagcttgtgctattaacatgaaaggaaagacacacttccctgctctaggattgtaaactataatgatcacataacataagctggaactataagtgtccacgttcctaggccacagagtgggagctgtctgcagtagaagagaatgaggccatatattatgaaaagaagggaaagagatcctcatgatatggtttgagtgcctggatctaggcatgcctgaagctattcaactcatggacttttcggttacatggaccactaaactccctttattgcttaaactagctagagttgggtttttgtcacttgcaaacaagagtcctgactaatacaggcttgtctgtagggtacttcagtatgcagtggggagcctagagaagatgagaacaggagaaatgagtcagaatgtgttcaaagcaggttggcatcctacaacacgcatgccattgttgtggcattccacggctccagttgtccttaccttattattgtgccctgcttcagttgacggtctataaaccaactgtctctgcacagacacagtccactggagagaaatctaaagctaaagcaatgcaaggctatcacctcaccaggagaaaatgtttactctgccttatcaatacctggatttatagcatactgcaaataacctgtagaatgctggttgatcacaaaaaggccacacccaagaaactgtgaaaaaacaagacaattgcaaagcttgtgctttaaaatatacctatgcatctcctttaaaaggttgggggatttggcaattggatggttagttagtccctcaggaatagctagacagattcaatagttattccacctttgactagtttgaagtatcctttctaggttcctgcactgcagagcagtgagcctttgtgtggcttggccttgaggttaatacaagcgaaactcttagagctatatctggcacatagtaagtgctcattaaccaagcaccattcttttcttctcttcttggctttccaaagattctacaatactggtattacctttccaattaaaaaaattataataagttgctgattctccccaaaggaagcacaaattcctcacttggaaataattccctgcaaaactggctttatggaccagaagcaatttctaaacctgataacaggtttagaatgaggggggctttaacaactgtatggactactgggagaagctccaatcaatattcccacacatggacaagagttgagctgaaaaagatttttaattcaaaggtcaaagcttgacaaacaggccgggcatggtggttcatgcctttaatcccagtactttgggaggccaaggcgggtggatcacctgaggtcaggagtttgagaccagtctggccaacatggtgaaaccccgtctctactaagaatacaaaaattagccaggcatggtggcagatgcctgtaatcccagctacttgggaagctgaggcaggagaattgcttgaacccgagaggcagaggttgcagtgaactgagcacagcattgcactccagcccaggcaacaagagcaaaactccatctcaaaaaatgaacaacaacaaaaaaaaactaactagagaaactaaggcaaatgaatgccaagagtcacacagctgatgagtaacagtgttgtgattcaaagatcaggttgggagaccagatgtgctggcccatgcctgtaatcccagcactttgggaggccaaggcagaggattgcttgagctcaggagtttgagactagcctagggaacgtggcgaaaccccatctctgcaaaaaaattagctgagtgtggtggtgcaccactgcagtcccagctacctgggaggctaaggtgggaggatcacttgagaccaggaggtggaggttgcagtgagccaagatcacactactgtactccatcttgggtgacagagccagaccctgtcataaataaataaataaataaaggaataaagatcaggttagtacaattaaattgtgccagcctcttggtctcccttgacaatgaaattaattatatccctattttttagtgtgttataatctgagttttaaaatctgaattaattatcatgattttctctgtcttcccataaactcacttgaaaagcagaaagtgcttggtcagcaagaaccttcagaactttgtagctgaaaggaagtttagaaatcaaataggggtgaggaagactggattaaacagatgtctttaccgtaggccttctcagagtctttgttgtgctagcatgcactttgattctccaatatataacctttctcaaacttatttgacaatggaatcttttttcctcaaaattattaagatcttgaggtgtcctgaacaacatgtaggaagtggtataataaatctctagtcccatcctgggctcacattttgttctgtaaatcctaattatgtccctgtaagctgaggcctagagtgacaaatccttcatctcaactccctcactaccctggggaggaggggaaggcggttgtggggggaatgggaggcctactgggaactccaggttcctgttctctcaggccctcagcatgtagggagggagaagccagaaactgcagctgccgccccaggcccccaaactccattcccttcactgtagctttgaattcctcccatgtgtaattataaagtatgtgttcagttatttactttccctgttccatgcagagtgtgttactgaataatacagttcacaagtaaatccaacttttctgctgcaaggtctgaattaaaaagattataaccttctatcattccagttttaaaagaaaccactacttatgtagcttaaaaaaaaatggaaacaatgattgtctgtcctctcagaaatgcaagcaaaattgtagaattaagatgtttacatggattttgttgtttctaacagccttaaattgcctcatttaggaagggtaaaaaataaaatgcccatgtttcttggatttccaggaactgagtctggcagccggttcactgttgtcttctagaatttgaagcaagaaaaattacaaccaaactggtgtcaatttgctctatttatcttgggaattaacttcaaagcttaattgtcagagacagtgacctctatactcatgaaaatccccagggaattacaaaagcagactacttgagtggaatgtgaatgtcattctgagaacaggcctgcacagcgcctgaaggaaaatgcttagcccaagaaggatggagctgaccctacaagcttctgtacttcatttctcaacactcagatcaagttcctaacccacagcttctgtctgacccatgtttctgccactgagctggttccagaattgcctgtggatgtgccctgccacagagagatgaggtatccttgaaatcggctgagctcaagtgcaaccactgaccccactccactcctgaagacttccaaggagatagtgcagtggccaagggatgagctgaagtagttctgcttgtataggaaggcccctgggcagtgttttgtctggaaacttccccttaatctggcagaatttggaacaaatgtttggctgaaaccatatactatcaaattaatagaacaattgtaggatagagaacaataagtcagaaaacaaaaatgcaagcacacagctcataaagtctactttatggaagtaagtagaatgctgaaaaagtacacattgtgctctgtggaataaccactcctaccccgacccggcctgcgccagcctgatccctcatgcacataattaaaacaaaaggaagaggagaagaaaatcatttgagcaaataatgtccaagcctctgctgtggtcagtggtaaacccagatacccagcagataacatcatggttgtaatgaggtaacagtgaacagccaggagaggcactggcttttgataacagccatttttgttaagtacaaaaaactttgctgactggccccgccctaaatcattgccttgtaagaaaggagccctgtcagaacaaaaacaatcatgctgtactagatgactctggaatacacaacaatctcctttcctggatatgtcagtgcaacttaagagccccaactgtggttaagtatactttcttttactctaaaagatagagctccttaattgatttcgccttcactaatgaatggtccctcttgctccaggaatgttgttccttttaaccaaagcacaattttgggtggtactttaatgaaatgatgaggtaagtggagacttgcagttagcaaaccagataatccaaataaattctggtagtcagataccgaagccagatcaacgaaatgcctggatccccaattgatctaaacaggcctccaggatagttcactcctgatggtaacaataattaacagtggaaaatggaagagataatttgggaatcatgcagagtttatcatctcagattgggagcaagtgagaagccaatgaaaggggaaaaaaaaataagagaaaatactatgagtaggaaaacagtttttatgatttggcatctaagaaaaacaaggtagttgggagtaatgcttactgttttctaagatttatctattcttagttattcctaagcaacattttggatcaatagttctcaaacagccaatttaaggacccatgaaggctagtcattggaggaggtctttaaatatcaatagctggattcccaggtctagctctagagcaagtcaagtatataaccagggaaacagtactccccaggtttagtagataaacactcgactttcaaaaacatttggataggaagagataagcaataggaagccattgtaggtgtttaatgaatcagaggaaagtgatttaaaagggctttaaggaaattatctggcaatagaggcacagtggcctggagtagttgtttccaaatttagtctataggcatatcaccaagggaactatcttgttaaaattcagattctcattcaggaggtctgctgcattactaaacagcccccaggtgaggccaatgctcctggtcctccagccatacttcgaaaagttaggccctgggaggacagctggggttgaatggaattctgatactcagaggctattgatacagccaattactctgctggaatcaagtcaccactttttcccagagccaaattccagcttcaatctagactgttacctggtcataagagaaagagccttttgcctgaaatcagtagccccaggtctgtgctgtggaaaagtcagctagtttgaggaaattactttcctcctgagcctctgtggccacataggtaaaatgagagacctgggttatatcgtctctaaactacattccatgatcctaaatcctctaactccaacacatagaatggggtcagaccaagttacatggccttttctaactctgcaggttattaggtattgtattctaaagagtcagcatgagtattttacatcctttggtatgtttgttgtaaaacatatgtgtccttcctatgtatcagttgtgtacattactatttagacatgtaataacaccctaaaaaagcgaaatacatttgtatgtggggagttgataaaagaaaatactattgtatacagaccgaaaaacattatcctttatttttaaaatattgtaagcactggcataaacaaggcatagcttacagatgtgtgtaaatctgcacaaattgtgcacatttactatttggagggggaaatgtattttaaaaattgtttggactatatgtcctttttctttttagcagagtggggagtcaaaagaattgaattacagggtagaatataaaatatctcctttaaggaaataaatgtgtaataggaactatctatccaattctctcaggcatgggaagcccttggggctcatgtaaattgtatataagtatgtcttcagtgtcactccagatgtttttgcagggaaataatccctctccccatatattggcatcaacaccctgcatgtaacctccatactcaaacttgccccaagccaagcagcatcctgaagagtgattccaggtgagattggggagctctaggcccttcctgccaccctccttccatacctatgttactaaatatacttctagacttggaagagagaatagagcctgtaagtattaacacaggacaaggctcagaagcaaagttaacccaccaggcagagaggtcaggccaggacaattttaaatggtaattaagtctctccacacttatctttagagattgtccttgggctctggctgagcagggccttccctgctgtgtgtggggtctgcttgcagttttgactctgcccctctggggaacccaagctgcacatttttttctgcagcctctgactatgaggttatattaataaaaaggccattcctgcctttagcagttgccgaccaagtctgctttatatggcaacagagccaggaagaatccagggcttcagtacagggacttttccactagtatgtactgttttgtttcatttcctattccatcttccaaggaaaaaatgaagtcctgctgcagaagacccagtcactaggcccacctgacacctagtacatatctgacaaaaggaatgctgccatgtggtacaagtggccttccccaacaatccccagccaggttcctgaaacctctcttttccaagtccgacccaccttctttgttcacacctccccactctaagaagaaagctgcatatcggaagccacaactaagagtgaacaaaaaggggcaagtagtggcaatatgctcaggggttccaaagtagaatcctgccaatgcatatagtgcttaaaaccataaaagcagcaaaggtgtcagtgaaaacgatgtagaaccaatgacagtgattatggtgccaacacatataagatgacatatgtaggccgggcacggtgactcatacctgtaatcccagcactttgggaagccaaggtggatggaccacctgaggtcaggagttcgagaccagcctggccaacatggtgaaaccccgtctctactaaaaatacaaaaatcagccaggtgtggtggcatgctcctgtaatcccagctactcgggaggctgaggcaggagaataagcttgaacccaggaggtggaagttgcaatgagctgagattgtgccactgcactccagcctgggcaacagagcgagacgccgtctcaaaaataaaataaaataaaataaaataaaataacatgacatatataaagagcaaagcacaagcctagacatcctatggctaaaactgttggttgtctccctatatccattctccttttctttagtaatagaagtctgaatttaaactgggcacatggctacccagagtaaagactacatttcctagcctccgttgcagctagatatgcctggtgactaggttctgctttctgtggagtctccttagaggtgggggtggggggcttgccctccttcatgccttccttcttgctgtgggtcagaatgcagctatcttggaccataaagtaagagtcatggcttgaagttggtgaaaacacatgatagaatgagcccaagtacctgataatgaagaagctatccaccatattgatgctggcttgtctatatttatgtgggagaagtcaacttctctgttgtttaaacccatgttaatttggattttctgatacacacagctcaattgtattttaatacaatctccttcctcaaggcctcatacatcaatagtatccccaaattaattgcatcattatttcattagagaatagcatccaaaataataacttagaagcttaaaacaacctattcattatagattcactccatgtattctctaattgcaattaaaacaagattataatataatgcatggtactgtattcctacttttcagtaaaaaatgaaaatgtagacattttctcttggtaaaagtcttactgtcaaagcagatgagtaactttttctctaacatttgttccaacagcttaaattgtatactcttgataaccagataataggtattgagtcaaatttcttccccttggttttctctccaacttcttacatggataggaggaataattttgtaaggtcagttcatgttaatgggtaagaaaaagtcataactactaagagcattaatatggatccatgttatttatttatttatttttgtttttatttatttatttttttttgaggtggagtctcactctgtcgcccaggctggagtgcagtggcccaatattggctcactgcaagctccacctcccgggttcatgccattctcccacttcagcctcccaagtagtgggactacaggtgcccgccaccacaccagctaattttgtttttgcattttcagtagagacagggtttcactgtgttagccaggatggtctcgatctcctaagcttgtgatccacctacctcagcctcccaaagtgctgggattacaggcgtgagccaccatgcctggcctgcatccatgttatttaaccctcagaatatccttaatttgcagattcagacacagagggttcaacaagcaacatgacttgcccaacataatagagctattaactagggatcttggatccagggtttctgatgcatacgatatcataattgcctatttacttgtacatcttcccagtagaccatagctccaaattcattattgcgttcccagtacctaccacaaggcctaccataccaaacatcctcaataaatgtacattaaatgaattaccaactctaaaataccactctgctattgctcccttgctctgcaagtgttctacaaaccaatgcccttaatatattccaggtcactcccaggccatatggcttgtcaagagaatgtggtcaatgatgagacagagggggagcaggactagtgaacacacccatatgacacacttgttctccacactctcctgggcctgggcgggcccaccacgtagggcatttggatgtgtgcctcatggcctgggagacaacttgcacttagtgtacttttccaggaaaagaaaaagacaaccatggtctaacacgttagaaacactgctgcctggtgttctgacatcatagcatccacccagtttgattcctggaggcaagcccacttgcaaagcatgggccagggatggtatgggggaaaggacaagggaagaggggtttggtgactgaaaagtgaagtatgtggctaagacaagcagtatgagcagacactgtaaagagtggaggggggcttctcatactggtatgtctccagatccattgaagttttctgtgttttgggctcagaggcaaagataacagagctcatcacttcttataagaccagtattctttgaaactttgatctgagctggtcctgctccaaattctcccaaaaaactatgaggatggggccaatctagccgtctgcctcttcccttactcctcctccagcaagggtgccagaagaagaatgatttgttttttctctgtggctccttacagtcaggaagtgagaatcagcttgagtgagctatggtcaccaatcacaatgaagctacagtggaattatcacctggcatgaagtgaaataacatcattataaaatgttgtcttccagttggaaagccagaagttaagcctgtgctggcattcactttctaataaatgggctggcttaaacattgattttctctccttgacttataaaaatgactaaaaatgtaagacagaattcaataaatgttttaaagattgccattaaatacaaatactttaacaatttaacaaaaccaaggggatccaaccttaaaattccaccttccttgtcctcacttctacccccaagtcaggatgaaagttcaaggtttcaaacaatagcacaattgcctcttacctggtacatagtagacactcaagaaaactgttgaaaaggaattgtatgtgccttattagtcggtacttcacaggatttttagagttggcttgacttggattagattcaagaatagtgtattagccctccaggggaatattcacaggcaaacagctacaaggatatactacattttcctttgttaaaacttgtatctgcattcaaatattggccttggcatttcctaagggctggctgctttgaatgttactatatcaaaccatctgcactgggaagcaaaattctgttaagaaatagaatcactggtagtaaagagattaccacattcctgaccactgtaacatcttatattttgagaatccccataagaaaaggtcatttgaaaatagcaaccctttgtcaaagtggagatgatgaatacttttgtacaatttatgactatggtcagtatgaaaattcatttttgtttatatgcgttttcagtggcttccctgcactgactcactaaaattaaagcttaaaaaaaaaaactaaaaaaacttgaaaatagatgatgacaagaggcttccagttagacgggattttggggaggcaaagtgccttctattgttcactgcccaaaactagaaaatcctggagggaagcaaatggtccagtggaggcagctctttggccgaggagagaagttcaagtgaaggtcctagagagaaagtgcaaagtgaacaatcataagggaagttgacttggcataagaagactagaaagtgccagtgtcattcagatttttagttgggggagaagggagactattttatactccctcaagaaaagcaaagggacttgattccatcttaaggtgacaaatcaggacgccaatgctggatgcacttgaaggtggagagctaggcagattgaggcagcaggaagcagggtgggagccagtgtgcaccaagtgggtgaggggaacatgtgagtcagttccagctgtcctcagaccctcctgcccagcctcagggtaatccaggggcacagagactctgagccctggcccacccgtggtccctcggattttgacactccctcacccccagtgtcatgcactctgacctactgcagggagggttggcaaggtgtgggcaatgtgtgtcaagatgtgtgtggaaggtgtgcagtagacacacagaatccctaaaatgtgatgaaaataaaagaatgacatcggcacggacaaggaaggcaggcaagtgttacaaatagttagaaactgtaaaatgaggtgcgacatttccggaaatcagtcagatctagtattagataatactaattaacaacaactggccgtgaaagaaggcacccgcactttttctccattgctctccccaccatcttatgccgactccttgcggggaggggtacagccttgttcccctaggtatcctaagctcgtttccaagtacttgaaggtgcctttggaaagtctgatgaatgagaaataagtgagcgagtgaatgaatgaataagctgcctaaagcagatgcgtttatgcgtgcattctctcgagtgaaggaagaaggaagaggtagggacggaggaggagagagagcacgcgcgggaaagataaatcgcgcccgcccgcgatggaccccaatgtcaatctgatctaggttagtggttctcaaactttaccatgcatcagaatcacctggagggcttgctcaaacacagattgccaggccccactcccagtttctgacttagtaggtgaggccagagagtttgcatttctaacaagttccagatgatgcgaatgctgttggaccacactttaagaaccgctgctctagagggtaactcggacctatcccagcgtcccagggaaacgaaatctgcagtgagaaatggaacgtccaaggcaatcttcagccggccttttaaaaacaagtctggagacgggagggtagcgctgctcagctccagccaactcactgccgcgtaggaacggaggtcatcggaaatcaagatttccgtttgaattttcccaaagtttaagcgttggcaagtgcgttgaaaaacacacacaatatgaaagcctaataaaaatataggtttgcagaccgtgccctagtcttttccgaggatgttcttttctgtcatccatcgtctacccacgttgagcacgacagccgggccagtcccgccctgggcggttggggccttcccagaggggcccggtgcggagagcccccctctccccggatgtgtctggggcctgtccttcactgcgatgtcatcggtaaacctggtcttccttgtcacggacactgaagcgcttggttcgaaaagcaccatgaattcgaagcagccttggacgcgggatcatgggcgttagcctggctctctccgacgaggcaaactgcaggagatccccttccctggagtcaccggaaggcgaaagcacgctctgtgcccgcgcgccgccccgggagcccgctcctaccccctcggcgtgcggcgcgggcctggagaccgcggagcccgagccgtatccagcttgtgcaggagccggtgcgcccttccgcccgctcctcccccgggaccatcctcacgctccagggtcgcggaggcatcttgcgactagcgaggggctgacggtggcctgggtggccttgcgccggctctgggctccgccgctgcggcagccgagggcctcagctgggaaatccaaacccgggctggacctgggctcaaggaggtttctgtccccaggctagaccaccacggccacggccacgcaacttgccctgagaccccgtgctcggccttcccactgagctccccttccctgtgactcagtgcctcgcaggctggtggccggaagggtgcctgcggctggctggcccggcccgattccgggtggcggggttcctgcagtgaggaacgaccctcagctcccgcagacgcgggaaggcccccgcgccatccgtgggagtggggcagcctgtctgcacgcggtcccctgggaaacccctctgcatctcccgcccggacaaggtccccggccttggaatctgcgccgccccgcacgcgaccgcctgcgaactccctgcgctggggtcagaactggtatctttctcctcctctggggaagtcagggcagcccggagtggcgtcgtgggtccgaaaaatccgtctcagaaacccaccaggagaaaaggctctggggtgggggacaccatgtggggctcccacaaaggacccgacggtgggtgtggagaagcttattggccctgagaataggcccaggccctctccacaggacccctaccgcacacgcgactctttctctgcagcaaaggggctcgggcccaggtacagggagccgctgggccggcggggcagctgttggccaagccctcacgcagcggagcccaccaccggtgtggccgccccctcagcccgcgccacgcagagctcggccggtgcctccagggggcgctgcggcccttcccgccggctgcggactgcagcccgcggctgcgctttcccacctcagccctgctgagagcacgggcgctgacgcgctgttttaaaagataaaattcttagccttttgcccttgtctccgcaccctcgactcggcctagtacacgcaatcctcctctgggttccccaggcgtccttgctactccagggccagggtgcacgcaccctgagcagagccaagctccctactcctccaggctctggcgaaaaacggccaacagtgcgggaagttcaaatgcaaaaggtccccgccccgcagaggcagtggaaggctgaggagaagggaggcgagtccccggaggtagtggctgggatccctggaaaaagataaggttttcacattgtattctttaaagattaaaagtttcgaggatccgagtccgagtgggagaggcgcgcggtccgagtgggagaggctgagagtcaactccagggaagtctgtgtctgacacctgctcgctgcttagctggcagagcctcctgggtgggccggggggcaggggcctgcgctgcgcgccccctcctcctccacctcctcctccgcgtttcctgtccctggccttcatcccggcctcccggggcgtaaacttgcagcggttggggttcaggcagccgctgctcgcgcgcccctcgtcagttagccatttccctgagagcgtccttggtgtcgcaagtccagagccgcgaggacagcagatgaccgggtcagcggaaatttcagagccagccagcagctcaggtccccggggccgcggcaggaatggaacggctccgcggagacagcctcgggggcacagccgggccactgcagactccgggacttccctctccgcacacccgaaacccacaactcgcccgtgggccgcgtggcctttctgcgccgagggctgctgggggcgggcggcgagcctggcgggtgacctgctcttgggtgggccccgcaatgcctgcgccctagacgccggccgggacgaggggctggctgggtctgagcctggagaaacacaagggtcagcccccagtgggcgcagaggtggcccaggagggcccgcggacggtgctgcgctgcgctcagcctccgggccgctccccgcgttcggcgcgcacctgcccatcgaggcggcagggccagcaggcggcctaggcgcggccgggccacgcggcatcccccaaagctggagctcgccgactcttccctaccttttcaagagaccgtagtcgtgcccagaacgccggcgtggcccagactccattttggaacttcgcaggctggcgtggacgaagtaaacacatttatggaaaaaccccggggttaggaggtttgcggaaagagggagcagctcgtggggttggaaattctgcctacccctcgggaaaaccaaacggttctgcac

SEQ ID NO: 254 - DNA, 275813 bp, Homo sapiens
  source 1..275813: mol_type = genomic DNA
cgagggtgtttcggggcgtccgaagcgggcgtgctccagcctgctcagcagcgagtggttggaaattagcaaagtgagagggtgcgtggcctgagggactcggggaggctgagggctttttttctcaacactgtgaagctcagggaaaggagtagaactgggaaccaagtaaagtaaaatcgtggcaagtgggcatagacctgaaatctccttcgtgagggaacccagaacgtgcagctcaatgtatgtttggaacgaacaggtgaaaggaagcaggaggaggagggagttctagcgaagacttcggagggaagcaacccatcccctgccacaagaaagcaccgccactccagtgggaacggacacgcgtgcacacagccacgagtgaggtttgaaagaggccccaccctccattacacctgtgctccaccgtggcccccagccaagtttaatctcccattcagcacttacttctggaagcttctttccctttccttcccaccactcattggcctttcaccccctagttttttgtctgtgtgtgggactgtcttcccccactccccttgactgaagttccttgagagcagcagccctctttttatcagggaagagatttgaagctcaggacattcttatccaagtaggtgctagccacctgggtagtcaagacagggccctgcacagttaatgtgaatcttgtcataatgccagggttattgttttgcaaggagccggtcatagaacactagattgcattgtcactgggaaataagctcattctattagcttgtttctcagctagcttatgtagaaatttgccacagttgttactgctgggcacctgccctggatctgatcatcaattatatcatctcttccatctgatggactgcacctcaccccttgctttttcagagctggcgaagctgggccaaggaaagcgatagtgccagctgagtggaatgtgcaggaagggaccgaggaggggcactatgtactggagaaaagagatggggtctccaggacaggggtaaggacactagactgagggcacaaaggaaggaaaccacaaggaagtagagtagggaagtggggagcatgctgaggagagaggtcaagagatggtgaccgctctctgcatgccccaaggagatggtgatgacactcccaagtccatgtgggactccctccttatgcgggcctcagtctgtcatcttccttggagcaggaccaaagtaaataagataaagtcacaatttctcatccttcttcactcaacttttctttgaggtgagttggcatttttgtaaaagaatgcattctctgccagatgcggtggctcacccctgcaatcccagggttctgggaggccaaagtgggaggcttgattgaggccaggggttcgaaacctaggcaacatagcaagacctccatctctgtaaaagaaattagccaggcatggtggtgcatacttgtagtcctagctacttcggaggctgaggcgagagaatcgtttgcacttaggcattggagattacagtgagttaagcgttctcctgtactgccatggtaggtgggtgttgctagccacatgaggatatgtgagccggtcaccagggactgcggctgactccccgagcacaaggacagtaagaataaacctccgattattcccctgcccccaaccccaacttcaattaaagagatatacccttatgtgactgacaaaaaagagccctgctctcccagagtcacatccccatacgccaaaacactcttacatataattattggtgcttcataaatggctgataaaaaaacttttctatcagggaatacaccctaccttattcacagcctcttatagagagctggcctgcccacagtctctgtaaggggcagttgtctcttctgagtgaccagtttccctgacctcccctcaagccatgactgaccaaggaagtcaatgtcaccactgagaagcaaggcgtagcctcagactctgagtttctaactctttccactttcctaagatggggttatgcctcatttctgagagatttccaaccctctgccatatattcctctttttgtgaggtcacttggggaggtgtctgcttcttagcaccagaagagctctctcaggacccagttgctgacccagttgctgcaaatgctgaaagtaggaaatggaggtcaagtgtaggccataaagattttcccactcctcctcttgaatcaggcatggccttgtgaattactttggcccatagaatgcggcaaagtgatactgtacaagttctagccttggtcttaagcctgccagcttttgctttcactcccttggagccctgagctagtatagaaagagatccagctgcaaggactggttacacaatttgcagggattagtgtaaaaggaaatgcaggtttccttgttttaaaattattccgaattttaaggcggtgacaacagagccctataccaagcagaggcttgatccgagctggtgcaggcatgacagccaggcttcctgatacatgagtgatgctatcttggatttctggccccaattcagcctcctaatggtcagcatgagagcatgaactaccctaggtgagaccagtagaagaacccagctcagattacaaaactatgagcaaacaaacggttgttattcaagtaaagctcactaaagctcttcatgacaaacgggtatagtcatgggggccgctaaggcctgggttgagattttatatagcaataggtaactgaagcatgaagaataagagtttgcagtgagtggtcacccaccatattccaggccctgtgttggtgcattgcatgtgccagctcacctgatcctcacaacacctttcataattcctttctacaggagagaatacagcagttccaaggacaagggattcgtaccactgctcctcactcagtaaatagcagagacagaatttgaacgtgagtctgactgattccaaaacccatgtaatatccctgcattgaaacagaggaaaatccaaggaaagtgcacacagcttggagactattggataggggtctgattcagtctttcctaaatttcctcataaatttgcagttgaagtatcaggcagagaaatgataaccaggtgaaagacccctaatgggacatcatgacatcacagctctgtgatcatcaaccataatccctagagggtcacctagagttatcctacaatgaggcttacttgggttttctgataggtataatactgagaaaatttgctatggttagctatgggtattcaccacttattttagtgtatatcatcccccaacaaaccacaggcacctgtgatcatctgggtatgtgttcaggaactatcttgcacccagaaagaacaagaattttttttttttttttgagacagagtctctctctgtcaccagggtggaatgcagtggcacaatctcagctcactgcaacctctgcctccatggttcaagtgattctcctgcctcagcctcctgagtagctgggactgcaggcatgtgccaccacacctagctaatttttgtatttttagtagagacagggtttcaccatgttggccaggatggtctcgatctcttgaccttgtgatctgcccacctcggcctcccaaagttctgggattataggtgtgagccagtgtgccagccaagaattaatttcaacattagactcagccagagttaatgaagaagctttccccacatgatggctcctcacaagaaatactatctatttataatattcattggctttacttgtctttaccaagccttcctgagtgtcatcagtgggtgagtgagtgtatggataggtacctgcctatctgtctgcccatggtgatgaacacatcactgtaggtcagcaatgacattgagtctaaatgctgttggccataaggaaaatagtgacattccctggctcagaggaaatgctggtaggaaagccatatggactagtatttataagtacaagctcaggggtcaaagatgctgaagttcaatgccttgtcctgtctcttactaattagtgatattggacatattgattaattgcataagtatgtttctcacttatctataaaatgagatgtatgagggctaaatgaaatgatgcatgtgaaaaactgaacaaggtgccaggcctaggacaagggctcaataaatgtcagcgattattttatttgatgaacaaaagaaggcaaatgttctttctttgatgccccctatcttttccctgtgtcgtttctctaaaaaagtatatgtgtgtaatttctatgccttccctccactctcccattatctaccacttcatcatcctctcactacccatggccactttccctcattatcttttctatatttcttccctcctcccctgaaatggggttgagcagggggagatcagaggatgagaaaaggcagggagacattggtggcagggtgacaatggagcaccacaagctgtctaggccatctagactttccctgaggacacttcagtatctctgagaataccattttctcaggactcctcacactgggagaaaccttagcaatcatctgatggtgtacttgttacagtagataggcagacatgtgcagtgcaggagagggccccccaccctgaccaggaatgtcaggtgaccatcaggtgatggtcacatggttgttacaccgtctctctcaaataataactggttgcagccagcaccagggaaaggcagtctccaaatagataggaaaaacctgaaagtgacaatcagcagcttcacaataagatctcaggaattgggcaggtgggctcaagcatgtgcactaagaggcaaagtggcggagtttaattggtaaatgaccttcctgtaggaatgctacgctggtaagggaagaaagcctcaagaaagcatctgtaccattccagcaaatacactgtgcatgctcccctcccaaatgctagcaggccactgcacatatggacagcccaccccaagggaagaattgggagaagtaacccaagaccccgaaagtatgccaacctgtaagaccgcaagtcaaaggtcaaactgtgcacttgatctcacaaggtgcccactcggccctcttccaaatatactctacttcctttcattcctgctctgaagctttttaataaattttcactcctgcttgaggactaagctctgatcttttcttatcttccaaattcctatctagggggtctggggagttatgccctacaaaccaaaaattctcatcagatgggttttatttaaccctatatattgtgactttttagtctgactctggcataatattacatgacaaaatcaaaatattttatcccataacatgtctctttggcatattttgaaatggccctgcaaagccatcctttgtaggggaaaatttgcatctgtaaagaatctctgttaacatagctagatatttttcttccaggcgctcccatctgaagagattaagagtctagcacctttttaaaattatttatttatttatttatttttgaaacagagtctcactctgttgcccaggctggagtgtagcgtcgccatctcagctcactgcaacctctgcctcctgggttcaagccattctcctacctcagcctcccgagtagctgggattacaggtgcctgccaccacacccggctaatttttgtatttttaacagagacaagttttcgccacattgaccaagctagtcttgaactcctggcctcactgtgatccacctgcttcagcactccagcctgggcaacaagagcaaaactccatctcaaaaaaaaaaaaaaaagttagaaaactaaactacaaggtccttaaatgcctgctccacagtattagccaaacatgaacaagatcccaggtgttaggccgggcgtggtggctcacgcctgtaatcccagcactttgggaggccgaggcgggtggatcacctgaggtcagcagttcaagaccagcctggtcaacatagtgaaaccctgtctctactaaaaatacaaacattagccgagcatggtggggtatgcctgtaatcccagctactcgcgaggctgaggcaagagaatcgcttgaacccgggaggcagaggttgcagtgggctgagatcacgccactgcactccagcctgggcaatggaacaaaagactccatctcaaaaacaaaaaaaaaatcccaggtgttctggattcccatccaaaagaaaaggggaaaccaaaccccctgcttccatctcacccaggatctcctgtcttcccaaagcactttaccgtctttcctgcccagctgttgaaatatcaaactgtaccaagattttggccatgatggactctgttctctgcacactaagagatttatcttcctgatcatcagtagaaatattaataaataatattggttgccatttattgagcagtgtgttaaacatccatattatttaatggatgtttttctagctgtgttttaaagttttaaagttgcagcatttgaatgaatgaatgacttctgagccaaagtgagaaaaagcaaacaagacacaaatgagttttctaaactatgtgtctccccgaaattagctctgctactttgcacaagtctcctttcctaagatcccgcttctcatctgttcaatggggatatgaacatctacaagtttatggtaaagtttaaaagcacatttgtctgatactaagagccaataaacaatcgttactttcattaccccagttggcaatttgagcagggcatgacagggagtttgggtgacaggcgataaagtaacggacattatggaaagtctgaaagaatgtaataaggataatatattttagatgtatttttctcttttatattttgtgaatgacttttcccctggttagcctaaggtaattcttatgactcagggaggtttgagattgttacagcaggaatgcaaacagaaaaaaaaaaaaaaaagatctagcttttgatttccaaatttgagttcctagaataactgtctttaaaattcagaggttggagataaagaaaaggattttctagattcctatcacttccattaaaataccaagggtcagaacaatgaacctgaattctaaagctattggtagagagaaatgacctttgatgtaagaggtgtccctactgcacagaaaagatggggtgtttttcctttccaaaccaagggaatgtcaggggaagaaaagatagagattaaaggggaaaagtgagttttatgtatcttggcttctccattcagggctgatatcacaagtagtagataaattgaaagaaaggaatcccaaaagaagaaaaagactgtgttctgctcctcacttaaaactcagcaaaagggacccccaccaagtggcccatgccaatatgtaacacagaaaggaaaaccaacagcatgggcctcttggcttggaggaagccaaagtgcacatttcttcagtcatactacatctgggttcatctagccacctctgccatgctgcccaagttcaaccccaatgagatcagtcatatacctgccaggtgccctggtggaaaactgggtaccatgtctgccctagcccttaagatcaaccctctggacctgtctccaaaataagttggtgatgacattcccaaggccacaggtcaccagaagagtcaaaggattacaatgaaactgaccattcagaacagacaggctcagactgaggtggtactttctgcctctgccgtgagcatcaaagccctcaaggaaccagagacagaaagaagcaaaacaatcaagcacagtggaaatgccatttttcatgacactgtcaagattgcatgacagatgcagcaccaatccttagtcacagaactctctgggacccgtaaagagatcttggagactgcccagtctgtgagctccaatgttgatgggcgccagcctcctgacatcatagatgacatcaaatcaacagtggtgcaagtaaatatccagctagctatgaactacgaaggaaaaaatttcaataaaggatcatttgacaactaaaaataaaaacacagcatggttatgacatagggtctgcatgagtgcctttgtgcctccttgaaaaagccagtttccccatgcacagatgtcagtagtacaagtcaaccaggtatccagagacattgctaaaagatgtcaataccaaatctaatcacagcataaggaccagtgtatacaaatctaaagcccactttctcctgctcactcctaaagctcactttctcacaacactgccaccccaatataccaagaaaccatctagaaaggagggcagacaatagccacttacctttaaaaacaaaaccaaactctttacaccaaaacttcttccatatccaaagagtctaaaatacagttagtgatgaatgtggatgtggagccaatgagtaagatttgatcagttacagaaaacaagtgaagccacatttactttgcacaaccaaatgtagtttgctaagtttttgaccccattatatgaagaagacaaatcatccataactctaccacgctaaacatccattacttttttttttttttttttgagagtttcgctttgtggtccagcctggggcgcagtggtgcaatcttggctcactgcaaccttcgcctcctgggtttcagcaattctcatgttcagcctcctgagtagctgggattacagccacccatagatttttaaaatacttctctttcacttgtcttgcataggcatgattattgcaaataactgcaatgcatatcagtcacaattttatatcgtgctctttgtaaaattcatcaaaattccttttccatgctgctgtgtgttcttcctggttaccaatgttaacagacgcataagctattagtcaaaactcttgtcattgcaagtatcataaagccaattccaactcaactgaagaaaatgggtatttaatggaagaacactggagttgctcattgacctacaagaaccacgcagccctgagggcctaaatgcaggggacgggggcttgaagtcaccagagttcttcactgctcattcttcctacagacatctccacataaatgtattaggcatttggccatgttaggtcattttcattagccacattttccaaatggggacggagggactaagggagttagatgtgactcactgcaggtgattcagctgctaaatggcattgatttgaaaaccagcatcttgattcagattggtggatccatacaaattgcaagggacaaaacttttcaaaaatatgtaagaatagtcacataggataagaatatatttgatttttgtgaggactacagctgaaggagaagagaaacatgcaaatggggttccatttcccacaccagggcagcttctgtcatctcagaatgcccacctggcatcttcctgacccttggctcacccacaaggaagttcatggcaatattgttttcagaagccaatattctcctgtctctacttgcaagaaaataactgagcccccccagtaagtataattggtgcgaacagtgatttattatatgcccagttctccagatggcctttcatatggaaatgatttttcctgaaaacagaaaaatatgggttttttcccttctcagcaggttataacaggtttacaatccactgcatcaaaactagaatcaaaaactttaacggagttcccttaaaacagaaacacaaaaaacacgttccatctggtaaataattgccggagttgcattcctgtgcattcaggcacaagctaactgctgtacagcataaagctgtgaaaatgtctaggcttaatggggaaacatgagataagatctacttaggtctatcatatactcaaattgcaaccttctgggatgctggttcatgccagactcaaatcacccataatctgatgggctagacagatgtgtaagattattccaggatatctgaaaatctcacatgtgagtacaaaaggctaggtggacacgtgcagcccttattctatgtgaatgaaggggaatgtttaccaagaaggtcattttcagatgaccatagttgaagagcaaagtcaaatgtggttctaagtgacatgtcctctgcctaaataacagatgagaaagtatatctaaaaaggcttatatcatcctgtgatggaatacttaagaatggggaaagcatttagcagtaaaaagtaagttaccaaaaggatttaatgcagttagtatgtagcaggttaatttcagtagatgactctaagttatgattttcatccagaaagaattattttcgtcagctttccaccagtggaacatacttcctcctaagctccctgcctctgaaagcataggcaggggagccgtgtattagagacgttgtggggaagatctccacatttggaaagctgaagatctgcagattaggggtgacactcaaattccttaaggggttgggcagataaattgtgtaaaatggtaaggcattagaaagtggaccagactgcagaggactggagaggcacagcccacctaaagacattcaaatttggtacagatgcttcttggcttaccatggggctactgtgtcccaataaacccacctaagtgaaaaaatgcatttagtacacctaacctaccaaacatcacagcctagcctagcctaccttacacatgctcagaacacttacatgagcctacaattgggctacatcatctgacacaatgcctgttttataataaagtgtagaatatctcatgtaatttattgaatactggactggaagtgaaaaacagaatgattacacggtacttgaagtatagtttctgctgaatgtgtatggctttcacgctatcataaagttgagtaattataagtcaaaccattgtaagttggagactatctgtatttaaaaacaaaacaaaacaaaaaaaaacccaaaaacaaaaatagactggtctggccaaatagaccactttggaaggacgtggcctatggatcaagaggatatttgccgctcctggactagcaaatccttaagccttctttgcctgctgagttctgtgatgtgtataaaaataatgcacttttatctaataagagccaaacacattaacctctgtggtaggagaaagtggagttgaacagaagtattgaatgtggtctccatcctcagaaaactcaaaactactttaaaataagatatgtccatacaaaggcagccaacaacggcgggcaaaaagctcatgacggctcattaggaagcatttctaactttgatctagatgggttcagaaagagccacagaataggcaaggcttgagtggggcttaaaagaacaaataggtctgacatagtggctcacacctcgatctctactcgggagcatcgtttgagcccaggaggttgaggctgcagtgagctatgatcacaccactgcactccagcctgggtgacaaagcaagaccctgtctctaaaaaaaaaaaataaaggatgaacattcagctaaatggagagtgtataggaggatagagttgttagatagtaataggacaaacaagaagcccaggggcgaggaggagggtcatgcttggatccttctgaacctctcaacttcttcctcagatcctaaaattggcttcctgtcacctattctgttctgagcctcctcctcagcctctggacctctcccttcttatgaactaaaaggtttcttagggtcacagttcccacagctgggccctaccacctgcagtcagagcccttagcgctccccttgtattcgcctggtacatatcccagcctcaccgcctgtttgcagacttgtcaacacagtcattgggctacctcttggacaatcacccttgatgctgaatcacccaagcaaattaattgaattttcaagtgacgagtgtaatcctaagcacttaatggtcagaagtgagggggcacaaactattttcggattcgaatttgtctttattatgtggtgtacacctttgttggggtactaagtgccatcagtaaatagctagcagcaattgatggcttacaacgtgccagaatctgtgctgagcccagggcatgcatgccctcccttgccaactcaacctccaaaatggggcacaatattttcccctctctcgagatgggtaaactgaggctcaggggttaaataacacatgcaaagtcatacaactaacgggcatggattcaaacccaagtcttctgtctccaaaaactgactacaatcacatgtggttgacggttatcactgcatgtgattgtaccattcatatggatgtgtaaatgcaccctcaatggcacagaatcacctgctggcctatcattggatgtaagcagctgccatctgccaaacaatacacgcatttgatgtatgaatttgtatcgctgactcttcagacgcagtagtcctcccttatccaaggtccaaatatatgaaacagaaaattccagaaataattcataaatttcaagttgtccgtgttctgagtagcatgatgaaatcttagccatcctgctctgcctgccggggtgtgaatcatctttttgtccagagtattcacactatagaggctccctgcctgttaatcacttagtagatctgttggttatcaggtcaactgtcgcagcatcacagtgcttgcgtccaagtaacccttattttacttaataatggcccaaagagtaatgaggtcagaatattgttttattatattataagttgttatcctttattgtaccaaatttataagtgaaactttatcatagatatgtatgtataggaaaaaaaaacatagtatatagagggttcagtacaatccatggttttgggcatcctctggggtcttggaacataccccctgtggattagaggggagtatggtaatgcagcattctcaccacatttgaatcatctgggggcactaataaaaaagcactgatgccttagcttcaatccccagagatttagatttaactggttttggtttgaatcaaacattggaatgctagaggagcttcccagatgatcctaatgtgtagagaacataggcagtgaatagttgctaggagtgagggcttggggtctgatttctgttaccataggccagctatgacacacctatgagtcttagttttctcatctataaaatgggaactacagaactgtgtactttatagcactgatgcaagggttaagttagatggaaacaatggaatgcaaaaatggtaaggttcctggtgccatccctaaaagcctcattgatccataatgaaatggaagtttatagtctcttaggcaaacacccattggttatatgagaaaatgtattctcctggctttctactcagactttctgacacctcagggtagaggagagggctggacaggcactcttgacaacctgctagctctttcagagatgtaaatgcaaaggcctttcagagctagacagctgacatacagatgtgaagtaactgggataagctatcagggctatttaaaaaaagggagacagagcgagcaggtatgatttgaagagaagataccccataaaagggcttaaagttcattaaaaataataattactaccaacaaagtgctagccaaacaaatccgtctgtccccacatgcagcaggtagggtgccagtttgcaccacgagtagttcacaccttcagctttagagattcaggtcagtggctcctccctgcttctgcacttgtgagctgagggcagctacttccccttccattggaagccagggggtttcaaggatatgtcggtgactatgaaggggcttgcagatgacagccagatttgttaaaggcagacaagcagttatttgtttaaaagttcccaccttacagagggcccatctctgtttcaggctagctgtgtggcctcacctaacttctctgaaccattgctcacatgtaaaacacggaaaaaattatccacttctcagggatgttgtgaagattaaaagaacaagagatgtagagtgctcagcacagtgcctctgctctgggaagcactccagatgtgtctgcttttgttgtgattttgccattcttcaacaaagttaaaagagcctcaagcactgtaagcattgtttctccccttgccctggtaaattatttaaatgacatggttcattctaatacattacctcatccctcctttgaagccacagtcaaaagcattgacaaacaagtttgagagagataaggagaggcaagataaaagatataaagtgaccaaaaagaaaaaaggtagataatttgttccttgtctgttctcaaggatcacaggtctggtggcttgctgaatggggtatggagagggaacacggtacacctcccacatctgtggcctgcagtggccccagtgagcactgggcagcacccaggcagagagaaggactttctggatttctctggggatagttactctcagtgtttccaagaataagaatccagcatgggattcatcccaccttcattgcattttgctttgctttgacatctgccatggagaatgcaaaaaaaaaaagttaggcctcataagacataaatgtgtcaatgctttggcctatccaggcccagatttgagttcagagaggccctggaagcctggactagtcctagaccaactttggttcttgggctttaagaaacagcattcattcacctgattttcaactggggaaccaccctccaccctcactgtcagtcactgtgctttggatgaaactgactttatccctgtcttcagggagtgggtgtggtattcaggcctggccaatcagagcatcacattcctctgatccagtgatagatagtgacccattgagaaatgggcatgtgaacccctcagagtcagagtgatacaaggaaactgtttttaagggctttgttaaggtataatttacataccataaaattcacccatttaaagtatacaattcaatgatttttagtaaattttcaaagtaaccacaaaaatctggtttttgaatatttctataatcacaaaaagatctcttgtgccatttgtaggtacaaggaaactttagcagagttattgaggaaaattcacctgttccttttgtctgggtctgtttgcaataatgattacaagagcctggatctacatagaacctgagaataaagcaaaaactgcttagtaaagagataggctgggcacagtggttcacgcctgtaatcccaacactttgagaggccgaggcgggcagatcacttcaggtcaggagttggagaccagcccggccaacatggtggaacctcatctctactaaaaatacaaattagctggatgtggtggcgcatgcctgtaatcccagctactcgggaggctgaggcaggagaatcgcttgaacctgggaggcggaggctgcagtgagccaagatcgtgtcactacactccagcctgggtgacagagtgagaattgtctcaaaaaaaaaaaaaaaaagaaaagaaaaagagagagagagatgtagagaagctgagtccggaggtccctggttgaggctctgatcaagctgaacctgaagtcagagcttcccctagacttcttcagttccatgagctgagaagtttcccgttgtctttagccagtttgacttgtgttttccatctcttgcaatgggatgaatctcgcctgactccaaaaatttttgaccagactctaaagattagaactggaacctttattaattgaatatcagacaggaaagcaaatctccagatttgctgtaatcaaaggattattttacatatgatcatagatgccattttacaaatgaggattcagccctgcaaaagtcaattgcttaaccaggatacataggagaaactggagaagtccgtgtaactctgaatttgattttgtaaccctgaatttgatcctgtctttcctcttgaagtaatcatcatcgtcgtcatgatcatcatcaccattacctcttacaaaatgtttactatgtgtcagacctatgctgagtacgtactgtataaatattaactcatttaatcttcacaactgccttatggggtaggtattattattattctcattttacagatgaggaaactgaagtctgtagaggtcacataacttctccaaggttatatagcctgtgagtagcagaggcaggatttggatgcaggcacactggctacagaggccacactcttaatctgtgcactgtactgccttttataaataaaaattaatctaacataagcttttaatcagtgttccagtggtctttcagctagagatactacctttttctgaacttatatttccgtcattataaaaaaataaaaagcaaaaacctcaaatattttctgtattttaagactcttcaattatataaacaatttttatctgatttcaagtagtcataaacttctgtgcttcttacaactttgttctgctcttctaaacacagtaaaagtaaagtttaatcatggcaaaagtctaatttttatgtcttcttgcagtaaaaaactagatgactgctctgctttattgatatttaatatgatatggtaatgatatttaatgtaatttaatatgaaattttacattttatatcagccaactgacaagaaagtaagacctggaagttatttttatgtagaagaaagatatgctgaattttaggaaattcagccagtggatatatacaagatggttgaggaggggagctgcaggcacggagaacagcttagaaggctgctcctgcaaatacagacagttcccaacttacaatggtttggcttatggtttttcaaatttatgatggtgtgaaagccatacgtgttcagtagaaaccacactgcaagtaccccataaccattctgtttttcactttcagtacagaattcaataaattacatgagaaattcaaactttattataaaataggtttgtgatgatgattctgcccacctgtaggctaaggtaaatgttctgagcgatttaaggtaggctaggctaagctatgatgtttggtaggttagatgtaagtgcattttcaactcacaatgttttccatttacagtgggttcattgggatgtcataacctcatcgtaagttgggtatcagtacctcagatatatttgtttagtatagggagtctgtacaagttacttgggattgacttggctcctggggcaacagaactttgttctaagttctaatgccattgttaaaatcaatgagtcatcaatagggcactagaggtaattgagaagctgccctattgggaggggtagataactagaaaaacagcagcatgaagtgtggattggagtacttaatggtggcacctgggcaaattattctaggcatgtctgcacagacctcaaatgatggaggtgggttagagttcggcttcccaaatcctctgtcagtgatctcttattgcagaaggcagcctggtacccctaagagtctaagacacagcttcagcggccctttccagttttctatttaaaattcttgtagaatttctgcttcactccctaggaaagcctatgtctgccttcgggatatgtgaaaatttgacaagaagtaaacaccttccctgttcaacataggccccaccttcccaagctctcatttctaggtttcttgttctttggtccatattcattctatgaggagatggtcaacatggctacgaactccacatgaactcagtattaactggttaatctactccatgaatccctacaaatacgggagcatgttggggtatggttcttgggtaatgtgtatgcattttgattgaggctgaggtttttgctgcaatcagtggtctagcctcacaatatccagtgtggtgggaatgtgtggctcaaagaggagaggaggatggagcttctggagaaggaaaggctttggagcaagcagggatattagagtctaacaagtaacagcaagtttcttacacttttgtgttcaacactttgttgctcattcatgctggaaaagaagacaagaaacaagccaaaattttcattcatcctcagattgtcttattctaacttggagacaaaatctggatttgaaccttgtttctgccgtttatgagttgtttgaactcgaacacatcaactaatctcaattacctcaactgcaaaggagcagttctgataacatccttcctgtctcattcacagggttactgggggaatgaatcagtcaatgtaatcaaaaatgctgcatacagacagtgtaaactgtgactgtcttgtaagagtcaagtgtcaataatgactgtcactttgatttggggtcaggattcactcttactgctgcctgttatgtacaatctcaagcagtgttgtttattattattctaagaatagcatagcttttgggtctgtattttacaaaccaaatattgtaattttagggataatggaatattaggggcataatggggaaagttgaaaaattatggtcagtggagagatagttaaaaaaaaagtactggaatagaagttaggagacttcacctagtacctcagtgatctggagtcatcatggcaccatgctgggcctcagtttcctcgatctgtaaaatgaggatgcttgatccattgtttcttaactaggaggagttttggaatcacctggaaaatccccaaaggtagaatttttgttttgtttcttgctgtgtttccaaggcctggaaaagtacttggtgtggggaagctactcaataaatacacatatattttatgaatgaataaactttttcaaaattcataggcctggttccactctgaaatcctcgtgcagtttggggtagagcctacatgtgtattttggaaaggcctttctgatcgttttgccaagtgctcctggctaattaataaccaccaagagccactaaactcaacaatctccaaggtcccttcacatgcagttgccacatttagcaaacaaaaatgcagagcatccagccaaatttgaatttcagataaacaatgaatacttttttagtgtaagtataggtcatgcagtatttggttgctgcaacttaaataaacataaccagataagacttctgcttagactgatagtttgggccagagagtggcaccttgaaactggcccagatttgaaaatcagacagagatagtcttggtttgagtctctgccctgatcttagcagattgcttaacttcactgggctccacaactacagtgtctaccctgtagagttggtgaaagtattagagataatagaggtaagatgcccagcacttagcaggcatttaataaagcttagctattattactattttttatctgctccacggggtttgaagaaaaataatagtatcaatgagactgttattggcaatactgtttactcgtaaattggcacttgaaataaccaagattatagttaacagttctaggtagagcttggcaaagttagattgaatgctgaccttgtattaaacaatacctctatgtctgggggaacaaaaccgtactaagtacagatcatccagaataaataaaggaaggaagtacttttatttcattcattatgaaatgtcatttgcttaactgacttttttgacgttaaagataaatatttgttcaggttttatagggtcactctctggggaaataggctattacttggccagcggaaatacttcaatcctgaccaggtttttctgacttctaagttaaaggcatcttcttcttctagagttttagttgtttctagacattttaaatacatctccactggttaaacaaatagacagtcaggcacagcagttcacacctataatcccagtactttgggagcccaaaaaaggtgggaggattgcttgagctcaggagttcaagaccatcctgggcaacaaagtgatacctcatccctactaaaattaaaaagaaaaaaaagccaggcacagtggtgcacacctgttgtcccagctagctgggagctgaggtggaagaattgcttaagcccaggaggttgaagctgcagtgagccatgattgtgctactgcactccagcctgagaacagagcaagaccttgtctcaaactaataataataataataacaataggcaaacatagcagtaaacataaaatgttcatttaaaaaattatctccagaaagatctatttggacaaaatctttagataatttcattatcaaatttaaaaagagatggctggaaaataaattgccaaagtttcaactgagcaactctgatattggcaaaaatacgttaagctccctatgtttacttcattgctcattcaacacatatttattgttgagcacatattatataccagacagtgtggtaagtgccagggactatgagtaaacagaacaaaattcttgctcttgtggagcttatattctgacacaggaaaacaaatataaacataataaatgaattaattagaatatagatggcaataagtgctacgaaaaaagatgaggagaacaaagatgagactatgtgaagggctaaagtggctttttttttttttttttttgagacagggtctcattctgttgcctaggctggcgtgcagtggtacaaccatggctcactgcagcctcaaactcttgggttcaagggatcctcctgcctcagtctcccaagcacctaggaccacaggcatgtgttaccatgccccatctaatttttaaacattttgtagagatgtgctcttgccatgttttccaggctggtcttgagctcttgggctcaagtaatcctcctacctcggcctcccaaagtgctggaattacacatgtaaaccaccgtgcccactcctggagtgcattttcttttttttttttagacagagtcttgctctgtcaccaggctggtgtgcagtggcatgatctcagctcactgcaacctccgcctcccgggttcaagcaattctcctgcctcagcctcctgagtagctgggactacaggtgtgcatcaccacgcccagctaatttttgtattttttagtagagatgggatttcaccatgttgcccaggatgctctcaatgtcttgacctcgtgatccaccctcctcggccccccaaagtgctgggattacaggtgtgagccactgtgcccggcctggagtgcaattttaaatagcatggtgatagtgggcctctctggggaggtgacatttgtggacaggagagaaagaaggagcatgctgatttggggcgagaaaagggaaacgtcaaacacaaatcacctaaagcaggagtgatatggtttggctgtgtccccacccaaatctcatcttgaattataactcctacaattcccacatttcgtggaaggaacccggtgggaggtaatcaaatcacgggagtgggtctttcccatgctgttcttgtgatagtgattaagtctcacaagatctgatggttttcaaaatgggagtttccctacacaagccctctctttgcctggtgccatccaagtaagacgtgagttacttctccttgccttccgccatgattttgaggcctccacagctacatggaactgtaagtctattgaacttctttcttttgtaaattacccaatcttgggtatgtctttatcaacagtgtgaaaacagactaatgcaaggaacatacctggagtgttccaggaacagccaggaggcaacgtggctggacaggagacagggaagaggagagtagtaggagaaaagacagagtcattattgtcatcataattgtgacagaactccacaaacctaacttccagttttgagtcttagtttatttactctgtgactgtagggaaatccttaactgcttaaatagaatgatagtacttaacttgcaaagcatcgatagttagagatttatttcacaaaactgactagagagaatcagtatagcttagccatgctgtcggtacttacgtggatagctctgggtttatatgctgatttacttactagatgtgtgtccttgggcaggttacttaaacctctctgtgcttcaggtttcctttctgtaaaatgaggcaactaataaatgcatcctttagagctgttaagggttgcctggacaactgtgaggctgtctgtgagagacagtctcacatcacatgcttaacatagtgattggcatatagaaagtactaagtaaatatcattatttattattatttgaaaagtttaagattaaatatattgaaatatgcatttaaatgtatatttgaaatatatatttaataaccaaaacatgcttttgagaaaaaatatcttattgttattaatagttgtggccaggtgcggtgtcatatgcctataatcccagcactttgggaggccgaggcgggtggatcacctgaggtcgggaattcgagaccagcctgaccaacatggagaaatcctgtctctactaaaaatacaaaattagccgggcgtggtgacccttacctgtaatcccagctactcgggaggctgaggcaggagaatcacttgaactcaggaggcagaggttgcggtgagctgagatcgtgccattgcactccagcctgggcggtcaacaagaacaaaactccgtctcaaaaaaaaaaaaaaaaagaaaagaaaaccagctgtggcctggtagccggcctccctgtctctgaatattcacatccttgtacagtcccttcccatattgtaccagggttggtttgtgcgaccatagaatatggcagaagtgatggtatgtcacttctgagattcggttataaaagacattgcagccaccatcttggtcattctttttgtctttctctccatccccacttggtctggagaaaaccagctgccatgtcatgggacagttcacgtgacaaaccttttgccagcaaccatgtgagttgctgagcctccttagaagagtgaagaagccttctcagaagtggatccaccagccctggtcaaggtttcaaatgacagaagcccccagtgacattctgattgcaaccttatcagagactgtgagccagaaccatccagtgaagcagctcactggatggttctcaggaactatgtgaaatgataaacatttatagtctcatgctgctagttttggggtaatttgcttttttttttttttttttggagatggagtctagctctgtctggagtgcagtggggtgatctcggctcactgcaacctctacctcccaggctcaagcaattctcctgcctcagcctcccatgtagctgggattacagctacacaccaccacgcctggctaatttttgtattttagtagagacagggtttcaccatgtcggccaggctggtcttgaactcctgacctcaggtgatctgcccacctcagcctcccaaaatgctgggattacaggcatgagccaccgcgcctggccggcaatttatgtagcaataaatactaatagtttacatacatttttttttcttttgagatggagtcttgctttgttgcccaggctggagtgcaatggtgcgatctcggctcaccacaacttacacctcccgggttcaagcgattctcctgcctcagcctcctgagtagctgggattacaggtgcacaccgccatgccccactaatttttgtatttttagtagagatggggtttcactatgttagccaggctggtctggaactcctgacctcgtgatccgcctgccttgacctcccaaagtgctgggattacaggcatgagccaccgcacccagcaatacattttaagttttcataaacttttgaatataaagaatttattgggctcaagcccaattctatcatttttgatctttaaagatcttcactgatccttggtagtttacaagcattcattttttatataattgttatcagtgtatacatcctacttcatatctgatttttcctcttagaattatttcatgtataccaatagagtacaagattcttagcatttatactggcggtatagaattctcccctgttactgtgtaaccacgctacctccaatagtcccttttgtacctggtttggtctgtgtgatgatagaatatagcagaagcaatggtatatcacttctgagattagattataaaaggcattgtgctaccatcttggtcattctaactttctctctctccccacttgctctgggggaaaccagctgccatgtcatgggcagcactatggagcaatacacgtgacaagccttttgccaacaaccatgtgagctgctgagtctccttagaagagccaagaagccttctcagaagtggatctatactggctgtatagcatcctgccccgctactgtatgtcacaccacctcaaacagtcccttttgttggaatttaaattccagtttttcaaaataataactggcacaataaaaatagtgcaaattagctgggcagtgtagtgaaagttaaatagatcagctctcttagatacataaaacacagataacacagaaggggcaagtcctcttaaagtacatagaccgtgaacaaatattgaacacatgcatttgttaaataagtgagcaaatacaaggctaacctaagacagcaagtgcaaagtaactaggtgaacttacttgtttagataataactttctagaattctgtgtgtttcctagagaaatacaggaatgacagctgacaataaagctttggaaaaatcctgtaagtaattgccttggctccaagtatcaaagcagaatttcggagaaggtcctcctgcactaaagtcattgtccccagactatgagtttctgcctccttctctttcagcattctcctcccctcctctggctgtcctttgtcagactctacaatcatggctagaagaaaaaagttgacttaaccgttctttgttgaaattcgggactatgttagagataccaggtctcaatcaaatacagccttcaataaaagactcttacgtaaccagatcctatgagcagagagccatcgtgcctccaacttagtttcttcagattggctggttttggtgctcaacttttgactttacccaccttcctgacaaagtgttgaggaccactaggtaagcatgctatcttcaacgttaaaaaaaaaaatcatgattgaaggcagctgcacttcatatatcaaggagcattgaatataactaactctaaaacttcatcaggtcatgaggttttattgacatcagtgtatttggcttcagctgtgataatcatgtggcgcagtctcttttcctccccgcaatgccttgcctcccttggaagactccctccaccccaccccagccccattcagcttcgttcagaaaaaccttcatttttatctcccattaaagtttgtctgatgaaaaggctctgaggctcaaatgacagctcagttgtttgaaacctgctgggttagagaatggtgctataaggttaagatcaaaaggtcaccaggtcagggtttccttgctgaggaagaaaagcttcagtgacagtgactcagtgtaaagttatcatcactagcataattaaacacacacacacacacacacaccacaatgcatacactgtcccagctggaaggggtcagggtggacttctggctctggcctccagcaacctgggttcaaattctgcctctaccacttggcactgtggcttcttgcagctatttgaacctctgtgagccccattcttcttgtctgcaaactgtagataataatcatgactaccttacaggagaagtaaattggttcagagaacacacttaactacagtgccaagcatggaagtaagctctcaataagaattattgattattaaaactacattcttggccaagtgcaatgactcacgcatgtaatcccagtactctaggaggccgaggcgagcggatcacttgaggccaggagttccagaccagcctggccaacagggtcaaatcccatccctactaaaaatacaaaaattagctgggcatggtggcacatatgcctgtatgtgccagctactcgggaggctgaggtggaagaattgcttgaacttgagaggtggacgttgcagtgagctgagatcgtgccactgcactccagcctggacaacagagcaagactccatctcaaaataaataaatacataaataaattcataaataaataaatgaaagaaataaaattatattcttgttttagttataacaacattttatatgtctctcaagccaaagtctaatagcattacaagttgtttttgcacatgtatcatctccctttaaaggacagatagtttcttgggattattcttatttttgtcctttatgaagcctaacccagcactttcagcacagcaggccttcaataaatatttggtaaataaataaataaatgttctaaataaagtggatctgcagggacaggtttgtacacataatccctctacttaggatcctagtagaatgacatacacattctgaatgctctataaatattttataatagtaacaatgatataataattataattatgaatgaagattactcttagctcaatttcctgaactagaattatgtccttcagccacggagaaaatgtattcatacagggttccagcttaatgtaaacagaattgtaacttgatttttaaaataactaaagcaaatgaaccaatgtgtcctttcctttcctttcaaacagttgtttccaggaaccagaagtgtggggctatcatatgcaagttgtgataaattaggtcttttccttcaacatttagtctcaaaaaaaagaaaaaaaggaaaagaagactccttaagggcagtatgaccatgggcaagggtgagggaacacacagctttccttagtaaatctcaagcctccaaggttggcgttggaaaggatctgcaggtagcaaatccagctgtcccactgtgcacgccctccccagttcaccttttctctgagggagactcattggtgctcaggtatgcatgtgactcttcacacacacacacacactcacactcacactcttgccaccatgacttccatttaatgttcaagaattcttctctcacagctctgtaaaatatttgagaaggacaaaaactttcaaaaaacccttaattataactgtagtatataaccatttttttaaatgaaattaaggagagtataaattggaaggctgaggtgggcagattgcttgagctcaggagtttgagatcagcctgggaaacatggcaaaacctgtcttgacaaaaaatacaaaaaattagccaggcgtggtggcgtgtgcctgtggtcccagctacttgggaagcggaggtaggaggatcagttgagcccgggaggtcaagggtgcagtgagccgtgattgtgccactgcactccagcctgggcgacagagtgagaccctgtattaaccccccacacacacacacccacacacacaagagtataaagaagaaaattacttctagggaccaccccagttccatccgtcccaaaggtctggtatgacttcggggatctctcgctggggtgtcttccttgctccctcctgacttgcttccttgctgccatataccctcttaggccctgatgggaaactcagggcacgagatttctacctgcagcatacccaaggctcattctgatccaacttactctgtgaggtttgatccttactgcaacttaatgaaagaggcacaggtaggtattactgccattttacagacaagaaacttgaggcttggggagattcaacagttgggctattgctatttgcacacaattccaagtatttagcagataactaattgcaccacacgaaggtctactacagaaatgggctgatggggtgaaactcggaaccagggcagatgctctttaactacaaagcttgtataacgcgtggtcatgttcagtattaatactagattagcttaactgaattctgagacaatggacacaagacaaattagatttgatgagaaaggagggagaggaaaggttctaaacatgggcatgctgtcagtaggatagtcctccttgtgacccacaactgacagaatggaggaaaatattttaaatcatatatcagataaagactagtatcacttatcagatatgaataaagacttcttacaattcaataataaaaagacacataatctaatttaacaatagacaaaagatgtgaatggacatttctccaaagaaaatatacaaatggccaatacgaattctcaacataattagtcttagagaaaagcaaattaaagccacagtgagatactacttcatagccactaggatatctataatcaaaaagaggataacaacaactgttggcaaagatttggagaaattaggacccttatacattgttaacaggaatctaaaagtgtatagctactttggaaaacagtttggtagttcctcaaaaagttgaacatggagttggctgggcgaggtggctcacgcctttaatcccagcactttgggaggccgaggagggtggatcacgaggtcaggagatcaagaccatcctggccagcacagtggaaccctgtctctactaaaaataaaaaaaaattagccaggcgtggtggcgagcgcctgtagtcccagctactcgggaggctgaggcaggagaatggcatgaacctgggaggcggagcttgcagtgagccgagatcacaccactgcactccaacctgggcaacagagcaagactctgtctcaaaaaaaaaaaaaaagttaaacgcagagttatcatatgaccaagaaattccattcctagatacatacctaagagagaggaaaacatgtttattcaaaaacatgcacttgaatattcatagcagcattattaataatagcccaaagtggaacaacctcagtgtccatcaaaggatgaatggataaacaaaatgtggtacatccacacaatagaatattgtccagcaataaaaaggaaagatgtacagaagccccaggagccacagccccagatgaagctggcatccctgggcccaattcctgctgccacagttccactattgccagcccccagaccttggagatcctccaccgccgacaaggctgctaccaactgccatccttgcagagggggctcctgcaaatcttttaccttgtacttgaagcaggggccagggaagaggactctggaaaggacatgtgggcctgagacaccttaaaaacaggaaaagccctgaggagcacgaaggggaaacttttttacctgtacccttttggggacttttggttaaaactgagaattacattgacatagatcaataggagaaatgcatacgaatttgtttaatataagttttgtgtggcataggagactttacaaggaaatgaagacccaaagatgcaattagagatgaacatgtatatactgatttagacaaagagaagtactttatgaaaatgtgacaaggaaaaggggcttgctagttaattggtgaagaagtggtgaagaggataaggattagtctaacaagtttgtttgtaatatttccctcagactcttcccctccttgatgatgataatatttccttctggtagagagagaacatcttttgcatgggaattttatctgctgcttttaagaaacagaaggaagggtagagtgatcttcttgcacctgctgttttttaagcgcctttaactcaaaatggtcaacatgctagagtagcatatttttaactccttcaagcagctacaacaaaatggggagaaaaaatagttacaactgtggcagtaacctacacgtgtcaaacatctctcatgaagcaaaattaacaagaataataaacaagtgacatgtcagctatggagttatcctcttactgaaagagatcccatagataataggaatttcaaaaaatctgtaatggaaactggctttaatgtaactggtaactccataaggctcttcactctgaaccactcattaacaagtgcttcagttgatgagcaagttggttcttatcctggactgcagatgccattaggtctctgctggccctatgctgatgaagacttttttaaggatgaaaatgagccccatgttaattcatgttcaactacagaaaacaacaagtgaaactttgtttgctccaaattggaaactgaaatatggaaacagcagtgtggaaggaaatttaacatatgaaggtgatttatcagaaaacgaaaaggcaaaggatactttattcaattatatttaaaggagggacctaaactgaaagccagaaacaacagaaaatgttgtagaatctttcacagaggagccaagtgaagtttttccataccctgattttctccctcctacggagcttcagtaccctggacttgcacagatgaggccctcacaaaatctgaaaattggaaagcaacaggggaaccttcagaaagctctattattggaaatggaaagattacaacatatgactatacaaaaagagaggtcaaagttacaaactactttctgtaccccagcagttactgaatgactttcttcctccaaagctatactgagagtgggacagccaaaactttctgattcactgagtcttcagacatctcgtgtagataaaagttgagaaaaaagaaaaaaaaaaccaatcgggttctttcaagcttgagcaaaatgcttcaaaatggatttggagcaatgctggaaaatataaatgaaattctagaccaccaactctaaaaagttcatccaccacaaaacagttggttgcaacttaggactttaaaactcttaaaagttcatttttaaatccgtggcaagaactttcagcaaggaccagacaacgcactgactggttaaagtggcctcaataaggtgtctgcccccaaggttttcagtaccagtctccatcttttcttgaaaatgagaagaaataaatcaaggcaccaagaaccaatcacaaactttataaaaaaaaaatagtgttgcatagaccattctatatttagaagctatttgttgccttcatttatagctaagggcttatgtattgactaaaaataattcttttctttcatatatctcagtgtgagcaaatctattccaagaagcccagctaaaatatggttcattgttcccagatacaggtattcgcccacgcacagacatacacacacacacacacacacacacacaccccaattgcttgatatgatatcgattggaatttgtgaaaattactgctgagagtattttaattttcttaattgttactttttaaaaaaatagagatgaggtctcactttattgcccaggctggtctcaatccaattcctgggctcaagctatcctcctgctttgggatctccaaatgatgggattataggcacaagcgcccagcctcgcgagagtctttatataaatccaagggcttctatgctgacatgtttgacaatctttcgcatgttatatttcaagaaatgtttcacttagtaaacggttctattcaaagattgttcttttgtgacagttttccagtataattctatcatcagtaaatggtataatgggtagggggaggaagaaagtactgaaacatactacagcatggatgagccttgcaactattatgttaagtgaaagaagctagtagcatgttgttatgttcctagttatatgcaacgtccagaatcagcaaatccatagagacagaaagtaaattagtggtagccagcggctgggagtagggaggaatggggagtgactaatgggtatggggtttcttactgggatgtcaatgtctggaattagtggtgatggttgtgtgactttgggaatatattcaaaaccactgaattatacattttgggagtaaattgtatggcatgtgaattgtatgtcaataaaataactaaattaaaaatgaaatttcaagtataaatccactaaaaattcagaatctgccatacttttgattgattcgttttgcttactcttgagggcctatcaatgtttactgactaaatgcaaagagggagaaataaaggagaggtgaaggctgggaattctggggatggagagcactttttttttttttttcttagagtcgtgctctgtcgcccaggccaaagtgcagtggcatgatctcggctcactgcaacctcagcttcccgggttcaaggattctcctgcctcagcctcccgagtagctgggattacaggtgcacgtcaccacgcccagcgaatttttttgtattttttagtagacatggggtttcaccatgttggccaggccggtgttgaactcctggcctcaagtgatccacccatctcggcctcacaaagtgctgggattataggtgtgagccagtgcacccggtcgagggcactatttatttatttatttttgagacagggtcacactctgtagcctggactagaatgcagtggctcaatctctgctcactgccgcctcgacctccagggctcaggcgatcctcctaccttagcctccagagtagctgggactacaggcgcgcgccatcgcgcccagctgatttttttttttttttttttttttttttggtgaaaacagaatttcactgtattgcccagaactcctggggtcaactgatctacctgtctcggcctcccaaagtgtgaggattataggcctgagccactgcgcctggccgacgagcacttttaaaatgcaggagtcttcctgcctctgatatctcatcccttatcaccatgcaaacaattctccttttcatagaagagtagacatttggggcggggtggtggtggtgggggattttagaaaatatctactgcatccaaatgccctactctacagacgaaaaagcaaggcccaggaggaggaaagagtttgcttactgccacccagtgagctggcaaaggcgctgagattcaaaatgagctttcctgccttcacatatcttccggctgccctttgcctattccctaaacagtcaggagccatcaagttcaggaatttgcaggtgtgcttcgctgtgaactgtggaaaagcagcgtcttctccccagaggcaagcatgtcgccttgtgaagtttgatggctcttcacttgcacactcacaaaaaagactgagcgtgtgtaacgccctgctggatgtgtgcggtgctagagagcttgggggtgaggggaggactctctcccttaagaaaatcagttgactgcagagctaacattgttttttgagtaatacctggtttttataaagtcgtcccttcagttcccaagctcctcttctgtttgttcaagccaccttcaatttgaaaaagactgaagtcacagcttctcaatccctactaatttctcatggacctactggattgctccaaatcgagtatttgggactgaactaggaagccagttcaatcctgagcccccgaggcaggcgttgggtcttctgtggagtccccagagacctgcaaccttctgaacacgcatcctcccctttccgccgaggactctgtcctgcagccgagccagggcgaatgcacggaggtcacaagggaggtgcccttggaggcgggaggtttctggccgccggggcgaccgtgctgacgaggcacctgcaggaaacagagctctgcacgctccggtccccctcacccggggagggagaggaggtacagaggcgctgggggaggacgtcgagcaggccagcctcgttgccagaacccccgccccagccggagatgggagcaccgcaccgtctcacgggggctggatttcttctccccttgcgggtgtgtgtgcgaggatggacgtggtaaatacgggttggcagaaggagcgaaccgcggtggaggaagttcttctgcttagttctcgccgcggcgaggcccgcgggccaggcgcggcgacgaaggtgcacgaaggtgccccgcgggcctggtggagttgcagcggcgcgcaggcgcactgagggccgcccgcggccggctccgcggtacaaagagcgcccccgcggggagccgggcgtcctctgggcggagggagcagccggggcttcgccggcccgcgccgttcttctcacgcgccgctccggggcgcagccacagctgtcgcccaccgcgggtgagaggcttgctggtccgccccggcttccccgccccggcggcggccgtgcggttcgggctttaattctggcgcttgccagccggggccgactccgccccctgcgccccgcccttccccgagctccgggtccgcggcggagcgagcgagcggccggcaggttgggaggagcggccgaaggtgagtgacgcggcggggccgtgccgcgccccgtgccgcggcgaggttgtcccggagcgcgaggcccctacccctgcctcgggctggccccgcgcggagccgacttggcgcgcgccggggttgcgcggcggccgtggcggtggcggagggcagcccccgcgggctcccgctcgtgcgggtgaacccggcggcctcggggcggtcctgggggggggtccgagaggtggcgtcggccccgcggccgtcggagtttggcgcgctctgcagcggcggcgctcggccggtctggaggagggagaggcgcgccgggcacggagcagcgagaaagttcgggccgggccggccggcgggagggtgcgggcgcctggctaccccggcccggcgctctgtccctcggatgcctctgggcccttccctagcccggggcggaacgggggaccctctctgaagcggctctccgtggagttggatgttgcccttcgcgggagggagtggcggtcaagacccctttatcctcggccccagaggggcaggtggcctcgggtcgccctccgccaactccgaggtggcttcggccggggctggagggcggggaggcgggggaggggcgtgggcgctgcggcctctggggcggcccaacccggcgcgggcagcgtgggtttccgaggtcccgcggttccaggtcgagggaaggtgtaggggccctgaagcgggctggtccccgaatgttgcgttttctgtgccgctttgggcaacacgcagtggcgctcgcggcagccacggctccttgaccgttcatctccttcacccgggtcccgtggaactttcagaggcaactgttcttggtggctcttgcgggtcagcacgagccgtgctgcacgagcgtgacctagtgaaggccttgggcgagttggcgttaacaatttatggcgtccgccagcgctcgctttccgcacgtggcctctgcggagggtcagcccatcttattaaatagtggattctattagaccctgatacccgaggctaataaggaagcttaatcatccagatgtgtaatcgtgcagttcctttcctcaccgtcattgccccccacctctggagctgaatggaaatgagggtctgtttgcttatattgaattcctgagtttattcaagttcatttttaggtggcgttaacagctaagtagctgttcatctgccagtttctcctttcatccaactttctctactaaaatgttgagcacgttttatttaaaaaaaattgaagtgtaataaacatataaatttactcttctaaggtcaaaattcagtggtttttaatatatccgtaaagttatgaaatcatcactaccatctgattccatttcgttgcccccaaaaagaacccctataccgattagcagtcattcttccatctcccagcccttctccctcattttaaggcagctacttaggaagtttttctaagatagagactgagtgagaaaactgagaggtgattaactttgatcctttttctgttactaggtttggggaaaggtgctgctgaagcaatggaagaaaaattaagtattggctgtcctatggggaggttaaaatgaataaggatggaagagaagctgccagtagaggaataattgcctcctgtagagacccacaagttgggaatacattttatccccttagggcacagggatgctttctgggctctagacttgcctagtccataaatcactctagtcgaggttctgcctcagcgaaagtgagttctgggtgtgtgtgtgtgtgtgtgtgcgtgtgcgtgcgcgctcggcagggaatgttagaaggaaaaaagactaggcttaaaagtaattttttaaaatatccaaactggccccaaagaaagaaaccaaaaaaccacaggcaaatggccactggaattgatacattcaagactagtttcatttcatgagtatcagttcacaaatagttctgagttaatgtgtgcatacattaactttttatcccaagtgggaggaggaggatggaaaaggatctagttgggggcagtgcaaggaactgggaagaggaatgggataatggccgaaaggggcagtgcttgtgggagctgaggactgttgagatggaataactatagggtgagcagattctgaaagagcagagtgggtctgtgaaaagttggacacttcactcgggctttttgttggataatgtgtgcatgttttaaaaatcatttttagtaaggagagttgaagctatccaaattatgcaacatccactacacttctcactcacccttcaataagaaaagtcaacttgttttcaagtgtttcgggaagttttaggcctgttgcatgggtgacagcttatgccatcttttttttttttttttggtaatttagaacattgacatagcgagactccgtctctacaaaaaaaataaaaaataaccggatatggtggcacatgcacctgtagtcccagctacttgggaggctgaggcaggaggattgctttagcccaggagtttgaggctgcagtgaactatgatcatgccactgcactccagcctagatgaccgagcaatatcctctctcaaaacaagatgagctgtaccataggtatacatatcccacacccccagccctgccgacggagttttgctcttgtcagccaggctacagtgcaatgtcacagtatcagctcactgcaacctccgcctcccaggtttaagcgattctcctgcctcagcctcccaagtagctgggattacaggcacctgccaccatgcccggctaatttttttttttttttttttgagatggagtctcgatctgttgccaggctggagtgcagtggcgcgatctcagctcactgcaacctccgcctcctgggttcaagcgattctcgtgcctcagcctcccgagtagctgggactacaggcaccgtgtcaccacacccagctaatttttgtatttttagtagagacagggtttcactatgttggccaggatggtctcaatctcttgacatcgtgatgtgcccacctcggcctctcaaagtgtcaggattacaggtgtgagccaccatgccagtttttgtatttttagtagagacggggtttcaccgtgttggtcaggctggtctccaactcctgaccttgtgatccgcccacctcagcctcccaaagtgctgagggattacaggcatgcgcccccacacttggctaatttttgtatttttgttagagacgggggttttaccatgttggccaggctggtcttgaactcgtgacgtcaggttatccatccgcctctgcctcccaaagtgttgggattacaggtgtgagacaccctgctcagccttttttttttttttttttttttttttttttttttgagatggagtttctttcttgttgcccaggctggagtgcattggggtgatctcagctcactgcaacctctgcctcccgggttcaagcgattctctgcctcagcctcctgagtagctgggattgcaggcatctgccaccatgcccggctaattttgtatgtttagtagaaacggggtttctccatgttggtcaggctggtctcgaactcccgacctcaggtgatccgcctgccttggcctcccaaagtgctggcattacaggcgtgagccactgtgcccagcctgtagctatacatcttaagagtacatcttcacaaattgtcacaaagtgaacataaacatataacaagtactcacggaaagaaccaaaatattgccagcattgcagaagtgcccctatactcttgtccaatcactgcccctcccgaagagtaaccgttgtgccaactgtggattagttttatctgttttcatgctctacacagactcacacggtatatagcttttagtatcctggtttctttctcaacattatatttgtgagattcagctgtgttgttgcttgtggctgtagttcagttattttcactgctgtgtaatattcaattgtatgactacaatttatcaatttttaggtttgaggggcatttacatagtttccagtttcttacatggtaagtagtgtgactatgaacattctaattctagtacacgtcttgatacacaatatccaatacaaatgtgtacatttgtacaaattctattcagaagtagaatttcccagttccaaactaggattcagtttagaggtacagtcatgcggatttctgaagtggttgtagagtttatacttctacccgtagtgtgagagagttctgttgtgtcctttttaaattggaagagcagtagatctgcagagtttggcaaatggacaaaatatgacctatttattattttttttttggaggcggagtcttgctctgtcaccaggatgagtgcagtggcgcgatcttgactcactggaacctctgcctcctgagttcaagcaattctcctgcctcagcctcccgattagctggaactacaggcacacgccaccacgcccagctaatttttgtacttttagtagacacggggtttcaccatgttggccgggatggtctccatctcctgacctcgtgatccacccacctcggcctcccaaagtgctgtgattacaggcgtgagccactggcccaatatgacctatatttaccccatcctagcagactaattatttgttgtcttcacttccagtgcttttccatgtctgttcatgtttttatgaagtcacaattctaatattcaattttgtattttgtttcttaacacagtatcttaatattgcttcagtctctgactttttaatccctgcatatgcctaaggatatgctttcatttaataatcctcttattagaaatgtgtgttaatttctggtgttttactagtacataccgttgtggaaatcatctttgtgcatatagtttttacctccctcttgggtatttcataaatttgagatttttgtttatgtggcttgggatctttgttaaactgctgcctgcagagttatccttgaacctaatatggaattgattaaagaaatcttttttatttttttgagacaggatatcattgtgtcacccaggctggagtgcagtgacaggatcagagctcgctgtaaccgtgaactgctgggcccaagcaatcctcccgcctcagcctgcctcccgagtagctgggactacaggcatgtgccactgcactcagctaatttttccttttttttttttttagttgtagagatggggtcttgctaggttgtccaggcgggtctcaaactcctggcctcaaacaatcctccctccttgccctcctaaaagtgctgggattacaggtgtgagccactgcacccagtctaagaaatctttaaattgctaatatgttacctgcaaaagggtgtctcattgggttaaattgcaattctgaaaataatggtgaggttgaccatgataacttctttaaaaatagcataaattgaacctttgtggcaatttcatttaggtatcactgattaattttctttatatggtcctgtttacaaaggtattgagccaagagcttgaaaggatataagaaggatcataccattaagtagttgattgtccagaaattatatctaataattaaaaataccagttaggcaaaattcttacacatgaccaaggagtgttcattctacaaatgcagtgcttgtttaagttctgagggagaagtctttcttgtctagatgattaggagctgcttcccccaaaagtaagacttgagctcagctttaaggagtctctagaaattggctagggagcagacatcactaaagagacactgagccttctcaaggagagagatcagcggtgcatagggagagccccggttgaccactggacagtggggttggtgatgctggcttccttactattctttttctggaagataccgaaaataaatgaactaatatataggccgaaaaaagtacttggaggattttgggagaaagctgtttggtacattcaagtcagcatcatggggtttaatggtaaacacctgccagagattagaatgcagtaggctgcttttttgcctaattatagatcttaactcctttcccctcaggtaaaattcagtgataatttctctaagatgaaggctgctagaccagccttcattcagaataagccaatatcacttaactttagtaaacagtacttaaatttgtattatgtgcaaggccctggtgggggaaatcagagactagaaagctaagagttcatagggaatgaatgtataatgatgcaaaattgtattaataggcaaaatgttagaaatactcaatatcgatacaaaaggttcactctggaaaggaaagggatggagaaattaatgctgagtagagagatctgggtgatatttagggggatttggccttgaaaaatgtgtatgggtgggaattagagtaaagggcactgcatttaggcaataggttttgaaaaagtaaaaggtggcagtgcttgacacataataccatggtcagtcataggcttggagacccaggtgaatggcaatttgagattgtacctttcttcctgtgacttgtgactgctgagccagcctggtgatctctgtggaaatattgtaggtgtaggcccaggctggctacttttaatctaggatctgttgcttgctgtgtgacctttggcacagttactaaacctctctgtgtgtcaatttcccatctataaacagggataataaaagcatctcctttattgggtacttgtgaggattgaatgagttaaaaccaactctgttggttgaggcagtcacctgtccagactcaagaacacttagaagggtggttggtatacagtaagttttatacatgtttgctgttattcccttaatttttgaatttctgaattatagaatttctaatactcacacatagtgtaaataatataaacaacaaagggtttaaaataaaaacaaaactcatcattcttgtctggtcccaactcagctacagtcttggtttaggtgtgataactgctgtttctgtttttagttcttctagtggttattttagcaaattaccccccaaaatttagtggctcaaaaatttgttttatggtgttttggattctgtgggtcagggattcaggcagggctgggctgggtgattctgctgctttcggtgttgactgaggtcattccctggtacccagctggtggatgtgctggtccactggctccaaaaaggctttgctcccatgactattgccttagtgggagtagctggaatgctgggctcagcaatgactgttgagcagagcacctacacatgttgacttcatttgtcttcatggcaactacatgtcttcatggtgacttcagcatggtggctccaggtagttgaacttgtgtggcagcaggcttccctcatgtgttactaagggctctccagagaaacataaccaatagtgtgtgtgtgtgtgtgtgtatgtatatacacacacacaagatttttaaaacaaggaattgacttattcagtttggaggcgggctagtcctaaatactgcattgtgggccaacagatggagacaaggagagtctagaagaagactgaaggaggtctgctggagaattccctccagctcagggaggccggtctttttgtttagttcatacctttagttgtttgcatgaggcccacccacattatggagggcagtctcttttacccatagttacctgatttaaatgtgaatctcatccaaaaacatcctccaagtcaacacataaaattaaccatcataccctgctacgagcaccttgggtaaaccagttggaagcttcatggccttttatgacatattatcagaagttaataacttcccttttgccaaactattggttgtagcacaaaacttgctcaggctcaagcagaggggacatcgacctgccacttgatgggagtgtcaaagaatttgcagtataaaatatactgccagtctatgcttgagttcataaatttgacagtgtctgttaacttcctgctaaggaagaagtggaatttatattccctcacacctctctttcctcttctctctgcctcctggtttttattagatatcttattatttttgccttattatttttagttgtcttcttttggttacctttctgatttaaaataaagcagtccattctttaccaggccgtagagatatggaaaactcaggtttgttgaagggtatggtgttggggagggacatggcagaaaagcagcttcaaatggttgaggcttgacaatgaggctcttgttaaaacactccagccactaaaaatgggaattgcctatgagtgtgtcctctttgtgagcctagcaggtggcataatttgacactttttattttttctctttggcttttaaactcagatacctgtttgcctttttcttccctacacttagcatttaaattatgaatgctggaagcaaatgatattttcaccaatgaagaatcttattacagacacatggttgagttgagtgtttgtatgtggatgtgctgtcagaaataagtgctctcttgcttttttcattaccaaagcaatcagttaattggaaacagagtgtcaggagccctgtaactctgttggaggtgttttgggttttttctttttttggattcatttagttaatacaattgagcaatggggcttagtttaactctcagaacacataactaatccctttttataattatcatccaagaaacatataagaacctctagtcttgttggtttgcattcattgtatattgcagatataacctcttttgatatttgtcttactaataaaatttgacttggttagtggcaagaatgtaaatttgtgtttgatatctgcataatatttttggctaaattttttcagatttctgttgttaattctgactggttcaccctttgaccttgggaaaaaatagaacaaaagcaattagaacaaaagtagatactttgggaggccgaggcaggcagatcacttgaggtcaggagttcaagaccagccatagccaacatggcaaaaccccatctctactaaaaatacaaaaattagctgggcttgctggtgcacacctgtagtcccagctacttgggaggctgtggcaggagaattgcttgaacccaggaggtggaggttgcagtgagtcaaaatcacgccgctgcattccagcctgggtgacagagcgagactccgtctcgaacaaaagttgaaatgaaacataaatactgtattcaccttttctcttttctgtcctcctcctctccttccctccttctcttactccctccctctcttcctccctctctctctccctccctccctcccttcctctctccctcccttcctctctccctcccttcctctctccctcccttcctccctccctctctccctccctcccttcctccctccctccctcccttccttccttcctccctccgtccctcccttccttccttccttcctattcatctcaatagagctgctttttcctctaaaaataatagcttcagggtagccctttttaggggatgggattatccctgttatgagatggttcagctcacttttctgccaaatactccctcatctcctttacccaaatggagccacagaccaatctgaccatcttggtgtcatatccccttctagtcacaactcttgccccgagggtatccttacttctaatatcatagatcaatttagtcagtttttgaactttatgtacctgagatcacagagcatgtactctttcgtgtctagcttctctccatgttatatttgtgagattgatccatgttgtatgtggttatgggttcatgctcattgctgtatagtgttccatcatgtgaatatactgctgttcatcctgttgtccatgaacgttaggtttctagttttggaccagtatgaacagtactgtcatgaatgattttgtatgtattttctggtgaatataggtacacatttaagttagatatatatctaggagtgcaatttttgggccatgcagttcaactggagtaggtaccgtcagagtggttttatcaagcggtattcccagcagtggtgtatgagtttcagttgcaccacagtgcttgttattgtctgttgtcttattttagctaatctggtaaacgtgtgttattgattccctagatgactaatgaagatgaacacctcaaaaagggttcatactttttattttattgcatagcaaagtagaaaaacaaagccagtttgaccgggtgcagtggctcacgcctgtaatcccagcactttgggaggcagaggcgggtggatcatgaggtcaggagatcaagaccatcctggctaacacagtgaaaccctatctctactaaaaaaatacaaaagattagccaggcgtggtggcgggagcctgtagtcccagctactcgggaggctgaggcaggagaatggcgtgaacccaggaggcggagcttgcagtgagccgagatcgtgccactgccctccagcctgggtgaaagagcaagactccttctcaaaaaaaaaaaaaagaaaaaaaagccagttaaagaattcatctagagacattgtatcagttctttaaccactctagcttttctgtttctctacacatttattgtgtttttttgttttagttttatgagagatgtatttcaaggaatttacttctaataaaaatttaaagaacagaagtttatggataactctactagttctgagaattaaggtatttaaaggatgaaactgctcatactgtattactctttcaacttttctaatttgttaactcagtctatttatttttgcctttcactttgacatttttataggagaatttgaatcatgttctatagtttccaggaattaaatttccacataaatgtaaaagaaaacttgagatcctgatgcaccattttttaaagggttttaaaaaggggaattgttaacgtagggataagctatatattgtgaggcttcgatggcagtgctgttaagttcttgtcacttcttagcaaatgaaatgcatagtttcaaggaaacctcacgtgtggtttgatgtgtttgagttcgttttgatttatttcctgttgacattttgagatttcttcctttagcttttattctgggcacctattttatcctctcagttgtttctttttaagacctgtatgcctctttaggaatccaacatgcagctgtcatctagctttgtacttctgtgcatatattccatcttcccttaaatattattggtgtattgctgatcaggggacagacacaaggtggtcttaaatatctgtaaggtacttacaggtgttgtttggcctcttggtggcaagactatgtcctgggtcagattatctaaagggtttttggagaattcaggcttttgaccttggaggcagaataagatttctctgcctccagagacaccaaacttttaactccttttggagttatacttcaggagtaggaggaaagtttgctgaattcctatcaagaaaaggtggttgagagacatgattgaagattgcttaattcatcacagtttctcagctctggcatgaaacagttgggagaagcgattcaaataactgctgatgaaagttgtatattatttttccttttttgaagtttagggaattcagggctagctcccaaatgagatcatgtgaacttagtgatgttctttctggtgggtctttattagagtcagtggggagggaaggggagcggttttggctgtagagtgggatctgaaaattgttcataatgctgggaatgacagaaatgtgggtgcgaagtgcagtgcagagacactggcttgaggaatagcaaggccttttatgatgggcccaggtgggaggggagttactaggttatacttcataggcattcaaaaatacttgttgaatgaatatggatcattttatcagtagcatactaaggctgtcagatctgcatgaagctattgattcactagttatcattatagtggcttagcagcccgctggggggtacctgtccttcaggtgattaggaatttcatgcctccatcagtgtaagtttgaacacttgggttacgaagaaatttgtcctaatgaggtttggccccagatgccctgccaggtgtgcatctgagtgtggtttctattcttcatcaccctctacacacacacacacacacacacacacacatccgtcttgtgttttttggtgggctcagagccacgagggagctattagttatccttccaaaattcagcaagctgtttgtgtttgtttttgtttttgttttgagacggagtctcgctctgtcacccaggctggagtgcagtggcgtgatctcagctactgcaacttccgacggttcaagcagttctcctgcctcagcctcccaagtagttgggagtacaggcatgcaccaccatgcctagctaatttttgtagtttgagtagagacagggtttcaccatgttggccaggatggtctcgatttcctggcctcatgatctgcctgcctcggccttccaaagtgctaggatcacaggcgtgagccactgcggcccggctgcaagctgtgttttgtcgggacggtttcgattagtttttaggctaataaagaacactgtttctttttgtttcttttttaggtttattttagccaacctgaggaaacaaaagcctactgttaggatattcatgggaaaatagggaagccttttttttcctttagtgaaatcctatgtgcctatagagctttttcacactttctagagaaggtaagcatctcttcctgagaaagagtggggataatatgtctgggctcaattctgcctgttgtagggaagggtgtgccggtgggtcaccttttgaggttaagaacgagtaataagaccttgaggattcttttttttttttttttttgagacagagtctcgctctgtcacccaggttggagtaaagtggcgtgatctcggctcactggaccctccgcctcccaggttcaagtagttctcccgcctcagcctcccaagtagctggaattacggagtcccccaccatgcctcgctaatttttgtatttttagtagagatggagtttcacattattggccgggctggtcttgaactcctgacctcaagtgatccacctgcctcagccttccagagtgctgggattacaggcatgagccaccttgcccggccaaccttgagggttcttagccatccccaaatgatctgataaagtagccttagtactgtggaaaaaagtgtcactctttcctgctctgtcaactttgatagcaaaaggaggaaacactgctaaaggggcttgaagtttatatagtttgtgaatcattttcttgggaacttttcaaaagaagtgttgtaaacctctgacctcacatccagtttgaccagataactgtgcttacctgttgaggcccatctgatttgagtcctggcttaaagcggttgttcacatgttgaagtctgtatttaagctccgctcccaggctgggttgtgtcatcccgagcctccccttctccctccttgacccccagtggcccagggcagtttttactttaccgtttcttcctggctttttacctatacttttcggccagacacttcaaggggatctgattcgatgtaggggaggggttcggagcatgggttctagaatcgaaactctactatttcctgcgaggtgtatgttttctttgcttctttgtgtttggaaagaaatattgatattgtcattccgtggtgtttaagtgtgtaaagaggaggagctgggaggaagatgaaggaagacctaggatgtagtatttcctgactataaaactccctaggaaaagtcctcaaagagccaccttgtttactttaggctagaggagcggagaaagggcggtgaccctgtatgacatacagtgaacaagagaggtggaactctggcaggaagtaaagggtagaggcaggctcagggacccaagtcttgtaggaaaccacaactccatgaagcctatatggagtttcttagcattgtctttaaatttttttttttttgttttgagacagagtttcgctcttgttgcccaggctggagtgcaatggcatgatctcggctcaccgcaaactcccccttccaggttccagtgattcttctgcctcagcctcccgagtagctgggattacaggcatgcaccaccaggcctgactaattttgtatgtttaatagaaacggggtttctccatgttggtcaggctggtctcaaactcccaacctcaggtgatctgcctgcctcggcctcccaaagtgctgggattataggcatgagacactgcgcccagtgtctttcaacttttactaggcaccttataattgtgtcttttcccccaaagcccgctctcacgacagcctctggatatcaagatctgtcagccttaacttagtaagtgttctgagtttctctgaacttccaacttctcaggatctgccacaaatttgcaaaaggtggtgttgaatatttttccttcagaaattaagtttttaattcttgtatattttcataggagtagctatgagaggagtcttaactttgggtattgtttttctttggcttctagagaaaagtttgagaggtctagtgattttcattaagttcttttttaagcaatcatttgtgaaactattcacatcctcagatcttggtaagatttccatgcagagcctaatactgaaaagctaaagaagaacctggactttttggaatgatttcgacctctcataaaatcccagacaattacatttccttattttgccaggagactggtatgccagttaagtttataacctcgatccttgttttatcctccatcagttagagattaattacatgcctttggaatggtgagctgttgagccttgtcgtctttgaacctactattgttctcaataaggtcttctaaaggtcagacaaacaagtcatttagatttttctcctccccttaaagcatgcatttataaggcaaaaacttaatgatcattcattccattccattgatcattaaaacagctttaaaaatgaagtggtttcattactcatattagtctagttatgctcagtgacttaaaacaatacattttaatttctagacttaatgagccactccactctgggacatacttatggcagagggtaagaaaagaaatgaccatagccgggtgcggtggctcacacctgtaatcccagcactttgggaggctgaggtggatagatcgcttgagcccaggaattcaagactagtctgggcaacatggcaaaaccccatctctacaaaaaatacaaaaattagccgtgtgtggtagcacgcccctgtagtcccggctacctgggaggtggaggtgggaggatcacctcagcctggggaggttaaggctgtagtgagctgtgatcataccactgcactccagcctgcttggtagagtgagaccctgtctcaaaaaaataaataaaaattaaaaaggaagtgaccagttcattcatagttattaacacttctgcttgtgtgtcacttctactcgccttcacttggctgaagaaagtcatatggccaggcctgccagcaatgtggtagagaagtgtggttaattcttccatctggagatgctataagtcacgtgacaatgggggatataatcctctttcagggaggttagcgaataattgaaaacaatataatctaacataatggaagactatatttaactcaaaaaatttaatggcctgtgttctgattcagaaatagtttttagaattggttaaatctgcactttgggttttattttgaaaagattatgcctcagaaatctgcctagatatggaaaacagggtctagtttttggacaggactgattaatcttttatgaattggagagctgtaccaacaacttggtaactttccattagttgtttcccatggctccagatctgtattttaatcaagaagttacacttcttcctctcttgacttttatatcttgattttgcatgcattgttagtatcctattggtcagatgatttttgtttaattgcctgatttaatatggttttggcagccaattaacagtggatgctactgtcaagagaagggtagagatggggccttttgacagaaataaaatttattaaggcctcatcagtctgtcttggtatttttctttcaaaaatgaaactgatgaactgttgctgatgttcttactaggaaatttctgtcttatataaaagatatgaaatcggaattctttgaagcaagatgacaaaataaagtcatacattgctgtgaggaacagaacgtttgtgcctcaattggttattcaccatctacatgttgagattctttttgtgggggatcttggccatttctgcatgttcaccctcacactcctttttatgaggtgtgggggccatctacttaggcaagagtcttaggtagcttctgtaatttttatgagaaagctgaagtctcttctgcttggttgacttttaaaaagtaggtgcaccaagcctcagctggtgtcagactgctgcacttggggttcttcctgagctcttaacctgcttccagctcttagtgaaaacttgtttttgggagatggtgttcattcatgaaatttcatcaaacactgggcacttggaattctctactttcttttccctccagattctttttttttttttttttttggagacagagttttgctcgtcacccaggctggagtgcaatggtgtgatcttgggtcactttaacctctgccttctgggttcaagcgattctcctgcctcagcctcccgagtagctggggattacaggtgtgcgccaccacgcgtggctgatttttgtattattggtagagatggggtttcaccatggtggccaggctggtctcgaactcctgacctcaggagatccacccacctcagcctgccaaagtgctgggattacaggcatgagccactgtgcctggctcagattcttttattgaatgaacgtctactatgtcttcagcttccattatttagaaatagagaagagtttaagaaacagccacaggcagctcatacatggtgatcccttttgcctctctcagtggcccttttttggagaactgttagaaaagttgctgtaggccttggtattagaaaatgttggcacatttcttgggaaaatgtttgatttgttgaataatgtaaatattgtaagagattgtgatttcctcattgctttgaccaaatttatatcccactgttaaaaagaaatggagaatttcatgatggttatttactaatttaggtctcattttacgattctgttttcccttttgctgaatttatttatttttaaattaaaggtaaatatagttacatctagttttgaaagatgccgcaagtgtttttggaccaaggttgggtacagatacatatatcgtggttccttcatgcagttgaaagttttaagaggactctgtgtgggggagtgcacatacacacagctggatagcactcctaacgctcctttctgtgctcactccgtctctttcatggttttcacaagcagagcatatgctctgtggcatactgggggtactcagtactctgtctcagtgctgagacttggagaaaggcattctttttgagcccttttgctcatgaggaagggggtcctggtgtaccccagggtttgttctccaggcctgggacccacagtggggttgaactggcagaaggcaaagaccataatggttacttctgcagggacagatctggaagggacttcatgctgacttttgggtttttaagttggtattttctgatgagtgactttggtatctcatagaattctgtaaactctaatgcactccttaagcttagcaatgtgtgcctgcctgtgctctcctgaccaccagcctctgacctaccctggttttcacttcattactcctcccttggtgctgacagctcatgggaattaagccagaattggcccaaaagctaaatgcctgcactgctgagctgtggtttcccatgaaaatgccttccctgagttaatgttagccttttgcttgtattgatggataatgcaaaacatgatcatctgtaaggtctcagttcttgatctcttttctgtagacactcattctcgtggtgacctcatcttctctcatggctttaagtgtggttgatattccaatcattatcacatttaggtctccagctctgacttttttctccagttccactctgtaaggcccaactccttccccagtatctacacccgagtgtgtggtggccacctcaaattcaacgtcacccaaacagaatttcttatttcccccaaactccttctccccacagacttctagtggtaaaacccctaaactttgtaatcatcttcactcccctatctcatacaccctacctttaattcagtagcaaatcctgtttcaccttcaaatatatgtagaatctgcatcgtcctccctctttccactgccaccatcctctctcacctcaattactgcactagcctgatacctggactctctgcttcccttgcaatccattctcaacagccatcttttaaaaacaaaagtcacattgtggcactgcgtagactctctgttggctccttgtttctatgggaggaaaagtttttacagtgaactccatggctgtccttgcccggtcccttgttattctgtagcctctcctgtgctcgcccccacctctgctcttccacaggtgtcccttttgcctcccttagggcctttgcactggctccttcctggggctggagtgctctgtcctcacctcagtgaggtccttgctcagatgtcaccatgtcagtgctgtgattattcagagttataacctgtcttctcctggcactccaggtctctcttaatccgcttggcctcttcttttttttttccatatcaaaaattaaccagtattattatggaatttacctattatatttattgtttattttcagcatatcccagtagaatacgggcttttccagggcaggaacctttagctggtttgctggttggtggtacatcaagctcctagaacggaactggaaacgcagaagacacttaaataggtatttgctgttaaatgagctgctgataaggatttactatgctgttcagaacccattatgtgaggaaatatatatttcagttcactgttaggaaaacgtttatttccttgatgaacagggactcccaacttacctgattccctcttctgctttggctaccaggatgccaggaactaagtgtcatgctcagttgtgaaagtgattggcttcaacttgctggtgaagtaatacaacccttcccttcctttcccttttccccagcctttacttgattaagtcgttctgtagttttttgttgttttttttttcttgacaataactctgccttttattgtttgacttttcaagtaactttttggagtgtatgtgtataagaattcaagtcaatcttcaaaggaagagaattcatttattacagagatttgtttatcttagcttacggctggttttattttagctttggccaggttggcaccattgtttcaagtagtatgtcacttattgtggggttttttgtttgtttgtttttgaaactgtgtcttggcctgtcacccaggctgaagtgcagtgctgcgatctcagctcactgcaacctccgcctcccaggttcaagcgattcttttgcctcagccttccaggtagctgggattacaggtgtccactacgacacccggctaatttttgtacttttaatagagacggcatttcaccatgttggccagctggtctcaaactcctgacctcaggtgatctgctggtcttggtcttccaaagtgctgggattatgggtgtgagccaccgtgcccggctcgttactggttttgatcagtgttctgaaatagtaattttgggtatgctgtctctctacaggcttctgtttgattgaatttcatttatacaggtattaacatgcttgtaaactactattgtctattgctttattgctttggttagtcaatcccaaactcttgctgccttttttttttttttttttttttgaggcagagtctcactctgtcacccaggctggagagcactggctcactgcaccaatctcagctcactgcaacctccgcctcctgggttcaagccattctcctgcctcagcctcccaagtagctgggactacaggcatgcgccaccacacctggctaatttttatatttttagtagagacggggttttgccatgttggccaggctggtctcaaactcctgccctcaggtaatccacccaccttggcctcccaaagtgctgggattacaggcgtgagctactgctcccagccaactcttgcttcttaaacccaaggaccctgatttctgacagaatatgtatacatacgtgtgtgtgtgtgtgtgtgtgtgtgtgtgtgtgtatttatttgagacagagtcttgctctgtggcccaggccaaagtgaagtgcagtggcatgatcttggctcactgcaacttccacctccctggttcaagcgattctcatgcctcagcctcctgagtagctgggattgctgggatgcgccgccatgccctgctaatttttgtatttttttagtagagatgggtttcagcatgttggccaggctggtctcgaactcgtggcctcaagtgatctgcctgcctccgcttcccaaagtgaggcatacaaaaagccgtagaatttcatatttttgagctggccagatttgtcaatggctctaataagtgttgcatttttatttaaggaggcatgtggtgatgttagccctgtgatataggagaataagcagcaaaggttgggctggtttccctgctcccctggctgccgtttctccattagaactggaattggggatttcacaaggacctcttggaaaacttcacagttagttttaaaaaaaaatgcatttgtcacccagaggatcaatatttttctaaaatttctaaaataaaggatcagtttgtttctgaaatttggttacctgaagccattgacaaattagttgtttcttattcaggttacttttaattgagttgtgcatgcaaacccacatgtatccctctctgcctctgaggagaatggggcctttcttggagaacacaaaagtaggaattctgattttattttgtgatcttagtcactttacaattataaaaattttggagctaatgagaaacctgaaaaattctgaagtcttcaaggagtgtgatcctggtgctgtctctcaggcatttctcccagagaacgggacggcagagcaatgactgttccccagcccacaggtaggagctggtgggcagcaccagcagcagtagacctagaagtcttagacttagatgtgatttgaaatatggcttttattatgggagcagcacacataagaccatcattggttctcatatgggaaaaacccttgaatattggctctaggacagattttaaggctgggtgtggtggctcgtgcctgtaatcccaacactttgggaggccgaggctggaggattgcttgaggccatgaattcaagaccagtctgggcaacctagcaagaccctttctgtacaaaaaaataaaaattacaaaaaattatttaaatgaaatttagcaatgttttatgtacgtgtcttctcatacttcaaaaagtcaagttgttctacaaaaccgtccatgaaaacagtagctttctgccctgcttttcccacctgattccctctcctcagaggaatctctcatctatcttctgatgttgaaccataagaaaatgctgatatttgactgctttagatctgtgaaaatgactgtatcttgagaaagcatgcttatcatgtcatttcttgatttttttaaattcaattttggatatttactttcctcacactgtggaagatgaagatataactcttatgacttcccccaacacgtctcttctcctgctgtaatattaatatgatttttgtttgattaatatataatgtttatagtattatttagactggaaataattcacagccaagacatgtaatttaaatatttccttcctcatacagcttttgcccacccagagttaatcattgttttgagtgcttgttttaagtacctgtcactgactcattcccaaactgaagcctaaccttcctttctgtgtgtttgcacacctcagggtagctgtccattcatcctttcttcctgaaggcgtcccttctgaagtttccaggccgttctgtaccttctctctgtttctcttccctggatactatggtatcctcctcctttgtggtttcttttggtctctggtttttgtgtgttttttgtttgtttgtttgtttgtttttgaaatggagtttcactcttgtcgccctggctggagtgcagtggcgcgatcttggctcgcggcagcctacgccacccagtttgaagtgattctccttcctcagcccctcaagtagctgggattacaggcaggcgccaacacacccagctaattatgtatttttggtagagatggggtttcactatgttggccaggctagtcttgaactcctgacctcaggtgatctgcccacctctgcctcgcagagtgctggaattacaggtgtaagccactacactcggctgctctctggtcttggtagagagcattggccaacagcttctgcacaaggttacaagggagatagtctccttgagatttggcatatctaaattgtcttttttttttttttcttttaccttcacacttactagtttggccaggtgtacagttctagtttgaaagtccttttccctcagaactttaaagagattgttcccttaagttccagctttttattaaaaaaaaaaaaatagagtttcccctcacttctctttaaaagtttttaggggcggggcgcgatggctcatgcctgtaatcacagcactcctgatcacaaggtcaggagattgagaccatcctggccaacatggtgaaaccctgtctgtactaaaaatacaaaaaattagccaggcgtggtggcgggcgcctgtatagtcccagctactcgggaggctgaggcgggagaatggcatgaacccgggaggtggagcttgcagtgagccgagatcgtgccactgcactccatcgagcctgggcaacagagcgagactccgtctcgggaaaaaaaaaaaaaaaactttttaggatttttctttttgtccaagtattctgattggtctttttgcattcatttttctgggcacacaatggccttctcaaactgggaacttaatgtttttcaattattggaacatttaaaaaattatatttagataactttccctcttttcattgaatttgcattttctaatgttggtggtccttctgggcaatcctctgattatcttacctttttctctcctattttctatgtcttggtctttttattccattttctggtggatttcctcagctttaccttacaaccattttactgaattaaaaaataacttttttttttttttttttttttttttttttgagacggagtctcactctgtcacccaggctggagtgcagtggcttgatctcggctcactgcagtctctgccttctgggttgaaggttgaagcaattctccagtctcagcctctcaagtagctgcgttacaggtgcccgccaccatgcccagctaatttttgtatttttagtagagacctggtttcaccatgttggccaggctggtctcaaactcctgacctcaggtgatccagccgcctcggcctcccaaagtgctgggattacaggcatgagccaccatgccattttcaagctaatatgtctcaatttttttttctttgaggcaggatcttatttgtaagccaggctggaatgcagtcttatgatcactgctcactgcagccttgacctcctgggcttaagcaatcatcccacctcagcctcccgagtagctgggactacaggtgcataccaccacgtccagctaatttattatttgttgtagagatagggtctcactatgtttcccaggctggtcttgaactcctggactcaagtgatcctcctgccttggcctcccagagtgctggggttacaggtgtgagccactgtgcctggcccatggctcagatttaaaagatgtaaaaggtgtatagtgaaaagccacccacttcctgtactagctaccatattctctctttacaggcaactggtattcctccttccagagataactctgttaatatatatatatatacacacacacacacacacacatatacacacacacacagacacacacacacatatatacactttttttttttttgagacggagtcttgctctgtcgccaggctggagtgcaatggcgccaccatgcccagctaatttttgtattttcagtagagatgggctttcaccatgttggccaggatggtgttgatctctcgacctcgtgatccacttgccttcgccttccaaagtgctgggattacaggtgtgagccaccgcgcccggcctcatacatatttttaaaatgtgtgtatatgatcatattctctctccctgtgaaatcacagatgataatagacttcatatattgttatgcatctttttttcatagaaccatgtgtcttcagactgctccatgtggaggtatgggtttctttttaaaatcattttaaagagcagcatagtatgattttaaactccatattttgtttaatcagtttcctattgatttgctacatccaacaatgctgcaaggggtaactttgtacgtgtattatgctcacacgtgatagtgccatgtgtgatgaatatggaattaccaggtgaatgcatatgtgcatttgtacttctcacagatgttactccagctgcctttcatggaagctgtgctaacttatgctctcacaggcaaggcatgaaagcacttgtttctttatatcgttgccagtacagtatgttatgacatttcttaatctttaccaatctgttaagtaaaaaatggtatctcatctgtttttaatttgcatttctcttaggagaatgagcatattttcataaatttataagagctgtttgtatttgtgtttctgcgaactgttcatatcctttgccattgggctgttaccaagttgtatgacattatacctaagggaaataagcccctcatgtgataagaattggagttgtttgcagtttgttcatcttttgattcgggttatattacatttttccatgttggtgaatttattagcagcttattttaaagtctttggatttaatatcatgaagagaaaaaggcgttccccatcttaaaattattatttttaaaatgtccagggtttcttttggtacttttgtagtttcaatatttttatatttaaattatttatccatattgaatttattttagtacatatggatccaagtttactttttttcccagatggctactggttttcccagtcatttattaatagtccattttccctctgactaaatcccccatgcctatgtgtctgtttcttgacttctgtttcttgacttctgttgtgttgctctgcctagctctgtgatgttgagctattcatgttttagttgtgacactattctaattgttaagaatatgtttgtattagggaggattgggcttgtattaaatattttattgttgatgttaattgtcagttttgtagtggtatttaaaaatgaattatgtggctgggagcggtggctcatgcctataatcctagcactttggaaggcccaggaaggtggagtgcttgagcccaggagttcaagaccagcctggacaatatgatgaaactctgtctctatgaaaaatacaaaattagccagacgtggtggggcatgcctgtagttccagctacttggcaggctgaggctgcagtgagtcatgattgtggcactgcactccatcgtgggtgacagagtgagacaacatctcaataaaataaaataattttaaaaaatgaattatgcaaactttaaaggaaactgatcatattttatgtaactcaaagaatgtttagggacctaggctggtaaaggtcagagttttctaactcaaggtttgcttccttttttttttaaatccctccaatgagggggaaacagatgctaaaacaatagtgagaagtacttaattggctgggtgtagtggttcatgcctataatcccaggactttgggaagcccatgcaggaggatcacttgaggccaggagtttgagaccagcctgggcaacaaagcaagaaccttccctctataaaaaatacccagatgtggtggtgcgtgcctatagtcccagctactgaggagactgaggtgcgagggttgcttaaacccaggaggtggaggctgcagtgagctgtaattgtacccctacactccatcctgggtgacagagtgagaccctgtctcaaaaaagtaaaaataaagtagtacttaatttgggatcaagatcggcttacaaatcagaacattcaggcttgaggaagagaaaaagcaattaaataggtcaacaattgcaaagcaaaactcaatttgagagttggataaagagatttgattgtggggactctgtcatttgagatgcaactcttggtccagtctcaggtgatgaaaatacagcatcagtagttaactggagtacagcagcattggtgcctttctttctgtgaaaaaagtctttatttgcctaagatgtagaaaagagactgtagtgaaccagagaccattttattctgaactgtggcagaataaaacgccttctggcgtctgtcctcactgttactctgaaatagcccatatatcgggaaaaaatgtggctgcttctgtgtgtgtgtgttgtgtgtgtgtgggccagattgttgttgtgttacattgtgataccaagagagaagagaacttttgtctagatgctcacctgagacatccacctggcctccaagcagcatgcacatgagtgaggaatttcaacaacttgtttttttcctgtaagataataagtgtaaaacattcattggacatgagcacaaacacagaggcgttatagactagactgtaaaatcgtctgtgggccactctgagcccctgtggtcagtcctttccttggatgactctaaaggggacttgggccccacttaggcataacggtgaacagagatttaaaaggagtttgagagcattcgtgtacagagatttaaaaggagtttgagagcatttgtctttttttttttttttttttttgagacagagtttcactcttgttgcccaggctggagtgcagtggcaccatctcggctcaccgcaacctctgtctcactggttcaagcgattctcctgcctcaagcactttttttttttttttttttttttttaccatttcaatcattttgagtgtatagttcattgatgttaagtatgtttacattgttgtgccaccatcatcaccatccatctccagaactctttcatcttcctaaatagaaactctgcacccattcaacccttaactccccatttccctccactccctccagcccctggtaacaaccattctacgttctaactgttttatttttaaatttagacatatagttgatactcagaagcttaacattccttatatgaaagtcttcaccaagctacttggcgtgagcatcttatttgccctttaagccttaccctgggaataaaatatagcctttatcactgtttttggaatatcttggaagtgcgtaaaactgcttcagtttattatgtagaagtgcatttccagatttctggagtgtggatcgaagattttcataccagcagtagggtctcaaccttgtttttcttatctcttggcaagaaagcaaagctggccattggggtataataaaccttgtgtacacagctgcaggagggaacagggaggtggctgtgcttggaggccgggtgttttgccgacgataatggggcatctctggcaccatgttgctggtcggaacagttttggagttggattttgtcctgcagtgatgtctttgaagaggaaagcacttttgaatatttgcattgctttgaagccagtgccatggagatattgtgacttattgccagtcagaggcaaagctgagtgtgtgaggttttgaacaaaggttgttgaaaaaaggagataatcattaattttttcagtaaaattcattgaaccccaagggcaatttggaggggtcatagctgtttttagaatctgttgctaatcactgtatatcgtagatattaagcctaggttaagagcattagtgtgggtacagagtttagatttgccagtttgtgactttaggcatgtttaacctttctaagtctgtttttccatctgaagaatggacatagagaaaatttatcactgggctttttgtgggggacagatgaggtaaggcataatgcatttaaagtggcaggcacagtctaaatactacctagtgctcctgcacaggcatagaaaatggaaaattgtttatatattttaccctcctccaaaacactcttagaccatctgatttttatttgacttatctgaatcctgaatagtttttactggatcatactctggtatctggactgtccctggtttgaaggtggtgctgctgggtgagaagccaaggatgagagaggctgtgttttggaggcccagtctgtcaaaactgaggtggcatttctagttcctgatagagtgagacagatgcaaaggtcatgggagctttgaacagtttctatgcattatgtgttgtttttcatcttctggaagtgggctggaatttgttttcagcagctaagttcattatgtagttgcctctaagccatgcctccccttttccatgtttgtgaaaagcaaaacaaaaccaccaggcacattatcttttacgaggacctggagattgactagctgacacccccagatttcacatttatgttgagataaggagaataatgtaagtcacccagactttttgtcattctgcatttttattcacagggatgaacagaagcttgcagattgggagaaaggggggggcagaaccagttgttttcaggtggacccaaataatgcatctgctttgataactgcctatctcgatttgcttggaaagggcatagagtaataaatagtttgtgggagtgtgaagaatgagcctttagactgacccaacttgtggaaattcagaaaatgcagaaatgtacgttcttccagcttgtgaatgttgaacaatggaattgttagaagaacttttgaaacttgttctttttttgaaagtattattgtgctcggttggctacatgtgctttggtctcaaaaatttgtgccttaatcacattgctggggaggctgtggatttcactatcaacagaaagtaatgtaagatgtgatatcttttcagcaggacctaaggagattttctcgaaagaaaaggggaaaatgccgctcttaagcaaaaaatctggaccatgttggcagacatacgtctttgaaacataccagcagagaattatttaatcatttgccccttagttttatcttgatcactcctagcgtgattttttccccctcttagttatgcagcagcctactggctgacatttaactattgattgttcatcctggggaatgaattactgtgatttatagtcaagggtacagatgtaaagagacagaaaggatcagatgtttctagtgccttttttcttcctctgatggcttctcccagaaacttgataaaagcaccaacactaaaacatgtttacaataagaaagctgtttattcatcttaagtagaaaattctataagtttatgtaaaattttgcccatgtgggaacaattagtcttttaatttgagttgtgtattgtaattccatggatggagatgggtggaggttgggccgaggggaagctgaggtaagaagccagaccagagaatttaaaatgatgtctttctttgaggatgccccctttgcccctcctgctgggcctcgcagccgtgggattggccacatcacttcctgtccaagttggcactgagagtggcacagtaactctgcccagtgttctcagactgcagtgggcaagtttccagcaatagagtcacccaaagaaacaacgcagcctcctttttttctttctctgttgcctagggcagttttcctcagacctcagtacctatgtcccttgcttttggaataaccccattaggtccccaaaccttgcctttgatgtatgtggcttcttgaggatcccctacatttgcatctgtttccttcccttatgcaaaggccctacgtcttccctgggagaagagtcctcgggggctttcctgtgggagaaaggaaggatctattcctgcccacacttctttctctccagatagagaaatagctcacatttttggtgcctactctgtactgggcactgtactgtgagttttcatgtgtgacctcacaggtactatgatcatctccaagtgacgttcagagaggtggtctgccccaggtcacagggctaaaattagtaacatgtaaggaaaatggctttactctcagcgtgagatgaaacagacaatacagtacacctgctgagtgacagagttgtccctgagttgttagggcctttgcccgccttggagctccacttgcttggtgcacagtaggcagcaaatgggctgtagaatcatggtatttgtgatttcctgtgtccttgacagttgagatattctctaaggctatttatgttctctctaccatgctcgtcacaagcagtcttctgggtcctcacaagcagtctttattgtttatatttctattaacaggtctgttcaaggcaacgtaaacctttcctaccatgttcctcaaaattcttccaagctccttcactacccaattccaaaaccacttccacattttttggtatttgttataacagcaccccacttccaggtactaaagtcttttagttttctattcctgctgtaataaaacccacaaatttcatgcttaaaacagcacgtgtggggcgcggtggctcacatctgtaatcccagcacttcaggaggctgaggtgggcggatcacttgaggtcaggagttaaagaccatcctggttaacatggtgaaactctgtctctactaaaaaatataaaaaaaatagccagacatggtggcgggcacctgtaatcccagctactcgggaagctgaggcaagagaatcacttgaaacccaggaggcagagtttgcagtgagctgagattatgccactgcactccaacttgggcaacagagcgagactgtctgagaaaaaaaatacacaaaagcacacatttttttatattacagttgtgtagatcagaagttggacacaggtctcactggaataaaatcaagaagtcagcaggaccagttccttctgaaggttttggggagaatctgtttccttactgctgcagcttctagaggttgcctgtattccttggcttgtgacccgtttcttcatcttcaaagccaccactggcaaatttagtcccttttacgcctgacatttcttctggctcctcttatgtgatcccatctttctgtctctgaccacagaaataaaagactttttaaaaagactcattagattgggtccatctagataatccaggaaaatctctccatcccaaagtccttaatcttaatgccgtctgcacaatgacttttgccatgaatgtaacatagtcacaggtttgggaattagaagttgggcacctttggggggcgcatttttctgcctgccacacatgataaggtgtagacacaatacagttaactctcttagttcgcagtcggcacccctttaagtaaagtgtgtggtttctaatcaagcattttattcagggtgcatctgttccacctggctggcagcacgcaccttgcaggtcaggtgtgagatgagcaagacccattggaagactggaagctacctccttctctcttttaggacaaggaagcgagagagaagcgaggagaccacttgagttgtgactctcctgcttatggtgaaattaagaactaaaactaaaacaacaggaaccctttcataacggaaatactgaagtataaaatgaaaccacctcctaaacaactctttttcctttgaaaacaaagctaagctgcgttgatgcttgcacctctgctcttgcgtgggaaaattggacccctctgtgacatttggtatgttactgagcagggttcccttggggaggacgagaagcctcctctccacttgacacttggaatttgataccagttcctgtctgacagctggttagcctgtcaggccctcacaagttaaatcttgtctcagaaaataatttgctagaagatcaaagcatggatgggataaattaatttttcaacaagccacaggtttgggataattgtctctcaagtgttgctaatgtctttgataaacaagtaatttgggggggctctttttttctcttgagattataaatcttgattgattcatatgttgaaaaagaactctgaaagcttgcacctaagatgaagccctggaataacctgaaataataataataggtatatttcaacacctgtgccattcggagcagtgattctcaacaggtgggggtgggagatcgatttttgccccccaggggcatttggcagtgtttggagacatttttggttgccatgattttggggaggggtgctactggcatctagggagtagaggccagagatgcccagaatagcccacaacaaagagttatagaatgtcagtagtgctgaggtggagaactcttgattgagaaaggagtgttttctattttacttattttcgtgtgtcttaacactattcctggatttaatttctttgaggatagggtccatccttttattttctcactcaacacaacaagttgccctgagtaggctcaaacatttatttactgttgattcccctctctcttgttaagctattcatccttttttttttctgtcttggagcagagctattgagggcagcactgaaaagcagatggtagagctgtggcagaatcaacatggttgggagagcggaaagaacacaagctctggacttctctcagccccttctttctcgtctgtaaaaaaaaaaaagttaataatagtgcccaacttaggatgattgtacttgagaaagatcgtgttgcaaaaaatggggatgtagtaagtgctcagtaatgccttctcaggcagctgagcaggagactgtgtgcaaggccctctatctcagggccctgtttttttgtaaaaagttgagtaaaggaggggcagacatcttacacatttcagaattgttatcagttctccaggaagaagagggaaagaaaaacatttatagcatttcagtaaagattactccatgattgacaaaacaattttgaggatcctaagaggcacattctgcctcaggctggagcagtttttaaaactaaattgacagcaactagttcaagttggaacagtcctaacttaattatagatacctgcagaggttccttcaaacaggtgggtttcaacagcgtggtgctatctagcaaaagctattgtttgcttagttatttgtttgagagtcagcttagaacataaggaaggagtcagagttggggtggaattctgtctctgattggatcagagcctccattttcctaattgtaatatggaaataatgattgtccctcagaggatggttataagggacaacatatttgttacacatttggcatagtaagtacttcataaatgacacctataaaagtttttgtttgaaaattttccagcttttgttttttatttatttattttttgagacagtctcactgtgttgcccaggctggagtacagtgacacaatctcagctcactgcagcctccacctcctgggttcaagcaattctcctgcctcagcctcccgagtagctgggattacaggcatgagccaccacacctggctaatatttatatttttggtagcgacgggatttcaccatgttggcccagctggtcttgaactcctggcctcaagtgatccacctgcctcggcctccctaagtgctgggattataggcatgagccatcatgcctggctgaaaactttccagtttttaaatgtcatgcatgtttttgctcaagaacgctttggctgtttggggcattttgtagttccatacaatatttttttccgctgtaaaaaattacattggaattttaataggaatagtattaaatctgtaggtcacttcggggagtatgaacagttttaacagtgttaattcttccaacccatgaatacaggatatctttccatttatttatgtcttcagtttcttttagcaatgttttatagttttcagcatacagatctttcacctccttggttaaatttattactaagtatttcattctttcttttttttgagacagggtctcactctgtcacctgagctagagtgcagtggtgcgatcacagcttactgcagcattgaactcctgggctcaagtgatcctcttgcctcagcctcccaagtaactgtgactgcaggtgtgtaccaccatgcctggctgatttttaaatttttttgtagagacatctctgcgttacccaggctggtcttgaactcctggactcaagcagtccttctgccttggcttcccaaagtgctaggattacaggtgtgaaccattgcacacggccttattctctcttgatgctattgtaaatgaaatcattttctttattttttagatagttcattattagtatatataatagaagtgctactgatttttatatgttgattttagtatcctacaacttcactgagtttattctaacaatcttttggtgaagttctgaaggttttctatatataagattatatcatctgcaaacagagacagagtaacttcttgctttccatttttgatgtattttatttttcttgcctaatagctctggctaaaacttctagtactatattgaatagaagtggttaagagtgggcatcctgttttgctcctgatcttagaggaaaggctttcagctttttaccactgagtatgatattagctacgggcatgccgtatgtggcctttattatgtcgaggtccattctttatacctaatctgttgagagtttttatcatgaaaggatgttgaattctttcaaatgatttttatacatctattgagatgatcccttgatttttatcctcgattttgttaacgtggtattagttaattttaattaatttgcatatgttgaaccatctttgcatcccagggataaatcccatttgttcatggtgtatgatccttttaatgtgcttttgaatttggtttgctggtattatattgaggatttttgcttctctagtcatcaaggacattgacccataattttattttcttgtagtgtccttgctggccttgcaaaatgagtttggaagggttgattccatcctcttcagttgttggaaagagtttaagaagggttggtgttaattcttctctttaaatatttgatgaaattcaccagtgaagccgtgacatcctgggatattctttgttgagaggtttgtgatttctgattcaatctccttacttactattggtctcttcagattttctatttctgtattattcagccttggtgtaagttgtatgtttctaggaatttatccatttgttctaggttatctaattggttggcatatatttgtctatagtagtatcttatataatcctttgtatttttgtggtatcaattgtaatgtctcatctttcatgtataattttgtcttttagttcagctaaaggtttgtcagttttatcttttcaaaaactcctggtttcattaatgttcatttttttccttctgctgactttgggctgttccttttctaattccttgaggtgtaaagttaagtgtatttgagctctttcttccttaatataggagttgattgctgtaaacttccttgtagtgctgcttttgctgcatctcttaagttttggtttgttgaaaaacgaaaaaaaaacacaaaaaaacagagagctggaggcatcatgctacttgacttcaaaatatactaaaaagctgtcatcaaaacagcatagtagtggtgtagaaacagacatatagaccaatggaacagaatagagaccccagaaataattcatatttacagtcggttggctctttgacaaagttgccaagaacacacaatggggaaaagagagtcttttcaataaatggtgttggaaaaactgggcatccacatacagaaaaattaaacccctttctcacaccatatacaaaaatcaactcaaaatggactaaagattgggggcatggctcaggggtagaggatttgactgcaaaatggactaaagacttagtaagatccaaaagtataaaactacttgaagaacacacagagaaaaagcttcttgacattagcctgggcaatgatgttttggatatgacctcaaaagtatcacagaagcaaacatagacaaatgggattgtgttaaactaaaaaaaaaattctgcatagaaaaggaaacaaacaatagaatgaagagatggcctgtagaatgggataaaatggttgcagaccatacatctgataaggggttaatatataaaatatacaaggaacccatacaactcaatagcaagaaaataaataaccggattaaaaaaatgaacaggccgggcgcggtggctcacgcctgtaatcccagcactttgggaggtcgaggcgggcggatcacgaggtcaggagatcgagaccatcctggctaacacggtgaaaccccgtctctactaaaaatacaaaaaattagccgggcgtggtagcgggcccctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaatgaacagaggaccttaatagaaatttctcaatagaagacatacagatgaccaacagatacatgaaaagtgctcaatatcactaatcagggaaatgcaaattaaaaccacagtgagtggccagatgcagtggctcatgcctgtaaatcccagcactttgggaggccgaggcaggcagatcacttgaggtcaggagttcaagactggcctagccacatggcaaaacctcgtctctactaaaaaatacaaaaccacagtgaggtatcatctcacatctactagaatggatattatcaaaggcaaaaggtaacaagtgtgttgggaaaatgtgagataaagggaccctcttagactgttgatgagaatgttagtacaaccaatatggaaaatagtatgagtatggaagttctgcagaaaataaaaactgaacttccatatgatccagcaatcctacttctgggtatacatccaaaggaattgaaatcaaagagatacctgtacttctgtgtccctcgcagcatgattcacaatagtcaagttatggagacagtggaagtgttcatcagtagatgaatgggtaaagaaaatgtggtatatgtgtacactggaatactcttcacccttacaaaagaagaaatcctgtcatttgcagcaatatagatgaacctattcataaatgaaatagccaggcacagaaagacagatactgcattttctcacttatatgtggtatccaagaaagtcaaactctcacagaagctgagagcggagtggtggttgtcaggggctgggagatgagcggtgcttgggagggcgttggttaaaggtaaaaagtttcagttaagttaaatatgttctggagatctattgtacagtgtggtgactgtagttaatgtatacttggaaattactaagagattagctctcaaatgttctcaccacaaataagtgcgaggtgggtatgttaattagctagatttaatttcacgaggtctatgtacatcaaaccatgtatattgtaaatatatacaatttttattttttaattataaccttaataaaagtgggaggaaaagtgataaacggtaataagcccttaaaggtaataagttaacttgtcacccaacgtatttattaatttttctatacaatgtaatgtgcttggagaacattgaggccgggcacggtggctcatgcttgtaatctcagcactttgggaggccaaggtgggcggatcacttgaggacaggagtttgagaccagcctggccaacatggtgaaaccccatgtctattaaaactacaaaaaaaaatagctgtgcatggtaacgggcgcttgttatcccagctactcgggaggctgaggcaggagaattgcttgaacccaggaagtggaggttgcagtgaatcaagatcacaccattgcactccagcctgggcaacaagagtgaaactctgtctcaaaaaaaaaaaaaaaaaaaattgaaaatccgcaagcttcagaagacacactactgcgtgtttgtccttctacggaagtcagtacagatctcaatgacttgttctcatttcaccagaaaatgaccattgtgcattatgctgtcagtgcagatggaaaactagcagcagtttacaaagtttccacttgaaaaaacataactctaattgatttaaaaaagtagttgattgttgcaagacttgacatttctctagttaatttctatgcctgttgttttgccccttaccgtcttcaaaatctgaatccaaatccagggcttctctattaggaggctccatatcatatctctttaatcctgataatttctcagttttttgtttcctacctacctggctattttcttacgctatctttatttgcttagtaaatataacatttcatgttctattttattttattttattttattattttattttttatttttgagacaatgttctgttgcccaggctggagtgcagtggcatgaccatggctcactgcaacctccatctcctaggctcaagtgatcttcccacctcagcctcctgagtagctgggaccacaggtgtgcaccaccatacccggctaatttttttattttttgtagagacagggttttgccatgttgcccagactggtctcgaactcctggaatcaagcaagccaccccccacttggcctcccgaagtgctaggagtacaggcaagagccactgcacctggccctgttaacttcttatgtcatttccccactttaatatatttgagggctagttctgtgtcatgtatgtattttaacatcactaccgcatctggtgcagagaggggcattctgtagtcttcgtacttcttatcttcactattgctgatgagccataacaaatttgagatgagcaattaatagatggaccggccaacaaacactatgtggaggaataagtgaggccaaagctgatggatgatgcaaagtgaggacgtaacatatttcgctggggaaccagacagatatgcagagtaagcgctctgataggggaagtacgggctgttatgggcgcttcatactgggaacattaatgggaggtggaggtcgtagttgaagctgaaacctgttgggtgaggtggagttcgccaggtgaagtggtagacttggggaagaggagaggagggggagcatcctgtgtttagaaccaaagagagtttagtgtgtgattattgggtgggggtgggagggtaggtcataaagggcctggtaaactgttaagaaattttaaactttatctcaagagttgtgggaaatcactggcaagttttaagttggtaggtgaagtgctggctggaggaatccctccagcttgggtatgtgaggatggcctgagaacggaggcacctgcagtaatcccccagtgagagacactgtagcctgagctgaccttggggctagaaaaaggggacaaatggcggctgaggaggagaatctctgtgagttgattgaatggggagaggcaaacatcaagcccagtgcccagacttctgggaggatctggctgctactcagtatggcggttgaggaggagaatctctgtgagttgattgaatggggagaggcaaacatcaagcccagtgcccagacttctgggaggatctggctgctactcagtgaaaggaagcctgggaggtttgggagggcagatggatgagctcatttatggacagattgagttcaagcatctacagatcattgaaggggaaatgtgagcttgaaccctgcatttgaagttcagaaaagagaaagagcagaatgaattgagttctgggagtctttcccatgtggatagtaactgcagcggatgaggtgataagatcacctagttagaggtgggggagcagaagagggcttagggcagaactctgaagagcaacctgcaaaggagactgaggaggaatggacagaaagggtggaggaaatcttcatgggtgcttttcaaggaggcagtggttaccagcattagctcctgcagagccaagagaattgagtcattttgctgggcttagcaacaagaactttcagggacttcatggcagcgtgacagcatatggagatgcagtactgttggcctgtacagagcctttttttttttttttttttttttttttaaattccctgagatgtagtctcgctgctctgtcgcccaggatggagcgcagtgactcgatctcggctcactgcaacctctgcctcacgggttcaggtgattcttctgcctcagcctcccaagtagctgggattacaggcatgcaccaccatgcccggctaatttttttgtatttttagtagagacagggttttgctatgttggccaggctggtctcgaactcctgacctcaagtgatccacccgccttggcctccaaagtgctgggattacaggtgtgagccaccacaccctgccagtacagagcctttgaagacattagaaaatgtgtgcctttctggatggacacagtccctggcttggtgagtggaccgtgcatgggacttcagctcttatgtgccaccttagctgggtgcacttgtttagtgtgcagaatacaccttccatgcgtggtggcctaggatatatctgcacttctcaatcgaaggcaatgttgcctcccagggaatatttggcaatatccgaagaaatttatgattgttatagctgaatcagagagggtaggtgctactgtcatctagtgtgtaaaggccagagatgctgctaaacactctgcagtgtccaggacaacccctgacaacaaagaattatccagccccaaacaccagttgtgctgagaaacgctggtgtctgtgaccctttcaggctcatgggaaaaggcggtcagagagggtgatagctggaggtgggtggacctgagaacaggctccttacatactttgctgcagtctcatttgcttgtggcagttttcaccttgcctctcctacctctctaccatagaactcttactcatcatgttataggttttcatttgtttattcttatgtagccattttcactattccctctcccacccccactcccccaagcagtaaattctgtaatgcaaggcaatcttgtgtccttatttctgtttctgggcacactgtaaaacatctgtattttaatagtatctgtcaggaaattctattttggcaaccaagtacgggctaatctaaagtagcccatacttgagtgctatgttgataaggctctaatgcatagttagccccttgactgtcaggcttggaaaaaagacaggaagtattccttgtctttggaaatgagcctactctggctttgggaaggaaagagtacaaatggttctcaccagatagggttgcagcagctctcccagcattttgggaacaaatcaggtcattatctcaacaatgtcaaaattgtgttcccagatcggttgttgtttgaaacatttggggctgatgcggaggaggagaattaattagcagctccctctgttggtgttctttttcagccttctcacattgcagcacgagagtcccttagacatgctggctgctcatttgataatctgtgttttgctcagtacaaaaggttgctggctaagttttgtgagcccctctaacgtcaggctggcagtatcttgggttcaattaacaagaaagtctacagtaacattttgtcaatggggaaggacttgaattcacagaactgtctcggaaagccctgggtaagtttgaagagcaaagttgccttttctgttttcagaaatattttaccccgcaacgatgtgtaaatctaaagcctgtgcaagaatgaaaacgagcttgagtattaagatttggcacagtgtgtgcaagcaatgagactgggttaaaaacaggaagtgtcttaatttaaagatggtgatggggagacggattaaaataaactgctggccatgttgaatctgagataggcaagccttggttgtgggcacattcccttctgaattactctatgcagatatattttaggcctctttctattaaattgtctttcacatggtttcaaagatagggctagtgataagaattctcttcctgcatggtgggtaccattatataaacggtatgagcatgcttttcttgtgtctctgtataactgcttggtctggcactccacaaaatagtaaaacacatttctgcagtggactagcccatgctgtgaaagaggaaggtggtggtggacaaaaagtggtaagttttaggctgaaggatgttgatgttaaactttatttctgattatggcagtctttcatcatgtaatttaagaagcctgagatcatctgacttttttttatgttttttttctttaggactgcaggaagtgttgataaacatctgtttaagttgtctataccatgaaatccataatcttccttcataactatgatagcatatggttttctatagttaggaaaactatttctcatgtatttcatggtttggccaaatccttttattacattagtactaaaaaattccttaggatttctagagaaaataatatgtattatggataaataagggaaagtaagataattcttaaaccttagtatcagcagtcattctaaaccacattacacatcttcagtaaaagtggttacaaaagatttttctcacttcaaaagatccgccagggaagagtcccagctttttcttggtgttattttaggtattaactcaggagggcttcctgaaggtttgtcagtgagatagttggggggttcctgagctttttattgttgtacgtgaacttggtacttacttctttggcttttaaactctcagcagcacgtacagatgccctcacatgctttctgggatgactttaacgctaaatagcaggggtgtttctcaagaatgtttaagaaaagaaagcagacatttgtttgcacaaacagatatttgtgacttctgtgaaaaaattccaatagttgtaatataggaaatttttataaacaaacacccctaccaactaacccatcgtgtatttttatgtgtgtatagaaaaaatgaaaggatatactaaaatgttaattgcatagtttctctgggaattgaatttaattaaaatttttttatcaagatttttaaagttttataatgaccacgttatgtttatgtaataaaaataaaatagaggctaggcacagtggctcacacctgtaatcccagcactttgggaggctgagatgggaggattgcttgagtccaggagttcgagaccagcctgggcagcatagtaacaccctatctttatttttaaaaaataaaataagagagggggacaataaatgcaaatatataaatgacagaaattttatggtctggtcaaagaactatcattgcatgaaattatagatatggtcatgtaaggttaccttttttcattataattccaccaataattctaaagtttcttttctttttttttttctacttcttccacagaaaaacaggacaaagaaacctgtgtgaattttcagcttttcaccttctctgattttatttcttcctcactcttcctttgacagtcctcgcagtccgcctgagagagtagagaagaccccctcccagaaccttcctgtaaggtctccccgctgacttcctgtagtggatgtgactgtgtgccaggtgcctgccgaagacccctgtcactgactgtgccctttgggaaagagtcaacaatggcctcctcctatggctgacttcgttcatgttcaggctctccagcttgctagtgagaattgccaaggattggttcatggcaggatagaactaaactgatagatgaaagctccacagtgcttcaagacggggtcccgttcatgttaagcagttttccttccttcaaaataaaaaactagcagtccttagggaggacagttttttccttccttttcctattctggctccaacagctgtctcaacacagcccgagatggggagcagcctggcttccaccggcaatagctgtattgtgggagtgtgaaagagaagccaccttttcctccctctgcccaagccacctggcccctttgtcctttctcctcctcgtcctctgaggtatgagtggctgtgactgtatgacataggaactatgaagcggggtgaggggacggtttggtgcgtaaatcctcacgcaggtggcggttattgtctgtgtggaggaaataagcccggttcttcctgggactgctttcatttccctctagcttccagagggtaaaatgaaccttaatggaggttggggggtggcacgcacaaagtcctgggttgagggggcagtggtcagaaagttccctagggtaatatacaaaggagaattaacactggggacactgaggtgggttttggtcctttccacataactgacacctttcaaagcaaggacttgctttctcgtgaggaatgtcagcagtcgcaacaccactgggttggatgcaggataattattcagaatcacgagttacctgtttgcaagcaatcacattgcaggtgggataaataagcagacagtctgtggtaggttcccccaccccaaccgcctcccctccccccagggatactgtaattttaagtattgttttggatattggtaattctaaagctccaatcttaactgggttttatgaaagccgttatagggtgtttattaccaaaaaaacctccttcttatttaataatacagtgcctagccactcctttttccctgcatccgtacatgaagcctgattgcagatctcgaacagtatatttctttgagctaaacagcaagaacagataaggtatcttatcaaaacaccacgccaggtggcgtggctcacagctataatcccagcaatttgggaagctgaggtgggaggattggttgaggtcaggagtttgaggccgcaatgagttatcgcgccactgcactccagcctcagcaacagagggagaccctgtctctaataaaacaaaaacattacaccattgtcagaaagtgatttgttcttctttgttggattaaattctctcacgtgcaaggtagtggccagcagcctaagaagatacacaagctcttcactgtagatgtttggcggtgtgggagttacaaggttaattatgagcgtaaggcccaggcatcttttcttcctaacaatttcatttcatcctatttctttttccattctttctccgaactgtctatactttattaaagtcttctttttcccagactccagaataatttcctgtgatatgttttagcagtttctccaggaaaaggctccaggagtctttaaatccagccctctttctgctgtatctttgtgcctcacatcttgagagaagttgagtggtagaaagtaaaggaaagcagaaaaagagatgggtcagggaggaaagccaagatggaaaatggatgggaatgaatgaggaacatgatgtgggttggggtgtcaattcatggttaatacaacatgtgtggctcagtataaccagattgtcataagaagctcaggcagctctccccctctgttgcctggggcttttcgcagttacaataaaagtggaaagatgaagaataagggcaagcagaagacacacacatttgcctgtttccctctttttgtccagattgagtagatgggaggcagggctgttacccatgatggtgtttcataccagagtcaatctactagtttgcttggttttataggcgtgattcccaaattttgaatctgaagttagctgtcagtttaaattcagagggtccgcagttgtttttcaggtttttcttgattctgcctttggaaaccaggaagatgttgaatttacttttcatctgacaatattgcacatctgtgaacccaactgatctgaaagtgtttacctcttaactctgtgaagttagctggttattctggatggctgggacaatggtgaggaccgtttataatggttactctcacctgtgctccagacgctccacttggtgctagaaatacagcagtgaacagacatggttcttgcctccacacagcttgcagtttagtagggcagactgacgacattaaaaagataccatcggtgttgttataatggtgataagagttacaaaataaggggccaggtgcagtgtctcacacctgtaatcccagcactttgagaggccaaggcaggaggattgcttgagcccaggagttggagaccaccctgggcaacatagtaagaccttgtttctacaaaaaaaaaaaaaaatcaaaaattagctgggtgtgttgatgtgcacctgtggtcccagctactcaggaggctgagttgggaggatcacttgagctcagaaggtcaaggctgcaacgagctatgatcgcaccactgtattccagcctgggtaagtgagaccctgtctcaaaaaaacaaaaataaagggagcatgtaacagtaggatctaatctagcctaggcaagtacggcattcttgagaagtgacttaagacctgaaggactgatcgaattgtctgtgtgaagattggcagcgggtgctctgagggggaaaagcggaaatagcatatgcagacaccctgaggtagaaagggagctctggcctgcttgtgtgattactgtgggagaatgaacaggaagaagacgaaagtagaagcaagaagaccaattaggaggttccaaggacctgcctaactaaggtcagttagccggtgattgcccaagccaagactcaaactcatttttatgaaggccgcacaccctcatctcctcagcagttgttaaacaatatttgataatggtgttcatgtcaacctggcacatgtctagaagattcttaagtgactttttcttttcacatggctttttgaccttttaaatataatatgttttaatatgacgttattagctgcacaaaggaagggaactgctcatttgaatgaaccagaagaaacttggaattttgcctgccttctgcttcagccctgccaaaatgtaatttctttaattcatcaaatcacattcttgactaatctgctcaagtctgtactatgccttggcctttttccctgtgacaatttagggatctttaaagaaaatattttgaaatgttttctcttgatcagggtgcttgtggttaggtattgcatacactgcttttatttgcagaatgagctatttttctaccatgtgatcctttgttagaaatgaacatgattgtggctggccgcagtggctcacgcctgtaatcctaggactttgggaagccaaggcaagaggatagcttgagcccaggagtttgagaccagcctgggcaacatagcgagaccccttctctacaaaaaaattagaaaattatccaggcctggtggcacacacctgtaatcccagctacttgggaggctgaggtggcaggatcgcttgagcctaggaggttgaggctgcagtgagccatgattgtgttactgcactccagcctgggtgacagacagcgagaccctgtctcaaaaagaatgcaattgtaattttgtcacctttatttaaaaaaatcatttatcaggtggttgcaatgaaaagcaatttagttgtttacaacctctaccttccagggacttaagtgtgttcagaagtatttaaaatgaaataattatcttagctaataatgataaaattactgtggagcattgagggctactttgtgccaggcaatcagctttaaacacctttgattttctccctatgatgaggggtatactgtgatttttattaaacatttggggaaactgaggcttaaagtggctgagttttctaagagcacgcaggtggaaagtgatcaagctgagtcctcagcttcatatcttctcagggtccttgatcttccgcaccctgtagttctggttcattttaggcaattatcagaagtcacctcaaatgccaagaacctgtgtaacacaggggatgaagtaaatgtgagcaatgtaatgaagcgtttccttataaactgttgtaaggattttgttccagagatgaagtatgagaaaaatataagccaattgttcagtttcatattagtcaccctcttctactgaactttggtaaattcaaagcttccctctatacgaatttacttttataggaatattacaaaatctatactaagaaatattagaaaataacctgtacttaataggtttaatggaaattaaacccaaatataatggaaatctgaatgaatgctcatttaaaaaaatataatttatagcagtggttctcaaactttagcgtgcatttgggtcctctggagcattatgttaaaacacagatagctgggctccaaccccagaccttctgattcaggagttctgggactggcgtacaaatgtacatttttgacaagttaccagctgtatgagggttctccaaagagacagcataggtatattaggaaggagattcattataggaattggctcatgtgattacgaaggccaggaagtcccaggatgttccccaagaagtctcaagatctgccatctgcaaactagagaacaagaaggccattggtgtaattcagtctgagtctgagggctgagaacctgggagcacctggcgtaagtttccatctccatctgagtctgaagatccaagaaccaggtgcgctgatgtctgagggcaggaaaagatagaagttccagctcaagcagagagcaagtatttgcctttcctctccctttttgttctattctggccctcactgattggatgacacccatccacactgatgagcatccatgttggcggtcttaacccttttcccacttagaaaaaaagtgcggtttgtggccagtgcttatttaattttacataaacaggctgttggaggctaaagcaaatcggactgattttcagtgtgaaaataaaatagaaaatattatttctaaacagaactaacatcacaaccatctgaattatcagaatcatctatttcagaaaaatcggattcatcaaatgaatcttccatcaactgttagagaacgatgttaacatcactcataggaatgctatgttttctaggatttgacattttcagcaattgagaattactatattttgtaaatggaaatgccactactaaaaacagaatcctataaataggatgatgtcttttgtttccaaagtcgatatactagaacgatgtgaaaatttaaaaaacgagatctttcgtggcaaggttatcttggggtaaacactgcagctgcaagcaccatgggcaagtattctcagggcaaacaggaagagagttagtgaagtctactaattcaaatgctgatctcttcttggcacacccagaagtaatgttttaccggctgcctgggcatccgtttgcccagtcaagttggcacgtgaaattaacctgcataccaggtaatgtttctgctgctggcctagcgaccacactttgagaacaactaataagtcataagacagtagaacccctggatagtaataagtgctcgtgaaatgagctggccagtagctaatccctgagaaagccatttcctagtcttataccacgtcagtaatccaaagcaggatggcgatctgaagtcctgaagagtcaagggtgatacgatgactctatggagccatcaccactattgggaagacagtggggacacctgcctcccctaccttccacaccatgtacatgatggcacgtgacttagatgtgcaaactgtgcagtgtcagctttgtgatgataaactcttccactcagtctgctatgtatatggcatagtcactatactgctaaattaaataaatcaaatgagtgaacataaatcaggattcagataccaattaggtaaaatactatagtttgtatatgatggggattatcctttttctggaatgtttcagcatccaacctttgctgcgtttgtcttcttgcagtgactgagaattagctgaaataactgtaaaagcgtaagattcccatttggctggagatgaaatcacagaggttggtttactaagccttaagaaattcctttagatttgatgtgtccagacttgtactggaatatgaaatattcaatttgacaagatctgtgagttcctagtacatacgtgtttttagaaatgtgtttctcaaaatacaattaggaaaaaatccctttgaaatgctaaaactacctttagtggtgataaagatgccgacaaccccttctgtttaaataaaaacaaacaacttttaaccttcatgatgttataataacatcattaacttgtgtagacaaacatcagtgctcacatttaaagtaatcattaaacattttcagagttatacttaaaatgactttttaatcatactataaaatactgctgcaaagttgttggtggggtactaagttgtagttcttatttcttctttctctacagtctgttttggctctaccttggggggaaaatacccaaagaattgtaactgaatacagaagcattttaaaaaatcttattttaaagaggaggagaaattttagagctatttctgataataaacctcaaaaagtgagaagtattagaatttatcttggttaattttctttttttaattaacgagcatgcattgcttatataaaacttttctctgtatgtgtctgtatctgatgcagttagaagttcaatgtgagtttagtgattcccagggaagacttagggaaccttggtttctgagttgtgctctcctctgactacgtggtgagtcttagtctctggagtcagccagatccagatcttagtctcatggagttagccatgatcattttaaacttataattattaaagtgctatgatgtacaaaggtgcttatgaaactaaaatttgaggaattagatacaatgactatgcggttttgctttttagtaactgtttctcattacttcattgatccaaagtgagatttttaaagctaaagtccttgttccattaagataattctgtcatttgtccagttactctccttactcaaattgctagcccctttggtacttttctctctagctcttgccctgcttcatgatgttcctgaatagttttagttttctttgtttatttttccactttcttgggccagacctccaatttaattcttttagttgaatgagctgctttctcgcttgttacagactcacttagggctcattcctccctgccttagtcccagtatggtctcagtaatgacatgcagtatggggactttggactcctgtttgaacaaaccagctttgagatgataaaaatttgaatatgaattgagttcttgaagataagaaattgttaattttgttaggtttgttaatggcatggtagttactctaaaaacaaatttctgggcgagtgtagtggctcatgcctgcaatcctagtactttgagaggccaaggcaggaggatcacatgagcctgagaggttgagcctgcagtgagatgaaattgcgccagtgcacttcagcctgtgtgacagagcaagaccatgtctcaaaaggaaaaaaaaaaaaaaaaaaaatttattcattagttataaatgcacactgatgttcttataagtgaaaagatatattgttttggttttgctttaagattccagcaaatataaaacagaaaaagagggaatatattaaaaaggctggcaaaatatgtatcattgttgaagcttagtgatgggtgcattgtattcaatatagtattctcttttgtgtatatttgaagtttttcatgatagaaggtttaaaaatttagaacaaaaatgaatgtggaggttcaggatcctaccagatgtttctaaatgaactttaagtgacaatggggaaaaatgtccatatcatcctggagtttaaggcagggaattcttggtagggggctattgaaaaatagccaaactgttagtcaaaaatgtacatatgatctcatggccacagatagtaatgtagaagacagatcacgaaagtactaatccttgggtgaggaagaacaggagaaggcagcccaagaacttaactgaggccccaagaactaaggaaatctgttttgtaaaaggacctgtacggccaggtgtggtggctgacacctgtaatcccagcactttgggaggctgaggtgggaggactgtgtgagcccagaagtttgaggccagcctgggctggtttaattaaattagctgggcatggtggcacacgcctgtggtctcagcgacttgggcggctgaggtagaaggattgtttgagcctgggtggttgaggctacagtgagctatgatcgcgccactgcattccatcctgggtgacagagcaagactctctcaaaaaacaaacaaacaaacctatacgaacaatggtaggaatgtcaaggaacccaggagtgaagatcggattagtcagatgctgtgagaggaggtggaaaaaaccagtgtagaatgggcaggcacctttgaaaaggctagaggaaaattttggaagggcattaaggaggagcatagcaaagaagtctagacctatgacttggagctgttctgttatataaataggatatccagagatagcaaactgctcactgcaggaaataggggaaatagaggataatttggaagaacaccccactgttattatttgtggcagttatgttctataaagtcgctgtggacataattagtgaatactgagccattgctcctaggggaacaatacagagttagattcctgtgagcctctggttataacgattttgtcagctgtcaaccgatcaatacatagccttgttttgcatgtgtttctgtttaaagataccttgtttaatatacattgttgattcattaacattgacctcatggcgaagagcactgtatctcatgcctaaatgaagcttagccaatgcgtctcttcttcctaaggcacatcatggccttgttgtgattaagaacattagacgacactaaggcatgatgtttggggctcattttaaacagcaaaatcaccaagaaacccacaaaaatgaaaaaaaaaagccctaaaaactagccacaaaagggacatttgttaatagtataagggctagaacaaagagtgtaggctggttttttggcttcagctgggtacatgtatgtggagtgactcaaatattttggtgtgtacttgcttcagtggcacatatactaaaattggaatgatacggagaagattagtatggcccctgtgcaaggatgacacaaattcgtgaagcgttccttaataaaaaaagaaaaaaaaattttggttctctccacctgtgcgcaaatgaccatgagcattagtcttggggttataaataagttttagtagatgaatttgcaaatgtggaatccgtgaataataaggatgtactgtattttttcatctttatttcttaattaacaactgtgatctgtattttaaatgagcctttttgggggagcttgataggcattgagtgtttttcccaaagatttgtcaccttcttgtgagttgtctagtctgttcttttggttttatagatttattctaaactaaaagttaatggtagttgccatttataatttcttgcagaggtttttgcagagatcatccatttaatatttttgtgcattgaaggttttaattgtacagtcaacactgtcattcacttgtgattttcattttttccaagcttagaaaacttgaaggatgatgacttttttattggagaggttaaaaaaaaaaagtaggtaaaagtgatggatgcttaggctgagggtggtgactgaatatgtggtacttgaaattgagtttgagtgtccaggcctggtttcattatatcttgggacacttaaaaaagtcttgcagaggcaatctgcttgaaaatgctgtataaaccttaaacctctaaattgtaaaatgtaagtgcataataatttctgatttgtagacttctgttgacaatctttcaagacgggagaagggtgaaaaagacggaaaagacaaacagatatttttcagaaatgaaaaacatgtacattttctgacatagggaatgagagatttttctaaatgtgacccagaaggctttcaggtgatttcctaacaagatttgagttttctcggattaaatatggttgtggctctctaccatgtgccccagtcttatctttgttatgccccttcacacatactctgttcttcacatactcttccttctgctggctagtgcttccctgtttctggaactttcttaagcatttttaccatgtattatagttatttgtattgtagttacgtgtcatccttcttcgtcttagaagagaagtttccatctgactccatgttttctattgtagaccctagttcagtgccttttaaacagcagatatggaataatcctctaatggaataaatggggagaagaagggatagtttgtggttacctgggaaagcagtgtggttaagtcagcatgggtttctcaagaacaagcctttcttgaattaacctcatttcctgtataaatcagatacttattggagagagaatttgggtaatgttgttgttagaggatatcagaataaaaaaactacatgtttcattaagttcttaggattttttatggataagttggaaaagcatgggcttgattgtaataagatagatgaatgtgttgcaggttgattaactgttgactttgtgcaattcactgccttgccagtgctattctaacttttccatcagggaactattaaggaagaggaaagtttatactttattttggagggtttagagggttgagggtacaggaattgaaggttggattgtgggcaggatgtagggagactttagaggcacagccaggagcgaaatgtctttgaagactcatgttttcacataaagatgcattcactttgtatttttaacatgcccatgtttgttttaaaatactttaaattatcaccagataaaatgtttgagtagccctttcccaatgtcatgatattctagtttgagaagagtggtctttgatcaagaaaggtggatcaaatttgtgtctatcccattgttgggagggaagctaaccaactggatgtcagacatcaggatagaaaaaaaaaaaggctgcaaaaagttgaaggcaatcaacatgaacaaatacacaattaagctctactgaatgcagcttcctagagtcgggggaaagttgcatgtttatagaatgggagacctggatcagtagcagctcttgttaaaaagattgaaggtttcagccaaccatttgatatgggtggccttctctggcagctttaatggcacagtactcagaattaaggagataatcatcccgttgttttctgacttcgttaggctacctccgagggcttgttttcaaacaagttctacattttaagagggtaagccagggaaataaatggactagaaactatgccctaccaggaatagttgaaaggctatcggggtggaaaggagagcaaagttaattctcaacttcaggggggcaggattggaatttatgggtagacataagaaggatatgtttttctatttcaatcaattaagaatttttgctttgtaaacacacataaaatggatatcatatactatttagtaatcacttttttcacttgatagagcatgtatatcttatgtaactatttgatatgttcatatgatttttaatggctacatagcatctctctgtatgagtgcactcttatttattaaaaccatccctgacagttactttggtcatttccaatttcttagtataaacaacaactctacaatgaagatatctcaaatacactcatcactgtgcatttgttgagttgtttccttaggacaaattcttagcagcaggacagctgagtcagcattggtactatttacttatggcttttgaatacttattgccaaactgcttcttaccagtaataggaaccgcatgtgttaaagaagtcagattaccccaaattagagatgttgtcataggattttggcagtgggttgaatgttggacagtgatctaaggctccttaaaaaatgcatgaaagttttagtgtaggaccagatgactgtttcatctagaactttcacatttcagtcttactatgtaagtcacactgttaaagaaaactgtcaagagtctgtaacagagaaaatactgcagacgttttctgtattcagaaagcactgtagaaattgaccaaggaagagaggctcatggcaggcaacaacgcaatgctgttaggttgcatgtatgatagaaatagtaaaggaatctttcagcagattaaccattttataacttaggtaagttggggttttccaagtaagtaaattgcattttctttttttttttttttttttttgagacggagtctcgctctgtcgcccaggccggactgcggactgcagtggcgcaatctcggctcactgcaagctccgcttcccgggttcacgccattctcctgcctcagcctcccgaatagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccaagtaaattgcattttctacaccctgccagagctgggtaacaactgcttctggggaagatgggaacggacaaaaagctgctctagatcatgttcccagtaaagagctcaaagtgattttgcacgtgttttatcctcatgacctaaagctcagctgcagtgagatggtgtagtgcactgagattatcagcaaaggggattccagcttcactgcttgagtaagccactgggcctctctgagctgtagtttcttaacctgcataggagatgaattaccaatacaagtcagagagttacagtgaggatttcctgagatgatatattggatagtactttctaacctgtaaaatgctttacaaatattagttgtcaagttagacaaccgatgctagtggagatttccaatttaaagctttctaatggatgaaagagctagtgaacttcatcacggcagaagttgggtctgattttgcttgattttgccttgatgtttggctcatagttgcaattcactaaatatttgttgaatgaaaaaaatgaaattagcatttcattgttttattaacacattagagaggcacccatgaaaatgtgtgcttctcatctttgtggagtaagtactgctattcattcttacaagcagggaagcagatccatcaattctcaaatcactctcacagccagattctgcatttttcaggtgatttctaattacatgaaagagattagatcaagtactcttttttggttatttaagaggaaagatggaaccaagcctgtgttctgtagctctattgtgtaaaatcacttcgagcaaatgaatgaaatattttgtcagactttttttttttttttacttactgacccttaatagaaaataattttatgtgtagccctccccagagtctctgttgccaggaagctaatgttgctatccctaatacggcaactttgtctatttttctgttctttgtgcattgtgtttggtcttaaactgtgaatattccattaactgagaactctgaacagccattgtgtaactggagtgatagtctgtgtcagttcaatgcattgtacttgagaataaacatgctgttttatttgtggtgggacttctctcattgccactagtaatatgttgttaactgaaaatataaggctattaataagcctcataagtactttgcattgttgaaacaatccttcagtgtaggatcacatgattttgtagatatgtatgtgtgtgtctatattttcaaataggcagtagacccattcgtttcttatccttgggtgtgaggtcagaagtgtcagtgaaattgagtccagaattgtagttatgcgtgctttcctagggagaggtttctcttctttttaatcagaatctcaaaattgctctatggttcagaaatgtttagggaccactgacgcagcaaattcagttcagcccggatagtttatttgatctgtggtgactgtgtcactagaaagtgatataaaatacctagactagcacagggcacacataggttctacacaaatatttgttggaaacccaataaaaatcactggtgctttttttctttcttccctgtaacacattatggcctgtgaacctctagaagacaggatctttgtcttacttagtctttggcagctgtgttaacttctcgcgtctgtctcctagtgtcatagaatgtgcactttctttctttttttttttttttgagacagagtcttgctctgtcgcccaggctggagtgcggtggcgcaatctcggctcactgcaagctccgcctcccgggttcacgccattctcctgcctcagcctcctcagtagctgggattacagacgcccgccaccacgcccggctaatttttttgtgttttttagtagagacggggtttcactgtgttagccaggatggtcttgacctcctgacctcatgactccgcccgcctcagcctcccaaagtgctgggattacaggagggagccaccgtgcccggccagaatgcactttctgtagcaaagtagaagttgtaaaactttttctcaccagacacccttatacatacaaaacaatctgaacatgtgtcctcaacgtagacacctagttataaattatatacgtgtacatatctctattgaggatatatgttcagattgttttatgctaatatgaaacatacatagttgcaatgttgagagatgaaaagtaatgttttagcatgtattgataaccatgatggctttatattaatattaaaagctatacctatttctgcccatgcctacttttggtgttctcataatctgagcatgcgctcagctctggctctttgcagccgctcttccacctcctaacactctttcaggagatgcccttactgttaactgcttattctctgtgcttcttaattcatattcttgagagtcagcatctaattgactcagttcaccttatcattccaggtcaactcatgtgagtctcattgacatacagtgttgtttttggcttctcttgggaagcccactctggtccacacaggtgactgcatgaagtgggaaatgaagacacttggcacagacatggctgttcaggtaacaaagagtgtgtgcagggcggcttcactgagaaggagcctggtgaggctggaatggtgactgctttcaccattagacaaatgtcagtgggtagagaagagagaccaaagtgtgactttagaaacagaaaaatccccttttcttcctttgcaaatccatacctatatattttgaagaccactaggcatgtcaggtaaactttcagcaatttaaattaatcagagagctggagaacatctattcctgttaagatctttcccacccattcaactccctgactagttactgctaaagagaaaaatggtagcagcttcatctttaagacttaagccatagttcttgcaatgggaaagtcaaccctaaagaatggtttcatgtttgctcccattctaccttgtgcagacagtagtttaaggatgtcttctgcagagcataacttgtgtagtcacccaaaagggtcttccagttcactgagaccatggtattgcagtaaagaaagagtttaattgacgaagaggtggctagccgcatgggagatggagttatcactcaaattaatctccctgaagttttgggggttgaggtttttcaaggatagttcggtggacaggggactatagaatggatgttgctgattggctggggatgccatcataggagtgtggaaaacagccctcatttgctgagtctgcctctgggttaggggccataggaccagttgagtcatgagtcgcaggtccaggtggagtcagccagtcgtcaaaaatgcagcagtctgaaaagacatctcaaaaggccaatcttaggttccgcaagagtgatgctatttaccacagtaattggggaagttacaaatcttgtgacttccagaacaatggctggttatcatttatacctacgcttttaacaaaacttttattttaggttcaggggtgcatgtgcaggtttgttaatatgggtaaactcgtgtcatgggggtttgttgtacagattgtttcatcacccaggtgttaagttaataatacatagttatttttcttcaccctctgcttcctccccaacctccaccctccattaggctgcagtgtctgttgttgtcctctatgtgcccatgtgttctcatcatttagctcccatttataagtgacaacgtgtagtatttggttttctgttcctgcgttagtttgctgtgggtgatggcttccagctatccatgcaaaggacatgatcttattcttttttatggctgcatagtatttcatggtgtatatgttccacattttctttatccactgtaccactgatgggcgtttaggttgattccatgtctttgctattgtgaatagtgctgcagtgagcatatgtgtgcatgcatctttatgatagaatgatttatatttcttttggtgtacacccagtaatgggatttctgggtggaatgggagttatatttttagaactttgaagactcatcacattgtcttccacagtggttgaactaatttatacttccaccaatactgtgtaaatgttcctttttctctgcaacctcgccagcacctgttatgttttgatttcttgataatagccattctgacaggtgcgagatggtatctccttgtggttgttatttgcgtttctctaatgatcggtaatgttgagctttttttccacatacttgttggccgcatgtgtgtcttcttttgaaaggtgtctgttcatgcctttgcctactttttaatggagttgtttttttcttataaatttaagttccgtgtaggtgctggatattagacttttgtcagatggatagtttgccaaaattttctcccattctgtaggttgtctgtttactttgttgatagtttcttttgctgtgcagaagccttttagtttaattagatcccatttgtcaatttttgcttttgttggaattccttttgacattctcgtcacgaaatctttgcccattcctatgtccggaatggtattgcttaggttatcatccaggtttttgagtattacatttaagtttttaatccttcttgagttgatttttgtatatgatgtaaggaaggggtccagtttcaattttctgcacatggctagccagttatcacagcaccatttattcaacagggagtcctttccccattgcttgtttttgtcaggtttgtcaaagatcagatagttgtaggtatgcggccttatttctgggttctctcgtctgttcccttggtctgtgtgtctggttttgtaccagtgccatgctgttttggttattgtagcccagtagtgtagtttgaagttgggtagtgtaatgcctccagctttgttctttttgcttaggattgccttctatgcctacatcttagcagaattcaggcccttctcataaccctaaccttgtggtgtttcattagctttacaaagttgatttagttttggaaagtgctattctcattcttgctttaaagttaaactataaactaaattttccccgaagttagctttgcccatgcccaggaatgacgaaggacaacttggaggttagaagcaagggtcagatatctcttactgtcacagttttgcaaaagcagtttcacttccctcttctaagtaccttctgcattgattggagccagcaaagagaacttttgcagcatttcttagtttgaatgtgccatataaatgaaacatgtttggaaatgtgaaaccaagtcatccatgagaatgttttcctctgaaaggcagcacttcttgataagtcccttcctcatggaactttggtgcagtgttggcccattttaaaatttattggttacccagggagatgcccgagcttatcagaattagagtctctcatttgagtacgttcttgcagtatagaagtttgcagatgttttataactttaagaggcccagtggtattgaatttagagttaatttttaaaactggctccaaagtcaccagcatggacaaaacttacagtcttccaaagagagagtgccaaagttcaacgcttggcattgttggtttttttttttctttgtgcccatatcaggtagctatgattatcttcattttacagagaagaaaacaaagctcaagagttaatttgactaaattcacagatgagtgaagtatgaggtagagagtgatcctgtgtgagaatagtttacatttatcttgatgtggttataaccactaccttatctataatgcatgttaaaaatcaacttctcaagattttttacaccaaaggcaaaaatattcaaatgttgatatagtcccttccattcatttttatatttttgtttaaaatcttcaacatcatacccagttttcaacctaactttataaagtaagcatttccttaatcttcataaacatgtttaagatatgtatcataatttaacaaattattaagtttctgaaatttttacagtagtgaggcagtggatgtatttatgtgtaagtctgtggggtttttttcctgtctctcccatagaggcagagacttgctctgtgacccaggctggagtgcagtggcatgatcgtcactctgttgcccaggttggagtgcagtggtgcagtcatggcatgctttaacctcaaactcctgggctcaagctatcatcccgcctcagcctgctgaatagctaggactacaggtgtgcatcaccatgcctgcctaattttctaaaatttttttgtagagacaaaatctcaatatgttgcccaggctgatctcgaactcctggcctcccaccttaacctcccaaagcactgggattacaggtgtgagccaccatgcctggccaaggttgattttttaaaaacattatttccttagtatgtgtatgattagaagcaaaattacaggtcagaagtcacattttaaaagatcatgaccacttaaaaaacccttaatatgttttgccaaatttatatcttttaaaaatgggatcgatttccacactcatcggggtatatttgagtatgtagctcactgtagacagagctcctggggagggaggaatggctctggtgctcttctacccacctgtagaggttcagctggggaccagctccactgtggggcattgggaggctgttagtgcagaggtatcttctcagtatctgcctgacacactactgtatccagctgcctgacccagtcctgcccacctgccttcctttcttcctgcctcccctctgttttatcaactttgtctcaaaaaacatagcttcctatctctatatgttcgtctcctatttatggtccctcagtatgttatagtgcttgctaaggtttgaatgtcccatgtgaatctcatgttgaaacttaacccccaatgtggcaatattgagaggtggggcctttaagaggtggctctgccctcatgaatggattaatccattcatggattaatggattaatgggttatcaggggagtagggctggtggcttttaagaagaggaagggacctgagctagcacactcggccgcctcaccatgtgattccctgtgctgcctccagactctgtcaagtccccaccagcaagaaggccctcaccagatgcagccctagactttggacttctcagcctttgtacctgtaagaaataaataccttttctgtataaattacccagtttcaggtattctgttataagcaacagaaaattgactgagacaatacgtatattctaattgtgttcacttttctttcatctagacttaccagaagtttacttctctggttggcttttcaaggaagcttttgaatttcacttctattttttctattaatgcattcattattagtgaagtattttgtaatcatttttcaaacagattgggtgttttttttttctcatttcaatatgtagttcacttatgttaattatttagggcttacatttttctctgttctcaaccttcatcagattccgtaacacttgatacgttgtaaggtttctgttttcattcattatacaccttccccaccccaggccttttcattactttcaacacagtctcgtattaggatttatgttttttaaaacaattatttaggagaatagaatagtttttttctccttgtattgggttttttgtttgtttagatgtctgttgtttctgtgatggctttgttttaatctgtgcttggagagtgctctctcattgctactttggagaatgtattattctttggcctagtatgattgtgtgtgtacatttggggacaaaatgtttttgtggagataatgtagacttaaaattttaaatccgtagctgtattttcgtcacaatgaaaatttgatgtccttagtaagccccgaatagaaagccttgacttgctttttgagcatagttaacagtgttgagataagagaggtttgctggcagttgcactgatggctgcactgttgtccagtgggcccagctgggtgtacagctcgccgtataaacagaaatctagacacaggtccctagaagcctaatctgtgacctagaccctgtctctgaggtactcttaccagaaagttaatctgttagaggatctttcatcagcataaaaggcagaaataattttctaaatgctgttgataaaatgtgagtgcatgctgcttcattcgattatggaaactgagcattggagacttattctcctttttaacaccacttgcctccagtaacttacactaattgtcatctataccaagcctttgaaaatttgtagtttttgtaagtttttaggaaatatgcatgctaattagataatgcctaaattatgttgcttttcatgtgaatttagtaaagtcatttaagacccgttggcttagtttttcatgagactttctaaacatgcttaatctctgcatactattttaataataatgtaagtttttgactttttgctattataatgggcagtgaatatatttgtgctgaaatctgtgtggaatttttttgaacatcattttcttactgtatattattagaggtgaaatgtttgggtcaggagttacaaacatatatatttttaaaaaactactctaaagatccttgatacattttgtcaaattgatttcttgtaaaaatgggaccagtttgcacctctgttgtggtatgagagagtgcccatctccttggggacctagccccttgatggttccagcactccatcgaaaaccagctccactgtggggtgttttgtgtgacatggtggtgtcatatgtcttctctgcaagaaaaggcattgttagcaaggcaaacagaaatactcgatacagttatgtataaaccagaggaagcctttgccagagagattgttgacaattgctagagggtatgataatgcagaagttacagagtgttcctttggcaacacgtgttaatggatttgttccagtgttggagccctttttaatgaaaattctcaacacctacactggaaaaataataaaataaaaagccttagtcaggaatgtattgcttgttaagatttagccaaggaagtcacatgttatttaacaaggtagattacttttttctttgtagtaggcaaggaaacagctatgcttcacttctaaataaaaaaaaaaaaaattttaaaaacgttttttaaaaagaaaaacgtgactaagataactgtctcattcccaggcactttttaatctcatataaatttacatttagagacttaacagtttggcttttttgaatgaatgccagaaatacagttggactatagagtctcagctgagaagcagacacatggagcaaggtatgttctgtcatttatcagaaaagttaaagaattcattttgtttaaaaggcagcacatagattattcagagagagaaaaatatgggtttataggaaaattcttatgtatttggtaaggactctgagtttgtactttagcttcatgtctcataaatcaagtcccaagttcaccaggtgatagtattcccaggttacttgtgggtgtaggtgcagaacaactcggaactttgtggttgggcatctttttctgccgtccaactttggaggttgctgggaggagatgcttattttccttttttagggcatttcagtttaaaacaaattaaaaatggaaagtcaatgttttccctccactaatacaactcttaacttatggttgtaataaacagtgattttttttttttttttttttctaagagacagggtcttgctcttttcccaggcttgagtgcagtggagaaattgtagttcactacagccttaaactcctgggctcaaggcatcctcctgcctcagcctcttgaacagctaggactacttgcttgtgctgccatacccagctatttcggatcatgaggtcaagagatcgagaccatcctggctaacacagtgaaaccccgtctctactaaaaaatagaaaaaaattagctgggcgtggtagtgggttcctgtagtcccagctactcgggaagctgagacaggagactggcgtgaacctgggaggtggagcttgcagtgagccgagatcgctccactgcactccagcatgagtgacagagcgagactccatctcaaaaaaaaaaaattttttttgtagagacagggtctcgatatgttgcccaggctggtcttgaattcctggcctcaggcaatcctcctgccatggcctcccaaagcactgggattacaatatggacataagccaccatgtccagccctacttttgcttttttgaaggacatgtgtgttaagcagaaatttctaaagtcagtgcattttttgcatcagaacatgttttaactcatgagttaaaacatcgctgtttctggcataacggtcttcccacatttccatctttatattaaaaatttctgaaataaaatttctttttgggctagaaaaaggtaagattggatcaagtgatccatttaggacttgccttttcatactttgcagtctcattactattatcacaatgtatgtcctaatacaataaagttgaggtttaaccaaaagttctcttttcttctggcatgctttgtgagaaaatatttgagctggtgtaaattgtaattactggcagatatggaagagagtctgacttggagtattcatgatgctgatatgctgctgcagtcagtcaagtgctgcgtgagttgatgtcattaccaaaggacagtctctataatcagagaataaagtataatttgtaaatgtggaggagctagaggaacaacttgatttcacttgtcactaaacttatctaataaataaaaatgaggatttattattattattattatttttttgagacagagtctcgctctgtcacccaggctggagtgcagtggcgcaatcttggctcactgcaagctccacctcctgggttcacgccattctcttgcctcagcttcccgagtagctgggactacaggtgcccgccaccacgcgtggctaatttttttgtatttttagtagaaatagggtttcaccgtgttagccaggatggtctcgatctcttgacctcgtgatccgccctcctcggcctcccaaagtgctgggattacaggcatgagccaccgcgcccggtcaaggattttttttttaaagccagaagtaatataagtcggtatcagtgagaaaaggtggtgaggatagcagggattaagtaagtcgcgggcattttatttttatcttaaagaaaatgttaaaatggttgacgttttctagctcaacactcccacccccacctcacccattgattgatggtttgctttcgaaatcctgagtgaaaagacaggaattacttcattgtgctgagagtgactgatgtcagaaggtcagttttcctacatttacaagattcatacacacttctgaaaggttttctgttagactgggtggactgtagatgaacagggcactttttgttttgtaattgcatttagctttaattagaggtttagagtagaaagctgagagttgcttggaggagccaaccaggagattaatgggctgtgcccatccgccgcagctctgtgcttccaagaagtttgccagggtaacctggatttgtctttattgtactggaaggagtcttgtcctgtagaagtagaaatcactgatgcatcactaacatcatgtggcctttgttctctgccgcacatgtttgaaaagcgcagctcgcacccactcttcccttaggaaagggggccgaagctctgtacctgtaacattccataaaggctaaggatcatgaggatgttgagtgggcagggccccagcggtctttactgaaataccagagcctgcactctgataatgaatgaggctcgagggaacattcctttggcatattttaatgcttgacctagttgactggggtgctctgggaaaatgagcctcacttcctgcttttccaccttaaattgaagtatggggtgctctgggaaaatgagcctcacttcctgcttttccaccttaaattgaagtatgtcatttatatgattgttaatattgaaatgagcagctgtaccactctgttctcaacagggaggaagcctttttatttgtaatgtttgaaaatattctttctcagccgcgcgtggtggcttatgcctgtaatcccagcactttgggaggctgaggcgggtggatcctgaggtgaggagttcaagaccagcccggccaacacaatgaaaccccatctctactaaaaatacaaaaattagccaggcatggtggcacgtgcctgtggtcccagctacttgggaggttgaggcaggagaatcgctgaccctgcgaggtgggaggttgcagtgagccgagattgcaccactgcactccaacttaggtgacagagtgagactccgtctcaaaaaaaaaaaaaaaagaaaaaaaatattttttctttttttaagtgtatatattttttaagttgaaacctgtgtttgccttgtctttatgcccacaggggaacttgaagtcattttacatatcaaaagcatcttctcaggttattctgaattttgagaaggctaacatttgctaggctttatgtttaaaaaaacaaaaacagaaaaagatcctgggcttctcccatcttgcttggcaaatgaggagtctagggtacttgtcttaaatgttctgacatatttcaattaaagcagtgaacaatattctcaaagacaaggcagcagctgatacttggtaatgtccttaaaactgcatagtaataaccttcagtgagatttgtataatttggagataagctccacttatatctgtaaagttaaagcacagagaaagttagtacagtatttgcctgaggtcagtcacgcagttggtgacaaaagccactattcttagtacttcatgagacttctgttttatataatagattacagaggccaggcacagtggctcttgcctgtaattccagcactttgggagactgagctgggaggatcatttgagcccaggagtttgagaccagcttgggcaacatagcaagaccctgtctctacagggaaaaaaaaaaaaaaaaagccaggaatggtgatgcacacctgtgttccagctgctcaggagactgaggtgggaggattgcttgagcctgggaggttgaggctgcagttagccatgatcatgtcactgcactccagcctgggcaacagagcaagaccctgtctcaaaaaaaattaattacagagatagtgttctagttaatagcaaggaaagaatggcttaagcaataagcttggccgggcacagtggctcatgcctgtaatcccagcactttgggaggccaaggcgggcccgatcacttgaggtcaggagttcaagaccagcctggtcaacatggtgaaatcctgtctctattaaaaatacaaaaattagtcagatgtagtggtgtatgcctataatcccagccacttgagaggctgaggcaggaagatcgcttgaacccagtatgtggaggttacagtgagctgagattgtgccactggactccagcgtaggcaacagagtgcaactgcatctcaaaacaaaaaacaataagtttaatgaatgattcccaaagtatggtctatggaccagcatcattcacatcatctgggaacttattagaaattttaaatttttaggccctatcagacctactgcttactctgaaggtgggagtctaggaatctgtgtttttacaaagccctccacatacttctgattcatgataaagtttcagtaccactagcttcataccatccttttataattttatgagtttaaatgctcagggctgctgagataacatacccttgggtcctgagtgtatacaaggtaagaagcagctggcagcctccttgaaggcccagcatagacaaccttactggcctcccttttaatatacagataggtaagaaagcagaagaggaaccaatatttgctctgctaggcactgtgcctatctttcccacagttcccttgcatttagccctcatgccaatcatatgcttgtcatagtgtgctccttatatgttttgggtacttcatcattttctagttgtaatctcagtcttgagagcaggctcagacgtttgcttcgattctttcactggcaatcacggagacttgacattgtttcatttaggggactgtacatttcctcatggggcatgcagtttgtgttggagatacagaaagcttcatcttgaacttggtgcttcttcctggaacagtaattttatttcaggtttgtgggagaggaagaggagggaccttgttttttttttgcaaaccatgacattccctgtacgtaccatgtacctggtgcatgataaataactgttaaatagatttctatactattaacagaaagcttgtattgtgtccggaattggttccttcaggtggtttcttggtctcactgacttcaagaatgaagccatagaccctcacggtgagtgttacagttcttaaagatggtgtgtccggagtttgttccttcagatgttcagatgagtccttagtttcttccttccagtgggttcatggcctcgctgacttgaggagtgaatctgcagacctttgcagtgttacaggtcatgaaggtagtgcagacccaaagactgagcagcagcaagatttattgtgaagagcgaaagaacaaagcttccacagcatggaagggaacccaagcgggttgcctctgctggctctggtggccagattttattcccttatttggccccgcccacgtcctgctgattggtccattttacagagtgctgattggcccattttacagagagctgattgatccattttacagagtgctgattggtgtgttattacagagtgctgattggtgcatttacaaacctttagctagacacagagtgctgactggtgtgtttacaaacctttagacacagagcgctgattggtgcgtttttacagagtgctgattggcgcgcttacaaacctttagctagacacagagtgctaattggtgtgtttacaatcctttaactagacagaaaagttctccaagtccgcacccgacccagaagctcagccggcttcacctctcagtatcatctcccagatagcttgtgcccacccttcagacttctttgtttaaggcagttattctcaaaatgtcccttgaccagaaacagcatcacttggaaacttggtagaagtacacattctcaagttccaccccaaacctcttgaatcagaaattctgagggtagggcccaggaatttatgtttcaacaagtcttgcaggtgattttgatttatgctagcatttgagaaccactggctttacgcatgagaagtaggattttaaaattgtactttttattataattttctgggaaagtaaagctgtttcacctgtaaactttgggaataggagcaccctgaagctcacaatggcatcctgcaaagccccaaagagtgctagttgttgatcattacctgtgcacacatcattccctcactcagagcccagctaggaggcctcctttcaccttgtaaccaggtcacccctagatgtgatcacttcctccacaagaactgagagagaagagaagaacaccagaggatactgaactggccatactggggcttatggtttaaagggcagaactgagccaaatgaggactcctcagaaaattgctttctcgttggatcaccccagaaataaatcagtaaaagcattcaccttttgttttatttgcttcaaacaaagtaggaaacattcttcttgctttatatatctagataccaagtaaggaagtatgatttggattcttgagtctctttattttatttttcaactgtgtgtgtgtgtgtgtgtgtgtttgcctttgctaagccatggagggtaaaaaatgaaatatattagcaacattgttgacatggaccacagacaattaaatgtttcatttcttattaatcctgaaagaaaaagccttttttttttgttgggcggcagggagggggtgcagtcctctatacaaaaatcttaaaaactaaatatatctattctaattgttttcccctggaacatcatcatagtttaggagtatatctcaatgttgattttaaaaaataaatatgtaaacagctagatttatgcactgttaaagcatcagtgcaagttttaggaaaaaatcaagcatgacaattgaaaataaaataaccattactaagttggactcttctttaccctcaagaaattgtacttggatgtttatgggagaaattattccaaatcctaccagttctgtcagaaaactaatattactctacataatcattttctcccacctctgtataatatttaacttttatttgaaatgtaggctcaagctatgctaaaaatcccatctcgaagatgacgagcttatccatggggaggggatggagggcagagcactctcataactctaggaatttgactgttatatcttgacttaataaatgtctgcagctgaaaataggaaaaattgactatatgcatgtttgaacacatagacataaaaaatgccagctgaagcagagtattccgcatgcaagccaagaaaaatcgggttcagtgaggcacagtttggcagggaaggcacactgaagctgcagggatgggaggtctagtaactggggaggtattcagttgagggctggtgccctccacgtagccttccccgacccacccaccctgggtctgcttccctctgcccccagtgtgggctcccgtagcacagctgggtattagcttggtaatggggaaaggatggtattcaactgggaatctttggcttctaggaacaaaacaaacttggggaggatgttatcaggatactgaagtcctccccaaaatccaggatcttcagagaaaacctaagaatcaaaaatagaaaagcacaggaagttgaaggactctgtctctgtgtgttgtccctgcttctctcagctccatcctcacctttctgcactccagctctgttgtgtcgtccacagcatgcaacacacagatccagctccatctggagcccgcctgtcagctcctcagccccaattttaaaaccctaggggagaagcatcttctcagcataggtctcacatctttatgtggtccagtgagccatggtgggggaggtaggtgggtgcagggaggcagtatgggaggtccacctctgaccctgtggcccagtcagaagaccccaaagagaggagtagcttgcatagatggaacaaaagcattctccctatgttattccgttcacatgttgctgtgggttcattaaccccacacttagaaagtaatcatctttggctctaagaaaatctggaggttggacctgaaaaacctcaggccagacagtgaatcagtcctggattgtgctgaattttctaatatgactccaccccatgaggcttcatgactgtcagcatctgctgtctccagtgatgctgtgtccgaaattggtgggttcttggtctcacagacttcaagaatgaagccacagacccttgcggtgagtgttacagttcttaaagatggtgtgtccgaagtttgttccttctgatgttcgtacgtgttcagagtttcttcattctggtaggttcgtggtctcactggcttcaggagtgaagctgcagaccttcgcggtgagtgtaacagctcttaaggcggcgcgtctggagttgttcgttcctccggtctggagttgttcattcctcccggtgggttcgtggtctcgctggcctcaggagtgaagctgcagaccttcctggtgttacagctcataaaggcagcgcggacccgaagagtgagcagcagcaagatttattgcaaagagtgaaagaacaaagcttccacactgtgggaggggacctgagcaggttgccactgctggctcaggcatctgcttttattctcttatctggccccacccacatcctgttgattggtcaattttacagagagctgattggtccattttgacagggtgctgattggtgcatttacaatccctgagctagacgcaaaagttctccaagtccccactagatcagctagacacagagcactgactggtgcatttgcaaaccttgagctagacacagagtgctgattggtgtatttacaatcccttagctagacataaaggttctccaagtgcccactagactcaggagtccagctggcttcacctagtggatcccgcactggggccgcaggcggagctgcctgccagtcccgcgctgtgcgcccgcactcctgagcccttgggtagtcaatgggattgggcgccgcggagcagggggcggtgctcgttggggaggcttgggctgcgctggagcccacggcatctgggggaggctccggcatggtgggctgcaggtcccgagccttgccccacggggaggcagctgaggcctggtgagaattggagcgcagcgctggcaggctgacactgctagggaacccagcgcaccctccgcagctgctggctggagtgctaagcccctcactgcccaggggccggccgctccaagtgtggggcccgccgagcccacacctacccagaactcctggcctacccagaactcctggcccgcgagcgttgtgtgcagccccagttcccacccacggctttccctccacatctccccgcaagcagagggagccggctccggcctcggccagcccagagaggggctcccacagtgcagcggcgggctgaagggctcctcaagcacggccagagggggcgccgagagcaggcaagggctgacagcacgttgtcacctctcaatgcctatcttaaacagaccctttacatggcattggtggcaagtgagactggaaattctttgtgaaatgcttgcatgatacaagagccttctcgtaaatctgttttaaaagtgtcctttattctgaataccattttgatccgtgatccactgatggaagtcaatgatgttgaactaagaaaatacataggttactagctatgaaccattcttcattagtgcacttgcttggtaatgggttaatttgaattgggaatgaatcttagtccacaaactagaggtgcagagaatattgcagtttgctaaatagacttaatcttgactttaagcttctactgctttcaggtagcagaaagattcacctcgattattcttggatttctttcccatatcaccctcccagagttgtgccaaggttccaggctttactaatgtcatgatgtcaggaaggcctgagaagttatccgtttacaccagtccctactgcttctgggctgcatttgaggctagggagggtgctttgtcagcatccagccatcctcctggggttgctgcacacctcagggtgcagccagagtgcaggtatggccatctgccactcagagtttcacagtcattcacttccaagatctcccttaagtgtgagagatcttgctatcttctcacctgcttttctcctcaagaaggtaagccagagccctcgacccttgtgaatgaggaaatttcagagagaaaaacattggaactccccctgccccagagttggtaactgctcaaatgctggctgccgccaggtggtgcaagaggcgctgcttctctgtggtcacctagcagcagtctcctgtggccagttccccacgtagaggtggcaactgcccttcttcatggctacttgctggaggtttgtgggaggaggggagtatggggggtgtgtgtggctttacctgccccaaattgtcaggaggatttgaggcatttctttgttgttgttgttgtttggctgtttccaaaacccatttggaaacctgttattccgtaagagtagccttcaaattcttaagcattttctataaatcttcagtgaactaataaaagtatttccttttcccttttctggcaatgggtagtctagttctgttaatattcctgcaaagaaactcatctaccagcctcactcacactgtgcacttttgccctcagaatcctcagtggctagcctaattgactacaaccagtttagatgatcagctaccttccttttgccattatttcagatgctgccttgcccatagcacaaccaatgcatttaaaaaataaaaacatttggggtgggagaactatgattaaataaaggagatctctgtagagtatggcaaagcttgcacacaactttaataaaaatatgctgtcttgagtaaccagcatattacagaggctctgtgaatgcctcttcatctagaatttcagtacaagctgtacataaaatatttatacagcacagtgtgctttgcccctcacaaaagcgtgggttcagatgtacactgttactatagacgtcactaacatataagccggtgaagaacctttaatgtatttgtaatgttagcaaagtatctgtcatcagattaaacttgtagtgactgataatgtagccttggctcctagccaaaaatattttttttgatatcagaatgacacttaatagtaaagatatgtcatagaggaaggggaagaagagaatttactagagaaacttaaaagactggttggtgcagaacctagtaacttggtttgtggctggcagaaatgggagtagtccctgggattacttctaaggaggaaattttactacaaacacagctgggaataattctgttaccaagtcttttttaggatcaatacagagcttatttgtaaaaattaaaatctaactatcactttattgtctatgggtatctgttacattttatctgtaaaagaggaatggaaatgcctgcctagtaggttcatcataaggactgagaggatacgggaccttattaagtcctcagtaagtagcagcaattttgcttttgtttttatgatgattacttccactcatgactttacctgcatgttctttaatcttcaaaatagattagtgaagtagtgatgtttccattttagaaataaaatacgctggggaaacgaattgtaatacacatgacaaagcttaatattagtatccttctatgaaggatccctcagtatccttatataaagatcctttatggctctaatatgcttcagttgattttgttccttgtaggcaaaagtttcaataaatatactgttttctctccattatcaaggatatatggattaatattaatatataaatatataaatccattatatagtaatatatattaacatatacttcctttattaatatcctggatatatgaaattaatatcttggatatatgaaaaggtattccagatcaataagatgaacacagtagtagaaaaatagagaacatgaacaagagtgtaaaaaggtgcgaagtgttcaaccccaaagatatgctaatcaaaatttaaaaattaaatctatacaatacaatttaaaaaataacattacccattgttagagggggtgtggaggagtgggtattgtcatgtgccactgggtcaaacattgtgtagggcaaattaacaatatcagatcctcacattttctgtacatttgaccttgaccttatcccaggcaaatacttgatggtatagtgaaggatatctttctcagcattacatatataatcaaaaataagaggtgacttaagtgcttcaagggaatttattaaaatggattattgatcagtcattaaaaatgaaagcatacaagactattaaatggtacagaatttctatcagaataagtgggaaaaacaagttacaagtaatatcatatgatttacttttagtgaaacttacatgcacttacacatttgtgtattatgtttatgtgtcatgcatacatataaaagtggaaggcggttcaacaaagtgctaattatcctcatgatttttattttttctttgatttttatgaacttacagtaaagaacaaagtactactttgaaggaagaaaaattattttttaataattcagcataaattacataggttatccaaagatagtaatatggtatttgatctgaacctagacttctgttctgttgatttgacacattttggtgtctttccttttatgttaaataagtaactatcatttacctacagcagaagaagaatataacttagcatttgagacttgataacatagagctgttgaatagttctgtaagatttgttagggaaccaaaaccaggcatgtgaggatggtgctggaagagaaaaggcgggaagggtttgcagtcaactgtcagttatcttcagctttcaggctcgctgcacatggacaggtgaggaccaagggaagaagagcaagcttgggtatttggttgagctgttaagttcagggttagaaaatgaccagcacaaaccttttggcttgagagccaaagttcttggcaggaagtctctgcttgtttccgtttgccttcctcccagtttctcctcaatgccttgcagtcagcatcctgtatctgccattttgaaaactgcccttaggggtcatgagtgacccccttccttattgttaaacccagtgacattttgtccttatctgcagcatttgatgtgttactcaactctctttgggcttgtgtgcctctccacccttgtggttattctcctgcctctgtaaccactcagtgtcttcttccatgtcccttgacccttcactgtgtcttctactgattccccttagaactttcatttacccctggagcttcaaccatcatcttcaggtaaaactctagcaacaagtcatctttgcccgctgtgcatcatccttgctgccattgagagtttggtcttaaaatggtacttgcaattagaacacgttcactttgtcacaaaatctgacagacattggacatacttagaattcatatctggcttcctgagacagctgtcagattgtctaccaatggtctacccattgatgatggaacaagctccttgtatcagcctcaaataaaaatgatggaattaataaaagacgcttaccttaaggcacaaaggcctatgaatttcaaaaagcattgacagaaccgatccaaaaaatatgtagtttgtaaaaactctaatacaatccacactgaagtaaaaagcttaacttagaataatccaaatagtctttgtcagctggacagctaatcttggtgaacatggaagagtagacaataatgttaaggcattgtgtgagggttaaattgtttgcgaggtcggcattgctggggcttcggattcaaactgggccttgaaagagggggtaagaaaagtctatggggaactgatgggcacaaaggcagggtgtaagtgtttgttcttgggaaaatgatcagactaatctgattgaatagaagacgtttattggaaattaaaggaagataaagtagtgatagataatggaagaactgaaggtcaacaggggagtttatatgtgatggaagagaaaatcattatcactagggatgtagatgtaagaaaacgttaggtttggaagttataagacaagagaacttcaaagtttgtgggattctgtaaggtgggatgggaataagcaatattgttgagtacctgctgtgtgatctgtaaggcataagatgtcattattattttacagcaagctttggagtagatgtactagttcccattttatgcatagtgagatggaattttgagcagacatacttgtctaagtttggcagagtggctggaccaggattcatgcccagtgacatctgacttcaaagcacagtgaggatggagaatgttgagaccagttcttcattttacagtcaaggggatgggcccaggcctattcaaggttacaggaataggatgaaagcaatttctctgtaagagagagtggataggctgtgatctgcagagggtccaagttagaggctcttgttataaacagatgaggtatgccaaggaagttgggttcagcagtgtgataggagtgaaaaagaaggggtagagagcagctggacattcggggaaagtggtggtgactgttagtggaaggtaatgacgagagagatgacttgaaaacagttccgaggttttagtcccagggaactgccattaacagttttaggagaaaagccatgtgtgtgttatggagtggtctgagtaagtatgatagacattaaaaaatacataaaaatagagtggtatgcatgtgctgaattatgtttgtactaccaaacacacggaggaggagaacagaacagaaggtggaaagctatgagggatccagcgcttttctttgcagtggtggagagtcacgagagcaaatagctagcctttacctaaagcaaaagggactctttgcatgatatcttaggctcccttttattctggcctgcccctgcacccccagcaggaaagtggcttaactgtactttgatttccaaaatgcgtagcagtctctagtattgattcccctctcctgcagatctcaagcctaaaaatgagtattgttccattacatttccctcaaaaacatttctttttcctttcagaatgatggtcactatactggatggacttctgaactagtgaattactttcatcttttgatcacactaggaaattgtccacggagttgaaatatttattgcagtaatttctggccttacataattaagataacatatcgtttttttctttataactatcatgaagttgtcatgtttgtttcctttaactttgctttttagaggtacgaatctgttccctagtcttttatgctccaatgatctgttcagactgctcttgatctacaaatgtatgattgagaaaagacttttataggatgaaatatgagcaagctgttttactctgaagaataaaagtgaattgtattactctgcagattaagtcaataaataccccattttcataaacacaatatgcacagactagataatactagggaaacttgatacatcaaaaggagtattaagactgaaaaaaatggagatactcaatttattgcaggctttattcaataaacctagaaaatagagagtttaaatcaaaatctgttactctgtttctagagataatcaatgttaaaattgtactatattattttccaagtttttagaatatgtgcatgtgttgttgtgttagctttctctatttttgcaacttgagtaacatttattacatgcttgtgctgtgccaagctaaataccaagcattttatatatattaatttattctcataacccttggtacttttattatcctcatttacacacaggacaattgaagctcagagaaattagccaggcacagtggctcactcctgtaatgccagcactttaggaggccaaggcaggcagatcacttgaggtcagaagtttgagaccagcctggccaacatggcgaaaccccgtctctaataaaaatacaaaaattagctgggcgtggtggcacatgcctgtaatcccagctactagagaggctgaggcaggagaattgcttgaacctgggaggcagaggttgcattgtgctgagattgcaccattgcactctagcctgggtgacagagctagacttggtctcaagaaaaaaaaaaagaaagaaagaaagaaatgacttgcccatgttcacatagctggtaaacccacactggttcagaacttaaaccagtgagataccaaagcccatatcagtgggcttttttacatacttcttttccttaataaaatgcttatttcttttttctacagcatcattttaaatgacagcatagtattcagttatatggaaatgtaatggtttctctatcccatctccttttattagacatttatattgtttcttgttatttacttttagaaataacattgcagtgaacatctgtcatgcacatctatgattatttccttaggataaattgccagaagtggcattgctgaacaatgatagaatgtagcactcaggtgttgatgtattctgttaatttactctgttgatgtactgttttctcgaaaggccacaccagtttataatctcagtagcagtatattgaagtacctggtaactttcagctctcagcaacattggtagttagcaatttgaaaaaaaaaagtgtttgtttttaaaaaacattctaggtattcctttttaagtccatattatctcttgcctctaatgctgtagtagtcatgatctccttactggtttatttctatctagcacccactttgccactaacagaatcggatagggcacggactgtagagttagatgcctgggttcaaatcatgactgtgctgtgcctcaatttccccgtaagtaaaatgaaaatagtaataaaagccctctggtaaagtactttagaacagtgcctgacttttggtatgtgttcagtaattgttggcctactagtattgtcttccagaagtccctgcttatatgattaaaaaaacccaaggttatacttgtttttgaattgtaattattaccaaatcagtaaatcacagtagaaactaaagtgctgaccttgaagcattgttagtgttaacactgtgaccaacctgaagatcacaaattaccttccgtgactcagttgatgctgagaggtcagggatagagtaataacaggaataactagaatgttaaagtgctttatattaagctgccagtgcacttccacacacattatctcattcgatcctcacaacacagctgtgaaggagatggagcgggtattattaatctcatcttacagaggaggaaattgacttggaggattaagtggcttgctcactgatggttgtggaaatggtcagtggcagagctgaatgtgtactctgggccttctgactgtaaatacttactcttgatgcttcataacatcatgataagctaaggaggtgcaggtgtagatgcccaggtctggagatttgctggaaaagaaggagcaaaagaggatgccactgggaggagggagcagagttggggtaaggaaacttagatatactaaaagagagggaggtacccagcggggagagaggtggggaaggagtcataaagaaagggaaaaacagggggccaggacttccgtgactacagggctggctgaatagatcagggtggagggcttcatctttgagactgaaggaatgcgtcccctgagccaggaaggagggaggagatggagcaagtagacacaggtgatttgaaatagaaaggaacattaagagggctgaaggattgtggcctgaatgaagaaagaaggaagtatttatttctggagagtaaaagtggtaggtttggggttttagatttgagaaagggaaaccatttagagtatctgtgtgggaaatgggccaaggaattagaaatgcctgccagagacctctgcaggatgcaggaaggacccagataaaaacgtctgggctccaagtcgacagattctgtgaaccccttaggcatgctgaggatttccttgccagatgatgtaactatctgaggatgtttctttgtgagctcagtgctagacaggcacaggagcagtattaggatggaaacatttcttaattgcttgaggagtgaggaaaaaaacggcactctgcaataaccctcttgtttccaaataccaaagcagctgttgggctgtgctcctgtctaggtaccttttcctcaggagttaagtgccacatgatgatatttatggttgctttttagggggtacatggttttttaattagtgaagaccgagtagcaatagttttgttttgtgttctaatagcctttgttattatagtcagggaggtgaagtgaggagatgatagatgctttcctaatctgtgaaatgaggagttggactaggcaggtgctccccaaagtccctttctaacattaccattttctcatccaactccagtctacgctgcctcctctccatttcctcctttaccagacagtttagtgtgtctcaagttatattttatggtgctttagatatatatatgtatatttttgcttagagacttcatgcattattattagagacttcatgcagtatgtagtgactgtagaaaaatgaaagatgtatcgataaataaaagacctgttaaaaatatgtaactttaccaccattaaataaccactgtttatattcttccggagatttttttttttaggtgtgtatgcctaaataagattcttaaatacagaaatgcaccctgcttttctcagttgaaaattataaacctctctgcttatcagtagtcactgctgtgtaattattaaaggttgatgaagactctgtttcaggaatgtattttaacaaatctcactttggacatatgcattaatgtacattcttctaactgtatttgtgaggctgctctgaattattttcttataaaattaggaaagaggtttaatatataatacacattgcctggaagactgaaccgatttacagttccatcaccagtatgcgagaggtctcttttcccacacccttaacattggatagtggagtttaaaacaaacaaacaaaaaaaccttaccagttttatagacagatgaacatcttttcatatgccatttatattcctttgtgagttttctgttcatatcctttgcccatttctccagaggggtatttgctatttttgttactgacttgcagcaacgagattttaaagatttaaaatttttaaatgtcttttattataaaagtatgttagttgttttgataatttctttgaatttttatactgcttttaaatgtatataaatatttaattttaggttgtcaaatctttttctttatggtttccatataggctaactaggaagtaagaatgccttggtatttgttgcccattgtcagttctttacatagcagagtaatctctttcaagtgtgatcacatcttggcatacccctgcctgagctcgtcatggcattcttgttatcatggcctgcagggcctggcacgatcttgcttttcctgctgtaaagccccacctcttgtcactcacccttgaacactatgttccagccccactggtctcttctcagtccagggaatatgccaacctccttcctgtccctgaaattctgcaggtgcagtttctttgcttgggaaatgtgtgcacacgcgcacacacacacactcttttgagcacttgtcaatatgcaattatttatttatttttgagatgcagtctcgcctaggctggagttctgtggtgcgatcttggctcactctgcaacctctgcctcctgggttcaagtgattctcctgcctcagcctagcaagtagctgggattacaggtgcccactacgacgcccagctaatttttgtatttttagtagagtcggggtttcaccgtgttagccaggctgatctcaaactcctgacctcaggtgatccacccacctcagcctctgaaaatgctgggattacaggagtgagccactgtgcccagccacaattatcatttcttattaacttactcttttcctgtttccccctccagcctgtaacaccataggggcagggaccttgtctgtgttgaccacagcgaggtctctagtgcttaacatgtggtatttgtaggagatcggtcagggtggtggaagaaattgtaggaaaagatgcaaaccttcttggaagaggttttgcaaaagcttcaaaaaagggtttggctgaaggcagccaaattctcttacctggagcctgagagcaaaggttagataataaggggatgtaaaggaattgatctagataagttagtttacttaggcctcagaacctggcctttaatcatctgtgcgcaggactgctctttcccagggagcagcgggaagccgggggagggggaaccatgttaattacccacaagtgtgttgactcaaagactttgtcattacatccatactgaataaatgcccgcagcactggcttgtcagggccacagctgctatgactctttctttctgtgagcaccccgatcccctagtccgctctttcactggatacctgtgtctaagtacgttttttcatccatcgctcagccagaatctgccggtcagacctggcaagtatttatagaagaaatgaatcaatattacatctctaaccacaagattgcacaggcatttaactatatttaccttattgtagttttatggtttcatctcacattttaaaatattttatctgtatgaaacttagtttgaaatgtgacttgagataggaattaaaattaatttctttcccaaatgaatagccacctgcaatttttgtagttcttgtttattagagagtccttactcaaagtatagtccttaagcactattatattgttttttctttcttctgtttgcttttctctccttgggtagtcctttgtgcaaaacgtaaatgcagaaactgctcattgacttgagccaaattgctcatgagcatgctggttcaataccaagaaagatgatcttggcgtcacccaccatagcctaccttctaagaagaaagaagacatcatgtgactgacttagggagttgtactatttgttcaatatctaatgctagtagacaatcttgttttagataattctggccgccagtttttttaaactgttggaacctggaaatttgaacattccagtgactacctttcctaactgcctcttatctctagatgtggaataaaaatcctttggcagaccatgtgttccagtttttggtttggaaaatatggattattattcttttccttattttaactctgaaaattaaaattaatgacaaaagtcagatgtgcccattctcacatattcaaacaataaaacatacagacaaaaaaaggattcttgtatcccactttttgatcctattcctaatataaccactgctgagtttattgtatatactttcagacattttttatgcttagtggatatattagatctttatacattccccccccccatatacttgcatttttttttttgactaatgtcataaactttgttatacacctcagtgggatttaaaaacacctgaagcctttgttttttggctggtggcaaaaaaaccagagtaacttagagaagttacccattgatgttttcacagggctttaaacacgaagacctgatttgtttgtgtaaatcgttggatgtaatcttacagaggaccagggcttgagcaccttcagaaacatggtatcatctgatcatgatgatttccatcccacgacagaggaagaaatggagactccaaagggacagaagtgaattcttccaaatttatgaaaatgaacacttagctaaaatgtgttcactgggttatgacaagtaactggacttctagggaatgggatggcaggtggggtgctatcagtttataaaattttttgtaaccttgtctcttatttctgcttccctcccccagccatgggaacacaagataaatttggagtaggtgagggtggagagcaaagtgactccctgggctgtgcccttcacactggttttagaaagcatgcagctgactgccctggggtctgatctatggtgctgcgctcgagagaactgtaaggtctgctgtaagtgatgggggctgtggacttatgcagaagtgcacttgttgggggttttcacagtacccaccttattatactagagaggcaggtttcattgcttaaggggacaatttatggcaataggcttatctccttgttttagctctttatgtttttctgcctttaataaaatgtgaagtcacaaagcaattaaatagtagtgtagttttcaggcaggaggtggagaaaggctaactagggggaaaaggccaacatgattgacagaggctggctggagatttacattgagaataactcgttcttcaaaactttcttcattttctggtgagaattagggacaaatcatataccagaaggatggatgattaaaaatgtaggagttatgatttctttttgactttgtaagtctctaaatcctccaccttaacatagagttctcatttcaaaatgggaaccagccctgccagagactaaagtgagccagaaatactctaaagtcttaaatagttaataagtgtgagattgtttatattttgtaaaatgtcttaagatacaatgaaatggagaatccctgagtgtttttttgatttcctaaactctgatccacaattatagatgtgtctgaaggttcaaaaatattgaacgtgatttcagttgtttctagaatttaaaaaaattaataatttttaataatgacactttaaatgaggagaaggcttttaaaaccaaatataaaaatctggagagttcagattccctgtctctcctctttcaacctttaatgtataaaacaaatccttttgattcagccactgtgtattgataatggcttatttattacaatcagaggaattaaacaaagatatgtagatactttgtcatcttttcttattatagaaacagtttgattttaagaatttttattcagaacgcagattcgaaaagaaaaaaaagaatttttagaaaagttgccttttaatttaaatttcttgttttgtcctaataatcacattgaaatagccaaaacaaataatataaattaaaatgcaacgatggcccggcatggtggcacatgactgtagtcccagctactcaggaagctaaggccagcagattgcttgagcccaggagttcaagaccagttggggcaacatggtgagaccctgtctctacttttaaaatgtggtgattggtacctgttgagagaagggttaactgaaagttattcacatggcccagaaagtggctgaaaagtgctctttctggtgtgaatttctcttgctgtgaaagcactctgaaggggagacctaatgccattgcaggagcacttcagctccaaacttgagcgttgcaatcagaacaagaacccgaggaaaagcctgcaaaatgagcctgctgcgatatagggtgtgcttttggacagttatacataagaatttttttcttttttcttttttcttttgtttgagacagtgtctcactctgttgcccaggctagagagcagtggcgtgatcattgcttactgaagcctcaaattcctgggctcaagcagtcctcccacctcagtctcctgagtagctgggactgcaggaatgcaccaccacatctggctaatttattttttgtagaggtgaagtcttgctttgttgcccaggttggtctcaaactcctggactcaggtgatcctcctgcatggacctcccaaagtgctgggattataggcatgagccactgtgcccagcctcatgagaagatttatgatgatagatagaagaattattaatttccacagtttgacaaatgataacaaatagcttttacagtttgagcatcccctatcccaaacgcttgggactagaagtatttcggactttggacttttttgaatttgggaatatttgcatatacataatgaaattccttggggatgagacacaagtctaaataacaagttcgtttatgtttcatatacaccttatatacaaagactgaaggtaactttatacaatatttttaataattttgtgcatgaaataaagttttgaccgcattttggctgtaacctgtcacatgaggtcaggtgtgaaatttccacttttggtgtcatgtcagcattcaaaaagtgttggattttggagcatttctatttcagatttttggattaaggacgttcaacttgtatgccaaattagtaaatattttttgagttcctacccacatccctgtgtatgggctctagaagcagccatggtttagtttcctcacctgtaagggagggtgtagaacttcttttaatgtacatcactgtaggttaagttcgggtagagaaaagactaaaggcaaccaaggctggctgtcctctgagcccctatgctaagctgaactaggcttttgtttctggcaatggatcattttgctgtcacggagccagtgattatttaccacccctggttttgagtaggtttccttttcccctggcaatagctcttagagtgtttcacagagaggcaacgggattcagaagatgcccgtttacactggtaccactgtctcgttatgtcatggtaaagtaatgaagtccaccatcattactttaccagttccccattggtgttttggtcttccctatacattttttttaacttttatttatttttaatgagatgaaattcacataatataacaataggcagtttaataattgacaattcagatgtatttagtacattcataatattgtgtagctgccacctctctctagttccaaaacatttttgtcactacaaaagaaaaccccgtacccagtaatcagtaacacactattctctcctctctctcatccctgacaatcattaatctgctttcagtctctatgaatttacaattctagataccacatgtaaaataaatgttctcatacaatatgtgaccttttgtgtctggcttctttcacttagtatattcatccatgttgtaatgtcttagccattttatggctgaatagtccatggtacggatatatcataatttgtttatccattcatctgttgatagatttttgattttttccccaccttttaattcttatgaataaggctgctatgaacatgggtgtgtaagtacttgagtccctgttttcagttcttttaggttcatacttagaggtgtaattgctgggttatatggcaagtctgtgtaacctttttgcaaaactgttttccacagggccaaaccatttctagtcccaccaacaatgtacaaggttccaatttttccatatccttgcaaacatttattttccctttttaaaaaaattatagtcgtccttgtgggtataaagtagtattttattatggttttgatttatattttcctaatgattaatggtatttatctttccatgtacacattggccatttgtatatcttctttggagacatgtctgttgaagtcctttgcccatttaaaaattgttatttgttgttgacttgtaagagtgctttatatattctggatactagacccttaatagatatgtgatttgcacatagtttttctcatttttaaggttttctttttttttaatttttatttatttttttttagacagagtcttgctctgttgcccaggctggagtacagtggcaagatcttggctcactgcaacctctgtctcctgggttcaagtgattctcctgcctcagcctcctgggtagctgggattacaggcatgcatcaccacgcctggctaatttttttgtatttttagtagagatggggtttcaccgtgttggccaggctatcttgaactcttgacctcaggtgatccacccgcctcagcctcccaaaatgctgggattacaggtgtgagccaccacccctggcctccctatgttttcttctaagaagttatgcttttattttttatacttaggttgttaattcattttgagttaatttttcatatggtatggggtaggggcccaactttattcttttgtatgtagatatctagttttcccagcaccacttgctgaagagacagtatttccccatttgaatggtctttgtacccttgttaaaaatctattggccatatatgtgagattttatttctggactcttttttctattggtccatatatttatccctatactagtactacaccgtttttgattactgtagctttgtagtaagttttgaaattgagaagtgagagttcttcaacttttttcttttttttagtgttgttttggctatttggatccctttcagcttcatacgaatttaaggatctgttttttcatttctgcaaaaagggctgttggagttttgataaggagtacattgaatctgcagattatttggagtaatattgtcatcttaacaatattaagacttccaatccatgaatataggatgtatttccatttatttaggtcttattcttcagcagtgtcttgtaatttccagtgtgtaagtcttttgcctcctgtgttaaatttgttcctaggtttttttgttttgttttgttggttttcttttttttttttttttttttttttttttttgagacagtctcattctgttgcccaggctggagtgcggtggcacgacctcggctcactgcaacctcctcctcctgggttcaagcgattctcatgcctcagcctcctgagtagctgagattacaggcgcacaccactacgcccagctaattttttgtatttttaatagagatagagtcttgacgtgttggccagactggtctcggactcctgacctcaggtgatccgccctcctccatctcccaaagtgctagaattacgggcatgagccaccatgcccggccatccctaggtattttattctttatatgcaattataaatataattgttttcttaatttactttatgaatgatttgtatttattattattatttttttttttttttgagacggagtttcgcttttgtcacccaggctggagtgcaatggtgcgatcttggctcaccacagcctccacctcccagggtcaagcaattctcctgcctcagcctcctgagtagctgggattacaggcacacaccaccatgcttgactaattttttattgttagtagagacggggtttttccatgttggtcaggctggtcttgaactcctgacctcaggtgatctgcccatcccagcctcccaaagtgctgggattatagttgtgagccaccacacccggcaagaaatattatttttattttttaaaaaataatctctagtggttattttaaaattcaaggtaagaaccccactattcctccaaatattctgtagagtggtctctgttaagtttgatatacatccttctacatgttttccatgcatttatatacaaacatactttcttactgtgaataaagtcatatactttgtctaaattttaacttactattttacataattatagattgtgtctttctctgctagtttacttatttctcttaaatgctgcagagtaacccatcatactgatatgctacgtagctgacccttgaacatcatgggtccacttatatgcaggtccacgtgcaggtctgcttttatgcagatattttcaacccaacatggattgaaaatagagtacttgagggatgcaaaacttgcataaagagagaattgacttttcatatacgcaggttcttcagggctggctacagaacttcagtatgtgaggatttgggtatttgcaggcagtcatggaaccagtcctccttgtatatcgagggatgactgtactttgtttaaggctttattttaatgatcatttagtgtggtgttggtgttttatagtataaataatgcaacagttaacaattttatacccacatcaacgtatgtccatgtaagtctttaaggtaataagaattgctgaggcaaaaaaaattaccttaaatttttttaaagttttgtgttaggcataacacataatttactatcttaactgtttttttaattgcacaattcagtaatgttgtttacattcacattattgcgcaaccagtctctaaaactctttttcatctttcaaaacaaaagcgctatatctgttatacaacaactccccacccccctcttcccctggcagccattctactttctgtctctgtaattttgactattctaggtacctcataagtggaatcacacgctgtctgtctttttgtggctggcttattttacccagtgtaatgtcctcaagggtcatctatgttgtaacatgtgtccaaatttcattcctttctaaggctgaataatattccattgtagcatcacattgagtaattaaatgcttggaaagaaagaagaaaaagaagggtatgtctgactcttttcattcccatacaatgtggtaacatacgtaataatctaaatagaatataaataaataaaatgaagtccttttaggtatgtgtatgagctatataaacaggtatttttaaatgcattgtggatccaacttcatattagtaggtgaggaaacaactagtagcacataaatgcttcttgggcttcttgcacacttgccctccatacacctcacctcatgcccaacataactttcattatccctccacccattgctggcagtcatttttaaatagctttggattttatgccaaaagatcttctacttgttgacagattctgtgaatacccagtgttcgcttcttttgcactttccaagaaagatgagtttgggaatttgctaacatgttctaaagttaaagctttttgttctgggataactgaaaagtttagttatccaaaaggcagcccaccttcatttttcaggagggtcactgtgatgttctgtctttctgagtctcatgtctcatacctttctgtgctctgtcataattaactaaagcagaaggagggagatccttttgtaaaatgcccaaagaaaagaaagccagatggaagtgaggagtaagagtaaccacagttgctttcctcttccatcagtctttaaaaactttttattttgaaataatgttagatttagagaaatgttgcaaaggtagtacggggctcccatacccttcactcagtttctcctaatgttgttatcttacataaccatattgaactatcgttaatataattatcaaaattgggaatctaaattggtctaatacttccagctaaacaacagaccttactagcattctatccagttttccgctatcctttctttatgttccatgatccaatccaagatccacattgtattgagtagttctgactctttaaactcccacagtttgtgacagttccttgtcattccctgtcagttatttctggttagttattttgtggaatgactagatttggggctgtctgatgtttcctagtgtttacctttaagttatgcttttttttgttttgaaagaagaccacaaaagcaatgatgtatcttttttattgcctcataactggttacttgatgtcagtttcccttattgctagtgctattcgtgtggactcatcatggacagttacttcattctgtgggttataacccaatattatcatcattattttcttcttcaaattattctagctttggccactgggagctccttcaggctgactctgatgtccttttgacatgcttccatcttttttcaagtacttcctcacattatggcatcccctgatgctctaggctaatcttgtattttccttgccctacttttggaatcagtcacttccctaaggagcctgggtccttttactggacaatggtgtttagaaaccaatatctgagtaccagacgtgcacattgcaactggggtggctttttgtcttccatgagttttatggtgagctctttcctgtgaacatggttgtaccaggtctgaaactcgtttttaacacttctaggtagtcagtcactttgatgtaaagtcattttgatcacttaatgttgagttgttaaaatcaatgcacataccctgtagaaaaataggttctttatcaatggaatagattaactttttgtggaaaaatacttttacattgataggatagcattagcatccagacatttttgacattccttcaataactattcctgagtttctgactctcatttttagcccattccatttttatttattttattttattttattttttgagacggagtctcgctctgttgccaggctggtgtgcagtggtgtggtcttggctcactgcaacctcccgctcctgggttcaagcgactctcctgcctcagcctcccaagtagctgggactacaggcatgcaccaccatgcccagctaatttttgtatttttagtagagatgtggtttcaccatgttggccaggatggtctcaatctcttgacctcatgatccgcctgcctcagcctcccaaagtgctgggattataggtgtgagctgttgcacccggcccccattccatattttaatgagaatatcttttggttagttatagaggtaaatacctggatttacaatgtgtaactacagattcatcatcctataataaagtaactctttttgcataaacttttgataagttatttttgtccttataattttatgtgtgaagtctttacggtcagaggacattgacaaaatattttagattgaaagcctgttctccttgatgattcagtataacttcttttgactgcgcttttagttcttgcaaaatagatcttgtttagatgagattccagcatgactcctttgtaatttttcatatttttgctattacatctcaactcttgaagagctatttctgtgaaaaccaaacatgcagtcaaggcacattccacgtgtggctgatggggttatcatagttacaaatcatatttatccacagtgataattatcttccttagcgttttgttctacttcagagctcatttgtgggccttaccacctgtttcttacatatggggaaagagtctcttattctcttttggaatatagatctaagagtagatttatatcaggatttgaaagatgaatctttttcaaggatgtttttcctctggaccgtggcattgtgtaagaaatttccctactcatcccatccctggggcacattaatttggagatgatgttaaatgtgtcagagtgtggcacaaatctcaactggcagataaagcctagtattgaattgttttcagttcagaaacgtggctggctgactttgaccctgaatgtgtaaattatctttgcagcaataagaacttgaagtagctttgatagctaatcatagtatgataactcagccagaagaattcactaagagcagtttgtgtgtcttccatctaatgtaaaggttagtaatgtaagtcatattcttggtgcctttagacctagttatgcagagagacatcacattgacattcagtaattcttactcttaacagttccttaactctaaaatcatctttttccttacctttccctagttctagaacagcaaaatattttacttagattctatcattaattaatatactcgtttgaatttttctcttctaaaaaatgtaggccaggcatggtggctttacacctgtaatcccaggactttgggaggtcgaggcgggcggatcacctgaggtctggagtccgagaccagtctggccaatgtggcgaaacccaccccgtctctactaaaaatacaaaaattagctgggtgtggtggtgtgcgccatagtcccagctactctggaggctgaggcaggagaatcacttgaacccgggaggcagaggttgcagtgagccaagatcacgtcactgtattccagcttgggtgacagagcaagactctgtctcaaaaaaaaaaaaaaaaaagtaaaattattttggccttaccatgcttggtttctttgtctttgttttttcattcactttatgtttggggaggagaatggagtgtcagtgatttcagcaaaaagttggggtaccagttcataataaattagtgtctaagattaatgttacagctgatattcaaagtaccaaatacgttattgttctgattattctggtccttaaatttgtctctttcctggagacgtggtaaacaataatgatgattctaataatgaccatttattgaatgagcactatgtgtcagacattgtactggtgatgtggtttggctgtgtgtccctacccaaatctcatctcaaattgtaatccccacgtgttgagggagggacctgatgggaggtgattggatcatgaggatggtttaccccatgctgtcctcctgatagcgagggagttctcatgagatctaatggtttaaaagtgtttggcagtttcacccttgcacccatgtctctctctgtctctcctgctgtcatgtgaagaagaggtccttgcctccccttggccttccaccgtgattataagtttcctggccgggtgcagtggctcacacctgtaatcccagcactttgagagaccaacgcgggcagatcacttgaggtcaggagttcaagaccagtctggccaacatggcgaaacctgtctctactgaaaaaacaaaaattagccgggcgggtggcgcacacctgtaatctcagctgttcgggaagctgaggcaggagaatcgattgaacctgacagatggaggttacagtgagccaagattgtgccactgcacttcagcctgtgtaacagagtgagactctctcaaaaaataatgataatagtaagtttcctaaggcttccccagccatgcagaactgtgagtcaattaaaccttttttcttcataaattgctcagtctcaggtagttctttatagcagtgtgaaaatggactaatgcaattgggcaatgtctgacagtttgcaaataccatctcatttgtttttaatagaaacctcctgctgagagtggtggctcacgcctgtaatcccagctctttgggaggccgaggcaggcagatcacatggtcaggagtttgagaccagcctgaccaacatgatgaaacctgtctctactaaaaatagaaaaattagctgggtgtggtggtacgcgcctgtaatcccagctacttaggagactgaggcaggagaatcacttgaacgtgggaggcagaggttgcagtgagcccagattgaaccactgcactccagcctgggcaacaaagtgagactccgtctcaaaaaaaaaaaaaaaaaaaatctaatactagccatgaggaaagataatcactctcagatagtaaagcatttgcttagccatatgttaagctctgaattcagatgaaggggcatctaaaacaggcagagagcatcaggaagggcttcctggaggagaaagtgcgtacactcagtctttaagagcacgtgggaggaaaaaccagtgaagtcctcctgctgtagacagaatgatcagcctgggcaaaggtgtagaggggtaagagagcgttaaacatgaggcagctgtgtaatattgtttcctgtaatctcttctgtacaggtggagaggtagcaagagacccaaatgatgaatggctgtgagtgccatgccatagcaaaattctgggttttaaaagagaataagcatgatcaggctggggatgttgaggaggggaaagaagggggatagagatggagaccacccagtggcccgctctccctcagtgctttggattatggggaaatgaacagagagccactgtgcccagattttattatgggttgagcagtgatcaagatgggagagagaaatggtaatgggactaactggcccatacaccagatggcatttgaggggaaggccgggtctgtgttgtcagggggccctgtgttctgactcccttcccattagaataggtggtgattaaacaagctatgccacaccctaaattctggttctgggttttactattcagtcagttttatcaaattaagatgatcatgtcttcccttctgaaaaattataggggaagaaaaaccatagaactttcccccagtatatagcattgaattacacatattcctacacacacacacacacacacacacacacacacacacacaccactcacacatatatacgtacatacatatataatagaatttttatataatatgtaaaattttaaaaatatatatttttagaagggctgggggtggtgggggcggtggctcacacctgaaatcccagcactttgggaggccgaggtgggcaaatcacctgaggtcaggaattcgagactagcctgactaacatggtgaaaccccgtctctactaaaaatacaaaattagccgggtgtggtggtgcatgcctgtaatctcagctactcaggaggttgagacaggagaatcacttgaacccaggaggtggaggttgcagtgagctgagatcccgccattgtactccagtctgggcaacaacagcaaaactctgtctcagaaaaaaaatatatgtgtgtgttttataaacctataaaatatgtgtgtgtgtgtgtgtatatatttatatatttatatatattacatatatatatatgtttagaaaataaaagatgcagtatgtcagtgctttcttatgacagttgcagctacaaaggaagattaaagctttttaaaaagtagaatttttatctgtttgtggagaggactgaaaccagtaagctcttgaaatgttttcatcctctcatcaaatatatatggacctgccatatgccaggtactgttcttactactgtggaaatagcagaaaggaaaaacaaagtccctgctctcagaaggtttagaatgagataaggcaggctactgagttggcttaaaaactaagaggaaactagtgaagtgtagttgcccgttcacatttttatttttttaagtattttatgcccacggaaaactgtgggactgggacttgaattctaattttatgttttcttgggttattctttaaaacagggtcttagactagtaattaatacagtgtcactctctttcaccttcctcaattcctttgcatgcttgttaggtcattcagagtggcactaaggtaaactttggcatatcaaaatccacttgaaagcagatggttagcaaggggcagtgacttatgcctgtaatcccagcattttgggaggccaaggcgggtggatcacttgaggtcagaagttcaagaccagcctggccaatatggtgagaacccgtctctactataaatacaaaaattagctggtgtggcgacgcacacctgtagtcccagctatttgggacggtgaggcaggagaatcgcttgaatccgggaagcagaggttgcagtgagccaagatcgtgccattgcactccagcctgggcgttacagcaagactccatctcaaaaaaaaaaaaaaaaaaaaaaaggagatggctatgcttgttaaacactgtttcagttgagtacctctcctgtgggcttgttggttcttgtgcagattcctgctcctgcccaagtccaggactagctgcacatacctgcacatgtgcctcacccagtccaggacggctagccttgttctcttcacccagcccagcagcagagtgctaggaaactttgctggcagggctgtaagaacctctgtagtttcttcccatttccttgttctcctaacttactatgctgggaggaaataatatggtgtggtaacgattttaggcaaagaaaaaaagcgccgaaatggatgtggtggtaaaattaggccaatcttttggaagcaccttagcaacctcctttcatgttcttggtacctttacctggttgtattgtaatgttcatttttccttgtgaacatctctctgtgtgtgtgtatgtgtataatttatctagtaccatggaatctttgaaggaaagactaaaaaactttcagaattattattattattattattattttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgaaaactttcagaattataacaataagtttcatttgttgtatagcacattctacgtgaccatagaccaactctcctttatcaatatttgtgtattctcttaaagagctaaaagaaatcattttttaaaaattctttatatctaatgttggccaatgttacctataagaaaagatcattgtttcagagcatgtgagatgaagatgattgactttagggcatttacatgtgggaactgtcaaggtagttgaagtttacaagagtgggctctctctctagtcacttcgggaggaatgccatcatcaggacatcatcacgactgactgatttggtcagtctgtctttcatcaagtcagggagataaacagaattgaaaaattgttcacaaaggttgtcagttattagggtgtggctgacgaaccacacctgaagagctacctagatgaaggcaactcacagagttacttaacaacctccaccccagttgatggtccagagtgtttccaagggaggtgaactaagccaatgttgagactgagtgggataaggccatggtgacatgcataatagatgcattcatacacattgcttcaatagagcattttcttggatggaagcatgggaaataacacatgggcgtatactcacgcttgttgttagctttcggggtcactgctgatatccttccttgttcagttaccctttgggacttgaactcctgcaagatcgttgaaaatcttcatgttctcagaactcaaagggaagaagacttgacccctaacccttcagaaagctggctgaaaaaaaaaaagattgtccataaatagcaattggctttacctagtattatttaccacattattaaactgctaattgcagtggtgtttttataatgccactatattattttaatttagaaaacattttataagtttattgtttgtaaattaaatagatttgcttaacagttctttgggaattccttaaactttattgctagctacaagtcctttttaaatagaatcaataggctgggcatcgtggctcacgcctgtaatcccagcactttgggaggccgaggagggcggatcacctgaggtcaggagttcaaaaccagcctggccaacatggtgaaaccccatctctactaaaaatacaaaaaattagctgggtgtggtggcgtgcacccttagtcccggctactcaaagggctgagacaggagaatcatttgaaccccaggaggtggaggttgcaatgagctgagatcgctccactgtactccagcctgggtgacaagagtgagacgctgtcccaaaaaataaataaataaaataaaataatgaatagactcaatagacattgatcctgctaacatattttgccttttaatctattggtacttcttttattccctttaaagttaattctaaataaaggagaagtatcttaatttggttaatatcatagtttggaactatggcaaaattattttttctcaggctactttctagtaagtattttatatttattcactaaagaaaatttttaaaatttcaaattacgtagaattgtaccactctcacatagaaatgtttttatctttcttatacatatatttatgtggtttgatttttatttggaatgcttgttttacttgaggtgtcaggactttccactcatttatgaagcctttacaattataatgataaatactgttacattaatgtacaataatttataaaactgactttctcatgtttaaaatttagatcgtgtctaattctttgctactttaagtatcattgcagtgaaatcttcaggccataataagttacttccttgcgataagttcacaggaataactagattaaaggtatgaatacattttaatttggttgaacacttacgtttatcaaaaactctttacaaaagtaacacaattatcctaataaattagaatattagaagtatataagatgaaaaaacattctcactgaacttcagtcctgctctccaaagtgaaccatgatgagaccttaagcaaatgttatatataatgagaaaagatagtcctgaagaattgagtgatatggaagtgataatggtgtactatatgggtgaaaaaataaagtactggtttagatacatgatttaagaaatagaatcctgacagttccctctgtggataagccatagaggtgtccagtgttggtttaatatagcagctggtttgaccgagtaccctctgctgcgtcaggtaatgttaaatgatgtccatgcccccttgactctgatcaagacatggctacaacctgcagtttccagctttcctgggtttaagggccattgaagaatccttgtagataagagaagaattgtacattccaggaactggaggcatagctagccttggaaagctcggagggttagttgagacagctttagacttgcacatctgtgacctgagtatctttgagacttgatttcatcttctagacccagaggcagagatcatgtttgtggttatttttctgggaactgagactgggcaaagggaaagaggccagtacgcaagagtgctgtttataaatggttaacatcgtccccagtcccgtagaagaagaatgaaatggtattctcctgtttggtggttttatttgattgtttttgaattctttgtctctgacagaaggcatcttctgtatcctttatgttgtcactcactttattactctggcattattataattaggttaccttatcactccacctgccagccctatctccatccccaagacctgaagggacggttggcttgacatgtgaggaggttttttggccttcagagatgtcgctgtcagccccctgagttccatttgttagtattgggtccagcccacagctttctactaaaaacaacaggcaaactaaagaatcttttagtaagtcacagacaattgtcactgaaccaagagcccagcccacggggccagttcctcaccgactctatgccttaatttccaatgtgtaagcttggatgactacacttatctccaggattcagtgtaggacatagaaaaaagtacaggactcaagtaatgattgaacttggaataaaaaccttaaggcccatgtcctctgtctctcatgcttttcagatgtgtcttagtgcctgctccttgcacagaagctgaatccaaacaagccactgaggaagttacatttcacttcacttcttaataacataggtatgtcgatcccattagataggagtgtgtctaaaattcagaacctttgacactaattatctgactgtcaaatgacagtgtcattctattttgcaggcatttttgatagtttatcttcccagtaatatttttgtaatcttcatcaccttgaccatctaactcttttttttggagacaaagtctttctctgttgcccaggctggagtgcagcggtgcagtctcagctcactgcaacctccgcctcccgggttcaaccgattttcctgcctcagcctcctgagtagctgggattacaggcgcatgccaccacacccggctaattttttgtatgtttagtagagatggggtttcaccgtgttagccaggatggtctcgatctcctgaccttgtgatccgccagtctcggcctcccagggtgctgggattacaggcgtgagccaccgcgcccggccgaccatctaactcttatgtgcccttgcctgtacatataaaagtacatttaaaaataggattggctttcatttgcataatgaacacacatattacccatagtacctcccacacaaagccacctatgcctcttaaattgcactttgttaataggaaactatctgttgttttgtgcttttggcagctgtagagaaaatacacaaagccaggtgttgtggctcttgggtaagactgagaatgtgatttttgcaatctgtgtttttttaatagccagttattggagataagaaagagaaattcagtacaaagtctaagatgtcccagtgatgcactctgactgggtgtcattatctcaacaggaatgaatgtagttcaacagtatgtaggcccggtttcttagacatgatgtctgctgaaatggtgataaggtatcccacattatcggtgtttttttgaagacagcctttagggtttcagtgtcatcatctttatgccttttgctaaaacagtttatgttctgccttttagtaagcctttatgttaaaaacgtttcatattaaaaaaagttatcatttggaatacataggtcaactatctaggaatgggacaaagtacagaaacaatgagacaggatttgtgggatgagaaattaaaaaagcagtcccttcagctgaagaagctgcttagaaatttaagccggacatctcaggcggccatactggaatggaatgtggaaaaggtagcagttatatgtgagcaatacctttgactgtgacactctttcgaaccccagtttagaccagcagcagctctcctaatggggagtcaagaagtagtaagagaccctaagagtcatataagacacaaatcacctttgcctgtgatatttgccatacatatgcctatggttacatgcagaggatcccaacaggagcatcatacacacagcaaataacactaatgtgttttatttatatgtaccaaattaaaggggcatacaaaataaaatttttaaatgagtgggtgaagatattgggacagaaggaagatatcaagaggaggaaatatggagtaaagatagaggtagcatgtactgtaaaagatcttgtaagtagaccagaataggccagtaatttggctccatgcttcctagcagccaaggcaaagaagtaattgtgaccagatacatagttcacagcatctttaagattcagtaagctagcaactcaagaaaagcacaagtagtcaccatatagggacaagtggaccatgctgtgaacagcacactagatagcaagtacagctgtaacaatcgttgctggagatagagcagagcttcagtcctttatgacaagcttgtccaacccatggcccacaggctgcatgtggcccaggacagctttgaatgcagcccaacacaaatttgtaaacttcttaaaacatgagatttttttaaagctcataagctatcattagtgttagtgtattttatttgtggcccaagacaattcttctagtgtggcccagggaagccaaaacgttggactcccctgctgtatggaaaatcgaatttgtttacattctcctgttgtattcatttttgaaattttgctaattcctaaaaggaatccacagagagcaaactctctattactaacttttttcctcttctcaatgtaaattaagtagtatttcaaatgagattaaaaacaggatacttcttgaactttactttaaaaatacaggttcatgagccccttaagttttgtgactttctgttgtaaaaaagactgtattcactagatggcagtgtcaccagccttttgggaagttaaatatgagtgtgactgtcctaagtactaaacatgggtaaaagtaggaagaccatttaactgagcataaaggatctcatttctgcgccctacaggaaagagtagttctcctttttctcctcccctcttatttgaggccgggaagaaggcgctgtgcatagcgctccaagcatctctgggtggcactggagggccatttttcacaaggagcaagtcggccagcagagtgctcagttcttggtcatgccagtggctgcagggtttccagccacttgtccttgcttctttgtttctgaactttcagtccggggcaggagttactgacaagagttcacaaaccagctgtgagataatggtgtattgataaggtacaaaagtgtgtttagcagatggggataatttttcgaccctcagtgtttgtttaaattgtttctagcatgaaagcaatatgatctctctcaggaaatgagattgttttctctattcaggtaataggatcttttacccatttccatctttgaggagtgattatatacttctgcagtttttttaaatgaaaaagatttatttttaaatcatactggcataaagttaatggtattttgttaaattttaggatttttacagcatatcttggctgacactgatcttggtcctatcctagtggcaatctcttaacagttgtgctgctggtgttatgagtaggacagttcctcattgtgtgggactgtctcgtgtgcggcagggtattctgcattcctggcccttgcccactaaatgccggaagtgcccctcagacatgactgcccagtaacactcccatgcatttccgtgtgcctcctggggtggggccagtactctctagtgttgaaaactgctgggctagagattttggtgtaggttgtgggccttgtggatttagtgaacatgatcttttaaagaaatgtatataaatgtactttatatttttaaaaaatcactacagcccatcaccttaaacttctgctcattcatatttatatatgtattctgattgtgattactcctacatacaattcttaatatagtacaaaattgtacatatataattttatggtacccatcccccccctgccctttttttgagacagggtctcaggctggagtgcagtgatgcaatcatggctcactgcagcctccgtttcctgggcccaagcaattctcttactcagccttccgagtagctggtaccaaaggtgtgcgccaccatacccagctaatttttaattttttgtagagggtctccctgtgttgcccagactggtcctgaactcctggcctcaagcaagtcctcctgcattggccttccaaagtgctgggattatagtcttgagctaccgcgcctggcatagtatcatctttttgataccaacatactataaatatattttattgcattttatttgaaactgttaatagacacataatttgctgatgaattgtattctttgctcttttagtccatctggcatcatatgctcttcctttttgctagaattccctctttttttctttctacagaagtatcactgggtgggagaaagccttacctgtgatggtttgagtacccacattttaaaattatgctagttaagaagagggggaataatgttgtttcttttctctttttcttatcaaatagactaaaaaggctactcaagggctggaatttgattcccacttgttcttgtggtacctagcacagagtcagtcccatagtatatcctttaggtaaagacttaattaattggtgtgctttcagtttattttccctggttggtctttgcatttgtccagttaacaccagcttctggatattagatcaccataaagtccaagacatgaagaacaaatgttatatattctctttgacatttaaagacagaagatagtggtagaggagatcccaagtgatacctaacctagctaaagacccatgaggaatgaaagaacgaacagggaaaacaactgctgaatccaggtggaaaaatgctggcctacttctggtccttggtatgccaggatccaaaggtggtgccagctgatagcatatgttcaacagctgtgttgatgccatttgcctgcccagacaagcctcttgaggcatgaaagcctaaggaaggtttctcatattaaggatcaacagggactcttctgtatccgtcctaccagtgtcacctccccacccagcatcagccgagcaccacatccactgaagctcaataaagaaatgtttaatgctgaagagtttcaatcaacaagatgaaattttcaggtttaggtaaacttaggaactggcttgggttactagacttccaaattttatccggtcctaccttattgcatgacataaccgtgaggactaaagtgaaggcttttcagcagtcacttcagtgagtcctcagcatttaggtgatactgtatcaactcgtgtctgaagcaacttggatttaagatagtagatcttgtgctgattattagaatggacatcctgaacaccacttaaattaccatcaaactgcatagccagatctttaatttacgaaacctctattttgtcacttctccaagctgtcatttaagctaaaagctgctgtctttacacatataaatcaaagaaatatttcatttatattcacttgatacctaccaaatttcaccactggaatttctgaatactttatatcctctatccttccatccaggcttggctttactaagtgtcctttctaagccactcattatcaatcaagatagtaattattctgcaagaccccaaatctcagtggctttcaacaacacacactgatttttttactcatatgctacacgtccattatttgtcagctgcagctgtgttcagtgttgacctcaacctgtgatggagcagcctctgcttatgtcgctgctgttctttatagcagaggaaggaaagaaagcaaggcaaagttccacactagcccttaaaacttcttcctggaagtgagacatggtatttctgctaccacttcattggttaaagcaagtcacaatgccacacccgagttgagtgagggtggggatatgtgattcttccttaggaaggagcaggaaattttggtgaatagtaatgtaatctaccacatgtttaaaatgcagtcccttctctagaagatctcagtagtctaagagagaataatttttttttaatatactaccgtaagtgaatgttaggtcagttaggtcgatttttttttcattcttgcaaggaatcattatgtctaataaaatataataaagagtttatggtatatttgaactgtccttaatgttattttactgagtccagttcttttggcagtggtttagtttctttaacaatctgtattctacaacttcactcgttgccttccttgtttaacatttatttttcaaaaccagacatgtcttttgtcttcaaaggataaatggaattggttaggagaaggattggggaggaggggggttgtggcaaatgtctaaaacctatgttttattcccttattttctcaaaaatgttagctcatgttcacacgggtttatctgtttagtctaagaagtagttacttttgctgtctggccaaagaggttcaggaccctggagctttgttctttgggaccctgaaggcagcctggcaggcagagcccagtatcacctttacagctacttgatggtgatcaagagccagctgctcttctttcacctggctgttgggggaggcacaccaatatgggtgggcaggaaaagttacttcccaggctgaaattttcccaccgtaaacttaggctgataggctgacagtctgcacctctcttcctcagcagacattccgatcagcaggccagtttgtgacgcgtgcatgtgcacacttcagattgcttcttccactttcctctttcctgctcaggtttctcataggagtaggctccatgtaagacttctgtcttttgtgaaaaagaaagcacgtatttatagaatggaatttcttactgaaagagggtgcgggcagaatggaggatgacatgaatcctgactcagtaacatttatggaaccactctctggatgccacacttactgtgggcagttaccaaaaaaatcagtttggcctacctgcctcctaatataatttaccctgcacacaaggcagtatcttgaaggttatttcagtagtacccacggaattctgcttcctttaggtaaggaaaagtattcccaagaacaaaatatacaggttaaagcccatgtaatataaaattatggcattcattgaagaaaatacaggctattctaattccagatcacatttatttatttatttacgagacagagtctcgccctgtcacacaggctaaagtgcagtggcgtgatctcagctcactgcaacctccacctgctggttcaagcaattctcctgcctcagcctcccgagtagctgggactacaggcacacgccaccacacccagttaatttttgtatttttactagagacagggtttcaccatatcggccaggctggtctgaaactcctgacctgaagtgatctgcccacctcagcctcccaaagtgcttagattacagtcgtgagctaccatgcctggccccagattacatttttaaaatgaagaaacagatattttctcttagtcaaaatacttatcggaacaattttttttaaagcaaagattgcatcatttaaaaaaacatattcactcctaggcatctgaatcactgcttcacatgcacagtagacattcgtgaaattatttttttaaatgatgatgaatgccagggcttgctttttttaaaaaaaagtctccaaccacaacatccaaactggtcatttgggaagtgatgcttccattcagtaagaaagctcctgcacactgggtgaacaggcggtgttttctcctctcatcgctgacatttaatacctgtcttgaggcaaaattgtctccaccttattaatccatggctcctcacgagccttaaaacagagaataaaacttgtcaaagaagaaaaatagaaaattagagaaaataacctcactacttattttcaggcaccttgtgacttaagaaaatgtttttaaatgtggactctacattttatgaacttaaatttagtgtctgttggtcaaaatccacaggacctttaggagagaaaatggccataactaagtacaagcctctctttttaaatgcttacccaggtcagttaaaagcttccttgtagttctgaatcctcagttcttgctttacagccaatacttaaaaggaacaggggagagctacagtgcttttgaatttcagagaggcctcttatttgtgcctcaagaatagtttgtataaatgttatatttcaagccacacagtacttaaaaccatcacactgtttagtttatctagttgggtagaagagggggcaagagaacaaagcagtattaaattagggcagcagcatcagggacaggctgatgtgagagcaccttctttcttgggatgggtagagtataattgtccctttgcctatcgtcagatttgggtggcccagttgctttaaattttgaaaacatgggagtattaacgcaaagaagagccaacattagttcagaatagctgaattcatcattcttttggaaccagttttgctactgtataatgataatagctcttcagcattcatctagtgagtgataaagataagtgatgatccacaagaaagtttacctttgacttgtgggtgctcacggactgcagaatgcagatgttcgtagatcagccgtactgtaattttcaaggatttaatatgcaatacattcctatattaagatgttgaaacattaaaatattaataatttgcaatgatttttaaatactttaaacaggctcttccactggtgagattgtttttccaagcagagttagctagtttaaattctttcgttgtggctgggtgcagtgactcacgcttgtaatcccagcattttgggagtctgaggcgagcagatcacctgaagtcaggagttcgagaccagcctggccaacatggcaaaaccctgtgtctactaaaaataagaaaattagcctagtgtggtggtgtgcgcctgtaatcccagctgctagggaggctgaggcaggagaatcgcttgaacctcggaggcagaggttgagccaagatcacaccactgcactccagcctgggcaacagagcaagactcccatctaaaaaaaaaaaaaattgttttgttgtattctcagttgtctatttcaggtctaggcaggcaagaaaactttgtcaggtacactggtgtcttccaaaatgtgcatcgtaccctctattactcagtgtcattaatcacatccattcctttcccaccctgtcttggaataggacattaactcttcaacgatctgccccctaaataaaacctgctttcttgggccatagtaaacaacacgtaattctttgcgagaaaagcaaaatagtgataattataatttttttttttggaacggagtctcgcactgtcacccgggctggagaacaatgaatggcgtgatttcggctcacggcaacctacacctcccaggttcaagcgattctcctgcctctgcctcctgagtagctgggattacgggcgcctgccaccacacccggctaattttttggtatttttttagtagagatggggtttcactatgttggccaggctggtctcaaatgcctgacctcatgatccagctgccttggcttcccagagtgctgggattacaggcgtgagccaacttttaaaaattaaaaaaatttttaaaaaccaactttttaaattttcaaaaaccaattttaaaaaccaatttttaaaaagccaacttttaaaaatttaatattggagcataatagaattcagcaatataagatttgattgggaataagaaataacatctcttttaaaaatgactacagccctcttaacaattttactcttaaccaattttggggtaccagtttactaattgatcaaattccagattggaaattagtcatcatttgattaaccagagttaagcctcttgaatcaaattctctaatttattatctcccatctgatctaaattcttttttaggggataaattgccaaaacgctttcagaatgcccagtactagaaatctaagctattcaattcagtctcttctctgttttcaggctcctttcctgaccctttggagaacctaatatatttagctaaaaatttttctttggggcctcacctaataaaggtaaatagaaaactgatagctatcacataacatacatattggttaataattgcaaccaaaagtaaattaataattttgagctatttatattagctctgccaaaattacatcattaaatttggccttatgaagcattgctgactgtagtaaaaacaagtgtgagcaaagtcttcatatgcactgagtctggtttcagttccacgtaatactgacttggcaagtgtggaaattctcatgtcatcattaccaaaaaaaagtgagttcacacagggatttctgatcaagtgacccattactgcgggaaaaaaccacacatacaaaagcctttgaccccagtaattttgtattggtatatttaccctgatcttaaactgcaaggaatgtccgcaattagagtttttctttgttttctaagtctgaaacttgataatccatttctgccttcccatgacgagtggacattcctccagccagtggtgagttcctctttccttcgctctcagcaagagcatgggttgccctcccatctcgtaagcagagcctaccacaaacgcagctcaaatctcagtttccagccctgcttactcactcgcttgttcctgaatccccacattacccatcatggcatcttactctgtagacttcacatgtgaactttgccctcgccggtggaaggggtacagtccagatgggagatgaaatccaaatgctccaccaaagggctttggtttgttctggggagccctggtgctgccgaagcctcttgggaaggaaggagggaagaggagaagaaaagatactaagtttggttttcattaaaaatttttccaggttttctttaaactgataggttcagggtctttttcatacaacagtctacttttagagcttttgttcgtttgttgtgtcatgggaatttataagggatggaaggaaaagggggacaaggaatggtctaatttcggtcagtagaagaatacctgaaacctgtttaaatttatttggaactaatgacttctacttttagtatccataaaagacttcccttggagcacaaagaagttaataatctgtgtatattgtcacttcatgctcttcttaagcgctgtgtgttggggcactgctctaggtgtggtgaaagactgctacaggataaataagtcatggtcactgccctggaaagaagcttaaaatccagtgggagtaaatgataaatgcataatgacctaaatgtcagatggatctagtacgtacctggaggattgcatagaagcatcctgacaagggtgccaagaatacgcaatgggggaaaggacagtctcttcgaagaatactgttgggaaaactggatatccacctgccaaaaaataaaattggacccttaacaccatatacaaaaatcaacttgaaatggattaagacttaactgtaagaggccgggtgcagtggctcatgcctgtaatcccagcactttgggaggctgaggctggcggatcacaaggtcaggagtttgagaccagcctggccaacatagtgaaaccccatctttactaaaaatacaaaaaatgagccaggcgtggtggcagcacctgtaatcccagctaatcgggaggctgaggcaggagaatggcttgaacctgggaggcggaggttgcagtgagctgagatcatgccattgcactccagcctgggtgacagaccgagactccatctcaaaaaaaaagaaaagaaagacttaatggtaaggcctgaaaccatataatttctagaagaaaacacaggggaaaaaagcttcttgacattggccttggcaatgattttgttgctgttacctcaaagcacaggcaacaaaagcaaaaacatacaagtgggactacatcaagccaaaaagcttctgcacggcaaaggaaacaaccaacaaaatgaaaaggtaacatacaggctgggagagaatgtctacaaaccatatatctggtaaaaggtcaatgtccataatatacgagaaactcgtacaactcaatactaaaataaaaaaaaaagtggaggtggggcaaaggaccttaatagacacttttccaaagaagacacacaaatagccaacaggtaaatgaaaagatgcttgccaggtacggtggctcatgcctgtaatctcaccattttgggaagccgaggcaggtggattgcttgagtccaggagttccagaccaacctggacaacatggtgaacccctgtctctacaagaaatacaaaaattagctaggcgtggtggcatgcacctatagtctcagttacccattagactgaggtgaggaggctgaggcaggaggatcacctgaacccgaagaggtcgagactgcattgagccaagatcatgccactgccctccagcctgggcaacagagtgagattgtgtctcaaaaaaaaaaaagaaaaagaaaaaaaaaagaaaaatggtgcttgacatcactaatcattagagaaatgcaaatcaaaaccacaatgagatattatctcacatttgttaggatgcctgttatcaaaaagacaaaatataacaagttttgacaaggatatggaggaaagggaacccttgtacgctattagggtgaaaattggtacagccattatggacattggtatggaagttttgtaaaaatcaactatatgatccagcagtcccacttgtggatatatgtttaaaagacatcaaattagtatgtcaaagagatatcttcacttccatatttatttcagcattactcacaatagcaaagatatggaaacaacccaagtgccatttatcttaggaatggttaaagaaaatgtggtatatatatacaggatagaataatatttagccataaaaataaggaaagcctgccatttgcaacaacatggatgaacctggaggacattatgctaagtggaataatccagacacagaaaaacaaatactgtatgatctcagttatatgtagaatataaaaacgttgaatccacaagccaagagtagaatggtgattgtcagggtctggggcatgggagaaacggtgagatgctggtcaaagggtacaagctttcatttataagatgaatatgttctggagattagggagcgtccttagtcttttccctctccatgcagagggtaactatgtgtgatgacagatgtgttgattaatttgattatgggaatcaatatgcaatctatatttatatcaaataatcacattgtatactttgaatacgtataatttctattaattattcctcaataaaattaggaaaatcagaagcatcctaaaagttgcattaaaaacaatgatgaaaacaggccgggtgtggtggctcatgcctgtaatcccagcactttgagaggctgaggtgggtgatcacttgagatcaggagtttgagaccagcctggccaacatagtgaaaccccatctctactaaaaatacaaaaattagtcgggcgtagtcattcctgtagtcccagctactcgggaggctgaggcaggagaatcacttgaacctgggaggtggagggtgcagtgagctaagatcacgccactgtaccccagcctgggtgacagagcgagactctgtctcaaaaaacaaacaaaaacaatatcccctttaaaaacgcaatgaaaaaaatagctgccttaccaagccaccagtgagagcccatctctgaggaaaaggggtgtgcagccggacaggcttcagtttaaaagcttaaaccttgacttggacttactttatgccctgagcaagctatttaacttttttgttccttaatttctaaattatgaaatggcagtggaatgaaatggaagatgaaattgtgccttgttcgatgccctggggtctgaaaggtgctcctaagggtgtacagcagttagcaccgttagcgtcctgggcaaacccacagcccgcagatctcttatttggcagcgaattcctgcagatcagctctaagagccagatttcctcatggaggaaaagactgctactgtcacgggaaagatttgtttaaacatattttttagtacagttttataagtccttatcaagtagggccagcccccagataaaaaccgttaagtatttatctgtaagccagaggttgagaataggaaacatttgaatctttaagaacttgagtccaacaaaaatactggctaacagcctgactgaggtgaaataaaccttgtttccagttttccagaaaaattgtttattactgggcaaatcttgggcctccaagattgcctatatttttgtttttcttttctcttaatctacaggaaacttctgggttgggccttctcatagttatccgttgttaaaagttctatatttctacaaaccttcttgtgcgaggagtatctggaaaaaaaaaacaacattgagatcactctttaaaaattagtgttttagacaggtttctggttttctctgctttgttaactgaaacagcccccatagaaacattctgaaagacttaatcaaacaagtattcagaataaaatgaatgggaagaagttttgagtctccttgatcaaacatggacctgtgctttaaaaagctgagcccctgagtttgttgcactgtgtacttaaagtctgtgacagtttagcctctttctaggctgcccatatctctcaccactcggttcatttcccggttttaaccactccccacggtccccagatgatcattttcatcctgagcctcttattcccaccttcagtcacttcagaaactcccctgcactccattcaactttctggacctcccctttaatgtttgccatttgtgcattctacagctcggtgcacttgttttctgacctcaagagtcaggagaggagctatcccagcttcaattcctcatcaataaggtacagaaaatactctctaggattactgaagaaatgaaataagcaactgtattttaagtattttatgtactgtaaaagcattgtgcgtccgggtgcagtggttcatgcctgtaatcccagcactttaggaggccgaggcaggcagatcatctgaggtcgggagtgactggccaacatggtgaaaccccatttctactaaaaataaaaaagttagccaggcgtggtggtacatgcctgtagtcccagctactcggaaggctgaggcgggagaattgcttgaattcaggaggcagaggttgcagtgagccgggtgacagagcgagactccatctcaaaaaggaaacaaaaaaaagctgtgccaataaaattatacttattattctagatacaaatattctgaatgctcctttagtcagattctgtgttttctgttttgtttttgtaattttcacttaggaggaggctgtacataaatcaagcccttagtaaatccttatttagtgaataaataaatactgccaacatctggccccagccctatttggcctcaaatttctgagggctggttaccactattgctgaaaatagaaaaggagaaacaaaaaacaaaacccaccaattcaggacagaatatatttgtgcttaaacaagcacacagtactctcacatccaccctcggtctccctgaaactcagacctgcaaaactaggatacaagctgtaatgacatgatgctttcacaatagcagattgaagttagactccagaagacagctttacagtgtgttaaaccagatagaagacaggcggctgctattggtgttttacactggtgtacatcggtgcttctcagtctcttcacattctaactcattccttttggtgttctgtgtagctattttggtctttatttcatatttatttgatttgctcttttcttgtaccctttattccaagggggaaaaaaaggtgggggttggacaacagagaatgaacagcacagaattcctttccttaaatactgccatcctgggaaatctagaatcatgaaatgtaagatacagattgtgccctagatcctcctgtcctactcttcattttatggacaagtccatccagaaacctgtgatggatgagggcagagcctggaagaaccccagtctccattccctcctccttctccctaaaccacaaagcctgatttgagtacccagggctacccaggttggaaatagaagtcctcatcttctgcccaggatttctcactcctagccacagagcttctgccccctcctagccacagagcttctgccccctcccactggaagcattgtgcccaggagaggacctttttctcttatctctgctggtaagcttgattatcaggatattcctggggacctagaatttaatctcttctccaaagctgctctttgatggtgttgagggtgtttttgccagtaatgaacaatcttcttgttttgaagctgccttttatcttgtttaatacattgtaaagttgtcttctggagtcttcttcagtctgctattttgaaagcatcatgtcattccagctcgtatcttggttttgcaggtatgagtttcagggggaccagagggtggatgggagagtgctgtgtgcttgtttaattaagcacaagtatatcctgtcttggattggtgggttttgttcttgtttttccctttctattttcagcaatagtgataaccagccctcaggaattttaggccaaatagggctagggccagatgctggcagtatttatatattcactaaataaaaatttactaagggcttgatttatatacagcccccgctaagtgaaaattacaacaaaaaaaaaagaaaaacacagaatctgactaaaggagcattcagaatatttgtatctagaataacaagtataattttattggcacaatgcttttacagtatataaaacacttaaaatacagttgcttatttcatttcctcagtaatcctagagagtatttcctgcatcttattgatgaggaattgaagctgggatagcttctctcctgactcttgaagtccgaaaacaagtggacggagctgtagcactaagcctcagcctgctcgtcttcaacctgctcctggctgcagagtcttgattgactctgcctgtctccagtgtgctttcattcccttcagtgggtaacttgtcagacctcatcttgtttttgagactttggtttctgtcttgccttcttcctaactttggtattcttagttccaaatcctgaataactcctgtaatgggcctcccagtagggggggttcctgtatttatattcacagatgtacgtattttaatagttaacatctgaaatcagtatacatcttaaagttgccatggaagttcatttcttcagtgtctgcctctgctcgtcacttgaggtgctggtaaactaagaccaaagtttagattccctgcttgagggcacttgaaccacagtggtggtgagttcagaatgcaaatgagagtaactactgacttaggattcaaatcttcaggggagattcctcccctctctgcccagttcccaggttgaaacatccaaggctctttgccatccctttctgcatggcgggtttctttgtggccatttggttccctggattcaagtggtccctgatacctgttcagtttaccatcttgggccgggcatggtggctcactcctgtaatcctagcattttgggaggtcaaagtgcgcagatcacttgaggccaggagttcaaaaccagcctggccaacatggcgaaaccccatctctactaaaaatacaaaaaattagctgggcatggtgatgggcgcctgtaatcccagctactcaggaggctgaggcaggagaatcacttgaacccaggaggtgaggttgcagtgagccaagatcatgccaccgcactccagcctgggcaacagggcacaactgtttccaaaaaaaaaaaaaaaaatcccatcttgcatgcttttcctttctctgtagtatgtaaaataatgtatgtttgtgatcagtgagatctcagatctgataaaatgcagtgttttgtcatgagagttgctcccagccgctgatggggttgccttgttcagcactttttagcaccaggggagtaagccatgttcttgctccccctccctcaggctgaggctttgcttgatcacctgctaagacaaaaaccagagtgggtcacgagtcactctctctcttcccccagccacagtggcagctgcctaacttggtttcttgctggtgcacacatgtgacagaaatacaatgttaataaatatttctacgtgtaatggagaaacaagccataaaagtagctgtttgccatctgctcagatacattattaggaaaggcaatgacattttatgattcagtaacttaactattctcctgccttctgtaaaggcccatcacatataaataaattataaacatccaaacacatcctgagagaagtgcattggtctctgaagcagaaacaaatgatacctgattctcccttctcccagaggagatctcaaacaactcagttacagtgcctcacagttgtaacctatagtacaaacgtgttggagatataacaccttgtatacgtatgtagagagaattggcataacaaagtagagaggagaattagacgaatgggcaccccaatcagtgattcagggagaggaccatattttaaacagcaggcaatgactcatttactgagtgttttctgtgtgtcaggcactgtactacgcactttgttcatctataagtggaagaatgcttgtttttcaagaacaaagggaataataagaataaaagtgaaggccaggcgcactggctcacgcctgtaatcccagcactttgggaggctgagaaaggccgatcacttaaggccaggagttcaagaccaccctggccaacatggcaaaacgctgtctccactagaaaatacaaaaattagcagacgtggtggcatgtgcctatagtcccagctactcaggaggcataggtgggaggactgcttgaggctgggagttcgaggctgcagtgagctgaggttgcaccactgcattccagcctgggcaacagagcgagactctgtcttaaaaaaaagaaaaaaaacgagttggggggcaggcacggtggctcacgcctgtaatcccagcactttggaggctgaggcggatcatgaggttaagagatggagaccatcctggctaacatggtgaaaccccatctctactaaaagttcaaaaaaattagccaggcatggtggcgggcgcctgtagtcccagctactcgggaggctgaggcgggagaatggcgtaaacccgggaggcggagcttgcagtgagctgagatcccgccactgcactgcagcctgggcgacagagcgagactcagaaggataaaaagtaataacctgaagagtagcttcgtttcaggtggaaggtgagagaggctgcagaaagcttagggctgggcgcggtggctcatgcctgtaatcccagcactttgggaggccaaggcggtcagatcacctgaggtcaggagtttgagaccagcctggccaacatggtaaaaccctgtgtctactaaaaatacaaaaatttagccaggtgtggtggcaggcgcctgtaatcccagctccttgggaggctgaggcacgagaatcacttgaacccgggatgtagaggagctccttgggaggctgaggcacgagaatcacttgaacccgggatgtagaggttgtaatgagccgagatcatgccgccacaccctagcctgggtgacagagcaagactctgtctcaaaaaacaaaacaaaacaaaaagtgcttagtcaatatctggttgttgattgtttaaggaaaaggccaagtgagggtatgactggttggtagaaatatgtatcttggtataagcagttctaggagtgatatgtgtcttttgctgctgttattgttgtttctgttcagcgttaatacgttttgcattgtaccacaaatatttccttactcctttgcctttgagacaaagggcatgagtttataagttgagttgaaaatagattaaatatatagtacagcctatgcccagcaagcagaattatctatgcaagttatgcagcccacacggaaaaagaaatgctgtgcggcctcattagcaccccaggatttgtggggctccccctgggcagccttaaccaggaaaatttcatagtctccttggcattccatccaagatttaagacttctcctttcatctccttgaggaccatcaactatacccttgagctcagccatcccacgcactgaggcttatctgtacttccagcccagacctccctcctaattccccactatacctgtgcactgaaacaccctcttaggatctccttcttccacattcctcctcctctaggcaaggcaagtcgttttcctcatctcagccagagcagtagttactgaaaactaacccaatatggtggcttctgagctcaggtgtctttcagtgactcctgctgcttccaaaataaagtccaactgtttagcttggcatgcaaaacctgtagtcatccatcccttgcatatttaactcctcacacaccccattctgtggtctcttcttccctttgcatctgctctgggtgctctttgaagactgtacttcctcccctttggggccaatttagtcatctttaagcctcatttcaggggtggtgtcctcagataacccttcttcacataccagtttgggttatctaccgctgtggctctatagctctcagctcacaccaataggataagtatttaacatactgttaaattacagtatgccatgataacttctcttccatcattctgtattgcatgagtacaaagactgtgtcattaatccctgtctccgtagcattgtgtctagcctttaacagtcacttaataaaggcaatgaaaaggaaataacatttgaccttcaatttaagtttgactaggtatggtcaaacgttagaaagtggcagtgaacttcttttgaagtcagaattcatattttcctttaacatcagatattggcagccagcttttccagattttcttggccaaaaatattactaaaattgcatgcccctagattttgatatctaggatgatacatctacagcatgtaattatttgtctcaataattgagctttaccttagggctctaagagaagaggttaaaggaatcagtggtttagtaattgtattgttaatcttaaaatgaaagttgaatggaaaatattttaaaaactggttaagaagataattattgagagcatggaaaagataattactacatatactgtaactggtgaagatggaggttttatgaaaaataaagcagcttgtaattttttacaacttctttcaaatgcaccttggactgccaaggtgagaggcaggggaggacattttcattccgtggagtcacactgaggatttatcttgtaattgattatcacattatctgctttgatcctcatgagataatgagagtggtgttttgttttgttttgtttttctttgagatggagtctctctctgttgcccaggctgtagtgcagtggtgagatctcggctcactgcagcctacacctcctgggttcaggtgattctcctgcctctgccattcgagtagctgggtttacaggcatgcgccaccgcacccggctaatttttttttgtagtcttagtagacacggggtttcgccatgtttgccaggctggtctggaactcctgacctcaggtgatccacctgcctcagcctcccaaagtgctgggattacaggcgtgagccactgctcccagcctgagagtgagtgttttagcaaagcaaaacggcagaggtaacatggccccctccctccacatcttatgaggtttcctaccattttctgtccaatcgtgactttttctacactcacttttagtgccccataagaaggatatttaatgaaaccttttatggactattgataagaacccaacccttgaccgggcgcagtggctcacgcctgcaatcccagcactttgagagccgaggcgggcagatcagaaggtcaggagatcgagaccatcccggctaacacggtgaaatcgcatctctactaaaaatacaaaaaaaattagccgggcgtggtggcgggcgcctgtagtcccagctacttgggaggctgaggcaggagaatggcgtgaacccgggaggcggaggttgcagtgagccgtgatcgcgcccctgcactccagcctgggtgacagagcgagactccgtctcaaaaacaaaacaaaacaaaaaaaacacctttttttgtcttgccattcaagttacttccaacagtgctaccccttctcccaagactcttaatgtagtctgtctgtccatagcattgtatccagattcctgaacctggcatatgagctctcaataattcattctgactcatctttccaggcttactgtttaaatatgttttatttattaatgtttgagacagggtctcgctttgtcacccaggctagtgtgcagtggcatgttcatagctcattgcagccctgaactcctagactcaaagggtgttcctgccttagcctcccaagtagctgagattacaagcacatgccaccacacctggctaagtttttatttttagtagggacagggtctccttatgttgcccaggctgggcccaactcctagcttcaagtgatcctctggcctcagcctcccacagtgctgggattataggcatgagccactgcactgagccataaatagatgcaagtcaaaatccaagaaaaccttgaaacaaattgccttacatggtaagaaaggtttatctttttcataagttcagaaatgaacttctggggttaattaatttgtaattgcccaattgcacacacaaagccaattcactgagactgtgatattgcagtaaagaaagagtttaatgaatgctaggccagcaatgtggaaaatggagttattattcaaatcaatctccccaaaggctcagagagttagggctcttcaaggatagtttggtgagcggaggacttagggaatgggtgctgctgattggttgaggatgaaatcatagggatgtgcaaaatggtctaatcctgtgccacctcacctgcactgagtccatctctggacttccttggttgagttatgagtcctggctcccggtggggtcactcggttgcctgaatgcaaaagtctgacaagcatctcaaaagactaatcttaggttctatagtagtgatgttatctataggagcaattggggaagtcacaaaccttgcaacctctggccacctgacttctgagcagtaagagattatagaaagtatgcttacatgttagcagaattcaggcccctcccattattctagtcttgtggcctttattagtcttacaaaggcagtttcagcacctgaacaaggaagggaatgagtttcagggagggactgttatcatccttgtttcaaagttaaattacaaactaaatttctcccgtggttatcttagcccatgcccaggaatgaaccagcctgtgaggccagaagcaagatggagttgaaccatgctagatttctctcaatgtcatcatttttgcaaaaggactttcagatttagtggcccactgatatcattaggggcccaggttcttattgtcacttcactctgccatccactatgcactggtacatcctgagacttgctctgcctcttggcaaaatggctacagaagtgccaggcatcacatctagacagggcatcttgtggctcttgtaggagtaaggaaacatttccagacgcaccctagagaacatcttacatttcactgaccaaaaatgagtcacatggtcctttacaaaccaatcacaggtaaagggaatgccgttattatggtaaccagcatgggggaacaggtggagagtcaaccaccaggactacagggcttccttttctccctttgtatgtccctcttccatcctgacctcatggtgaccctaaaaagtctgtgcctgcctaccaccaaacctgctctctgcccctctagattttaggtacccagccccccaggcctatacccgagttcgctttgctccatggaactttccttgcgcactccctgttctacccctttgccacctgtgtgaaggtcatatctctctagctggaccctgaggtcctttggggcatgcctgcgctgctctctattccttcatgtgcttcgtagagaaccacagaccctgactttatttgtgcaaaccttttccccaaaatgctaagactaataccacgcacagatggaagtactcttacatcctagtcatatcagccccttgagactggagctagtcttcaaaatggaataatagtgttccctttttattattagaatagtaagaattctatatgagtagaataagaaaaagttaatgtggcattcacaatttattaatgtcccttcatccatttacccacattcctttttattcttttttttttttttttttttttgagacggagtcttactctgttgcccaggctggagtgcagtggcacgatctcagctcactgcaacctctgcttcccgggttcaggtgattctcctgtctcagcctcccgagtagctggcggtacaggtgcacaccactttagtagagacaggtttcactttattggtcagactggtcttgaactcctggcctcaggtgatccacctgcatcagcctcccaaagtgctgggattacaggtgtgagccaccgtgcctggctttattccttcttaatgaggcacaaactcagtttctgcgtggtacatatagcctttagattttcatagttttactgtttttctgatattctcagacaaataaatggttgtacatcagaattattggaggagctttcaaacaatatgcctatccaagtatcaattaaagattcagtttcagttggcctgggttagggcctagggtgtttttgtaaaagttctcagggattctagtggcggccaggttgagagctctgctcttagatctttatatgcagaactctcctggctgagaattatcagaataatttcaaacttttcagagctcttatccagactgctgccatatattactgcttctcatattagcactgctgatcatgcagggtatgtcctggtttcttttgtgtttgatggctaaatatccaccttcccttttatctttttcctgcctggattgtaaacatctcatttctcttctgttccacagcattcaggacaatattaaagagatcatggaggctcagtcagttcccatcaacagagtccgaaacgttgtccacttcataacttgctgggcattctgtcctgtacacctttaaacaaccttcctggctgggtgcggtggctcacacctgtaatcccaacactttgggaggccaaggcaggcggatcacgaggtcaggagttcgagaccagtctggccaacataatgaaaccccatatctactaaaaatacaaaaaattagccagatatggtggtgtgtgcttgtaatcccagctactcaggaggctgaggcaggagaatcgcatgaacccgggaggtggaggttgcagtgagccgagattgccattggactccagccaggcgacagcgcgagactccgtctcaaaataaaaacataaacaaaacagaaacccttcctttaggcccagagagccaacctttccctcagagactgtttttaaaccaagccactttagactttgccagtccttctgtagtcccctattcaaaactttgtttatacctttcaggaatattttatctagtactttattgatttcatccagttatgtgccccttctctccattttttgacagtttctactttattccactcctccaacaactccttaatttctgctgtatcagcagagcctctcctaggtaattggaagagttgtccttctctcaaccctattctttctcaagtttgctattcccaggtcttctgttgccttcaaacactaccaagtagtctcattatctattcacaataatgatgtgaaagcttttgttccagcatttgttgaatgttcattttttctctggcctttcatcatctgtgacagtactttgtttagaaaatggagggtagggtggcacttgtatagcccattttgtatggttcaacattcatttcattgtgactaatgatgactgatagctgatgtcataagtagtgtttcttgcagcaaagtttcataaattttagcatgcatcacaatcacttggggtacttaactcaagtacgtattgctgggacttaccttcagggatatctaagtcaccaagtctggggtgaagcctgagaatttgtatttctgttaagttcccagatgatgctaatgctttatctggggaccacacttgagaaccactgtcctatgggatcaagaaataagccaggaacgagtgtatattttttctagttaaatatttaatgttaagatgtttagaatttttttagggaggtgcttgtcagatacttttcctaatagtgggtactcagagtatttcatgtgagactaccaatgtcatatattttaaaaactattagactgggacagatgggaaattgccttcagcataagaaaagccaatatttttcataagtcccaaaagcagcttttggggttggttgattcagtggttcaatgaaaccatcagagactctggttcctactctttattccactgtgccatggaccatgtgctggtacatcttcagactcactctgcatggtgacagaatggctgtagaagtgccaggcatcacatccaggttacatacagatgcacactgtttaatagccaagcttatgcagtatcagtaactattagagaaactgaaatggaggatccagaacttcttatcaaatataatccttaagatacaaacaaagcagtcattgaatagtttcttagcccattttctgtggcttatgatagaattcctaaaactgaatggcatataaagaaatttatttcttatagctatggaggctgagaagtccaagatcagggggacatgtggtaaacgccttcttgctgataccagtaaagcctgctgagctggagtgtcacttgaatcatattcgccacttttgctttctcttcctacatgggtcctgaggttttgctctcatcatcatcttgcctttcagtaaggtaactaacttgttaccctctgctatgtcagagagattgtttgtttcaggataaacatataaacagagtttcagataaatctcttatttcctggccactggggctcgagttatattgttagcaccagctctgtaaagtgcctcaatgtgttttttcaaccaaaggcaaaatatttggcaaagaatatgttggttctttacctccaggttctgggcaaactttgagtttccattcttttgagatagatggactttgttgtctttcataaacttgttaaatttgcgatctgcccttgaagaggcacttggttccttctaattcttttctgtagattcctctgattctccatcagcgtatggaaattttctcttctatcccttccagagaattattcttctctctgccattcaatttgactgtgttactgccaggaagagacagataaaagggcatcagcaatgtcgacaacttaggagtagttcattcctttttcctatggctgagcaagtggatttgactgtacttatttttgtgtattttaatatgttcacctgagcaaagtcagtgatctagaagcttcataaaatgaatagtgcataacagaaatcacacctcagtgtaagtcttaccttcctacaggagtcccataaaaacactcttaggacatgctttccccccacacatctgattgctgaacactttgtttcactaggcttcaacaggtctcttcaaagctgtcattttacttcagctgggattacattccaccctatttcacttaaatatacaccttccctttaattttctctcattcttatcattggcagtaatcagtgtggcaagagttcactttcttttcacatggagatttgatctttgattattttatttttatttatttattattattatttttgagacagagactcactctatcacccgggctagagtgcagtggcacgatctgcaacctcctcctccctggctcaagggattcttttgcctcagcctcccaagtagctgggattacaggcacacaccatcacacctggctagtttttgtattcttagtagagacagggtttcaccatgttggccaggctggtcttgaactcctggcctcaagtcttctgcccacctcggcctcccaaagttctgggattacaggcacgagccactgcgcctggcctgatcttagatgatttaccaaacagtgccacaccctctgccttctgtgtgtgtctcaggctgtaagtaaagtctccgtcttagtccattcaggctgctgtaacaaaatgctacagactgtgtaatttataagcagcataaatttattgctcacagttctgaagtctgggaattccaagatcaagatgacagcagattcagtatctggtgagggcctgttcctcaaggatagtgccttctatgtccttacatggcagatgggcaaaagagctaacaagcttcctcaaaccctttgtaagggcactaatcccatttgtgagggttctaccctgatgatttaatcacctcccagaggacccatccttaatgccatcccgttgaaggttgggtttcaaaatgtaaatcttgggagacacaaaacattgagaaccatagcagtctctcagacctcgttgtactcagcttcattttaggataactccacatttgagttaagaaaccaagagtttgtattcccaactctatgcttcatgaggttaaagactcttggcttctcattctcactgctcaggcaggggtagtccatctgaatggaaactcctttttggggggcacacatcatttttattttattttatatttctgagacagagtctcgctctgtcgcctgggctggagtgtgtgatctcggctctctgcagcctccacctcctgggttcaggcgattctcctgcatcagcctcccgattagctgggattacaggtgcatgccatcacgcccagctaattttttttttttttatacagagtcagtctctgtctcccagactggagtgcaatggtgtaatctcggattactgcaacctccgcctcccaggttcaagtgattcttccacctcagcctcctgagtagctgggattacaggcgcctaccatcatgcccagctaatttttgtatttttgtacagatggggtttcattatgttggccaggctggtcttgaactcctgatctcaggtgatccacctgcctcggcctccccaagtgctgggtttacaggtgtgagccaccacgcccggcctaatttttttttttttttgagatggagtcttgctctgttgcccaggctgcagtacagtggtgcaatcttggctcactgcaagctctgcctgccgggtccacaccattctcctgccttggcctcccgagtagctggacctacatgtgcccgccaccaggcccagctaattttttgtatttttagtagagacagggtttcaccatgttagccaggatggtctcgatctcctgaccttgttatctgcccgcctcggcctcccaaagtccagggattacaggcgtgagccaccgcgcctggccaccacttttaaatgtctgtgttgcagtgaaattttaaaagagagagctaaattttgatgtcagtttttaaatagatgctgccaagagccatgttgatagcccaaaccaattttccatttataccagtgatatacttcaagcctgaaaaatgtagtccagtgtgggaagaagccctgtgatggtgagaaatgcagtaagaaactgggttctcccatggaactgataattaatgcaatcagatatgaacagtatgtttaaggatagtctggacatgaatgtgtataatctgtctttatcagataaacaaataaaagtcttttacctaatcgtcgtttcctgagttagaagaatcctccttatcagatacctgctttggtcattggaaggaaagtagaacatccatcttggtggtgatccttgtttcttagtactctgtatatcctttccaagagacaggtttcttttatgaaatggctaagatcatctccaccaccatgaacaacatgcaaatggagctgctgcacaaagtttagggagttctaagcgttgggattccaaggcatattaccctgtactgaagaaactcggaacagaggcatcctcaaatcctaactgcaaggaagcgtagcctgtgtcctttgttgatggaggaatgattcagtgagaaagaacacagtgatttttttctctacctatcttacatcttactctcttgccatttcttgtaacaccttttcatcctgtcttaaccttcagctaccagcttaccctgatcgtaatgacaaggaaattcatacattttggttttttaaggactactttattaaggtataattcacaaaccatgcagtccaccctttaaagtatacgatgcaatggtttttagtaaattaacataatcgtgtaaccattggcataaacaacattagaacattttcatcaccccaaaaaagaaaacccatacccattggcaatcaaaagccgatttcctccccaaccaccacacaccccccagcactaggcaatcattattctactttctgtgtccatgggtatattaaatactgtgttgtaactggagataggatgcccatagtcagaaagcttgagctcacatgaactgttggcttggatttctgtgcggattaaaccagcttacttctgacacggcagatgctgggctttttaacctctttcctcattgtgcttcctgacttgttacctctgtatcataaaagcatgaaaggtcgtagaataaatgagtctgcagaaaactgcgtggttaagttaccccatttgtgttttacaaagatagcggaagggaataacctttgagggtcacatacaaaaagccatttcctcatcctccctaaccttaaaaagtcgacattatttttacagcagcttctctaaattgacttacacttgaacaaactaaaaactacaagaagagtagagcttagctggcaggcctggttttgaacaagtgtttgattttgctaatcttggtagtgcataaggtcacttttgtaaatttcctgtagaaaaattcttggttcttggacacactcagctactagaacagagagatggtttatattttttctatgaattaccagctgataaaattcccctcctttgagtgggagaaaaattcaagccagacaagaacttttgtggcaggtaactcttacttgaaatttatttggatttctagaggcaaattaatttctctctctgtctttcacaataaataggtgcctgtcaccttttttttttctctatctagtgagctgcttctatagatggaagaaagttagtccttccttttggtattttgagagttttatttttaggcctctccttggctgtcttttctccttgtaaagccagtgtcgaagtaatggcaatggtaagtatgcttagcgttctaaatttttttaatgcatgtttattactaagtaatttatctccttttcttctactttatagctccatattaaatatggtggcaccttttaataaaaaagaggaaagcctatttggaaacatataaaaatagcacaggataggtcatttttcagattctggtcagatcaccatttggaaagatcttattctttaaagcaaaagttttgaaccaaggatctgttgaagatggggagtgactctcattcatctccatcttcctttgaaatttcatacagattttttggtgtgtgtttgtgtgtgtctgtattttctaatgagaagatccataactttcataagcatcaaagccactgcctttaaatatctttttgattacttttactgtagttattgttttaagatctgctttttgccatttaaaaacatctttcaaatactagttaactcttaaatgtttttttgcagaataagatcctttttgcagtactttttgttgttgtttaatacctacccaaaattttggtccaagctctaggggcctcctcccgaagaatttggtttaaaagcaaaagatttttaacataaataaaccagaatttgctttttttctttttgatttttttttttttttttttttggtagtgatagggtctctctgtgttgcccaagctggtctcgaactcctgggccaatcctcctgcataggccttccaaagtgtgaggattaccggtgtgagccaatgtgcctagcattgatttgtgggggttttttgttttttttgggttttttttagagacagagtctcgctctgttgcccaggctggagtgcagtgggatgatcttggctcactgcaggctccgcctcctgggttcaaacaattctcctgcctcagcctcctgagtagctgggattacaggtgcctgctactgtgcccggctaatttttgtatttttggtagagacggggtttcaccatgttgcccaggctggtctcgaactcctgacttcagttgaggcacccgccttggcctcccaaagtgctgggattacaggcgtgagctgccacgcctggccttgatttgtttttgcatgtgagaaaatgtatgtcctagtgtagtgtggtgtgtcattagaagcatgatttgttcttaccaatgcagtgattacattggttcttctacattcagtagaatgctaataatgtggtaatgctagtcgccagtcttcttaatctctataacagaggaagcagaagtagagcagatcctatcctagccttgtaggtctagagaccgaactatagtgtcttctgggaaagcacttaaacaaaacacaggtttataaattgttatggtcactaatgtttcagtcaagatggtgactacctatgatttgtgtgtatgtgctacccttttgagaagcattaattagtccgttctctcactgctataaagaaatactggagactgggcaatttataaagaaaaggggtttaattggctcagggttccgcaggccaggaagcatggtggcttctggggaggcctcaggaaacttagaatcatggcagaaggcaaaggggaagcaggcacgttttacgtggccagagcaggaggaagagagaggagagaggtgctacacgcttttaaataaccagatctcacagtaattcactgactcactgtcaccagaacagcacccaggggatggtgctggcccattcatgagaactctgcccccatgatccaatcacctcccactaggccccaccttcaacactcgggattactgttcaacatgagacttgatggggacacagatctaaaccatatcaagcattaatattactattaacctgtgtgaaaaggaactgaattctgctgtgacattttttgtttaagaattaggcctagcaggtgtggtggctcacgcctgtaatcccagcacttcgggaggccgaggtgggcggattgcctgagctcaggagttcaagaccagcctgggcaacatggtgaaaccctctctctactaaaatacaaaagaatattagccaggaatggcggtgtgcacctgtagtcccagctactctggaggctcaggcaggagaattgtttgaacctgggaggcagaggttgcagtgagcggagatcacaccactgcactccagcctcagcaacggggcaagactccatctctacaaaaaaaaaaaaaaaaaaaagaattaggcttagggagtgcatggtggctcacgtctgtaatctcagcactttgggaagctgaggtgggcagatcgcttagggtcaggagttcaagatcagcctggccaacatggcaaaaccccgtctatacaaaactacaaaaattagcaagccatggtggtggacatctgtaatcccagctactgagaagtctgaggcaggagaattgcttgaacctgggaggtggaggttgtagtgatccaagatcataccactacactccaggctgtgtgacacaatgagactgtgtcttaaaaaaaaaaaaaaaaaaaaaaggccttaagataaaaaacagtgaaataaaagaagtcatatttttaagaaatgaaatccctaatgtttaaaaattatttaatgtataaaattatcaatttttatacattagggatttcatttttttaaatatgacttcaggctgggcgtggtggctcatgcctgtaatcccagcactttgtgaggccaaggtgggcggatcacctgagatcaggagttcgaaaccagcctggccaacgtggtgaaaccccatttctactaaaaatacggaaattagccgggtgtggtggtggcatgcacctgtaatcctgaccagccagctgagatcgtgccactgcacttcagcttgggcgacagagcaagactccatctcaaaaaatgtgtatattatatatatatgacttcatagacacacattggtctatacaacaaaaacaaagcattaggaaattatctcatgatttagccacaaaattaaaagatttatttcaacaaacacttattgaatgcttacccatttgactggatgatgcgtaggaataacaagaggtctgaggcatagtagtagacccatggagctgatagtttcagggcagggtagacatctaataaagtctttgtttccttttgtaagtttctctaagtttgtttaggatacctattttgacagccatacagatcttcagaaaatagggattatcaccagacaccacaaggaaataggtggaaaaatatttaaaaataaattgtaagccaagcatggtggcccatgcctgtaatctcagcatgtgatttgggaggccaaggctagaggatcacttgaggccaggagttcaagaccagtctgggcaacatagcaagacctatatctacctaaaaaaaaaatttaagaaaatttaaaataagtaaataaattgtagtaaaaatgtaggttatgtttcttcgtctgaaaataagctattctgaaaagctaagctttcccaatggtacatgagttctctctctaattatatcttctgtattcctctctcacttgaataattttcttttgaaaactttctgaagttatatgctttcagactttgtaaaataatatgttgaacatgattaatcatctctcagttaggttcattattttcaatcatattattgtattgtgctgtgataacaatgtccctagaaactggacagtttatagagcagttcgcctgatcatttttgttttttaagtatctttttttttttttttaaagacagtctctctctgtcacccaggctggagtgcagtggcacgatctcagctcactgcaatctccgcctcccgggttaaagcaattcttggtctcagtctcccaagcagctgggatgggactacaggtgcatgccaccacgcctggctaatttttttttgtatttttagtagagacagggtttcaccatgttggccaggctgctctcaaactcctgacctgaagtaatccacccgcctcagcctcccaaagtattgggattaccggcgtgagctactatgcacaccccttaaacatcattgtaaaaatcacttcccttgctataggaatttggctttgagttactaggccttccagaagccatccccatgactttgttatctggcctaagccataggtggggagtggggagggagacatccaaagttaattagaaccaagtataaatttgccatggatttaagccttctgtataagataaattcatccatagtatttttggattactttatttacttgattatttatttacttatttgattatttctgttctcattaattttctaattatgactagacaactaagttctgggtaagatatgtcattattacgtaatgatgtcttattcttggcattataaatgactatactgtgttgtagttttattatatttatgacatatgagaaataaataataggaactttaagaagactctatcacttcatatctctttggtctctttctctgtctttaacattggtcaggttccaaactagtgaaaactacagaaacaagtgcagttttctagtatagtctttcatcttacgaaaatatatttaatccccactcttttttaagtttcactttgccttaaggggagtggtcttaagaaaactcttagtatagttgtgagtatccatagtgtcaaatgaggggaaacattgtaacaatgttaggagccaaagttctcaccacaatctcatcagatgtcctgagctattttttacttgttaactcagaacaacaaatactaaagaaagtgccaaacaacctcaattcttctggctcacacttatatatagcagagatacgaaatagcccgcaatcccagatcttccatgggtaattttgggaaagtgtttttcatagagatgttgaagtccatggaaatcaggtagaacactaaaggacccggttgacccagtacattgcaaccctctgctctcatgtgcacctcacacacagccagtctacggattagagaccaccatttctgggggttgttatcttttttttttttttttttttgatacagagtcttgctctgtcgccaggctggagtggtgcagtggtgcaatcttggctcactgcaacctccgcatcccgggttcaagcaattctcctgcctcagcctcccgagtagctgggaccacaggcacacaccaccacgcctgggtaatttttatatttttagtagagacggggtgtcatcatgttggtaaggatggtctcaatctcttgaccctgtgatccgcctgccccagcctcccaaagtgctgagattacaggcgtgagccaccacgcctggccagttcttttcctttaacttgtattaactgcatagtagttagtttctctttcttctttctttaataggatcatctcaacatatttaaaaactatgccgtatatgtataagatttgccacctctgggtcattaaatggcatcacagacatagaaatgtaccaattccttttttatgaaatttatccattcatgcaaaagaagtatgataattaaaaataattttgaacattgggtatcctaggctctgagcgcgaggctctcagaaaattaaaatgacatcatcatcgtacttgcaaagcttaaagcccagtggggaagagcaacatgatagtaacaaaggtagagtgtaataagtgcggttgcagaatcgcaggccaaggggagctcacgtctttgagcttcaatttctttatctgttgcgggggagagtatctcatgaagctgttttgaagcttatctaagacaatgcatgtgaaaacactgtaaaattataaagctgcggacatgtcagttgtcatgtttggtttaaaatagaagctgggagactctttattctgaaaccatgtagataatccagggatgagactctagttaaagtgaggaaaacaatgtacttgcatgtcaattgcagttcctgggagaatgtttgtattattaggagactctcattccagaaatcattttgttggcatttatactaagtggcgatgacactgagaacagcacagcttcatctgacatctgacgttattgtcagcctttcttagtacccatggtatgtttttactgtatctcgtgaataagataatatattaagtctcctggcatataaggatatatgtaagatacgtgttgtatagttggtttctagagtgtcttcatagcagtcttccagtatttctatttattgctattccctctccacctctgtttctttcccattagttctttacaggtagggagattatatgtcccagtttgcctgtcctggtttatgtctcttgtccctacatcccatctacttaacattttaacaccctcgaaagcgtcccaatttggacctcaccttatctggtcaccctggctcaaagcatagaagaaaattaaatgaagagccagcaaattagtgaaattgtacagatgtgtgataactgacttcagtcactgagctgagctgatttacagagtgtggatttggtccagtaatatcttggaatgcagcttacagatgtaagtaagtagtgcctgattatagctacacactatagcaggtttcctaatgagctgttaaaacgaaagcatgtgtttgttcactgtggcacagaacagtagctttgacacttcagtagttttcaccatagcatggcttgttggggcttgaagactggcattccttcttaaaggcccatcaaggttttcattcactgtgagctatgtgttaagctggtactgatctcgtttttgaccatcattcacccatggcagccaaccagggaggtgtaaaatgcttttgtccccctgcccacatatgcacctcctttggtgtgacccatgggatgacagttgcgatgcagcttgaaaggatggctctacattgcagcttctctgcgtcatccccgttgcccttttagaatgagaaaagaggattgaaaggttcaaaagcctagagagaaaattctgcagtcctgtgtttttctgagcagagggaaaggtgctacttcgtaagactgcttgcaatccccaatataatagaataaaactgtccctactgccagcattaatatgaaatttgtataaaggtggagggattactttactgttttattaatatgcaatcccaatattttcattgcagggcagcttgcaaattcattgcaaattatgctgagttaaaatcaaatacataaatctacctttctctgttggcagctgtattggagtttgggattggcctctgtgcttattagagccaaagaatgtatattatttaattcttgcaaagtgaaagtaaaagatcaggaaataaagacaaatcaggggaatggaacatttttagtgcgattcctcttttactctccagcaagggaaagtggcttaaagatctctgttaaaacagtgcttctcacactttaatgtgagactcttgttatgtagattcttactcctgggtctaggatgggggcctaagattctgcatttctaactagctgtagagcatgctggtgctgctggaccacaggccatgacttgagtagcaggttgtcaggaagtgtgtgcttcagtgggctgtgactctgcatatccctgttgtgaaatatgcagatgagagtggcacacaccagaccctcaactggcaggaggagctgtgttttagctagaggttagggtgagagggaccacccagacttgtaaagcttaagtattgtccccggtctctttaccagtcttaaggtatccctaacagaggcccaatgttcctgctaatgaaatgaataaagaaatgttgcagtccatggatttgtaattccagtaacggcttattttacatctattaaaggctacaaggaaagaagtggagggaagggctggaagactaagaaaataggaaatgagaagaaatgcacaaaggagagttgcatttcctcctgcttctgtcaaaggaaaaaaagatgttatgtgccttctctttccacctctaaataaagcaacagggccaccactaactagtttgtgtgactatattctggctatttaacctctgctatttcacaaaaagtcctcatctgtgaaaggaggaatttggaatcgggacagttttcggaaccccttcaattgttaaagcatagcgactaagaattttatggtcatacaacactaaaaatcatacatatgtccttaggaatggggttttatttctgtaagagcacctccaaaacaagtggtgtgttaatacatgtgcattttatatttttctttatattctttgttctcttccttttaagaaaatctagtttgtttcattgcttcaaaattcctgaaaaattttctgtctttttatataatacagagttggctgtgttaatttctgcttccatcatactaatttaggaaacgtggcctaacagtggcaggaatagctagaactttcttctgtgacttactggcattttccctaagcatctgcatgtgttgggtgtatgtgtaagtaccatgcattggatacatcctctgttgaaaggataaaggaatgcttgttcgttccacaagttaccttggctccaactctgttccatactcagcctgttctctcaacacaatgatgtcttcagtcttaggacagaagtctggagttcattcacatctctattttgattaattgttttacacatcaggctccatataatgtagtggataatgaaatgctctaagtgagttagggattttcagttcttagacttgtggatgagagaatttcaaaaattatctacaaatttaccaacatagataatgtttgtatgatatacagaggttgagttttataaaatataaattgctctgagccagaaatgaaaaataaatgtagaatcccatgataaaaaactaaagttgctatattaaaattaatagtatactgggatttttgaaacattgttttgaggatgtgtttactatgttcaaagcaataaatttaggaatggaatctagtttcattagccctgctataacattttggagagaatataaattaatacctgctttttgaaggacaacctgacattatccattagaatgtgtaggccctattttcttcatctcacagattcatttcttgtaatttacccatttataattaattattgcaaatatgtgtttggaattattggacaggtacagaaagctatatgtagaagtacattcatcagagtgtttgcagtgtgggccaggtgcgacggtttactcctgtaatcccagcactttgggaggctaaggcgggtggatcatctgaggtcaggagttcgagaccagcctggccaacatggtgaaaccccgtatctactaaaaatacaaaaaaattagccagacatagtggtctgcacctgtaatcccagctactcaggaggctgaggcaagagaatcacttgaatctggtaggcagagtttgcagtgagccgagatcgtgccattgcactccagcctgggcgacaagagcgaaactgtgtctcaaaagtaaaataaagtgtttgcagtgtgaagaaacaatctaaatattcaacaataaaggaaggtcaaatgagacaaagatgaaaggggaatactatgcagccataaaagagagatgtggttgttatcttaggaagatgactataatatgaagttaaaagttacaaaggaacatttgggaagaatgtataggtacatacatgcttataaaaccacaagaaagaactgggaagcaatacaccaaagcgttgatagtagtagaattacggctgattttttactttctctgtcatgcatttctttattgttgaatatttagtactagtacatggagagggaatagaaaacttaatttggaagggatggggaaaaagtagccaccctgggagctgagttagaggagaacacagagcccaggtgtttcagcatctgttccggcgttggcggtgggaattctctgaatagtcctcactgtgccagagaagctttctgcgcacagctgggtcctgtgaggcaagacctgtgtcctgctgactcatacacagcatcccatatggccttaactttatttagcaacgtcagctcaaggaagccttgtgttccctttgggcccaggatttagaagagcataatcatagaatgtctgtcaggcctggaagtgtcattagggctgtcctagtctggacatgaagagtctgaggcccagagcatttaagtaacgttcccagagtcccagaggtagttcgaggccaactggaaatgaaaatgcggttcccaggctcgtggtctctctagtgctactactttgcttgtctccaagctctgctctggtggatgagtctccagttctcacaagcagtttttaaggccagagcaaaaggtttccaggtaagagaattttttttgtcatataagagaagattaaattaataggacttttgttcagatctgcattcagtgagatacatggaaattcagaggttattgactttccttgggtctggcctcttttggatatttaataaaggctgcaaaacctttcccttgaacgatgcaagtttgctgaaaaccacaaaactttgcatttgatttcggaggtttcaagagccctgtaaagcctgtccctgggttctgaatgtcctttgtcttgtgctcccctgttttcaagcagttcttttgcatttggaggtaacagaactgtgatctggtttggttttcatacctttgttgcagatatgttttcttcaaataaaaaagaaggagaggatagcaactaggaagatgaacaagcctcatcacattggatacttagtgttgtctttgtgtttacagttgctgttagattgtcattccaataaaagtaaaattatgtaatactttttaaagctcccatcacactagcacaactgctttcattttttgcagagtgtgccaccctgttcctttccacatggatacttcctggttacagccaaagactgttcattatgccctttcatgcttccacatgaaagacacaaactgaggctgaaattgagtggcttcttaccagaaattaggtatttgaataagagcagatcgtttttacttaaaagatgtaagttttgaaaatgaccacatgcagcagttaacacactgatgactggacttacctgaagagtctctgattcagtagcccgttgtggggcccaagcatttctaataagtcctcaggtgatgctgacatcactggtccacggccagactttgagaaacagtggcccagagaataacagtcttagaaggcagggtgttttccaaattttgctgaagacaagaatcagttgagaatgtttgttagaaatgtaaattttaacaccatgtcagactcactgaatcaaaatctctgggagaatcttggaatagtatattaccagatctggaggaactactattctcttgctatcaggtaagccccatagagtgtcacttgtttgcaaaccactcacaggacaatagaattttttttttcaaacactaactcaaccagaagggacaatgtaatatatttaccactcaatcgtttctcatccattgtctgctttgaccctatgagcccatgagcacctagcagcatccacatttttaaatgaattttaagtcacccttctaagacataaatatttttgtttcaggtaccaatatattgtttgaaagagataccagaatacctgctttctgagaatttcctcaagttttactgagttcctttttaataagcatagtcacaatatgcatttgtgtgtgtgtgtgtgagagagagagagagagagagagagagagagagataaagggaggaaggaaaaagaaatgtggttttctgccaagttcaagttccctagtgatggtgatgctgctgatctcggaacacgttttgagaaccactggaatagaccaataactctcaaatgtagcagttggaatctcctggaggagctttgaaatatacttctgctcaggtctcacccccagagattagttcaattggtctttgatgagacctagacagtaattctaataatcatccagccgggcgtggtagctcacgcctgtaaccccagcactctaggaggccaaggcgagtggatcacctgcggtcaggagctcgggaccagcctggctaacgtggtgaaacctcgtctctactaaaaatacaagaaattagtcgggcatgatggcacacgcttgtaatcccagctactcgggaggctgaggcaggagaatcgcttgaacccgggaggcagaggttgcggtgagtggagatcactccattgcactccagcctgggaaacaagagcaaaattctgtctaaaaaaaaaaaaaaaaaaaaatccaagattgtgaaccattactgtaggttgctccagataaaaggtaatgggttaggaagcttaagacttgatgaggaaaaataaaggttaaaccagtgctccttccacttcagtgtgcatacaaatcacctgggggtcttgctggaatgcagattgattctgtaggtctagggtagggcccaaaatgctgcttttttaaatcaagtcaggcagatgctgctaagattgcccaggggtctacactttgagtagtgaggtggttagaaagtgttgacctatgtaagtgcttatcaacacacagtttttatatatttttacgtagtatagaacaaataaaagcaatgtcattgagatttcagataccttagaaacaataaatattttgccattaatgactatttcccttcccttgatggctaaaacgttttgtttttgcttctccctacctgcttactcagagtttcaatcaaatgtttgtaaattaattttgctttagtatgacacatgtagtaacaggcctttcccctttgtaactgagtcccaggattcacggagtttgaggatcttgccttctggcttcctccttgcctcagaccctgccctttaggggttactgccctaagaggctgaaagtttagtaatgccccagagcctcgttgcaggagctagtcacttttggcactttcttgctgtcagaccgcaggctctgggagccagtcttcttgggacatggcttcatcctgtgtctctggcttgagcccaacctttcaggcctgggttaggggtgaagccttttatctggcaggtcccacagtctggcgcctttcccagcgtggtggagttgagaccttgctgtcagagcctgttcagaaggagagagggagagacaagaccttcgcgtgaggaggaaagagtttaagtcccgtctgtggaatctgtttcccctggcttgttgaattttctcagctgaacatggcagaagtggttgatatttgaattagaggctatgaaagtgtccttgggaaatgggtggggctgagccagtggtcttcccttttgcctctacctcatgctgaccaggggacaaggctctgtctcctgggtgtggcctgtcattggtcagtctgtgaccatactgctattctccaaggcattcctcaacagaatgggatcaggctttttcagtcatttcccatttttaaaggacatctccatggcagatgcccctactccctcccggtgcctgaatatttgcctgtctagcgtgggtaggtgaacgtcagcagaactcttgaagaatcactaaagggatgtgcttgtcctagcaggagagcctgtgacaataaaaaagcagagaatgttctgagtctcctgtattaaaaagggaaaagcttaagtgaggtttatttccactaaaggatagcaacataaggcagcttgacctttagtgtgactggagcaccgtaaatgctacttctacttttttcctttttttttattgtggtgaaaaacacatagcatagatttgccctctgaatgtttaagtgtacacttcattattgttaactgtatgcacaatgccatgacagatctctagaacttttccatttcacatgactaaaatgctgtgctcatcaaacaactctgtttccccctgtgccagccgctggcaccaacctttctactttctgtttctatgactttaattacatgtatgtgtcatagaaatttggctttttgtgattggcttatttcacttagcatagtgtcttcaagtttccattctattcatgttgtagcatgtgatagaatttccttttttgtaggctagataatagtccattgtatgcatataccacattttccttaggcattcatctgttaatggacttttaggttgcttctgcatgttggtcattgtgaataattctgtagtgaacatggggatgcaaatgtctcttcgagttcctgtttttagttcttttgggcatatacccagaagtagggttcttgaatctcatggtagttctatttcttatttttttgaggaacctctatactgttttctgtagcagctgcaccattttacagtttcaccaacaactctcaccaatgtagggttccagtttctctacatgctaccgatgctttgtttttttgttgttgtttgttcttgtttttttttaatagtggccatcctaatgagtatgaggtgatactgtggttttgatttggttctgcctttttaaactccaaattcagtctctggttacagcttttcccataaccattttcaggtgaggtgcgtatgctgcgttggtaacataaatttaacattgtgagagcttttatcaggcagcaaattgtaaagccccttctaggtcagacagttgacctctgtaaagcttaagttaggaacttttatgttcttaataaaacacaagaaaatatgggaaatttccatttggcatgagcctttctgttttcttggtggtggtggtgtgggggtggtataggctctccctaaattgcccaggctggaatgcagtggctcttcacaggtgcaatcatagctcactacagcctcgaactcctgtctcagcctcacaagtactgggactacaggcatgaaccaccatacccagttccattctgctttaaacagtggaaaaaatacatgtattttttaaatggaagggttggttatatcttcaatgtgaaatcctctatgtgaaatctaaataaactattcctggaatgtccagtgtcctttccccgtgatgataaacaaagcccagagctgcctctctttaaagatagtaagaagcctatgcataaacaaaacacttaaaaataagatcatttattttattttactcatccgcttaaacccatcaatgacttttaacttagaagaaaacctagtcttcctactatgaccaacaggactaagcaaatctcataacctagcctctgcttacctctcacttcagcccaacctactctttccctctcttaaaaactcagtagctgaaatatatggagctctttctggccccgagcctccagaccttttaaagaaaaaaaaagattgtaattttgatgaagaccgcattgtcaatttttatttctatggctcttacttttggtattatgtctagacctctctaagccctaggtcttaaagatcttctaggttttcttaagttttatagttttttttttaattttagatttaagattcatttggaattaacttttgtataagacagacggttaagaagattcattattttgactatagataccagattgctgtagcactgtttgttgaaaagactttccttccttttctgaaagagtttttcttttctgaaatgcctttgtcaaaaatcgcataggcacatctgtgtgggtctatttctgggctgtatgctgttcctgggaccatttttaccttccacctttcccctagttaactcctacttatccttcaggtcttagtttcaatgttgtttccgtggaaagacccttaaggaccacccattcctatacatctgcataccctcaacttcagtcctaaggaagggtacctctgttattctcactcaacacctgtttttttctccttcgtagcatttagcataatacgtttataactttttttgtttgtgcacatatagttcgtgcctataagcctcaaaaaggcaagaactgagtttattttgttcaccactgtagtgcccagcactgtgcctattacatgctgagttctcagtcaatatttttgaataaatgagtgaaacaaagttaggcttcctgggggatgttttctaaatccctaggtatcattttcttaaaattagaggatattcttggctcttggagccttagggcataatttttttcccagttaacccatctttgaagatagggattttgagaacttttggcctacctcagggtcacctagcgggttatcaaaatgcagattgcagggccccaaacccagagttcctgcttcagtaggtctgggatgggccccaaaatttggatttctaataagttcccagaaaataatgctgatgctgctgttctgggaacccactttgagaactgtattagtctgttcttgtactgctatgaagaactacctgagactgggtaatttataaagaaaaaaggcttaatcgactcacagttccacaggctgtaaagaagcatggctgggaagcgtcaggaaacttacagtcatggtggatggcgaaggggaaggtggcacgtcctatgtggtgggagcaggagaaaaagagggaagaaggtaatgctatgcactttcaaacaaccagttctcgggggaagtccgcccccatgatctaatcacttcccaccaggcccctcttccagcacggaggattataactcataagatttgggtggggacacaaatccaaaccgtatcaagcactagtgttttaacgttaagaatctgaagaggcccgagtcactgagccgccactgccaaggactcatctcccccttctcccgccaccgcccgcttttgcagccatttccactgaggaaaaacaatcgtatgtccacagtccagaacctccactctttccacccctttgctgatacaagtaagggtgatacctgtcctgctggcactgaggattatatccatataagaattcatccaacagagaaatggcaggaagacccttactactgtccaagggactgctgatgattatgataaaaagaaaccaatgaaggcatttaaaaagaaatttgcctgcaatgatactgtaattgagcatccagaatatggaggtcattcagctacagggtgaccagcacaagaacatgtgccagttcctcttagagattggaatggctaaggacaaccagctaaatgttcatgggttttaactgctgtggctcgctgaagcttgaatgaggttttccttgcaatgagtagaatttcctttctgtcccttgtcacaagtttaaaaacctcacagctttgtataatgtaaccatttgtggtctgcttttaacttgacctagtgtaattccttcatgcagtaaacttgaaagagccatgctgtctagtcttgaagtccctcatttaaacagaggtcaagcagtaggcgcctggcagtgtcaagtctgaaacaaagcaatactgtcatgtttcagccacacctagacccctaagatcatagacaactacgtctggccagaagctcctccgctctccctctgcagagttccctgccctaagagactgtcaccacccgaacaatcctcggtgaatctaagaggagaggatggggtaaggcagcaacagcaactctaccactggaagggagcctttggtggtcaaagaaagatcccctggtgtctataacctgaccaggtgcagagttttagagaggcccccttcccaatagcgaggtgataggacatctggcttgccacaaaggtctttttgaccagacatgccctagctaagggatgtccaaacaccagaatgtgagaccaaccttccatcaaagttaaacctttgacaagggaacaaatctcaaaactgatgtaccagtcatgtagctagctgtagagcttgcaacttaatggcaacagctgtccaatttcatggaaagtaaccaactggttttgaggtttgtttgtttttttcccctccagttttaatgttatgtgtaatgtatttaaaccccttttttaaatttaagttctagggtacatgtgcacaacatgcaggcttgttacgtatgcatacatgtgccatgttggtgtgctgtacccattagctcgtcatttacattaggtatttctcttaatgctatccctcctctcttccccctccccacaacaggccccagtgtgtgatgttcaccgccctgtgtccaagtgtgctcattgttcagttcccacctatgagtgagaacatgcagtgtctggttttctgtccttgcaatagtttgctcagaatgatggtttccagcttcatccatgtccctacaaaggacatgaactcatcctttttaatggcggtatagtattccatggtgtatatgtgccacgttttattaatccagtctatcattgatgggcatttgggttggttccaagtctctgctattgtgaatagtgccgcaataaacatacatatgcatgtgtctttatagcagcatgatttataatcctttgggtatatatccagtaatgggatcactgggtcaagtggtatttctaattctagatcgttgaggaatcaccacactgtcttttacaatggttgaactagtttacactcccaccaactgtgtaaaagtgttcctgtttctccacatcctctttagcacctgttgttccctgacattttaatgattgccattctaactggtgtgagatggtatctcattgtggttttgatttgcatttctctgatggccagtgatgatgagcattttttcatgtgtctgttggctgcataaatgtcttcttttgagaagtgtctgttcatgtccttcgcccactttttgatggggttgtttgattttttcttgtaaatttgtttaagttctttgtagaatctggatattagccctttgtcagatgggtagaagccaaatgatgagtgaactcccattcacaattgcttgaaagagaataaaatacctaggaatccaacttacaagggatgtgaaggacctcttcaaggagaagtacaaaccactgctcaacaaaataaaagaggacacagacaaatggaagaacattccatgcttatgaataggaagaatcaatattgtgaaaatgaccatactgcccaaggtaatttataggttcagtgccatccccatcaagctaccaatgactttcttcacaaaattgggaaaaactactttaaagttcatatggaaccaaaaaagagcccgcattgccaagacagtcctaagcaaaaagaacaaagctggaggcatcacgctacctgactttaaactatactacaaggcttcggtaaccaaaacagcatggtactggtaccaaaacagagatagacactaatggaatggaacagaggcctcagaaataacaccacacatctacaaccatctgatctttgacaaacacaagaaatgaagaaagcattccctgtttaataagtggggctgggaaaactggctaactatatttagaaagctgaaactgcatcccttccttacaccttatacaaaagttaattttttttttttttgagacagggtcttgctctgtcacccaggctggagtgcagtggcgcgatctcagctcactgcaatctccacctcctgggttgaagtgattctcctgcctcagtctcccgagtagctgggattacaggcacccgccaccacgcctggctaatttttgtatttttagtagagatggggtttcaccttgttggccaggttggtctcaaactcctgacctcaggtgatccacccaccttggcctcccaaagtcctaggattacaggcgtgagccaccacgccaggcctaaacccttatttaactaaaacttgttttcagaaaaaaataaatctgaggatgtgttacatgtcccccttttacttagtgacagtcccaggcacacacgagcttgtcattaacaatattcatcaatttaagagttgatcagagaaggtcatacaagaatccaatctcagtggaattaaaggaaaaatttttgctaagcagaaaataaatgagaactgtacatttaaaataaataaatgaacagaaagcctttcaaatcgtactaaactaacttatatctgtggctactacattgttgttctttaatgcttaaataggtaaaagcactgatgttttagttgaaactaccagcagtaggaatgcttgctcagtaagagcaagaccccactaacacagtcatatttataaagtcaaggtttaggtgtctgccagggtctgttttccctaaatctattacaaacaaatgaaagcaaatcagtaaatactgttttaatgtacctataccgagtcataaaattattttcctcccaagtcaggaagaaacataaagttggttaactgaaaaagagaaagtttaatcattctgattttcattctgatgctcttctttagactatctattgctgctttcttttgtagcagaacagctgattttccgcctaggttttcatgatctgataaaccttcaccatagacagtttcttggaaagaaactctggaagtgtcagttatctttaaatgttcaggaagctgcgtgggtctcagacccagctggagcagagccagcacgggattctgaaagcatttgcaggctctgagatggttttaacctgttccttggcagtgcagcccttgtgtacactcttggaaagatactgatgtttactttcatgatgtagaatggatgagcagtgaaggtttctaggaaggttgaacacactcatgcccactttgggacacaaggaggcagatgctctcatgggaactcttcaaataaggtcgtatggtttggctgtatcctcacccagatctcatcttgaattgtagttcccataatctcgtgtgttgtgggagggactcgatgggaggtaattgaatcatgggggcagttaccctgattctgttcttgtaatagtgagttttcatgagatctttacacttgattaatgttaactgtagttgtcctactgatctatcgaacaccaagtcttatttcttctaagtgtatttgtacccattaatctactgctcttcattccccatccccactacccttcccagcctccggtaaccactagtctactctctatcctcatgagattcagttttgtagctcccacatatgagtgagaacatgcgacattgtctttctgtgctttgcttgtttcactgaacataatgacccccagtttcatccatcttgctccaaatgacaggatttaattctttttatggctggataatattctattgtgtatttttaccacactttctttttaaatatttattattattttgtagagacagagtcctgctatgttgtccaggctggtctcaaactcctggactcaagcgatccacctgccttggcctccacattttctttattcatccattgatggacacttaggttgattccatattttgtctattatggatagtgctgcaataaacatgcaagtacagatctctcttcaatatattggttttctttcttttagagaaatactcagtagtggaattgctggatcatatagtattctacttttacatttttgaggaacctctgaagtgttttctatagtggctgtactaatttacattcccaccaacaatgtgtgaggatttttctttctctgcatcctcaccagcatgttattccctgtcttttttgataaaagctattctaattggggtgagattatacctcatcgtggttttgatttgcattttctggataattactgatgttgagcacttcttataccctttgttcatttgtcctctgttgagaaatacctgttcaggccttttgccctttttaaaatcagattaatgactttttgctattgagttgtttgagctccttatatattctggttatttatcttgtcagatgggtagtttgcaaatactttctctcattctatgggttgtttcttcaccttgtttgagtgtttcctttgctgtgcagaagcttttcagcttgatgtaatcccatttgtccattttcgtttttgttgcctatgcttttgagaacttaaacaaaaaatttttgcccagaccaatgtcctggagcatttccccaatgttttcttttattagttttataatttcaggtgttagatttaagtctaaatccatttgtatttgatatttgtacatggtgagagatagaggtctagtttcattcttctacatacagttgtccagttttcccagtgccatttattgaagagactgtcctttccctgttgcatattgttggcacctctgtcaaaaattagttggctgcaaatggcatggatttatatctgggttcactattctgttcagtcggtgtttgtgtctgttttttatgccagtaccgtgctgatctggctactatagccttgtagtatatttttaagtcaagtagtgtgaggcctccagctttgctctttttgctcaagattgctttggttatttgtggttccatataaaatttaggattgtctgctctgtttctatggggaatattgttggtattttgatagggattacattgaatcagtaaactgctttgggtaggattgtcattttaacaatattctttcaatccatgagcatggaataatatcttctccattttttgattcatcttctatttatttaatcagttttttatagtgatccttgtaaagatctttcacagctttggttaaattgattctcaggggccaggcacagtggctgacacctgcaatcccaacacttcgagaggccaaagcgggagaattgcttgagcccaggagtttgaggccagcctgggcagcatagtgtgacctcatctctaaaaaaaaatcaaaatattagccagacgtggtggcatgtgcctgtggttgcagctacttgggaggctgaagtcagaggatcgcttgagaccaagaaatcaagactgcagtgctcactgcattggtgacagagtgcaaacctgggtgacagagcaaaaccctgtctcaaaaaaaaaaacaaaatattcctgggtattttacattctgtgtagatacaataaattagattactttctttctttttcagattgttcactattggtatatataaatgctactgaattttgtatgttggctttgtatcctgcagctttactgaattcacttattacttctaatagttttttggtttttaaaaatagaagatcctgtcgtttacattcaaagcgaatttgacttctttctttccaatatgaacacctttatttttttttcttgactaactggccaggacttccgctttatgttgaatgaaagtagtgaaagtgcacccccttgtcttgttccagatcttagtggaaagccttttaggttttccctgtttggtatgatgttggctgtggatttatcatatatggcctttattattttgaggtatgtttcctctgtacccggtttgttgagggtttttatcaaaagggatattgaattttattgaatacttttcagcacttattgaaatgatcatatggtttttgttcttggttctgttaatgtgtatcacatttactgatttgcatatgctgaaccatctttgcatccctggggtgaatcccacttgataatgttgaatgatctttttaatatcttgctgaattcagtttgttaatattttttgttgaggatttttctatctgtgttcatcagtgaaattagcctattgttgtcttttttttttttttttttttttttggtggccttatctggttttggtatcagggtaatgcccgccttgccggatgagtttgagcattccttcctcttcaatttttttttttttgaagactttgagtagaattattatagttcttcttgaaatgtttaatagaattaatcagatcctcgacttttctttgataggagagttttaattatagctttgatcttattacttgctattggtttgtcgaggttttctctttcttcgtggttcaattttggttgtatatgtccaggaatgtatctttgtcttctagatttttcaatttgttggcaattgtctctaatgattctttgtactcctatggtctctgttgttttgtatcttttttgtttctgattttatttatttgggtcctctctttttagttagtcttgctaaagttttgtcagtttttttttaactaaacttttgttttgttgatcttcagtaatgttttaatctcaatttcatttatttttgctctgatctttattatttcctttctcctagtaaatttgggtttggcttggtcttgcttttctagttccttgagatgctccattattagtccattattaggttgtcttttggtagtctttcaacttttttgatgtagatgtttattgctataaacctccctcttagtactgtgtttactgtatcccatagatttggatatgttgtgtttctatttttatttgttttgagaaatttttaaatgttcttatttcttcatcaactcattgtttattcaggagcatgttgtttaatttccatgtttttgtttaatttccaaaggtttttttgttttgtttttttttttgagatggagtctccctctgtcatccaggctggagtgcagtggtgcaatctgcaacctccacctcctgggttcaagtgattctcctgcctcagcctcccaagtagctgggattacaggtgtacaccaccacacccagctaatttttgtatttttaatgagacagggttttgccatgttagtcaggctggtcccgaactcctgacatcagatgatccacccacctcagcctcccaaagtactgggattacaggcatgagccaccacacctagcccaaaattcctcttgttattgatatctagttttattccattgtggtcagaaaggatacttgatatgatttctacttttaaaaatttgttgagacttgttttgtggcctaaaatatggtttattctggggaatgttccatgtactgatgaaacgtgtattctgaatagttgagtgaagtgtgttttataaatatcagttggacctatttggtctgatgtgtagtttgatacaatggtttctttgttaattttctgtctagatgatctgttcattggtgaaaatggggtatttgacgtcctccactattattgtattataatctctctctctctttgtatctattaatgtttgctttatatacttgggagctgaatttcagtccatcaaatgtattaatcagttctaagatttctgtttgattttttgaataatgtctctttgttaaatttctctgataaatttctgaatggagaattaccgttttgtttcttgttttctggttgttttgtaactcttctcctcctttcttcctgtcatcctttatggttaagtgactttctctggtactatgttttaatttgttggggttttttttagtgtgtttatcataggtttttacattgtggttaccatgaggcttatagaaaacatcttatagataaaacaagttattttaaagagatgacagcttatcttagataagcagtccccagtctgttttggcgccagggaccagtttcatggaagacattttttccatagatcaggcagtggggatggttttgggatgaaactgttctacctcagatcatcaggcattagatcctcataaggaacgctcaacctagatccttcgcacttgcagttcacaatagggtttgcactcttatgagaatctatgctgctaatgatctgacaggaggtggagcaggcagtgctgtgtgacctggttcctaacatgcgacggaccagtactggtccatggctcaggagttggagatccctgtcttagatcacaaaaaaaagaataaataaaaaactttaaaacaaccctccatctttaattccatcccctgacattttgacttttgtgggcctgaatttacgtattttgatattgcctatctcttaacagattgctgtagctgttagggtttttgatagatttgtcttctaggtgtcatactagaattatgggtaacttatgggtggactgcacatgacaattagagtatttgaatattctgggggtttctatacttgatgttacctgtaggttttataccttcaaatgttttctttttgcacattaatgttttttcatttcagattgaagaaccatctttaacatttcttgtaagacagatctagtagtggtaaattctcttagcttttgtttgtcagaaaaagactatctctccttcatacttgaaggatatttctgctgtttgctggataaagtatttgaggatagcagggttttttggggttttttctttcagcactttgaaaatatcattccacttcctcctgacttacggtttccattgagaagtgtgttgccaactgaagtggagtttctttgtatgttatatcctccttttttcttgctgcttttagtatcctctttttgtccttgacctttgagagttttattattatatgccttgggtgtagttttatttgggtcaaatctgtttagtgttttctgaccttcctctacctggatatttttctcatattttggaaagttttctgttattatttattgagtaagcttttttctacccctcactcttgctcaactttctcttgaacaccaataattcttagatttggtcttttaaggtaattttctatatcttgtaggcaatctttgtataatatatttccattcattttactttttctcctctatgtaatttcaaagagcctgtctttgggctgactgattctttcctctgcttgatgcattctgctgttgagagcctccaataaatttttcagttagcaaatatatttttcaatttcaagattcgtttgattttttatcacttcaatctctgttaaattcctctgataagtttctgaattgcttttctttgttgtcttggagatccctgagtttctgtgaaactgctattttgaattcttggtcagagagctcatgaatcaccatctcattagggtcagtcactggttccttgctttatacatttggggaggtcatggttccatgttcttatggatatatgtctgtgtctttgcattaaaggatttattatttattccaatcttctctgtctagtctgttttggtttttactggtatgtttgcttagagattatttgtaatttagctgttgaatttcttacacatttttcccgctaggtcactgcctctttttcagcactaaatggtacttaaaacccaggtttgcctctgttcttctagcaaaggatcagaggattgcctggctggaatgggggaggttgcaaaggagctatccctgtggtatggaaaggctggctaggagttcatgcccaagagacctgtggaatctacctcctacagcatagtgctgccgaacacccactctgatttggcgtctcctttggttgagttacagagcggagcttccagggctggagatggtaatcctgcctccttcctttgtgtccggctgtccacagggtggtatctcccttcaggcactcctgatgcttctcatgggttgaggcatggataggtctcctgccaaagaagccaagatggtaggcaagttgtgtgtccaacttaatctcactttttccagtgtagaatctgagttgggggaagttttacatgtgcttgataccaagcagattgggggaagggtgtcacagatatgaaaatctgattctcttactgtctgctggagtttttttttttttttttttttttttttttacttctcagtggccccaggaactgaccgattctctttcatgagttctgagagattgctggtgataatctcgatggtgtatatttattttggttattctgtggggagaagtgaagccagctttcatctacatttttaaagtataattcttattttgagtggcaagaatctgattccagtatcctgccttagtttttatgcatttttgaaattcctaccattgcatttagaaccttctacctggtggagttttttttttgtttgttttttgtttttcagttttggaagtatttgattttttgaaacagttgacattcatataaagaacaaggttgataatcaagcctgctctagtaattctgtgcagtctagaaaagagtgtactggggccgggcgcggtggctcacacctgtaatcccagccctttgggaggccgaggcatgcagatcacaaggtcaggagatcaagaccatcctggctaacacggtgaaaccgcatctctactgaaaatacaaaaattagctggacgtggtggaggctgaggcaggagaatggcgtgaacccgggaggcggagcttgcagcgtgccgagatggcgccactgtgctccagcctgggtgacagagcgaaactccgtctcaaaaaaaaaaaagagtgtactggttaagtactgagaagcatttcctgtgtgtctcatgtaagtacttcaggctcttaaatgtgttactccaaggaataaggttgcaaatacagttgctctaaaaacatattataccagcctggccaacatggtgaaaccccatctctactaaaaatgcaaaaattagctgggcatggtggtacacacctgtaatcccagctgcttgggaggctgaggcaggagaatcacctgaacctgggaggcggaggttgcagtgagctgagatcgcgccactgcactccagcctgggctacagagcaagactccgtctcaaaaaagaaaaaaaattacataaaattccgagatgcagctttcttatctaaaaaggatttgcgcaaagcctccttgcagtaagcatataggtaactaaggtgtctaccttacgtatatgcatcactcatttatgccctaagttctcatttgttaaaacaatagtgcccttactctaaatcacataatcacaagagccctagggctgaattgctcagctttaaatgtcagcactgtcatactagctgtgtgatgtgagcaagttctaaaactccctgtgcttgtttcttatgtatacaatggagagaaggggtagtactttgtagggttgttgtgaagtttaaacaaggtaataactgttaagtgtttttaaaagtcccttgaatgtaacaattgcatcagtggtaaggtatgcatttttctcatatggcctctgaaatgaggatgtgtcttataatgaatgtaatttcttaataagcattttatcatttagtgacatcttttttattagtagtacttaatgttacactttgggtgacattttatatttcaataactaatagtaagaggtctattaacattagctgccatcaacattaccatcaatattatcatcagcattatcttgtttctaactgagatagtggcatttgatagtttagcagtgctagagtatatatcaaatctcaattttatctaactacttgtttgcattggtgtatttttatcaaagttctagtgtgctgtttttcatatttgtatcattttagctaatgtaaagtatttatggggtcagctcatgcaatgtttccgtcattcattgtaccttacttggcgatctactaaaacatgcatcagcatccttcagtctcccgaaataaatagacacaaagacaaattctttattttctctgttgatgtattttcctaaatcgtttcgcaggagtggtttctttcttagctaggagaactaagccaccattgtaccacttaagatttactggtttgcactgtcctctgagggagaaaagaagcaatttattgatctgtaacacaggaatggactgtggccaaaccttttctggtttatacaatgcaccgacataagaatctgcatagcattaagaagaatgagcactcacaatttgaggccgcctgtcagcatgaataataactgagaaaaatcaatacacaatatacaactgttctctttgcacagacactgccaggattcacacccagtgacagtgtcttcttttttttttttttttttttttttttgagacagggtctctcactctgctgtgcaggctggaatgcagtggcgtgatctcggctcaccgcaacctctgcctccctgttcaagtgattcttgtgcctcagcctcccaagtagctgggatcacaggcgtgtaccaccctacccagctaatttttgtagttgtagtagagatgggattttgccatgttggccagcctggtcttgaactcctggcctcaagtgatccacccacctcggcctcccaaagtgctgggattataggcgtgagccaccgtgcccggccaacagtgtcttgttattttaccagtgatatgcttacagttcctaattttaggcttcctccttattttggttttattgttcagtttggggaagggtgggaggcaccaatttggatctgagaaaaagatcttctgccagatgaaagagtttcaataacaggagaggaccttgggccaaagtttattaagcttgactaggaagattctgggcacatctccatccaaataccttgacacatacttcattcacccctagcacatgcagcttgtcccttcttgtcttctgtttgccttcaaggttttacatggtggtatttacaagccgttatggagcaagagtgcaaacacacaaggctagcaaggggccagtaaacagggtttggcttagggttttgtggttgttagcttttaaaagcatacttagttgaataattccagaaactgggcttctttcctttgccccttcatttgcccctccctctctggtcttcccagtctccacttttttttttgtttaaataaaactgcgtttgtcagaaatgtatagacattcactcctattcttaaaagacagtgtttatccctaatgcctgccttttgattcagccagcagtgactgtgcacacagaggttattgctctccaagttcaatgttgtggacctgaaccagtgcctctgtttccaagagaaagtcaggtgattaccccttcatcagggagattggagccatcctatccttctggtgtgtcaccagccagaaactaaggatcagcagggagtggatggtttagaatctcctctctccaggtgaacacaatgctagtcagtgtagctggaaaagccacgcagcgggcaggcttgtcagaagcaatctgtttaaaaaaaaaaaaaaagagagagagaaaaaagggtccttttgaatttacactgagttgctttcacagtagttagctttgaactgtggtgcaaacccatttaaacaatgagggaaatttcactaagtggcaagaaattctcaccctgtgtgatcaaagcaatcagccatttccttttctttcctttttatttacttatatttctgaccccttataatcttcatgattgtagcctgatagtttccttttttgaatagcatttaaaaaaataccttttcttttccctgagggttttaaagcaaataagacagaaggggtctaaatttttagttttgttttttgagacagtctcgttctgtcgcccaggctggggtgcagtggtgcaatctcagctcactgcaatctccgtctcccaggttcaagtggttctggtgcctcagcctcccgagtagctgggattacaggcgtgcaccaccagccttggctaatttttgtattttttagtagagaagaggttttgccatgttggccaggctggtctcaaactcctgacctcaggtgatctgcctgcgtcagcctcccacagtgctgggattacaggtgtgagccaccgcacctggcctaaatatttatttttaataatgattattattacaaaagtaagaaaagagctaaaatccatgatttcatcacccagaggcaaccaccacagtgaacattttggtacaattacttctcatcgtttaaatgtgtacatatacacatacatatttttaataaaattaggtttaggatagtatacagttttgtttttcttttaaccaacatactttgaatattttgccttattaaaaacttatatgatttcaatggctgcattagaattagtgtatacagatattattttggcattctgttgttaagaggtcatgtgggtttctgaattgacactttaattctcaacttagaatttatttctcccaacttcttctgatttcatgggtctagagtcagagtttgggcacaatggaaatgggatttctatatgtactgttgtttactgtttgctagtatttttcgaaaggtatttgcaaaaaccaaaggggaaacagtatacttttttgtatttttttttctttttttgttttaaattttgtgattgaaatataagtcttattatggtaatctcaggtaacttttaaatagaaatatcaatgcaaaatgaatatattgcccaatgtggaccccggtgtttcagaactatgtgccatgctctatcattttgttactggaaaggggtcttaatccagaccccaagatcttggatctctcacaagaaggaattagaggtgaatccatagagtaaagtaaaagcaagtttattaagaaaataaaggaataaagaatggctactccataggcagagcaggagcgtaggctgctcaactgattatacacacagttacttcttgatgctaaacaagaggtggattattcttgtgttttgcaggaaaggggtgggtagttcctggaagtgaggggtcctcccctttttagaccatataggataacttcctgacattgccatggcatttgtaaactgtcctgctgctggtgggaatgttttttagcatgctaatgcattataattagcatataatgagcagtgagaatgaccagagatcactttcatctccatcttggttttggtgggttttggacggcttctttaccacaacctgttttatcagcaaggtctttgtgacctgtatcttgtgctgacctgtctcatcctgtgactaagaatgcctaacctcctgggaatttagacttaaaataaaggtctcagccttattttatctagcccctactcaagatggagttgctctggtccgaatgcctctaataatttgaagtttatccaacggcacagtgggagataatgaatttttgtttaagaggaggaggactgactggatcagatttgtgctttagaaaggtggttgcatgtaagaaagaggcgttggtagaaagacttcggatatctcaaaagaatttccatgaagttaatctttttaaaaatgtaaacatttggtgcaataattgctttgaaattgcagttgaataaatgaactttttgaaccagaatttggaaaggaagatatgcttaaaaaccaaaaatatttcgtagagtgctacacattaggaagtcatttgtatttggtgaccactttcctaaaatagtctcatttctagagaaccaattttgtttcccatagattattatgtgtagagaccccctttcagtatgtagccactggtacatccgtgggtgttatctccatactgccaggtccaatgcagtcacctcctggatctatagtctttctccccccattccgatttcctttctctgttagcagtcatctttgtaaacagaagtctaagatttagtttgtacattttttaaatgatccattttgatggggctctctttattgtttcaggttgaatgcctttgagaacttgatgcataaaatttgcatgactcctcactcctttctggatctctcattggactcaagccagcatggctcacaccacaaaggttaacggcagtgcctcaggtaaccctgtgctctggagtttgtgtgttaaatgtatgtcttttctcaaactaattttttattctctttaataatgaacggataatagcaagttgcctagataactaggatttcaaagcaattttctgtccattgaagtttgggtttgttttgttttactctcagaaaatttgcttttatcttagagtcttgcactgaaatcaattgagtaaattattacctaagtcaattctgttgaagtgttgaaagacaaatgtaaatactgaatgctgatgcaaatgtaatgtatactcctcttgcacttctttctgagggattgaatgaggagagaggaaattagtttggatgcttaaaaccaattcctagtagccactcccaagcagcttttgtttgatgttgctaaacaaagagaaaggagggaagagaagtatatattctgtaaaatgattctcttaggaatatgcaacaagccatattatgaatcataaagacctgtatttgaattcttattttggttatattagagacttacatagtttcactttctgttccaatattgcttctgtgagattcgggagaaatctgtacacgaaatgcagagaagatcctcctaagagacacatcaccatagggacaacctgcccaaaatggcgtgccaagtgttcatttcttttttgagttatgtgccaaatagctgaatgagtaagaatagtaattgtctatgcagaaattttttctgagcgtctgagtccagactcctacgtctgctggctctgaacaccttcaaatgacaacattatatactggagcaagtgtagaattggagccaggaaacctgaatttgagtcctagttccagcactaaccgtgaaatattgggcagggctatttctccacatgtaaaccatcggtaagtatatccacctgccggtttaggaccagtgagcgcaccagaaacatacttagaggagctatgtaagccgtaaagcacttttgaagacaacagcaggaagtgacctctaaagtgggcattcccagcccatgaatgtgactttttattctagcggtctcagctgcaattatctcctctgggtagaacactataacccaaacccagataaactcagttatttgttctgggatgactgatctttccctgtccattccatttttgaccttttttactgcccagcttcttgagacttttatagattctgctgtgggactgctatcaataataaagacatgaatgataatatctaacattcattgaacacttaaatgcaccatggtgcctaaaatgctttgcctgcattttcatacttaatcctcacaataatctaatgagattaagctattattttactgtcatcatcatccctatgtaatgtcacagagaagttcagggacttactgtaaatgaagtaagaaaaatcagaattatgggcagtggctcacacctgtaatcccagcattttgggaggccgagggggatggatcacccaaggtcggtagttcaagaccagcctggccaacatgacgaaaccccatctctacaaaaatacaaaaattagccaggcatggtggcgcatgcctgtaatcccagctacttaggaggctaagacaggaatggctggaacctgggaggcagaggttgcagtgggcccagattgcactactgccctccagcctgagtgacagagtgagactccatatcaaaaaataaaataaatcagaattatgatgactttctccagtaaaatatttggtgagagaggagattgaaacattatgaaatttcaagtgtagtgggtgggttttaattccctctgatgatgtggtttcctcccttgccctccatttgcttccattcacatgctcaggggaaggggtgtttaagattgttggtgcctcaagacctcaaccttcttctggtgccttgggcaaaatcctttcttcatgggtttagatacctaccccactaattcctttccaacttggtttgttctgtacttaccttttttctttgttcctgagatctaataagcaagctgtaacttttccttcccacctggtatcctgcctaacaggtctgggcattgaggttgaaggcaaaagaaagctctccgatttgtgactttcagggtgtcagagtatgaattgttactgcagacagttatctggactgtgcaggggaagattttttacttattctagtcaccatgacccatgtacatctataagcaaatctaattagagactcaaccataaacagtaatatatatgcaaacatacatatatgtgtgtatgtgtctgtatatgtatatacacacatagtaatatatacatacatatatgtatatacaaacacaaatgtgtgtacaccatatatatgacactcatagaaaaaaaaaatttttttttgagatggagtcttgctctgtcacccaggctggagtgcagtggcacgatatcggctcactgcaacctctgcctcctgggttcaagtgattcttgtgcctcagcctcccacgcagctgggattacaggcccatgccatcacgcctggccaatttttgtatttttagtagagatgaggtttcaccatgttaaccaggctggggttgaactcatgacttcaggtgatctgcctacctcggcactttgggattacaggcatgagccaccgcacccagctgaaaatttaaaagtatagatgtgtgttgtattgtctgaaaaccaaaacaaaagcaagaattactggtgataataccacctagaaataaatgtcttcctattttttatatagttgtcaaatgttatatatttcacatggttgagaatatgttaataaaaatcattcctttaccttttcccactttgtattacaaaggaaacacctctccaatgtttaaaaaaatactcaatgtaagagatgcgggttataaatacacttctgtgcatgtaaataacatttagagaacctagatgaagatgagataaagagggcttcatggcagctagtgagggccaattactggtctcctatgagaaaaggataagctatttgggtttagtaggagtttcagatgtggagtaaattatatgtttcttcaatttccaaaaattgctgcttgggcttcatagagcatgaggggaaatttcatgtgacgatggagtcagggcagtggcaaaagaagcactttccatagtgttagtaataaaacaagcaaaagaggagcctctgggaaagggcaaaccatgcccttggcacaaaatacatccgacgactgatcatctcaagttgacatccccatgtaacatttaaatgggataaggggtgattcacaaccttttatactctgacttccccttggagtccctcacggaggctgggtaaaagaaactgcttttaaaacgagctattcattaatgctgtaatttgtaaaatgtattatgccacacttcagacatacaaaatgtgtgaaagttatataacaagcacctttgtacacactacttagcttaagaaataaaccttattaatataggccagatatacatgagcacctactacgtgctgttttaggtactggggatacagcagtgaaccaaagaggcaaaaatttctgccctcaaggattgtacattctagggacagttaaagtctcctgtgtacacggttgccagaagaaaaaatactaagcacgtgttcatcgtttatctaaaattcggtttaatggtgctccactttcgtgcgcggccctacctgtgtaccccttgcagattgcacccctgcccttcctcaccgccagcccatcaaaatcaatcttccctcgtagtgttacctctttttcaccagatcctccatcctacttctcttgattggtacagtactgttttcattaattcaaaacattttaggccagatggggtggcgcagacgtgtaatcccaacactttggaaggccgaggagggaggattgcttgaggccaggagttcaagaccggtgtggggaacatagccagactccatctctacaaaaaaaaatttttttaaattagccaggcatagtggtatgcacctgtagtcccagctactcaggaggctgaggtgggaggattgcttgagcccagtagtctgaggctgcagtgagttatgatggtaccactgcactccagcctgggtgacagagccagaccctatctctaaagcaaaaaacaaaaaacattttattatggtactgctaacagtactgcagcgtcttttgttaaggaggtaagagcatcataaattgctcttgactgttctctcatagccagctaggaagtaaatggtgattgttggttaggaaaatagctgtgtttctttggggtgtagggatgaggcagtctgctttttccccaagtttctgaatcatgttgtaaactgaatgcactgattgatacctctctaaacactaatgttgtgaaactttaattagagcttagatatgctttagaagccaaataacaagtggcttatttgtgaaagaaagataataatagctatcctaccttcttcacaaggtggttgtgcagggaaaaaaagaatagctgtaaaaacactttttaaaacacaaagtgctggtcatatgtcaggggatagcaccattccccttgttctcttgtccttgtcatgagccgctgatcaggaaacatcccaggtaccctcatgtcaggccctgctggacgccatgatattggggccagagttgtattaacatcctcattaaacccagttaaatgacataaatggatgagcactgggaggtgactttttatgcctgctcttatcatctttatttttgctactagttgccttccccaattgattatagcttttccctcatgctctttctttttttgcagcctggatatatattttttcagacagatacatatttatttattaaagatgcttattgaattgcattaaaatgttatttaggctgggcacggtggcttacgcctgtaattccagcactttgggaggccgatgcaggtggatcacctgaggtcaggagctcgagaccagcctggccaacatggtgaaaacccgtctctactaaaaatataaaaactagctgggtgtggtggtgggcgcctgtaattccagctactcgggaggctgaggcaggagaattgcttgaacccgggagacgaaggttgcagtgtcccgacacagtgctactgcactccagcctccatgacaaagtgagactccgtctcaaaaaaaaaaaaagaaaagttatttaaattaatgataacataaaatttgacaggaaaccagaagagaagaattactcaaaattccacactaggtcttatttttagtatttatttttcatgcttttcaggctaacaaacttaaacacagtttcaataagcttttataatttggatatcagctcttgactttaacattctttgcatttttccaagtcttcatggaaaatagttttcaaattattattttcaatgactgtataatattccttatggtgtttctaccagttgaagtattctttttttgtttggatgtttggactgcttccacattttccctatggtagatgatgttgcagagaacatcttccctggtcatttttctcctccttttttattatttcccaacaatttcaaagaagcaggatgactgggttaaagggcacaatgttttcatggctttagtaactgttgtggggcttgaatctcgttatcttggtcagttatttggctccagcttttgtctctatgctgatcttaaatgagtacaaaggccactgataagaccgggtcagccagacagagccaggctcatggcagggtaggcagaatgctgcagtgcggtgcaccccactctcgcttgtgtaaatatttttctgggcaggagcgtttctcaaacagaactctgagcccactgcggtgaacctgatagcaggaattacgtgctatttgtcaagtataagactagtttgcagtgactggtctggctagaacccacctggtgttttctgagatcatctgtaaggaaacacacagcacagcagaggcagtgtgcgcccgtggtggtgagtcttagacctgtcatctgtgttagcattaccccgaaggcagagagtttgctgattagaaactatggctgctttaattcatgggtaccctccgtgacttttcagggtctcctggttgaatgaatttgcagaaggattaaaatgtgtgttcttatttgtgctttgtattctcccataagtagtgtgttggaggctattagaatagctgagagggtaaaacataaacacataggtaggagcctgacataaacacataggtaggagcctgccataagcacgtaggtaagaactaaaagggtgtgtttccatttcagttgtccagccttccttccatactctcagatgacaaaacacaagttgctgagctcacacagctaatgactaagccagaagttggacatggagaacatttttcctttgttcaaggttatttattatgttgacatttaaaatcagaagtgtgatatctgtgaagttctgattaaacagatcaagtgaaaaggatgtagttcagaaaactgcataaaaccctaaagtacagtgtttaaaaataaaacgtcctccctgatagggattatgttggtaagttactttttttcttagtatggattatttcaaattaataaacatattgttattcctttatttattgcatcatacagcttcatcctagtattagtgtgtttaataattgcatttaattagattatgcatttcaactttcaatgaaactgtagctgttagtcttttgaaggctaatttcacgctgaaatttatagatgaaataattttcttatagtggtggtgtttgagaagataatgtaactacttcttagatttcaatttcataacccttaaaatgttgggaccacctacaaatgggggacaccctgggttttgaagtcttgcctgtgtggttaatcagaacctcagaattcacccagcccccggagaggttttgaaaagcccctggctcatcagagcttgcttgtttcataaactcttaaggctttgttttaacctgtagccagcttcgccttataagctttcttgccccaagccttgagccagtcataatggcttaagcatcagatttcagacaggcgattagctctccagctaagccaagaaaggatgatttatcttccagtgagtaccagcctatttgagtgtaggaaggagaaaaatctgtgctcctgctcctgggtactgggcaaagaaaccctttggttggggatttttgcctggtaccaactttataggtgccaacaagaaagaaagaaaaaaacacatacaaaataaacacccaacagggagattcgctgtgttaagaactcgagctgttgctattattctaagagactgggtagccagtcaaagggttaaaacagcccttcctacaaggatttgaaaactctgtgctctgctcttcctcagcagacttctcgttgtgagtattggcatttatttctgattatgcacttcccctctttcttgaatgagttgggtgggctagctgagcccatcaaaggtatagctcatttgcttccttttccagggtttgccttcttcctgtgtctgggataatttcagttcatctcctttgtgcagtttctgagaaaggtttgtatgggcttagaggaaaatgatcgtgactaaagctcacagtcaccgctttggctccttttctataaaaggtggtttgatttgatctggcatgaaaaatattatcataattctcaaattcacagaaacgataagttcttgctctttcctgaccaaaaaaaaaaattaattgcattgggtagacttctctaataaaacctttaaggagacccatccaggaaatcagattttataagattcattcaaacagttgtagaaattctaagttcaaaaaccaaaagcagactcttttctttttccttccttggcttctctgttggatatttttggagtgagccttaactgagttactcatttccacatgctttaggaaaagtatgctcatgttttacaggctaagcctggttctgcttttgagctgcagttcattatgaatccggaaaacacaggtttttgaaatgcggcccatttgtacatatagcattagtcatctcagctggtagttctatacgatgagttatctcaccacttaaaaataagtacgctgctattttgagatttaaaaatatatatagtgaccagatttcttaccctagttaaagcaagccatggctgaaactcagattaaacaatattctataaaaatgagagaaggccactctaatcaacagatagaaaaacagaactatagacataagggagagctgtgctaagggacaaattgttggatttgtaggatttgttcgtatcctgaaagttaaatctttgtactcttaccttgtttatggccagatttgcctgatccctgatttccctcccaactggatcagaggttgtggaattggaatttcaccatacaaacctttacttaaaggaggtagtactagagtaaccatttatgggaacagtttgctactaatagttactagtactgagtttattttagttcctttttcatgattttattccattggaaaagttttctctcagggatcttttctactttggacatgatctctgttaggcagaatcaaaagatagctgtgtggctttctgaatttagtctcacaatatttggtttagttgataaatcccatccatcagctttgcaaataattttgtgaaaacattgattcagcttgtcctgcccaattttcccatccctgcccagtttactgagtgccttttccatttgcatccactgtccattaggccaaggcgtttgaagtgtttctgtacagcaggtacatttaagactctccaggaagaaagggggaagaatattccaaactgaaaacatcaaagagagagatggggtatttccagtaacttatatgcccagtgcttaatatcttaaaaaccctactcatgtgcatcagctcttacttttttctaactaaaaccagaaaaaagttctctcttcctctgttctcagtatccccctcatgtaagtctgtctacccaacacggtgcagccgatttatttatttttccctcagcatttttaggtggattgactgggatgctttattcaactcagggacgcaccacgaatatgttttttggggcaacccgtttggcatgttccccctcagctgtgaggacaaagactggtttgtcttcttgtgacctggcagaggaggcagaagtacctgctgagcttatgcagcatgtaccccaaccggtgccccacctcttcaagtggtgaatcagcctgatgatacactgatttttagaacacgctagggtggagacctggaagtctgtacactggtcggggagggagggatggtttgcatgtcaaaccatttcaacaatgcagcttacaggaaaaaaaaattaattgcaaaacactgtgatgccctttgccaccagatttttccattagcaccacactttatacagcttccaagtctgccccagggacaactgtttggcagtgtgaggggaaatggcagcatcacgtcataagtgcaatgattgttacctatgagcctatccggtaagggatctgagtgggcccaagcatcacacacgtgctggagctgagtgttctctgaggaacatgctaggatgttacttgggtgctagaaaacagcagctggaattcacaacacctcaggacactgattgtaaatgaagaatcctgagactaaacatcttctagaaaggtaaagggggcttagggctgggggcttttcctctgggctcttatcctttggtatgttgtccctggatgctttgagatgagactttgcagatactgctgaatttcttttcttttctttttttttaatactgctgcatttcaattggggtgttgtttggggactactggaaggaatgttatgaaactccatagaaatacttcaattcagtgagttcattcattcagtggctcacttttaaatgaccatacagatgtatttggcagaatacatctttgccattttccttctttgtgtaatggaccagccccgaggctgcgagcattggtccttctttgcctttttctccctgctttgtggttttgtgtatgtaaggatggctggcaagattaaggatcattgagctttgtattttctgttatttttctgtctccccaaacattttcactttcacaaactttaatctctaactattattcccttatcttaactctgaacttttgttttggacttattttgtctgaaatcatggtctatttccgtttcttcagttcttgtgtctgtaaaaatcacagtaggccttaccggaggtccatgactacaggtactcagagaccagctgtatccaaagagttgtgtaagataggggcatctgctccctcccagtgctgttgcccagccccaccctgccctgttccccagttagtgtctttgctttcttgacctggatatctttcccatatctattaatataagcccttcttatccttcaagtcttgctgcctctcttacctctcccaacaggcattctcagatactcccaatgggagttcctctcttcctcttctttattccttttattctgttattattctattattatttctattaaataattgccatcagttgcttttaattaagagttacggttgtgtgcgtcactaatcttataaacttgagtgttttaagaggcaagaatcatgtcatcttcttcgtatgcccaacaatgccttgcttagtagtccttgtagagtcaacagattcaatgttcaaccagcaaatatttgcagagcacctactttgtgctggcatgatgctgggcatataatacaggtcaaaaatcaggcccagcacctgcctaagaatttgtgggcctgagccctgccagttgccaatctgatgtgctatattctttgcagttttcttccagccttttcccgtaagttcccagttggtcgctctgtgaattcatgtgtgacacttcacctgggtgtgtttcctgggtgaacagatggcttttactgtgtcacacacacactcttgcgttctgcctcctctcgtgaaagttgtagttatctgctttctctccctcacttgctctaaggcaggcttaagatggtgttgttgctgggtgtggtggctcatgcttgtaatcccaacactttgggaggccaaggcaggcagatcagttgaagtcaggagtttgagatctgcctggccaacggggtgaaaccccgtctctactaaaaatacaaaaattagctgggcgtcgcagcgggcacctgtaatcccaactacttgggaggctgaggcaggagaatagcttgaacccgagaggtggaggtcgcagtgagccgagatctgcacttcagcctgagcgacagagcgagactctgtctcaaaaaaaaaaaaaaagagtgagaaagaaagatggtattgtctgttaagtgccttgggttccagagagaggtgaccaggtatgttgtggctgtcttaaggggaagattattgtcaggggccatttggaaagttcttcctggctgccatggcctttcattgctttttgtggcatgttagcagcacaaccagatagggaggaggtggtactccagttggttccttttgtctcaggcttattctctggtgcagcttggtgggctggttgcaaccgtaggtaagaacctgagctggtagcccctgggggtatggctggctggcctgctttccttctttcccactgttttcttgggaaggtctctacagacctcacctcttttaggtgtgaggagataaatagtccttattatcccttatttacagccttcatagagtctttgtagtaatctaagttaaggtcttaatgttcttatttagttctgtgtccccccaattcatttggtattggcttttcttaatgctgatttcaaatcttggatgaaaatatattatgagaccatctcttctttagatgtgacaaaggtaataaccatggggcaatccagactgtgaagaaagcctaaggtgtagaaagcccatgcgacactagttttaagccttcacatgtgtttggggaaatgcgtttgttgaataaaggataagaagacagaagactttttatttttcttgtcttttaaggtaggaccatcagatagcatcgtcttcctaaagtcactctcctgacaagaatcagacccctctgccggggcacaccctcctcatgtggaaggcagggtggcctctccttggaaaatctcccctcatgttaagtcttctgagcggatcctgctaatccaggcatgtaaaggaggagtcctcatccaagacccaacatggtgcacacctcacaggaggaggaatggaaaagcaggcacctttgctggactttccttttaatcccctaaatcctgtcacaccctaagactatgaaagagatgggtggagaagagccttggtgctgtggaaagggccatacccactttctccctcattgcagctcacagtgtaggtctcacacccatcccaagcacctaaggggaggggtcggttaaagcagcacaatacagtatttgaactcttcaggggtttggggaagtccaatataacagaaataacccaggccctcagcgtggggtagcagagcatcctcctttcactctgtctctttctaaggcaaatactcataggtagagtttttgcaaggtaagcttacctgagccagaaagggtgggaggaatgtgagattgttttgattgttgtccttgggttttgttgttgctgttgttattgttgtttataagaactacaagaggctgggcacggtggctcatgcctgtaatcccagcactttgggaggctgaggtgggtggatcacctgaggtcaggagtttgagaccaggctggccaacatggtgaaaccccatctcttctaaaaatacaaaaaaaaaaaaaaaaaaaaaaactagctgggtgtgttggcaggcccctgtaatcccagctatttaggagactgaggcaggagaattggttgaacccgggaggcagaggttgcagtgagccgagatcccgccattgtactccagcctgggtgacggagcgagactctgtctcaaaaaaaagaaaaaaaaaaaaaaggctacaagagagaatgtccctagtttatggcttttcagtaccaaaatagtatgcattcagcagtagagtaagcagtagcagtagaatagcaccatgcttatgcatgacataagcttcatctgtaaaaggctgaagtaatcataccttgctgtagggttgttgtgaggattaaatgagttcgtgtatgtataaggcacctgcagcagtggagtccagaagaattgtgcacagtgggtggtggggaaagatgagggcagggaacattgggggaggaaagtaaattcaatggatgtcaggaaataggcatcttgacctgtccacagtgtaattcaggccaccactcactacttaatttaactttgttcttatctctagactaatggagcaggctctctgggggaaaagtgttgctgcagtaatcctgttaagtgtaagaactgaaggttcaggttgaagtctcaaagttccaaagccaccatcccagggataaagactgtgctggtatacgctcagccagcctggtaccacagaaggcttttgtctccagcaggttccttttctcactgggcgtcaccttttctggctactctccgcctgtcagaggccaagccttgagtatatcttcatcttcccacatcttacttggcttctttctttgtatgtatattgaaagagtaaaggcagataggtgtgtgtttctctcttcagtgggaacctttgtgactgatggtttccaggcagaagaggttcaaatttttaattgtttcccttcccaacccttgtcatcgtctgataaaggactaggcatttatttgcatacaatgactttttctggtggacctcaccttcacagaagcacagaggcaaacacccatagggtcagatacaagctactttagcaaaatgattgactttgactgctttatgtaatctaaactcttaccagaacacaatatttatgaatgtagcagatttttttttttgcaggatcaagaaacactacattcagtactttattcgtttaacttttaagaacaagtcttttgatagttttaaaattgtatgtgtgtgtgtgtatatatatatatatttatttattattattttttttaatagagacaaggtctcactattttgcttaggctggtctcaaactcctgagctcaagtgatcctcctgccttggcctcccaaagtgctaggattgcgggcatgagccactgcacccagccgatattaaatcttagtttggaatataataatgtaactaaataataccagaatttttttttttttttttttgagaccagagtctcactctgtcacccaggctggagtacagtagcatgatcatagctcactgcagcctcaacctcccaggctcaagtaatcctcccagtctcagctcccgagaaactgagactacaggggcaagccagcacacctagctaattttttttttttttttggtagagacagagtgtcactgtgtcatccaggctggtctcaaactcctgggctcaagtaatcctccttcctcagcttgccaaagaattgggattacacgcatgagccaccatgccccccaaaaagggttcttttaaatgccttcttcacctttgtctaagtacattgggtaaatgtggcactagttgaacaagatttactgaattttatcacagggcaggcaggcaaagccagttctaaacaataaaacagagatcaacaaagatgacggatgactctaaatagcctgttttgtaaaattcaaaacgggacagctgtgtagagagaggcacagttttataagaattcactggacctgcctagtttggctcatcttggtgcctgcacatgccctgccttattccatttactttccttctgtctcatctcctactggtgaccacagttactgatgggagaccttaaaggtgattatctttgagacacatactttcctgtgtgaagacacaaagattaaactctataagaccatggcacttatttgggcttggggcttggtttataccaaataaaccaacagattaaaaaataacaaactaaaaacaaagtttcaagtgccaggtattttgaaatagcagatccaaataatttcatattactttacacaacaagacctccattagtaagagatttgggttagattttttcttccttttttttttttttactttaaactttattgagctgttttacataccatagaattcacccattttaagtgtatggtttgataagttttagtatatgtggacagttgtatatccacaatccagttttagaacatacccataacactaaaaattctcttgaggtttatgttatcatttacttttgacagaaatgttttcttctgcttttgaaaaaaaaaaaaattctgggccatgtgtggtggttcatgcctgtaatcccagcactttgggaagccaaagctggaggacttcttgagctcaggcattcgagcccaacctgggcaacatagtaagaccccatcactacaagaaaaatacagaaattagctgagcatggtgtcgtgctactctggaggctgaggtgggaggatcacatgagcccaggaggttgaggctacagtgagctgtgattgcaccgctgtactccagcctaagtgacagagtgatacactatctcaaaaaagaactttttttttttttaggtaatgaatttaaatcattaggggaacataccattcttactaactttttgaaacaaaaacaaaggttgctcgaagatgttatgaataaaatgtttaagagtatgagggtacagagcaagggaaggaggcttgggcctatggtttacgaatggtgattgtttttagccttctaattatatgttgcattaaataagaagaaaccaaaaaggaaccacttgcctccattccagcctcggttcagcataaaactcaatcatttccttcacaagccagctgctgtgctatagctcaaattgtaacagagagcctttctctgcagtggagggttagggaaagagggagtaagtcagcacaaacaatgaggaaacatttgctgcctttctgatttcttcctagaattaacaggcttacagctgcatttctaggtcagcatttcatatgcctgaagagtatgaggatagtttgaaaaatcagaaggaagatgagagagggctttgcctcttttttaagatcttgctagcagttttgtttgttggtaatttttgctgtctcactgacgccaagagtcctggaattaaaccccgtggccagcaggctgttagttcgtcaggaaattccaaatgggtataaataaattctctgcaacagctcctgggctctttgcctgctaatgtgtggagtccctttaatgctgagggaagtttgcctgagacctggcttcctgctcgctgaaaatcacagttattttgtttctgggtgggtaagtaagaatgcccacaaaagaaagagaggaggagagcatgatgtttgggtgggggttggtgaaatataaactcgagctctgtgtgttgtgaaaaagatttgcttttacttcaagctagaaagaataacccagtacttgatttttggtccagtgaaaatttcagctttacctatggctttaacataaagatgtcattgttgcaggagtgaatggttgtacatatatatatgctaagatttgagtttttgagtttaaggtttagttcaattcaataatttccttttttgttgctaaatccatctttgggtatttgttttcagctctgtttttccaatagggagttgctcaatattcattaaagctggcttcttgtataaacactataaaacaaaataaggacagggattcatacaaatactagctttccactaccaccccacctccccctggccaaaaaactgtaatgttttgttagaaaagcctgttttatccctaagttagccagtgctccttttctgcttttcacagaattactctctgaactggcacatttcttttttacgcttagaacagcatgttacttttgaagaaagtttggaaaataacagtccaagctcattctcttctgtgcatgcatgattgatttgggctgtatttcagcaacaacttttaaaatgagacagtggacattagagagcagcatagttggggttgcacttaggagcccatggcattttggctgttttgagacagatttggggtaaagagttgctgcatcttgtagttggcactgaacactggagaagagggccactgtataaaccgcaaggcccctgttaccatcacatgcctccctagcacaatgtgccctttattaagacaggccgttccactactgagaatagtaaccctttccgctgtcttcccctcactcttacgtgcagcctggcttctggcctcttaacccatgcccagagtagaattggcaatacccaggagggacactgcactggggattgttaggtcatgccagttaggatgcagctggaaaggtgctgctgagtgggacgtgcagaggggaagactgcaggctctgtctgcctgagctcatctggtctgacacctgccgtgattcatttttcttcatgccatgttaagaaattttgtatcaagtctagtcgacagttactcatagcctggaagcaactttggaaatcagagttccactgacccccctcattttaagggtatgaatcacatcactgcattgtatgattccagggctctcttgcccatggctcgtgcatgaactaggaagtgatcatagttcctgttcttgttttatgaaaacaatagtataccttcccccaacctaggcaggccattcaggacgactaccctggaggtgctctgggtggcttaaagcaccgtctttgcacagtgtgttagagagcactgtgccctgaggacttcgggagagctgcagaatgagtgttcagaataatcggcactcacctttgccctcatgttgtgagatggagatattttaacctggccataatatgctttaaaagttggggggtgtttgtctgcttttgcttttatttccttcctgtgctggactgggactcccccttatctaactggtacataccactctgcccaagcagtgcgtgtgcacacacacatcccctacagctccctgctggcatctccttcatacactcttaagaagaagaaaccaatgtagaactcaagattttagcagacttacttggtcttgaacaagtatcacaaataccttaaaccctgacttcgtgggggggggggcaaggtatagaggaggaagggttctggatcctctctggggggccagggttgtgttcttctccagacaacagagggtgatccagtaccactagtagtgacaatagaacccacccattgttctaagtgacaacacactgatgcaggtactattattttctcaaacaattggaatatagtctaatttgccgacagctgcaaagcagcagagccaggattcaaacccaggcagtctggccccagagtgcctgcttcaaatcactacatctcttcctctgttatacttattcatcagtagatgcctagatgtggggctttacacttcagcagatactaagagggccatgtaccaagcgccaagtactgaggaatacaaacataaatactgcttgagggccaggcgcggtggctcatgcctgtaatcccagcactttgggaagcccggctcacgaggccaggagatcgagaccatcctggctaacatggtgaaacgccgtctctactaaaaatacaaaaaattagccgggcgtggtggcgggcgcctgtagtcccagctactcgggaggctgaggcaggagaatggcgtgaacccgggaggcggagtttgcagggagccgagatcacgccactgcactccagcctgggtgacagagcgagactccgtctcaaaaaaaaaaaaaaaactgcttgacttctgcctcccctagacacttagagtctggtagagaaacacaggcatgtgcttgctaactgtaacacagttccgcgtatataggcaaagtgacttaggaaacaagagggaagaaggggaccagttattcccaggacagagcagttgagggtaagtagggctttacaaaaatgaggtatctgggttgggccctttaggacaatgcagctgattttgacagatgggagagtgtggggaagggtgtgctgggtagaggggatagaatgagcaaagatagataagcttgaaaatttctcagtacgttgaggtttggggtggggaggaacctgggaggtgctggattggggctaaattgttgacatttcgtgccacagaaaagagcttttaggctttcttctttaaagtggagctcctggcacatcactttgcaaggatagtgattgagaagttgtagacgtttccaggaatacctgaaacaaatgtaaaatttctcaaataatatgtaatacaggaaagcaaagccatctgcccctgaaaacaggctgcatatttgcagtatgagtaacagcagagtctgggctgtgctccctagtggcaggctgactgcactcgtgcaccctaaggacattgatgcacagatgaagaaaggaaagacagaaataaaatttatttttaaataattttaatcgtacataaaaagagctctcatgtcttcctcacccagactcagatttcccagtggttaacattttaccgtatttgttccatctgtgtgtgtgtgtgtgtgtgtgtgtgtgtctgtgtgtagaaatgcagttgtcatgtctttttggcctccttccatctgaaaagttctcgtttttacctttttttcatggccatgatggttttaaaaagagaggcctgacattctgtagaatgtgtttcaggcagggtccaggccatgccttcttggcaggacagtgcaaaagtgatgctctgctcttccccatgcagatacatgatgtcaactttgatcacctggtcgaggtggttatttgtcagctttctcatcatagagtcaccatttttttttatgattgacatttcatgccacagaaaagagcttttaggctttattctttaaaatggagctcctggcacatgactttgcaaggatagtaattgagaagttgtagacgtttccaggaatattttctggtgagatattctgagacgacatcagtatcttagtctttagtaggaaatctctacccactagccttagctagtgattcctacctgaatccgccactgttctaataattggtccatggtgattttctgttgacataattccttgtatatattagttggtattcctacatatttattatagcatgatggactcacaagtagatacctattctctggattgtaacttgttactatcattaatcatattattttcatgctcaaattatcctagatttggctagtgggggttcaaaagagtttgaatcaaatatacccttgacactggcattaaatagccaatctgatgtgtgctgacgattgagactaataactggtaggcggagggtgttatctgagttctagatatgtatttatctcagacagtatgggttacctgcaacaagatctgtggtaggcaggccaacagtaacactcgggaccctagaggcaagccaacctgaaattcagcttgtcagagaccatctggtgggtggaagttttgcgttttcagagtatattgtttaagttccccaggcctatcgtctacctttagctttccctgttggccaattcaggccctggtcagatgcgggtggataggtacacaaagctggaaacagcgtgctgcccgcctttctctcctgcctccagagacacttgttggctgtcagggtcggtgttgtcttagcctcacaggcattttcagtccttgctcttcccatcctagagtttcaaacacagagcgagtctgtgttctgcatctcaacatgctaaatcagaacctggattccctaaaatgttgtctcctgtttcttcctgccctcactcatgccatatccgtccttcccaggttagatttctcatacttcagtgaccttcagaaaaggaatcccatcacttttctctgcggtgagtcatccattggtttaaagaaaaaattttcttttttaatagcagaatgaggtaacagagccctagaagacaagcccagagaccggatcctggtctccagctcagcccagagtagctggaatttgtcagaccttctcagtttcctccgaagtattaggggcagacagagtcaaggctacaggctggctagcccagatgcagacagtgtcaaagttctcattgtggaataccaccagaacttatcttactattaccacttaccatctaattgggtaggtaaaattcatatggtgcaaaggagtttgttatacctagacaaaaattcatggggacttgaataatccatggaaaccctaatggagaatgctgaggagaattttaatctccagcatctagccagagcaatcttattaaaatgcaaatctgatcatttcactcccttgtttaaaacccttcaatagcttaccaatgcatctatgatgcaaaaacttgatccccagggtcctgtggaattagggctctgtctgtcccctttctgcctcactgcagtctttgcaaagtcctcttcccagttcttaaaagtggcaggttttgcatatgctctttcctctgcctagaatttctgccatccctccacacatccccaccacactgcccggtggactccttagctaccgctcccttgaagaaccctccctacccgtagcctaggcagggtccctgctgtgttccaacataacgcctgcattgtgctttcacaacacttaatacagttgttatttatgtgatcacttgtctgtctcctcctatacttcgtaagttctacccagacaggctctgtgtctgttttgcttagcacctagccgtgtttggcctattgcaggcacttaataaatatttgctgaatgaaagaatacatccatctttcagtgtaacaactgcatcttccttacatcagcaggaacaggtagatgtggaagatggagctggtatggagaagggtagtgatgggagacagtggaagatgtaggagtagtgtgcaggttaatgtctgttaaaaaagtccagataagattatctgtgagaggaaatccaaagatttgtggggagaagccaaaaggagttaggaagggttaggagtacacgaagcaagaccacattctaacttaatcatataaacaaaccaagcctgtaaaattgcagttatgctacatatgtgtcaactgacctgatatttcttaggaacttctggcatatacttttgctttctttaatgttacaattttatttgcatgaagtgtttaggtagctttttaaaacagctatactagcctgggcaacatagtgggacccccatctctataaaaaatttaaaaattagccgggtttggtcacacacatctgtagtcctagctactagagaggctgaggcaggaggatcgcttgagctggggagttcaaggctgcagtgagctgtgatcgtgccgctacactccagcctgagtgacagagcaagaccctgtctctaaaagaatgaatgaatacatacttacctacctacctacgtataacctgaagaggtattggtgaattgcagtaggcagtataaactctgtgaggagaagcatttcaggcttcttagaaaaagcctagcacgtggcaggtgcccatcatttgaatgcctgaatgaacgggttttatctgggagggaaaagagcaggcttaaaaacaactctttggtaaatgcaagagcaaaagaaaatctcatctgttatacatttcctttaaaccagaaggaggaacactcatattgctaccctttttattgtgtgttctctaacaaatggtgttcctcacacaaatttgatacaggtagcgaagctgctgggtctcaaagagcttagtgctaacagtgtcatcaggagataccacctgctaaacccgttcagaaggacgctgttgtacttcgctgtcttcttagaacactttccactcctggaaaagttgatgtgctaacttaattactctcatactctgagtaattagcttcatgagaacttgcctctcttcctgagttcatcctactggtttgctttcctgctgacgtgggatctttttgactgctttgaacagcaggatgcttacactctggggcttttaaatgtggaaatctgtgataattatgtacttctctaggactgactcagctcttcaagcaaaatcttcatgcttcatgtgagaggggacaataacattaatgggaattagcaaagttcttcagtttcaacagtcaggtgtggtatctggcgaagaaaaacacataaatagtgtgtgaaagttgtggcacaggggtgtaattatttttcacagcaccgtcagtcagtaactgggcctagagtgtgcagcagtgaaatcagaacaaagaagtcagtgtgtcctaattaatagataaagtaataatatcaaagtctcctccgttttaaagtccacaggacacattatttcaccccagtgctttttgctcatattaaagaatggctcattgtggtagagtatgtagaaagtattgaatgcttttctttactcaaaagtggcattttttatcacttgagcacttgagcgtagtgttattggccccaataggaaatgaaagacttgaagactacagatttttttttgaaatggagtttcactcttgcccaggctggagtgcaatgtcatgatcttggctcaccacaacctctgcctcacaggttcaagcaattttcctgcctcagcctcgcaagtacctgggattacaggcatgcaccaccatgctgggctaattttgtatttttagtagaggtggggtttctccatgttggtctcgaactccccacctcaggtgatccagccgccttggcctcccaaagtgctgggattacaggcatgagcctccgcgcccaatggaagaatacagattatatggccaaaatttcagttgctatctgtgaatttttattcttctcgctgtccccagcacaggctttctcagcctcagcgctactgacattatgagctagataattctttgttgggggaaggagggcctgtcttgtgcatggcaaaatgtgtgcagcagctctggcctctacacactagattcgggtagcaccccaagcagcgacaacaataaatatcttcaggcattgccaaatgtcccttcgcgggggcaaaatcacctccatgcctcgtttggttggtttaaaagaaaaattacctccagttgagaatcactgcaagcaggttagtactcgactagtttcctgcgatctaatcttcttcctggtgagtacgttaatttttatgtctttcaaaaccatgtattatttggacagcaagtttagtttcattaaaagttaaaatcatatagtactttatgaatctagatgaaatgatttttgaaatatccataactccatttcactttgttaatgcagaagaattgcaagcaaatttctcactgttcttgaggcagtaaattgggcccctctcacagagcactaagttttataggagatgaatatataaataaggagcagacttgccatcagtttgttgatttcaccttttctctgaacacagaggaatttggtctgaacttggagagttttctttaatcgatgccgttgcattggtgtttggttaccccaaattgcagagtgtgcaaacttagttgggagcgagagggaggaaatggactctgtgacccttggtgtctaggagtgagttggctcagagatgatgccaacctaagacaacatggagcccagtgttagttagcaggccatccacttaccttgagacgctggtataaattctggcaatgccagctgtcatgtagctgtttgcttcacttctgcctttaattacttttctatgcaccccatccccactagactgtgagccttgtgagaacagagactttgtccattttgttcggtgcccccagctccgagaacagtgcatggtaaatagtaagtgaagatccatagaaaactagagagatagagaaagagagacagagacagaaagcagaaattaattcatgtgcctttattatcaatatcaattataaatgtaagtcgaatgtgtgaataaatgttttattcggtctgcacttcccactgggtattataacattttaactggtcctattgaatgtagcctctttccctacgtcagtctcacgcacgcacaattgtcaagacgatctttgttgatgccttttagcccctagtttcagtggaaaaacttgccctgctccaggatgtgagattggtggcctctcctgtactcatcttcttccccttgtctaaccttggcattccttcagcagcaccaacaggttctgtcctggctcttcacctttttactctggtcatttaccttgtcttcagaactcatctctcgttaactcggttctgttttgatcactagtttacatactttcatactgcattgtgttttggttttttggagtgggggcggggttgttgttttttggggttttttcagacggagtctctctctgttgcccaggctggaatgcggtggtgcaatctcggttcactgtagcctccgcctcccaggttcaagcgattctcctgcctcagcctcccaagtagctgggtttacaggcatgtgccaccacacccagctaatttttgtattttcagtagagacagggtttcaccatgttggccaggctggtctcgaactcctgatctcaagtgaactgcccaccctggcctcccaaagtgctgggattacaggcatgagtctccactcatggcctgcattgttgatatatgcctttgtcactgatctcaattagtgttaagggtgtttggtagtcatctctcagctagactatatctgattttatttcttaaaaatttttcctcttactccttccactgaataggaccattttctgtagccaattaagctttcaataaatgtttatataatgaaagtagaggtggtgccaggagcagtctccaccactggatttccagacattcaaaaaatttttgtaaacaccagggacagccctccaattccagaatatttagttggaagctattactctcaggatttcagttgcagatatagccagtggaattttgactgtgcaaaagcaggcatagttctgttagtccaaaaaggcttagttaagagtctctttataacccaggtagatttttttttttaaactgctcttttttttttgagacggagtcttgctctgtcacccaggctggaatgcagtggcgtgatcttgacacactgcaacctccacctctctggttcaagcaattcccctgcctcagcctcctgaatagctgggattacaggtgcacaccaccatgcccagctaaattttttgcatttttagtagagacctggtttcaccatgttggacagactggtcttgaactcctgacctcaggcaatctgcccacctcggcctcccaaagtgctgggattacaggcgtgagccactgtgcccggccaaaactgttgtttttatacttcctcttgatcctgaattaataatttaagttttattgtaacacttttccagttaataatttagcgtctttctcctttttaagatctagtcttaatttttgagagggaaagggggaagaactgtagtacctgttagaattcagtgtaactccaagtaaacaagacccaaaacaaacgatagctaaaacaaaatagacctttatatctttttcacttaaaagtatagaggtaggctttttagaaatgttatagtagctctgatccacaaagtcctttgaggcccaagttccttctagtacatcgttcctccacccctagatatgaactcatgtttcaaagttacactagtgttctagtcatcacatctgcattccaggcagcaggatggaggaaggcacaaagaagaacataggtgaaaggattatttctgtgtttcttaatggaggttcctggggtatactacatgacacttctgcttacagacttttatttgcccctattagtgtggaaggaggggataatgcatactaaagaacatcaagctgtctttgccatggccacccctattcattcacctcccaagtgaactttctcattttattgcagtcaattccatttgccttccaaacagagacttcttgtaatatattttaagacaaatgcccaggccaggtatagtggcttacacctgtaattccagcatgttgagaggctgaggtgggaggattgcttgaggccaggagttcaagaccagcctgagcaaaatagcaagaactcatctctattaaaaataattttaaaaaattaaaattagccaggcgtggtgctacatacctatagttcccagctactcaggaagctgaggcgggaggatcacttgagcccaggagatagagactatagtgagccatgatcgcaccacgtcactccagcctgggcaacagagtcggaccctgtctcaaaaaaaaaaaaaaaaaaaaaaaaagagcaatacccacgtgttgtaaaaattataaaatataaagaataaaaatcatctataattccacaacctaaagataacaactgaaacaatatcatggaagaaatgtccttaacactaatatttaacgaacaacttctgtcttcagagcatcaagatgtttttcaaagtttattatcttattctgttggccaggcacagtggctcacagctgtaatcccagcactttgggaggccgaggcaggcagattacctgaggtcaggagtttgagaccagcctggccaacatagtgaaaccccatctctactaaaaatacaaaaagtagctgggcgtggtggcacacgcctgtaatcccagctcctcgggaggacgaggcaggagaatcccttgaaccagggaggtggaggttgcagtgagccaagatggcgccactgcactctagcaagtttattatgttatactatatattcagttatttattccttcagtaaacgttgtcagacatctcctttcttcccagcatgttgataattggtgtgtggttgggagaggaagcaatgaaaaaaaaaatgtatattttttttgggggggtgggggcggagatgaagttttgctcttgttgcccaggctggagtgcaatgtgtgtgatcttggctcactgcaaccttcacctcccaggttcaagcgattctcctgcctcagcctcccaagtagctgggattacaggtgcccgccactatgcttgggtaattttttatatttttagtggagatggggtttcaccatgttggccaggttggtctcgagctcctgaccttcaagtgatccaccctcctcggtctcccaaagtgctgggattacaggcatgagccagcgtgctctccaaaaaaaattttttttaattaagttttttgctctctgggtgcttatagtctggtacaaaagacaaaaaagtgttttcgtcttgttaaagttgggaaataaatcagggactcataagtgcctaatttatgttgatgtatgtaaacatacactagaaaacaggatattaaaaaaataatgacaccgggtagttttattgtagaataatttttaccatggacaattgtttgtgaaaatgacaccttgaaaacacatcttacttttttacttgctggagaatgaaacttgaattacaagtcctttgggtagcctggtttgagcagtattaggaaataagcaagcctaacttagttaaattctaacctcttctgattcccagaagtccaaagttcatttgggggtaatacaacgtgatacatgctttttgtgatttctacaaggtgaactaaagaaataactaaagatggaccagttaggttttggtaaaaactgtgataagttttgttgtgttttaaatactgatgttgagtcagttcatctttcctactgaaaatccttaagtgggaaaagtatagaaaaagtaggagttacaccaaaatattaacgcttgccacttgatggtaggatctgagtgccctttttttacgttctttaaattatctgtatgtggcttttttttttttttaatgttttacaagcatgtactactttcgtatctggaaaaaggtttgtttttctttcattttttaagaagaacttttcatcagtggcaaaggctcagttgaaattaatgataaaggataactacttgccacgtgtcataagcccagggctgagaagagtcaggcagtgctctggaaccagtgagtgctgcccggatcctgagaacccgcagagaacagtggggctgattgtgcctctgcacctcctcaggtgaccgagggctgggcaggaggacacagactctttcatgaagcagtgactagtataggaaaaacagagcctctctgtagagatgcttaaagtgctagctttatttaaaaatcagctggcaaagcgggagtgaagaacacacattttcagaagataccggtttcctgttttcattaagaaaacagggaatgcggaacagctgagtgcggcgggggtggtgtcactgcagccggagggagacctcgccggtgaaagctcagcctatggcatccgagcgtggccggccaagtttacacgaatgttgaaacttctcctcacggggtgaggatcgagggcgcccgaggccgggtccggctgagctggagcgagctgtgcggggcagcgcgggctggcggggagcgcggcgggcgccacgtggtaggtgagctgcgagcggcgtggggcggccaccgctggccgaattccggggggcctgggcgaggggggccggccgggaaggtgcgcactgctgggccgcttcactccaccgcaggcctacgggagtccagcttagacccgccggctcccacacacacatcccgggaggcccggatcagcctgcctgacagccaagctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggaatttcagacagtcctggagacaggtctggctgctgcagcttctctcctgttaatggaatttcagacagtcctggagacaggtctggctgctgcagcttctctcctgttaatggaatttcagacagtactggagacaggtctggctgcatattttgagtgatcaccttctccatgtggagatgaaagttaaaagggaaagagagaaggacagctacgttcttttaacacgagcacaagtttccaggcacagccctcccgaccagccctcccattcttaggctagagcatgactgctgctgggcacttctttcacatagaattcacttcccacacgtgttagaatcgaacagctagagcaatttaatattgttttaaattgggacgtaaggaatatacgtcctttttattcctctgcttggcaatcttatttttgtactttctttccaacatttgggaagaaagcgggcagatggaagcagaagtgttcttcacagcattcacactgtcgggtgtaaatgttcggcagtgctgggggttgggagggcagacagcaaccaggtttgctggaagttacttcaaactggacagcagtcaagtgggtttgtatactcaggagagggcagggagactgatggcttacattttcactcattgcttttgagttctttccatagctctaaaaatgcgcagcttattagcgtggctctgggaaaacaacacatgacctgatcctacaatttaaaaaaataaaaatgaccttgcttttaagtttgaaatgcatagcccaggtcagcgacaaggtctgcgctttgaaaggttcttgtgtttcctcttttaaatgtctggtttagccttaagtagtatttactgagtgccacatgatccagtggttggagtatgtaggttttgcccttatcttcattctttgcatctgtttgaactcatgacaatacaaaacaaggtgttcctgggatagggaatgttttgtccaaaaggagtcaacacggagaaaactcttcctacagttaagacagggtttggttttgtttttaaatgaggagagaaactgagaagtggaaaacacaaaatagagttgaagtctttcctctgtgtgcttctactcatgctgccagagttaatcactaaatatcccatgccccagctttctcagccggggaggtgccaaggcaaattgtaagcccatggaggtagtcaggagctgagtgcccttgacctccatttagaaaggcagcccagtctgcaaaagacagcagcagggacatctcatcccaggcctcctggttatgctgctgactttgtctgtctgctactgacttttagtttttttgtgtgcctcagataacactttgaaaaacaggaatcttaatgtctgctgtctatattccaagagactgtagatgaccaatgaaattatctactggacaatgctttcatgtcttttttttttttttttttaattgagacggagtttttgctctgttgcccaggctagaatgcaatggtgtgacctcgcctcactgcaacctccacctcctggattcaagcaattctcctgcctcagcctcccaagtaactgggattacaggcgcctgccaccatgcccagccaattttttatttttagtagggacgaggttttaccacgtgttggccaggctggtctcaaactcttgacctcaggtgatccacccgccttggcctcccaaagtgctgggattacaggagtgagcaccgtgcccagcctttcgtgtcttttataatgaattcttttaaaaatatttagtaaggacttactatgtgcttgtctcttaatcattatctctgagtactgatggacataaagatggaaaaagatggaaatagtagacattttagactacaaaagtggggaaagaggggagtgagggttgaaaaattacctattgagtacggtgtgcactatttgggtgatgtgtacactagaagctcaaagctcatcattacacaatatatccttgtaacaagcctgcacatgtactccctgaatctaacatacagttttaaaaaataatacaatcattatctcattacattgtttttaagcctgtgagttaaatatttgcatctccatttttactcagggagaaactgaagttaagagaggtttattaacttgcttacccaagccgggcgcagtggctcacgcctgtaatcccagcactttgggaggccaggttgggtggatcacctaaggtcaggagttcgagaccagcctggccaacatggtgaaaccctgtctctactaaaagtgtaaaaattagccaggcgtggtggtgcacccctgtaatcccagcaactcaggaggctgaggtaggagaattgcttgatcccaggagacggaggctgcagtgaaccgagatcatgccattgcagctccagcctgggtgacagaatgacctgtctcaaaaaaaaaaaaaacaaaaaaaaacaaaaaaaacttgcttacccagctgttgtagatccaggttcaaaacataggtgtgtcaactcttaaaatcataccagcttgctgtactgcaacaaacacaaatattagtttttaccattaggtgtattgcatgtcattataatattcttttctccctcttctaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggtaggtggtaccctgaggacctgggaatgaggaaggatgggggaaaatgtctttccagaagctaaggattattttttaactgctggaaccatttttggaggagaaatggagaaagttttagagtggtaatctgtagaatgaaaactaagaatcaaaatccataagcacctctgctgatgcttattatctggtagcctcactggcctctggctgaggactaacgctggaagaaaagtaaactggtgttggctggcctagaggttgtcttctggggctgctagtttggtaagatgctttattctttgtctttcagttatttacttgctcattatttatagaactgcctttaaaaaatcctaccctgtttgtacccactattaccagtatattagcaattgaaatactggcataaaatgttttcagttaaaacgtttatgagaggagagactccattaattcattctttaattcagcaaataattattgaatttgagccaggtgcaatggtacacatccgtagtcccagctactctagaggctgaggcgggaggattgctagagcccagaaatttgagaccagcctgggcaacatagtaagacctccatttctaaaaaaatatgaagtaaaaatcattattacttggattcctactctgtctcaagctataggctgtgaagatagtgtgaacaaaacagaacagagcccctgtccctgcggtgcttacattctaggtggggtgcaggatatagacagtagacctataacatgtcaggaggcgataaatactgtgaagaaattaactccggttatgggaacagcgagtggtagtggtcagggtgagggctgtttgagatgaggtggtcaaacttggagagaagggagtcttttcccactcattttttttttttttttttgagacagagtcgctctgtcacccaggctggagggtggtggtgccatctcggctcactgcaacctctgcctctcaggtacaagcgattcttgtgtctcaacctcctgagtagctgggactacaggtgcccaccactatgcccagccacttttgtattttagtagagatagggtttcaccacattggtcaggctgatcttgaactcctgacctcaggtgatctacccacctcggcctcccaaagtgctgggattacagacatgagccaccacacctggcccgataggcgcttacatttttgtctgtcttattctttctcgtattcattgggattcctgctcactcttccttcttgaaattgaagctaataatcagaaagccaccctggatgattttatggcttacagtaattccctgtgagccttaccaacctgattttgcttgtgaccatgtgcactgcctctcacagtgtataacatcatcctcagcttaggaccacactgcctggcttccgtttctggctctccaattctcatgaatcagtgtgacctgggaaagagtgtgcattagattaattttacatgaaaatgtgtgatacagacttaagccatccacagaaattccagtctttctattagtgtctgatggggcaatgattaaaatagactgaaatatattatttttatatcttcctaggtttccactttcaaacctgaattattgttagttttcagtatctgtgctataggacagttagtttgttgtggaagaaaaaaatgaatatgacagctcatgtgtggggtttttgccttttagaatccaaagagtctaataaacatacagggaagtcattttagaataaacaggattaaaaatgatctgtagactcaaacagagtctgcaagaactcatgccatgtctgctttgacatccttttaaaaatcatgatgtcagatgaagtcaaaataaaattcttaaatacctccagacagatggcacagtggatcatccattataaaagcattttgttcccagccttcctccctcctccccaaactggggtttctatttcacattcttgccagaaatattcagctgtaaccctgaagtaatttgctgaccctctgagcacggagaccagggagcaagttcggtctggctgtgtgacagtgttttttggtctatttccagtcacactgacatgccacacatcactggttagatccaaccctgctaacaaacacctaattaatcagctaaaatacagaagacctacagcacttgtgaacaaaacaataaatatttttaacagcacttatttagtcacaatggcagcccctctcagagcacacaagaacaaattttaagtatttctgtaatgcacatcatatttgtgttttcaccattttgtttaacgttctaatgaggaattaattaggttaggaaatgaacgcagagtattccatttttgttatctggcatttgtcatgtggactgaaaattaaagcaacttgatatagtaaagtggagatgctcaacacttagaagctttgagaatccaggtggcccagggtgcactgtgcattcctgtgcacaccataccatagagaatagcactcaccacagtctagaatgtatttctgaaccaaaagatatactggagtatagaagggtattcatctcaatgtttgttttccccaaataaaacagtagggaatttgggtctgacacctaccaaaaagagcatataaatgatcacttatatgaacctaacacagtattctaatttaaggaagttgttcagtttgggctctgaagctagacagtgtgggttcacattctttctctgtcactagaacagattgtctttgttccttcacagggttgtaatgaagattcagtgagtcaataggagtaaagcacagagtataaatgctcaatgaaagttggctgacgttgttgttatggttagagtatttccagaaatagaaatgtagatctagaacaaatgatgccacacagaaattgtacaagtggtcttttgttttcagcctaaatttttatcttcattattctgggtgatgcccctacccaattattatacctctccaactaaccattgtatcaatataaagaagtacatagataacaatgggaaacacaaaattgataaatgttcagtccagagtcattcagaatccgtgtcaaagctcaaaacgaagtatattagcggccaatccatagaattctgttcatttctcctagagttgaagatttgatgatggtgtcacttttcagtatgcaaaaaagtgttatttttagcagcatcataatgcttaacactatatttaatttcttaaaattacaactagagcatgcatcataagaaattaatagttcaagcataggcaacgtagtgagaccttgtctctacaaaaaaattttttttaattatctggtcatgttatcctgtgcctgtagcctcagctactcaggaaactgaggtaggatgatctcttgagcccaggaggttgatttgaggctgcagtgagctgtgatcacaccactacactccagcctgggtgacagaatgagaccttgtctgtgggtgggggtggtggggggagattgtgcacggtggctcacacctgtaattctagcattctgagagctgaggctggcagagtgcttgagcccaggagttcgagaccatcctgggcaatatggtaaaaccccgtctttactaaaaatacaaaaatttgccaggcgtgatggcagatgcccgtagtcccagctactcaggaggctgaggtgggaagatcaccggcgccctagaggtggaggctgcagtgagccatgattgtcacccactctagcctgggtgacagagtgagaccctgtctcaaaaaaagaaaagaaaaaggaaaaagaaattaaaagttcagaagagcatataataaaagagttaaagcctccctggcacactcctgtggtagcccgcgtgtgtttggtatttacagatgtccatgcttgcacgtctgtattttagaaacatatatttttgtaataaaatttgaatcatacatagtccgcctctttgttttttcacctaaaaggtcacgaacatttttctaggatttgagagacaatgtcttggttttgatggaattggaacctgatagtgaccagaggtgttctgtattttttaattcctgatagtatgagtttaatgcatttaatattttcttttataaaataaaaaagttaagaggaaatgagtttctgttataacaaaaatgttggtaaaaaaaagtttattcttcctgtaaatcagttggattgttttcgtttgaggcatagattagtgttttctttttttaattactattttcttctagagagggaagaggagagagaaaattccagataaatgacttacagatactctaaaaatatataactgtctctgagcaaatacaaacaaaactataacagtggaatttaactgcctgccccatgatttatagaacattcatctctcatactgaaaagacctgctttttaaaatcagcttccgtatttatactcttagttatcttagttcatcaaaagttaatgaactcgaagtcattcccataactatgaaagtaagttgtagacaagagatctgagccaaagcaaaagtagtcattacaaaatacgtttctaggtagttttctcctcgttcaaataatatatcatttacctgtcttagcacttggcttcttaatcactttcttttaatgctcaaaagcaccaaaacaatgcaatccaagtgtttctgggaccctgcagatataaaaatatgatgtaggtagtggaaggcctagaagtcagaagagctgacctctcatactggctgtgtaggtaacttgctgtgtcttttttttttttttttttttttttttactcttaagacagggtctcactctgtcacccaggctagagtgcagtggcatgatcacagcttgctgtagcctgaacttcccgagctctaaccatcctccctcttcagcttcccaagttgctgggactacaggtgcatgccaccatacctggctaatttttgtatttttagagacaaggtctccccatgttgcccaggctggtcttgaacttttgggctcaagcaattcgcctgcctcagcctcccaaattattgggattacaggtgtgagccaccatgccaggccactgtatcattttagaaagggagattgtggacttccatggcctcctgtgtcaaataaatagggtgagattagtttttctcctacagtcccttcagcaggattattctgtacaagtgtgagttaactgtttatgttggtgaccacacatgtattagcattcaggctgaggtctgagaggagagcgtagaaacaacatatttgtcctttctcctctatcaaagctacatgcttttcctcacaaagtagtatgtaccaaaaaagaagatggtccttcatgaataatctctactgcctgttccccaaaccatcatttgggcttaaagagtgaattcatgctcgagcccttttttttttttttttttttttttgagacacagtcacactctgtcacccaggctggagtgcagtggtgcaatctcagctcatcgcaaccttcacctcctgggttcaagtgattgtcctgcctcagcctcctgaatagctgggactacaggcacacgccaccaggcccggctaaatttttttttattattatttttagtagagacggggtttaaccttgttggccaggctggtctcgatcttctaacctcatgatccacccacctcggcctcccaaagtgctgggattacaggcgtgagccagcgcgcccggcctcaagccctttttcttaaaaacaaacattatttcagatccctttgaatttttagtcatactttgggaaagtaacctaaatatttgaaaggactccataatgaattggaaatttcagtcctacctgttctcaatgagtaagtttagatgttctttaaaaattaaatcagaatgtcaagctgaaaatgtggcacagctacatggttagttagctggctacactcttcttttttgtgttttcagaaagttcttggcactatcaatacaaatgtagatcagcataccagaacagttggaataggtgaacagagcaacttttaaaatccattttaatatatttttttaaattgattttctaacaaatttggaaacccatggctatataccaataactaatacccattctggacagataaatgttacacagaagactggagaattgatctctttaaaacccattcagctctagttttgggtgattttttttttctttttttaagagatggggtcttgctttgtcacccagactagagtgcagtggcatgatccgggctcacgccactgcagcccccaacttctgggctcagggctcaagtgatcctcccaccttccagctctagtttcactgaattatttttcttgtaaaacagtttgcttttaacattcctttatgtcaaggacataaagttttcattttaagtggcttgtttttcattatagtcatctcatttgccttagaatttaatatatggataattataaaagctaagtgcacttcggaatgataattaatgcatcaaaggtgttcctcttattttccaggacactgagatttctgtcacttgttgtcctttagtgatcactaatctgaccaagtcgtaaaatgaggctcatgctttattggtgtttatggctgttataagtttgagttaatgatagaagacttcacagttgcccactctgctgtccattaacttcccagttgtgcctgtgaaaaccgttgccacctggtgagaattttgagcatctagaccagagtgccagaattctgaaggtgttttgtaattactccacatgttgctgtcgttttgttttgttgagacaaggtctcactctgtcttccaggctggagtgcagtggtgcaatcatagctcaccatagcccctaactgccaagctcaagctgtcctcacacgtgaacctcccaatagctaggactacagacacttaccaccatgcccagctgttttttgttttgttgtgttctgtttgttagagaggggggtctcactatgttgctcaggctgatctgcaactcccaggctcaagcaattaacctacctcagcctcactaagtgctgggattacaggcgtaagccaatgcacccagcctgttttttgtttttcctcagagacggggtttcattctgtcacccaggttggaatgcagtctcaatctcccagcctcaaaccatcctccagcctcagcccctcaaagtactgggattacaggtgtgagccactcccagcctgtaattactcctgtttttatccctattgttcagggagcatttactttctgtttagtatgaacatctaccattagtggcccagggctgttaattaaaccaccagcagttcctaaaaattcacatggatccaagttgatgggttgaaactagaggggagtctaaattcttaatttcagtagtcagcttttatattggttaatttaattcagtggatctcaatcctggcagcacaatagaatcacctagggagaagtttgaaaatactgatgcctgcaattggagacactagttgtattaccaaggctttgactggaatggcatgtttacagagtgctttggggaactgaagttgatctttagagccaatggaagccccttggaaaaactgacctccctcataccttgtcctttacagggttcctaacctgtggtaagtaaagaatgtcactttctgacaagctcaggagccccacgttattttgggacctcgggaaaagaggaagtcacctaatttatataggtatctgcaggcacaaataaattcttggctgggctcaagaggtttgtaaaaggtctaatttgagattccttatgaaaaatgtcagcaaagtcaatgtaaaagaaaaagggggggccatatggcaaatacttactcttgctgcactttatgcaaataattagcccaagcataataagactaaaacttattttggaaataaattggtcccactatgattggtctttggtagaaatagaaaaccagagagagaaaaattatgtttcagaaaaactatagtaccccttttattgactccagctttgtccacttttttggataaggtcatctgctgataactcaataattgattggttctcagggtcatttacctgggtccctcaaggcttcaggttggttctacagggactcctgaagctaggactttcacttcttgtggtagggcttactattaatcttacagtctgctgttcacttatgtgctgtactaaaactgtggataagaatgaccccaaccagacaccagtgaaggcatacggtcaacttgaagacggtttcactcctcttaccttgggggcaaccccttccccaacaatgttccataagcaagaagaaattagagctgtcattagcctttcccatctccatagctcacacctcaggattgaggtgtaccgaaacccaagggggtggggacattgaaactgcctttccaaaatcatgacagtaaaagaaacctgacatagctgactccgtcttacttctgacctccaagctgtccttgttcattcctaggcacaggccaagctaactgtgggtagaatttggtttataatttaaccttaaagcaaggatgataatagcccttcccaagactaaactgcctttgtaaaactaatgaaagcacacaaggttagaattatggacgggccctgaattctattttatttattttatttttttgagatggagtttcacttcaactgcaaataagtgttcattctctctctctctctctgtctctctgtctgtctgcctctcttgctctctctctctcatatctggacccatccagatcattgtatctacattttttaaagtctcaccctcgattcaggtgattctaaagggtagctagggttgaaacgactgaattttgtttgttggcctctttgttctttggctttcctggctgcacgttttcttcgttttgctcaaacacagcagtcatttgtcagtcttacattggtgcatgcggtgcctacaactacaagtgggtccttatcaagttcagagaattgtttataggccactcaagaccagccagagtttcaacaccatccaaagaacattttctggcaatataggtgaccaattccctctgacttgacaaaggagagccagtttggaatttaatgaggttcttttccttaccagttaagcctcagtagaatcctcatgacctttggttgaattacatggacacttattaaaggctctcaatggtcccgcactgttctaagcactggacaggacaccaaataagaatgtagcagggaggaactcaagatgctgaccatctcattgaggagacagggcatatttgaatctggaccgtaagtgctacaggacaatgatggggaaaaaagacatctctgtggaatggttggaatggtatcatagaaaaaagactagagaagatagaatttgggccaagccttgaaaagagtatgggtcgaattcagctggtgaaggatggcgaatttccagacctgtaggatgatctaattactccctactcacagagttggagtaattaagtcacaggaccactctgaacagaatggacagagtggaggagtagctgagaggtaaagttcccgcaggcaagatgaaaccttccaccttgacccttggatgcctgcaggaggaggtggaccttgattggagaagctttaaaaagccctagtttacaaaagtaagctgtggtgagaaaaattatagcacctggtattcctgggtgacactatctggaaggggtgggaggaaaggcttaccaggttgttagaaatgttctgtatctctgttacagaggtggttacacaggcgtatacatctaccaaattccatccgacttacacttaaaatcagtgcattttcgtggggcatgatcacaagcacctgggtcctgtgtcctagctactccaaaggccaaggtgggaggattgcttgagcccaggagttcaaggctacagttagctatgatcacattccattgcactctagcctgggtgacagtgtgagaccctgtctgtaattcattctgtgcattttattgtctataaattgtgtttgaattttttaaaaattttaagttgtatttaaacaaagagaacctatggattaaaagactttaaaataatagcaaccaatggaaatacatgactggaattctgatgcaaacaccctattaaagaaattttttagagactattggagattgggcacagtagctcatgcctgtaattccagtactttcagaggccaaggtgggtggatagcttgaacccagcagttcgagactagcctgggcaacatagtgaaacccatctctattaaaaatacgaaaaaaaaaaaaaaagaagccaggcgtggttttgtacgtctgtggtcccagctatttggggggctgaggtgggaggattgattaagcctgggagacaggttgcggtgagcagagatcacgccactgcactccagcctgggtgacagagtgagatgccatatcaaaaaaaaagactattggagaaatttgaatactgactggattatgtgataatcatacttatctttttttaagatttgatagttttagcctcaatggtttgcattttttagagttcttttagggacatatactgaaatatttatggatgaaaatgattgaatctctagctgttgcttcaaaataatccagtgtgagtgggcagagggagttatcagggaaaccagatgttttctaatcattgttgaagctagtaatgggaagacaggagtttattaaactattatctacttttgtatctgttttatggtttcaataatagtcaaaactatcatgtatttgcatttaaaaagtcattgttggttattgaagaggaaaatgcttcgtacaagcatttctctacaaagagtgttctggcggccaggcacggtggctcacacctgtaatcccagaactttgggaggccgaggtaggtaggtggatcacttgaggtcaggagttcgtgaccagcctagccaacatagtaaaatcccgtctctactaaaaatacaaaaaacagctgggcgtggtggcgggcacttgtaatcccagctactcaggaggctgaagcaggagaatcacttgaacccgggaggtggaggttgcagtgagcagagatcgcgccactgcattccaggctgggcgacagagcgagactcaatctcaaaaaaaacaagagtgttctggcattcagtgattaactagtgagactttttggaggccgctgcaatattttctaagtaatgatgaatggacttggagaaggaaaaatgaagataaatgccctgctttatctactttgcttaaaataagtcaaaggcacattaggcatttcatatttgcagttaggggacatcaagtcacatagtgtgaaacgttgtttggaccgctgaattcagtattgtgtgtatgtgtgttgaggaggaagttggagttgtaaaggaatcgtccaggtagcccccatgtcccacagctaaaggagaaagcattgtgctgttgatttggggacaggggactgttcaccgaattaggaaatgtgagttctcgttcagctctgtggcctggggcaagtcctgaacctagctggccttcagaatccttagctggaagtctggaattaaaaattaggtgatatcccttgaggtcaggagtttgaggccaggctaaccaacatggtaaaactcagtctctactaaaaatacaaaaattagccaggcatggttgtgcacacctgtagccccagctacttgggaggctgaggcaggagaatcgcttgaacccgggaggcggaggttgcagtgaactgagatcacgccacagccctcactccagcctgggtgacagagcaagactctgtctcaaaaaaaaaaaaaaaaaaatttagatgatctctaatgccttacattgaattttttgccagctctcactcttttactatagcgtcattgttttaaaccagtcaaagtagaccacctgcatcagtgattcttgtaggtggtggggaatgtcagaaatgccatcacttggcccccatcccagaactgcagaatgatctcctggcagcatgttcctgggaatctgcattttagccaatgtcacaggtgattcttatgaagaatagaactcagagcagttttagggcttgttattcgttctttttcttcatattgcctcaaaatacaatcaacacttaagctgcttttcttctaagaatctaagagatttcagagctttactttgaaagggataaagttgtgatcacctgacattgtgagtagatttaaatgtttaatttttgttagtaatttataaagtataatttaggaaatactagagacaaaaagaaaaaagttatagtagcctgtgactctttagccttagcaaagcagtgttaaatgggtttcctgtatatccttccatgatttttctaatacatacatatgtaaatataattatttactaatgccagtaggcagcaatgagaacaaaacctcttttgtatttttttttcccatgagtcaaacaaaagacttcagattcagatcaattctggtgtgctagggcaggcctttcctacaaggggtggagaggccagcctttcttctcttggtgggaatggcctgagctgtgttgtggggcaggccgctgatttgtgtgatgtatcattagagggaataagcccattgatcttttctagtttccgttaaacttgaactgagaggccaggcacggttgctcacgcctctaaccccagcactttgggaggctgaggcgggtggatcacctgaggtcaggagttcgagtccaacctggccaacatggtgaaaccgagtctctactaaaaatacaaaaattagctaggcatggtggcacttgcctgtagccccagctactcgggaggctgaggcaggagaatcgcttaaaccgggaaggcgcaggttgcagtgagccaagatcgcaccactgcactgtagcctagcaacagagtaagactctgtctcgaaagaagaaaacttgaacggagacaaaaattaaaaataaggccaggcgtggtggctcatgcctataatcccaacgctttgggaggtcaaggcgggcagatttcctgaggtcacaagttcaagaccagcctggccaacatggtaaaaccccgtctctactaacaatacaaaaattagccaggcatggtggcaggtgcccataatcccagctactcgggaggctgaggcacaagaatctcttgaaccaagaaggcagaggttgcagtgagccaggattgctccactgcactccagcctgggcaacagcacaagacaagacactctctcaattaaaataaaaaattatttaccaaagtaggtttattttctccgtattattgtatgacctatttttaatacacatcatgctcatctatgttaatattctcctatatcaagatttgtaatggccatatagaattcctctgtataaatataccagtgcttatatggttgtttcttacaagcagactgtctgcctctttttactgttttaaacatggaaacaatagccttctgtgtctttttgtacatccttaggataaaacttttagacaattaagtgaaataatttttcatttttaaaagtgattttgaacacagttaacccatattcactatagaaaaaatggcaaatccaaggaaatttttttttttttattagagtctcgctctgccgcccaggctggagtgcagtgggacgatcttggctcactgcaacctctgcctcccgggttcaagtgattctcctacctcagcctcccgagcagctctggattacaggcactcaccaccatgcccagctaatttttgtatttttgtagagatggagtttcaccatgttggccaggctggtctcaaactcctgacctcaagtaatctacctgcctcagcctcccaaagtgctggaattacaggcatgagccaccacgcccaggctaatccagggaaaaattaaaactaccatagctgtttcatttagcacagagtcagataacttttcatgtgtgtgtgtgtgtgtgtgtgtgtgtgtgtgtgtgtatgtgtgtgtgtggtaatgtattttaataggatcacacaatacatggaattttattatctgcttttttcaattaaccatatattacaaacatttttccacatcacccacattgaaaattctacaatatatctgtaaaccaaaaataaaattctaagccccctaaccaacggaatagatccctcctgtcagccaggggattccatagtaaacctgaaaaactagttcaggccatgatgggaaggaagtgtcaaacatgcctcattataccctcctccctttggaattcaggcacaactgaccagcattaacattaaaacagagatcttaggagtgacaaacagactctttataccaataagataacaaattccaacctgactctcctatagcatcacatgacagcagaccctaaaagaaaatgaagtattttaccctaaaatatatttcttcgatgtattttgtctttttttgttttgtttcttttgttttcttgagatggagtctccctctgtcactctgtcacccaggctggagtgcaatggcacgatctaggcactacaacctccacctccgggttcgagccattctcctgcctcagcctcccaagtagctgggactacaggcaccccccaccatgcgtggctaatttttgtatttttagtagagacggggtttcaccgtgttgaccaggctggtctcggactcttgacctcaggtgatccacctgccttggcctcccaaagtgctggggttaacaggcatgagccactgctcccggcctcttcgatgtatattgaaatggccctgcaaggctgtctcttgtggggaatatctacattatgtagtgaatccccttacctgtccaggccttttcctgatccaggagagattcagagtctggtacctatttaggtctgaaaagagacatttaccatctatatagaggtctgaaaagtgacgtttaccatctatgtagatgaagcctgctacctggaggcttcatctacataataagaaccttggtcttcacaaccccttatcttaacccagacactcctttctgttgattgcaggcctttagataataagttaactttttcaaccatttgccaatcagagtatctttgaatctaccgaagacctggaagcccacccttatttgagttcttccacctttctaaactagtgtataccttacatgcattgatttgtgtttgcctgtaacttctagtccactaaaatgtataaaattaagctgtaacccagccaccttgggcacatgttgtcaggacctcgtgagattgtgcttttggccttggtcattcatacttggctcagagtaaacctcttttttacagagtttgactcttttcattgacatatctgtatacattaattacaaaatattatttaatccaaattgcttcggtcagtatacagattttaagtggctaacatatacaaaagcactctagtagatttgttaagagaaagttgatcagaactgtttgatgccctcaaaatatttaccatctacaagggagtctaaaaccatcatacaagtcatcttgtacattgtatcacagatccccaggagaaggtacaaaagatgggctgtgagagttcagggcaagaacattgttagtgaaggagatcagggaagggtctgaagaggcagtgatgggagggtgcggctgtgtgaagatgggggaagaaaggtattccaggtagtagaagggcataagctgaggcatgctgccaggaaacaagagacccgcatctctatacagcgagtcctggcacttaatgggatgcagtccctgtcccagtaaggacgacaggaggagtgggaaatgaagttgcgggggtcagccagtaccaggttatggatagtttagaatctctggctctgcagtgtggactacatttcctgagcagtgggtgctttttaggcgttgtcacattttgttttagctggaataatgatggcattggagctggctgggagtaatgctctgaagcattgtgccagagtggaagtagtaatggaagaggggcagtaaaatgctacttccatgactagaaaccaaggctatgacggtagcagccaaaacagagaaaagaagaggtgctgtggagttagaatgacgaggcccggcagtctgcctacgctaatgaaatcaggaaagctggagcgtcaaaggggcttctgagttttggtggctgggataatagtcccattttaaattatgagtggcaagaattgtttttgttgaagcctgctttttcagtcctagcatcacacactctgtacctttctttttcctgataggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatggtaacttttctcactcacagtcattggcatcaggattctagggccagcattgccagcattccaatttaatgtcaatgtaccttttaaattgacctggaagaaagttaatatcgttatttggaaggtaggcccagaatatctttaaataaggttaccaaagaggccgggcatggtggctcacacctgtgatcccagcactttgggaggccaaggcaggcagatcatttgaggccaggagttcgagaccagcctggccaacatggtgaaaccccatctctactaaaaaatacaaaaattagccaggcatggtggtgcacacctgtagtcccagctactccggcggctgaggtgggagaatcacttgaacctgggaggtggaggttgcagtgagctgagatcacgccactgcactccagcctgggtgacagaaagaggccctgtctcaaaattacgaaagaaagctgtacaagaaagcttacctgatattacaaattatgaaatattttaaatagcattttattcacgttctggcaggcataagttttttcaggttatctcagctgaagaagaataataatccctgtttagtacgtaaatggtccttgaggctcgtgagacacgacatcactttataagcagtaaagccggatacaaatgtcagttttcactggctttgttatgtctggaaggactaattgatttttttcccatgtgaagaatgttattaatggaactttgaattattttctttgcatgcacacactttcccattgaattttgtggaaacttctcacatatatatgccaagatctacatttacatgcatgagaaaagaactgtacaggaaaaaagatcatttaacatgtatgggtgtgagttttcatttttattgccttgactttttcacagcatgtacaaacaatgaaagtacactgaagtccatcatgaagaagaaagatggtaacaaagattcaaatggcgcaaaaaagaatcttcagtttgttggcattaatggagggtaaggaaagatggtggttctagaggctaatgctgtcagtctcctttacctcctgcctaagtcacatttcaaggcgcctagtcggggaagcggccacagcgcagtgatgaaagattccctcctcagaaaggcagaaaggtgcatttgggctttgctttcctcctctggtgctgtctttaaggatttgtcactctcttaaggatacctgatgaagctgagcggtttacatctcctcacctctgatctgaaagaaatagtcttcagcgaacgcagcagggttcctgcactgtgttggacaacttgtacttacctatacgagaactcacaattgagcagaaaaagactgagagcatcactctctgggccaacgatcgtcatcttttccttcaaaatgggtccttttgcttagctctccatgtttacgacccaaattgtagggcctttcacaattgataaccacatcaccagtttgctttctaaatagaatggttattgtttgttccttctctttgcattggcccacgtacatagttaagcccctttgttgtcctacaattgaatcaaatcaatgaattgatacatggcccccacaagaaagaaataatacaaagtgtaccattagggtttaaccttatggtgcctgttttccaaatctagaagttttattcagtgataatggccaggagattttggagggcatacaccagaaaaactatcgattgcctatgtaatctattccccttgatactgggagaattaataggatgaaataggaagacatggggtgggggggggacaaaaagcacctaccgatctgttttccataaagtatgttttctcatgatttatgctaagccggagatgccattattttctttaacaagtgttacatgataccaattggttatatgataccgataaccagtttaagttagagtccattcaaaaccaccaggcatttaaatagaccttactttgaacttctaagtgcaggatctaaaaccactagtgaaatttctggagtcaattagcaaatcccttcatagaaatttctatcactgggtcttcgtgagcacaccttgcatctcctgaaatcccaattgccacctaggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtgtggtacattccccttccctcccttgcccctcccacatttaatgtactttggcaatagagttggccagttcagagcttttgtaattaaatgtttgcttttatctgttcctcagaggtatacacatcttgagatactaatatatacaagtgcagagtattacaactcttagatctcttatggtagaatggcctggtacctaatcacccttgttttctgaaaccttaactctgctatataatttaacatatggaaccacaatccactaaaacttgcattgtttgaacaccttaccttatatttaaagacattttaattttttggtggccagcctactttaagatttcagattttatgtttagccatttatcttgatacaggtgtatcattattacaggatcattgtgtggatgaggcctcagccaaagatcacatatactgtaaagatgatgcatatcacttacatgtttgtattttgttacacattgaatgatcaggaataccacaagaatggatttgggtatatcataaatagtagctgaaaaacactctggttggctgaaatatgtgcctcagaatgtaagttttcaagaccattagataaggatttgatgctcataaaatagagagtagaaaaggtggaaacttcagtatggtttttcagtatgtgaaatataaatagaacatttcagaaaacttacctctatttaatttggcaaatgaaagtttaactgcattaaaacaaggtaagtgtttttagtttatatttccaagtgtttcacatggctttttaacagctttgagatgtaatttatataccatatgtcatttttttacttttcatatgggttaaacacttgagtcaccaaatgtgggttcagatgtgtggtttactggtcagcacgatggatatatggtaatttgtggaaagtcaaggcaagaggatcgcttgagcacaggagtttgagactagcctggacaatatagtaagacctcatccctacaaaaatatcaattacctgggcatggtgtcacatgccagctgctctggaggataaggtgggaggatcacttgaaccctggaggttgaggctgcagtgagccagtgcactccagtctgggtgacagagcaagaccctgtctcagaaaaaaagtaatttgggtctccttcaacccccttaaaattaaaaatattttttaaaaacttagaacaggttgggcacagtggctcacacccataatgccaatactttgggaggctgaggcaggcaggcagatagcttgagcccaagagttcgagaccagcctgggcaacatggtgaaaccctgtctctacaaatacaaagccgggtgtggtggcacacacgtgtaatcccagttacttgggaagctgaggtaggaagattgcttgagcctgggacagcaaaactacagtgagccgtgattgcaccactgcactccagcctgggcaacagagtgagaccttgtctcaaaaaaaaaaaaaaaaaaaaaaaaacttaaaaatggcaaaaaaaaatctctaaatgttattccagaatgtcataaaggccaattggtgaagccgaatgtcaccctcccaaacaaggcctcaatctctggctggaggtgttggctctgcacagtggacgtaacccttagacccctaaggatttctgtgctgcctctgcccaagcaccttgtgccataatgacctgcctgggctggcttggggccacttgccttttaaaaatatatttttaaaagttgaagctgcgcagtgtcccacccctgtaatcccagcactgtgggaggccgaggcaggtggatcacctgaggtcaggagttcaaaaccagcctggccaacatagtgaaaccccgtctccactaaaaatacaaaaattagctgggcctggtggtgcacacctgtagtcccagctactagggaggctgaggcaggaggattgcttgaatccaggaggcggaggttgcagtgagccaagatcatgccactgcactccagcctgggcgacagagcatgaccctgtctcaaaaaaaaaattagatatttgggttgaaataaaaatgattttcttcttgtgaccaatcgtaacttgttttttctcctttcaggtatgaattaagtgaaaagatgttgtctgcatgcaacttactgaaaaatactataaatgaccccaaagctttgaccagcaaagatatggtgagtctgacctgcaaacaccatccccagtgtgtacaaagtgcatgagtgggttcattgtcaaggccagctgtaggctgcccgagctgttgcttgcatgcttttctcctgaactgtttccagcatgagtgggctgggtaaacatcatgtggtcttgctccctggatcacactgccagcgtttccttgaggcccaacttcggacatcctttacccaccctggacttttcctggggtggaggcatctgtgaggcgtacacttgcagacagaaagcagggctaattgcagtcagtcgtcatctttctacatatttcatttctatttatagaacagtaagatccagggagcagcatccaagaattttttttttaagttagcatatgtttttaaaagaaacctatctgagccaaggtcagcattcctttcagttatgaaactgtatgttatgctctgatgtggaatgcaggcggccactatttttaaacataaaaataaccgcacttgtcatctcgcagtctaagaaattcagagcaaacagcaaagagtttgtggttgccttagtgatcatgaatggtacaacataggacacaagtatttctatggcaatggttaatgtgacaccatggccaagaatgacatattctcatgtgtcgaagttatgtgcacattctttcataggccagactaaccccctggttgacagctgtcttttttattagtgcattgagaaaatgtaggatcccctaaggataccgaaatgcacagatactcaagtcccttatgtaaaatggtgtagtatttgcatataaactatgcatctactttaaattctgccatatattttaaatcatttctatatcataatacctaatacagggccaggtgcagtggctgacacctatgatcccaacacttcgggaggccgatgcaggtggatcacatgaggtctggagttcgagacgagcttagccaacatggtgaaaccctttctctactaaaaatacaaaaagttagccaggcatggtggtacacccgtgtaatcccagttactcgggagtctgaggctggagaattgcttgcacccgggaggtggtggttgcagtgagccaagattgcacctctgcactcaagcctgggtgacagagtgagactccatctgaaaaaaagcctggagtgcagtggcgtgatctcggctcactgcaagctccgcctcccgggttcgggccattctcctgcctcaccctccccagtagctgggactaccggcgtccaccacaacgcccggctaatttttttgtatttttagtagagaccgggtttcaccgtgttagtcaggatggtctcgatctcctgacctcgtggtccgcccatcttggcctcccaaagtgctgggatttacaggcatgacccaccgcgcctggcctcaaaaacttaacacaatgtaaatgctatataaatagttgttatactgtattgttttgtattacatattttttaaatattttcactctgccagtggttgaatctatggaaatggaacctgtagatacagagggccagctgtactaaataaaattgctggtcaagtccaggcacagtggctcacacctgtaatcccagcactttgagaggccaaggcagtggatcacttgagcccaggagttcagtttgagaccagcctgggcaacatggcaaaaccctgtctctacaaaaattagccaggtatgatggcatgtacccatggtcctagctacttgggaggctgaggcaagaagatagctggaggcccaggaagttcaggctgcagtgctccatcatcatgccactgcactccagcctgggagacagagtgacaccctctcaaaaaaaaaaaaaattcctagtcaaggggaaacatagaactacatattgaaattcttggatttgtattcatgaaaatacctggctataccctggtcactagtaaaaccataaaatctcactgcagggtcagtatttcccatcaggtttaacctaaacttaaaactggtgccttacaaccccagattttatagccatagtacacttttctttcactgttctcaaaatactaggttacgtggcctttgggaaggattctgttttcctgcatcctccaaattgccgagcatggtgtcatccacacacactgtgatgggtacatctttttaactgaattttcatttggtgtgaaagtgtttaaagtattgtgttgtgaaaagtagtggacgagtaaacacaatgccagggctagataatcatgtcaggacaccagttatttagcagtaatagaattagaatgaccagaagacataatttcccttctttcagtgtgacaactccagagaaacaggaatgtgaatatatacagaaaaaaaaggacactcttcaagtgacccaaaatgtgattgaaatggttaaaactaaataatcagtagcaggatgataaagagatggaagctctataatcccaactctaccttttctacagaaagaggacttcttgggttctggtgcttctgacataggctgtctttctttgatatatttttaaacttttaaagagtaagcacagcagaaatgaatattaaactcatatgaaggcccattgaaaagacactgtagtcatcctcatcaccagtactgactgctcagtctccactgagcttcatgtgacccagggttgagttgatcatccacaaagcaagtgccttcttcatgtgtccacagcctaaggaagtcagagtggagctgatgagagaatgaaattagttccagacggggttcccttttattttccctttccgtggttgaacagttgtatttgggattggggtgggaattgggttggctatacacgtacggtctcccaacctagtgctgtgctgaggagttgaaggaggtgagtttggtctggataggaaggaagcagcataattcagtgtaggctagttaatttcttcctaatttctatgaaaattgtttgcaaggccagtatgattacatcatattaatagcttaataaatggagccaagcctgagtgtttattctcatcacagaaactatgaaagcatggtattatccagtttttcagatgaggaaacggaagcagaataacttccctcgggtcataaagcttttaggtagcagagcctgcatttgaaactcagtggtctggctccagagcctctgcttctgcatggtgctgtctggtctcctttatagacattagaatctacacgtcatttaaaatcaggagaaatgtcccagtttggtgtttgaagcttctcttagggctgttggtttttgagagcagattctaactgcatatatatactttgactataaaaggacaggttacttgtgctttcaactaggtctcagaaagtctataaatagaagaactaacgaccacttggtgttttggcagaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccggtatgttggctgcccttccaccctctcttctctaacagtacttgggttgtgactcatctcagagaacctggttgagccactcctgaattctctgaccatgctaaaatcctttttattgcttttccacatgacatggcaagaattttcttgagtcattcataagaggcttgaagtttaaacaaaactgggtgacacagattctagatctgtttttgaaaggaggttttgaggatcttcttgctgcagttcagctgcattcaaaagtgagaggtgtatgcctggtaagaagcatgtctcacgttccctcctgagctgaatcatgcgggcttggccggtttgcactcaggaggcagagtgctgcttacaggcccagggtcacagccttggtgcgtgtggaccacttgatttgaccttactccatgactgctgtccttgcagaagtgtgtggttagtcaagatggggactaagcaaagccaccttaacagatggtcaaatgatcaccattctcaccaaaatatactgttattggggaaacagcatagagcaaagggcatgttattcttgtctctcaaccataatagaatagtagaaacttgttatcccagaatagagccagtggacatcttagacatgaagtgagggaggggcacatacacagatggtaccctcaagaaactgtgagctttcaacttcttgttcaaatggagcagcctgatgccacatagaccccaagtcttttaatttttgtaatacatatttttatttctagtatgtgacagagaagtcagagtatctcagtctgattaatgaggatgtagtgtgaaccttagaatatgcaatcatactgtccaattttctgaaattctgtcttcatccactgtccaatctcttctgctctgttttgggaacttggaattgatgcagagaagaaagccaagcagatttatccttcctttctcttataagtgtgtttgttccctctttttggagccatgttagggtataactgcttccatcttacaggaaggaatttcaagcccctcctcttcaggctttctagactataaacagagctggtgatacagtcagccagagtgattgtttaaacagaagtagataatatccagggaagctgaaaacaagatttcactatcactcctgacaggaacagcttagtatacccttagaagttgataaaacatcttggcaaattaaataattttaattccattgctggatggtttgggttaatcacttatcttaatggttactgctcccccttctaggctgagattctggctccataaggtgtagatctaggatgcttcagcatctatgcagagcagagtccgcaaagtccgaggtgctaaggagccccgaagcgcacacgaattcacctgcttctcctccacagggccttttattttctgcattaaaaacacccacttttaaaaacatgtccttagtatggagttgtttgggatcttaaggtaaatgttcatggtaccttttattttcctttatgatagaaacattctgaacattttaacttcatatttggtcccacataaaagctgctttctaacactcaccattccggtcatttcagagaaagtgccgaaggaacttttaaatgcccgaaggataattttatccctgaagactccttaagaattacaagaatagaaaaggtctggttcatcgattctgttaaggggacttaactgcatttgttctcgaccataaattctggagctggatgttatatgattggaattctgcttttcaggacccccgacaggccagagtagtaaattcagagtctcagaatgagtaatgtttggataagtaggtaccaccctgtccaacgttccatacgtaagcgtttgcaaacacttcgttcatgaatagctcactacctgcttcactttcctaaacacagctgagtgcctagattccaaaaatcgtttattctcaagagcaaccagtagaacaaccaccctgacttccaagccattgcatttcagccaccagttgcaaacaagatacgctgtggaagcttaccgttgtttctcttgcttcaggtgtcgtgaaatagggggaaaaaaagtttttggtttagtatgaaaacatctctcacatttccttctaagtcactcttggtctccagccacctggtaccatttcactgggctcctgtaaacaccatcccttcagtggcttcgtaagcggctgctattagaaggggctgcttcctaagagacttttttttttttttttttacagatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggttagtgcgcctggttcctgtgctcaggaatgcacccgtaaccagcagacaggactgcggtggccattctggcagagcaggcatagatgccacgcttccaccacagtgcacttgtttgcaggcctgccctgagtccatacactgcctggcactccttgctgaccaaacataccagggaaatatgggcttaaatttcacactggaaacttctccctcctttgccttgccttttgtccatttgcatagtttgcatggaaatactgttagttcccctacatataaatgattgcgcatccccatcagatgctcagtgactgttgcttcctgtctctgtgttgtactgtcttcatagcaaacagtgtcccaggtccagatgtgttcacagcttgacttttttttttttaagagacggtcttgctctgtcccccaggctggagtgcagtggcgggatcttggctcactgcaaccacccccggctccctggttgcagtgattctcctgccttagcctcccgagtagcagggactaacaggcacacaccaccacacctggcttttttttttttttttttgagactaagtctcattctgtcacccaggctggagtgcagtggtgcgatcttggctcactggaagctctgcctcccgggttcacaccattctcctgcctcagcctcccaagtagctgggactacaggcgcccacccccacgtccggcttattttttgtatttttagtagagacaaggtttcaccgtgttagccaggatggtcttgatctcctgacctcatgatccacctgactcagcctcctgaagtgctgggattacaggcgtgagctactgcgccagcccctggcttttttttaagtagagatggggtttcagtgttgcccaagctgctcttgaactcctgagctcagacaatctgcctgcctcagcctcccaaagtgctagggttacaggcgtgacccaccactccaggcccacagcttgacttttaaccaccacctgaacttccagccccttactctactgagacatcctccacgctaaaatgaagttggctccttactttatgcccttcctttgctcatagctcatgggaagctggtttctccctgcttgccaccacctgccccaagtagttccatcgccagttctttcccttctgtcaccacactcttccccctttccctagcacagccccactagaggccaccactgccagctcagtacgtacttctgaagtccttgtcatctcttcccataggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgtaagctgtctccattgggcctcctggccaggggtctgggggactctggacgggagctctgggagtgccttttggccaggagcgaccaaatcctcctctattctcctctgggatttgtgtcgccatctaggtgcctcccttcacagccaagcttggctacacttactgtgtgtgtgcaaactaacacgctcataaactagtacccaaagcagaataaataggccctaccccaaaaattcatgaaatgaaaaagtgatttaacgggcatgtccaagagcccctctactaaagggaaatcaatggatttgcactgcagaatcaaattcagtgtaggtgacttctgacaggtgcacttggaaatctggattatcattagaggctggggttacacggtgactaaaaccagttcctactatagtgaaccttttccacccaaagtgaacacactgacccatcaaagtgagtagcttgtgacacaacatatgccagagcctgcagagtagcttgacttcttgaagcgttttcccatttctgcttagtctgtcccatcaacaccactctgctctcttctcccagttcccaggctgtccacatttccagataactccttgaccgggaaactcaaccaaagggggtacttttgcgtgtctctaggccaaaggacaggagtggtgataggtagaaggtaggaactggcatgtaggcagtgagatggtgtaaaggtcacagaggtcgggttggcttggttccgtttttgaaagtttatctctgtggatcacaggtttggatcagagcttctttagctcaaaacaccaaaaagttaggaaaatatcctttgtaggtcagattcttctgggcccaagccagtagggagaaaaaccagcggagtttttcactggtatgagggactgactagcttcacactcagccatctccacaggagcacatggaagctgcagctgtagcagattcccttcttcccctctgtgggagggagagcttctgaccgacttctttcttccagaagagtttgttagctgtgctgtggtttttgtttgattttacttctattatctttcaaagcttttgaggggaaggatcataagattaaaccaaagagaactgtgtcctgctgctgctgctgaccagagggaaatccgtatttcaagactagataggctgggcacagtgggtcactcctgtaattccagcaccttgggaggctgagacaggaggatcgctcgagcccaggagttcaagaccagcctgggcaacatagtgagactcccatctctacaaaaaaaaaattatctaggtgtggtggtatgcacctgtagtctcagataccgtggtggttgaggcaggagaatcacttgagccctggaggtcaaggctaccgtgatctgtgatcgtgccactgcactgcagcctgggagacaaaccctgtctcaaaaaacacactagacagaagacaagttgtgttgttctttcccttgatactcctttatatccatttaaatccctgaaatttaatggaaatcaagcagttaagtgaagcttttttcacccatatgtagtgtttcccctcttatttccagaagttggatctgtgcaacccactgggattgcgtgcttacacacagatgttacttgtagccttaaaccgaggtggtttagggttttaggatcacagtgccctctctaagaggaaaggtaaaagatctttggcaaattgcagagtctctaaacacacactactgctgcttgcctggtcattcataattaattagaagaaaaaaaaactttctatccccatcttctgcttccccctcctggtgggcagaatggttgagtaagataatcctcttaactgggacctctggagggtggaggcttgcctcattcatcttcacatcctcaggccttcacccttagaggtcccaaaaaagtttcccagaagaccgaacgagtagggatatttggggaaccttgccaattattggagggtgttttgttctgttacctttcggttgtctggaggtttgagaaacccaacatggcttgttctttccatcttatcttaaggatggcagcactgcgctctcaatcgccctggaagcaggacacaaggacatcgctgttcttctgtatgcccatgtcaactttgcaaaagcccagtctccggtcagtgttgtgcatttggcatttgtaaataggctgaaatccaccagactggtggacccccttcctccaggaattgacgggagacagattttatgttgattcagaaaatggaagttttagtctggagcttaagagttcatcctttccgcctccaccccgcaaaaagcaggagaactaatgttttagcagaggctggaccttgcttgtccttgcaagacatatgctcacagcttcccatagaggttttgattctgtgcagaattatccagatagcagcccctgagcccatggggatatttcgccatggttctggcattgttcctgaagcagatggcaggcagcctgtagtccacagttcactctgagtgggaaggtgacttcccaggacagccggacatagcactgctgagcccagctggccttggagctgtggacacctgttccctgttctcagccagagctctcctggctcgggctcacagctgcttgttgcctgtggtgggccaagatcctatgtcacagggtacacatctgcctgaggtcacttattaacccccagtttttttcctttcctggtctctagggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctctttt

SEQ ID NO: 255 - DNA, 241412 bp, Homo sapiens
  source 1..241412: mol_type = genomic DNA
gagctccgggtccgcggcggagcgagcgagcggccggcaggttgggaggagcggccgaaggtgagtgacgcggcggggccgtgccgcgccccgtgccgcggcgaggttgtcccggagcgcgaggcccctacccctgcctcgggctggccccgcgcggagccgacttggcgcgcgccggggttgcgcggcggccgtggcggtggcggagggcagcccccgcgggctcccgctcgtgcgggtgaacccggcggcctcggggcggtcctgggggggggtccgagaggtggcgtcggccccgcggccgtcggagtttggcgcgctctgcagcggcggcgctcggccggtctggaggagggagaggcgcgccgggcacggagcagcgagaaagttcgggccgggccggccggcgggagggtgcgggcgcctggctaccccggcccggcgctctgtccctcggatgcctctgggcccttccctagcccggggcggaacgggggaccctctctgaagcggctctccgtggagttggatgttgcccttcgcgggagggagtggcggtcaagacccctttatcctcggccccagaggggcaggtggcctcgggtcgccctccgccaactccgaggtggcttcggccggggctggagggcggggaggcgggggaggggcgtgggcgctgcggcctctggggcggcccaacccggcgcgggcagcgtgggtttccgaggtcccgcggttccaggtcgagggaaggtgtaggggccctgaagcgggctggtccccgaatgttgcgttttctgtgccgctttgggcaacacgcagtggcgctcgcggcagccacggctccttgaccgttcatctccttcacccgggtcccgtggaactttcagaggcaactgttcttggtggctcttgcgggtcagcacgagccgtgctgcacgagcgtgacctagtgaaggccttgggcgagttggcgttaacaatttatggcgtccgccagcgctcgctttccgcacgtggcctctgcggagggtcagcccatcttattaaatagtggattctattagaccctgatacccgaggctaataaggaagcttaatcatccagatgtgtaatcgtgcagttcctttcctcaccgtcattgccccccacctctggagctgaatggaaatgagggtctgtttgcttatattgaattcctgagtttattcaagttcatttttaggtggcgttaacagctaagtagctgttcatctgccagtttctcctttcatccaactttctctactaaaatgttgagcacgttttatttaaaaaaaattgaagtgtaataaacatataaatttactcttctaaggtcaaaattcagtggtttttaatatatccgtaaagttatgaaatcatcactaccatctgattccatttcgttgcccccaaaaagaacccctataccgattagcagtcattcttccatctcccagcccttctccctcattttaaggcagctacttaggaagtttttctaagatagagactgagtgagaaaactgagaggtgattaactttgatcctttttctgttactaggtttggggaaaggtgctgctgaagcaatggaagaaaaattaagtattggctgtcctatggggaggttaaaatgaataaggatggaagagaagctgccagtagaggaataattgcctcctgtagagacccacaagttgggaatacattttatccccttagggcacagggatgctttctgggctctagacttgcctagtccataaatcactctagtcgaggttctgcctcagcgaaagtgagttctgggtgtgtgtgtgtgtgtgtgtgcgtgtgcgtgcgcgctcggcagggaatgttagaaggaaaaaagactaggcttaaaagtaattttttaaaatatccaaactggccccaaagaaagaaaccaaaaaaccacaggcaaatggccactggaattgatacattcaagactagtttcatttcatgagtatcagttcacaaatagttctgagttaatgtgtgcatacattaactttttatcccaagtgggaggaggaggatggaaaaggatctagttgggggcagtgcaaggaactgggaagaggaatgggataatggccgaaaggggcagtgcttgtgggagctgaggactgttgagatggaataactatagggtgagcagattctgaaagagcagagtgggtctgtgaaaagttggacacttcactcgggctttttgttggataatgtgtgcatgttttaaaaatcatttttagtaaggagagttgaagctatccaaattatgcaacatccactacacttctcactcacccttcaataagaaaagtcaacttgttttcaagtgtttcgggaagttttaggcctgttgcatgggtgacagcttatgccatcttttttttttttttttggtaatttagaacattgacatagcgagactccgtctctacaaaaaaaataaaaaataaccggatatggtggcacatgcacctgtagtcccagctacttgggaggctgaggcaggaggattgctttagcccaggagtttgaggctgcagtgaactatgatcatgccactgcactccagcctagatgaccgagcaatatcctctctcaaaacaagatgagctgtaccataggtatacatatcccacacccccagccctgccgacggagttttgctcttgtcagccaggctacagtgcaatgtcacagtatcagctcactgcaacctccgcctcccaggtttaagcgattctcctgcctcagcctcccaagtagctgggattacaggcacctgccaccatgcccggctaatttttttttttttttttttgagatggagtctcgatctgttgccaggctggagtgcagtggcgcgatctcagctcactgcaacctccgcctcctgggttcaagcgattctcgtgcctcagcctcccgagtagctgggactacaggcaccgtgtcaccacacccagctaatttttgtatttttagtagagacagggtttcactatgttggccaggatggtctcaatctcttgacatcgtgatgtgcccacctcggcctctcaaagtgtcaggattacaggtgtgagccaccatgccagtttttgtatttttagtagagacggggtttcaccgtgttggtcaggctggtctccaactcctgaccttgtgatccgcccacctcagcctcccaaagtgctgagggattacaggcatgcgcccccacacttggctaatttttgtatttttgttagagacgggggttttaccatgttggccaggctggtcttgaactcgtgacgtcaggttatccatccgcctctgcctcccaaagtgttgggattacaggtgtgagacaccctgctcagccttttttttttttttttttttttttttttttttttgagatggagtttctttcttgttgcccaggctggagtgcattggggtgatctcagctcactgcaacctctgcctcccgggttcaagcgattctctgcctcagcctcctgagtagctgggattgcaggcatctgccaccatgcccggctaattttgtatgtttagtagaaacggggtttctccatgttggtcaggctggtctcgaactcccgacctcaggtgatccgcctgccttggcctcccaaagtgctggcattacaggcgtgagccactgtgcccagcctgtagctatacatcttaagagtacatcttcacaaattgtcacaaagtgaacataaacatataacaagtactcacggaaagaaccaaaatattgccagcattgcagaagtgcccctatactcttgtccaatcactgcccctcccgaagagtaaccgttgtgccaactgtggattagttttatctgttttcatgctctacacagactcacacggtatatagcttttagtatcctggtttctttctcaacattatatttgtgagattcagctgtgttgttgcttgtggctgtagttcagttattttcactgctgtgtaatattcaattgtatgactacaatttatcaatttttaggtttgaggggcatttacatagtttccagtttcttacatggtaagtagtgtgactatgaacattctaattctagtacacgtcttgatacacaatatccaatacaaatgtgtacatttgtacaaattctattcagaagtagaatttcccagttccaaactaggattcagtttagaggtacagtcatgcggatttctgaagtggttgtagagtttatacttctacccgtagtgtgagagagttctgttgtgtcctttttaaattggaagagcagtagatctgcagagtttggcaaatggacaaaatatgacctatttattattttttttttggaggcggagtcttgctctgtcaccaggatgagtgcagtggcgcgatcttgactcactggaacctctgcctcctgagttcaagcaattctcctgcctcagcctcccgattagctggaactacaggcacacgccaccacgcccagctaatttttgtacttttagtagacacggggtttcaccatgttggccgggatggtctccatctcctgacctcgtgatccacccacctcggcctcccaaagtgctgtgattacaggcgtgagccactggcccaatatgacctatatttaccccatcctagcagactaattatttgttgtcttcacttccagtgcttttccatgtctgttcatgtttttatgaagtcacaattctaatattcaattttgtattttgtttcttaacacagtatcttaatattgcttcagtctctgactttttaatccctgcatatgcctaaggatatgctttcatttaataatcctcttattagaaatgtgtgttaatttctggtgttttactagtacataccgttgtggaaatcatctttgtgcatatagtttttacctccctcttgggtatttcataaatttgagatttttgtttatgtggcttgggatctttgttaaactgctgcctgcagagttatccttgaacctaatatggaattgattaaagaaatcttttttatttttttgagacaggatatcattgtgtcacccaggctggagtgcagtgacaggatcagagctcgctgtaaccgtgaactgctgggcccaagcaatcctcccgcctcagcctgcctcccgagtagctgggactacaggcatgtgccactgcactcagctaatttttccttttttttttttttagttgtagagatggggtcttgctaggttgtccaggcgggtctcaaactcctggcctcaaacaatcctccctccttgccctcctaaaagtgctgggattacaggtgtgagccactgcacccagtctaagaaatctttaaattgctaatatgttacctgcaaaagggtgtctcattgggttaaattgcaattctgaaaataatggtgaggttgaccatgataacttctttaaaaatagcataaattgaacctttgtggcaatttcatttaggtatcactgattaattttctttatatggtcctgtttacaaaggtattgagccaagagcttgaaaggatataagaaggatcataccattaagtagttgattgtccagaaattatatctaataattaaaaataccagttaggcaaaattcttacacatgaccaaggagtgttcattctacaaatgcagtgcttgtttaagttctgagggagaagtctttcttgtctagatgattaggagctgcttcccccaaaagtaagacttgagctcagctttaaggagtctctagaaattggctagggagcagacatcactaaagagacactgagccttctcaaggagagagatcagcggtgcatagggagagccccggttgaccactggacagtggggttggtgatgctggcttccttactattctttttctggaagataccgaaaataaatgaactaatatataggccgaaaaaagtacttggaggattttgggagaaagctgtttggtacattcaagtcagcatcatggggtttaatggtaaacacctgccagagattagaatgcagtaggctgcttttttgcctaattatagatcttaactcctttcccctcaggtaaaattcagtgataatttctctaagatgaaggctgctagaccagccttcattcagaataagccaatatcacttaactttagtaaacagtacttaaatttgtattatgtgcaaggccctggtgggggaaatcagagactagaaagctaagagttcatagggaatgaatgtataatgatgcaaaattgtattaataggcaaaatgttagaaatactcaatatcgatacaaaaggttcactctggaaaggaaagggatggagaaattaatgctgagtagagagatctgggtgatatttagggggatttggccttgaaaaatgtgtatgggtgggaattagagtaaagggcactgcatttaggcaataggttttgaaaaagtaaaaggtggcagtgcttgacacataataccatggtcagtcataggcttggagacccaggtgaatggcaatttgagattgtacctttcttcctgtgacttgtgactgctgagccagcctggtgatctctgtggaaatattgtaggtgtaggcccaggctggctacttttaatctaggatctgttgcttgctgtgtgacctttggcacagttactaaacctctctgtgtgtcaatttcccatctataaacagggataataaaagcatctcctttattgggtacttgtgaggattgaatgagttaaaaccaactctgttggttgaggcagtcacctgtccagactcaagaacacttagaagggtggttggtatacagtaagttttatacatgtttgctgttattcccttaatttttgaatttctgaattatagaatttctaatactcacacatagtgtaaataatataaacaacaaagggtttaaaataaaaacaaaactcatcattcttgtctggtcccaactcagctacagtcttggtttaggtgtgataactgctgtttctgtttttagttcttctagtggttattttagcaaattaccccccaaaatttagtggctcaaaaatttgttttatggtgttttggattctgtgggtcagggattcaggcagggctgggctgggtgattctgctgctttcggtgttgactgaggtcattccctggtacccagctggtggatgtgctggtccactggctccaaaaaggctttgctcccatgactattgccttagtgggagtagctggaatgctgggctcagcaatgactgttgagcagagcacctacacatgttgacttcatttgtcttcatggcaactacatgtcttcatggtgacttcagcatggtggctccaggtagttgaacttgtgtggcagcaggcttccctcatgtgttactaagggctctccagagaaacataaccaatagtgtgtgtgtgtgtgtgtgtatgtatatacacacacacaagatttttaaaacaaggaattgacttattcagtttggaggcgggctagtcctaaatactgcattgtgggccaacagatggagacaaggagagtctagaagaagactgaaggaggtctgctggagaattccctccagctcagggaggccggtctttttgtttagttcatacctttagttgtttgcatgaggcccacccacattatggagggcagtctcttttacccatagttacctgatttaaatgtgaatctcatccaaaaacatcctccaagtcaacacataaaattaaccatcataccctgctacgagcaccttgggtaaaccagttggaagcttcatggccttttatgacatattatcagaagttaataacttcccttttgccaaactattggttgtagcacaaaacttgctcaggctcaagcagaggggacatcgacctgccacttgatgggagtgtcaaagaatttgcagtataaaatatactgccagtctatgcttgagttcataaatttgacagtgtctgttaacttcctgctaaggaagaagtggaatttatattccctcacacctctctttcctcttctctctgcctcctggtttttattagatatcttattatttttgccttattatttttagttgtcttcttttggttacctttctgatttaaaataaagcagtccattctttaccaggccgtagagatatggaaaactcaggtttgttgaagggtatggtgttggggagggacatggcagaaaagcagcttcaaatggttgaggcttgacaatgaggctcttgttaaaacactccagccactaaaaatgggaattgcctatgagtgtgtcctctttgtgagcctagcaggtggcataatttgacactttttattttttctctttggcttttaaactcagatacctgtttgcctttttcttccctacacttagcatttaaattatgaatgctggaagcaaatgatattttcaccaatgaagaatcttattacagacacatggttgagttgagtgtttgtatgtggatgtgctgtcagaaataagtgctctcttgcttttttcattaccaaagcaatcagttaattggaaacagagtgtcaggagccctgtaactctgttggaggtgttttgggttttttctttttttggattcatttagttaatacaattgagcaatggggcttagtttaactctcagaacacataactaatccctttttataattatcatccaagaaacatataagaacctctagtcttgttggtttgcattcattgtatattgcagatataacctcttttgatatttgtcttactaataaaatttgacttggttagtggcaagaatgtaaatttgtgtttgatatctgcataatatttttggctaaattttttcagatttctgttgttaattctgactggttcaccctttgaccttgggaaaaaatagaacaaaagcaattagaacaaaagtagatactttgggaggccgaggcaggcagatcacttgaggtcaggagttcaagaccagccatagccaacatggcaaaaccccatctctactaaaaatacaaaaattagctgggcttgctggtgcacacctgtagtcccagctacttgggaggctgtggcaggagaattgcttgaacccaggaggtggaggttgcagtgagtcaaaatcacgccgctgcattccagcctgggtgacagagcgagactccgtctcgaacaaaagttgaaatgaaacataaatactgtattcaccttttctcttttctgtcctcctcctctccttccctccttctcttactccctccctctcttcctccctctctctctccctccctccctcccttcctctctccctcccttcctctctccctcccttcctctctccctcccttcctccctccctctctccctccctcccttcctccctccctccctcccttccttccttcctccctccgtccctcccttccttccttccttcctattcatctcaatagagctgctttttcctctaaaaataatagcttcagggtagccctttttaggggatgggattatccctgttatgagatggttcagctcacttttctgccaaatactccctcatctcctttacccaaatggagccacagaccaatctgaccatcttggtgtcatatccccttctagtcacaactcttgccccgagggtatccttacttctaatatcatagatcaatttagtcagtttttgaactttatgtacctgagatcacagagcatgtactctttcgtgtctagcttctctccatgttatatttgtgagattgatccatgttgtatgtggttatgggttcatgctcattgctgtatagtgttccatcatgtgaatatactgctgttcatcctgttgtccatgaacgttaggtttctagttttggaccagtatgaacagtactgtcatgaatgattttgtatgtattttctggtgaatataggtacacatttaagttagatatatatctaggagtgcaatttttgggccatgcagttcaactggagtaggtaccgtcagagtggttttatcaagcggtattcccagcagtggtgtatgagtttcagttgcaccacagtgcttgttattgtctgttgtcttattttagctaatctggtaaacgtgtgttattgattccctagatgactaatgaagatgaacacctcaaaaagggttcatactttttattttattgcatagcaaagtagaaaaacaaagccagtttgaccgggtgcagtggctcacgcctgtaatcccagcactttgggaggcagaggcgggtggatcatgaggtcaggagatcaagaccatcctggctaacacagtgaaaccctatctctactaaaaaaatacaaaagattagccaggcgtggtggcgggagcctgtagtcccagctactcgggaggctgaggcaggagaatggcgtgaacccaggaggcggagcttgcagtgagccgagatcgtgccactgccctccagcctgggtgaaagagcaagactccttctcaaaaaaaaaaaaaagaaaaaaaagccagttaaagaattcatctagagacattgtatcagttctttaaccactctagcttttctgtttctctacacatttattgtgtttttttgttttagttttatgagagatgtatttcaaggaatttacttctaataaaaatttaaagaacagaagtttatggataactctactagttctgagaattaaggtatttaaaggatgaaactgctcatactgtattactctttcaacttttctaatttgttaactcagtctatttatttttgcctttcactttgacatttttataggagaatttgaatcatgttctatagtttccaggaattaaatttccacataaatgtaaaagaaaacttgagatcctgatgcaccattttttaaagggttttaaaaaggggaattgttaacgtagggataagctatatattgtgaggcttcgatggcagtgctgttaagttcttgtcacttcttagcaaatgaaatgcatagtttcaaggaaacctcacgtgtggtttgatgtgtttgagttcgttttgatttatttcctgttgacattttgagatttcttcctttagcttttattctgggcacctattttatcctctcagttgtttctttttaagacctgtatgcctctttaggaatccaacatgcagctgtcatctagctttgtacttctgtgcatatattccatcttcccttaaatattattggtgtattgctgatcaggggacagacacaaggtggtcttaaatatctgtaaggtacttacaggtgttgtttggcctcttggtggcaagactatgtcctgggtcagattatctaaagggtttttggagaattcaggcttttgaccttggaggcagaataagatttctctgcctccagagacaccaaacttttaactccttttggagttatacttcaggagtaggaggaaagtttgctgaattcctatcaagaaaaggtggttgagagacatgattgaagattgcttaattcatcacagtttctcagctctggcatgaaacagttgggagaagcgattcaaataactgctgatgaaagttgtatattatttttccttttttgaagtttagggaattcagggctagctcccaaatgagatcatgtgaacttagtgatgttctttctggtgggtctttattagagtcagtggggagggaaggggagcggttttggctgtagagtgggatctgaaaattgttcataatgctgggaatgacagaaatgtgggtgcgaagtgcagtgcagagacactggcttgaggaatagcaaggccttttatgatgggcccaggtgggaggggagttactaggttatacttcataggcattcaaaaatacttgttgaatgaatatggatcattttatcagtagcatactaaggctgtcagatctgcatgaagctattgattcactagttatcattatagtggcttagcagcccgctggggggtacctgtccttcaggtgattaggaatttcatgcctccatcagtgtaagtttgaacacttgggttacgaagaaatttgtcctaatgaggtttggccccagatgccctgccaggtgtgcatctgagtgtggtttctattcttcatcaccctctacacacacacacacacacacacacacacatccgtcttgtgttttttggtgggctcagagccacgagggagctattagttatccttccaaaattcagcaagctgtttgtgtttgtttttgtttttgttttgagacggagtctcgctctgtcacccaggctggagtgcagtggcgtgatctcagctactgcaacttccgacggttcaagcagttctcctgcctcagcctcccaagtagttgggagtacaggcatgcaccaccatgcctagctaatttttgtagtttgagtagagacagggtttcaccatgttggccaggatggtctcgatttcctggcctcatgatctgcctgcctcggccttccaaagtgctaggatcacaggcgtgagccactgcggcccggctgcaagctgtgttttgtcgggacggtttcgattagtttttaggctaataaagaacactgtttctttttgtttcttttttaggtttattttagccaacctgaggaaacaaaagcctactgttaggatattcatgggaaaatagggaagccttttttttcctttagtgaaatcctatgtgcctatagagctttttcacactttctagagaaggtaagcatctcttcctgagaaagagtggggataatatgtctgggctcaattctgcctgttgtagggaagggtgtgccggtgggtcaccttttgaggttaagaacgagtaataagaccttgaggattcttttttttttttttttttgagacagagtctcgctctgtcacccaggttggagtaaagtggcgtgatctcggctcactggaccctccgcctcccaggttcaagtagttctcccgcctcagcctcccaagtagctggaattacggagtcccccaccatgcctcgctaatttttgtatttttagtagagatggagtttcacattattggccgggctggtcttgaactcctgacctcaagtgatccacctgcctcagccttccagagtgctgggattacaggcatgagccaccttgcccggccaaccttgagggttcttagccatccccaaatgatctgataaagtagccttagtactgtggaaaaaagtgtcactctttcctgctctgtcaactttgatagcaaaaggaggaaacactgctaaaggggcttgaagtttatatagtttgtgaatcattttcttgggaacttttcaaaagaagtgttgtaaacctctgacctcacatccagtttgaccagataactgtgcttacctgttgaggcccatctgatttgagtcctggcttaaagcggttgttcacatgttgaagtctgtatttaagctccgctcccaggctgggttgtgtcatcccgagcctccccttctccctccttgacccccagtggcccagggcagtttttactttaccgtttcttcctggctttttacctatacttttcggccagacacttcaaggggatctgattcgatgtaggggaggggttcggagcatgggttctagaatcgaaactctactatttcctgcgaggtgtatgttttctttgcttctttgtgtttggaaagaaatattgatattgtcattccgtggtgtttaagtgtgtaaagaggaggagctgggaggaagatgaaggaagacctaggatgtagtatttcctgactataaaactccctaggaaaagtcctcaaagagccaccttgtttactttaggctagaggagcggagaaagggcggtgaccctgtatgacatacagtgaacaagagaggtggaactctggcaggaagtaaagggtagaggcaggctcagggacccaagtcttgtaggaaaccacaactccatgaagcctatatggagtttcttagcattgtctttaaatttttttttttttgttttgagacagagtttcgctcttgttgcccaggctggagtgcaatggcatgatctcggctcaccgcaaactcccccttccaggttccagtgattcttctgcctcagcctcccgagtagctgggattacaggcatgcaccaccaggcctgactaattttgtatgtttaatagaaacggggtttctccatgttggtcaggctggtctcaaactcccaacctcaggtgatctgcctgcctcggcctcccaaagtgctgggattataggcatgagacactgcgcccagtgtctttcaacttttactaggcaccttataattgtgtcttttcccccaaagcccgctctcacgacagcctctggatatcaagatctgtcagccttaacttagtaagtgttctgagtttctctgaacttccaacttctcaggatctgccacaaatttgcaaaaggtggtgttgaatatttttccttcagaaattaagtttttaattcttgtatattttcataggagtagctatgagaggagtcttaactttgggtattgtttttctttggcttctagagaaaagtttgagaggtctagtgattttcattaagttcttttttaagcaatcatttgtgaaactattcacatcctcagatcttggtaagatttccatgcagagcctaatactgaaaagctaaagaagaacctggactttttggaatgatttcgacctctcataaaatcccagacaattacatttccttattttgccaggagactggtatgccagttaagtttataacctcgatccttgttttatcctccatcagttagagattaattacatgcctttggaatggtgagctgttgagccttgtcgtctttgaacctactattgttctcaataaggtcttctaaaggtcagacaaacaagtcatttagatttttctcctccccttaaagcatgcatttataaggcaaaaacttaatgatcattcattccattccattgatcattaaaacagctttaaaaatgaagtggtttcattactcatattagtctagttatgctcagtgacttaaaacaatacattttaatttctagacttaatgagccactccactctgggacatacttatggcagagggtaagaaaagaaatgaccatagccgggtgcggtggctcacacctgtaatcccagcactttgggaggctgaggtggatagatcgcttgagcccaggaattcaagactagtctgggcaacatggcaaaaccccatctctacaaaaaatacaaaaattagccgtgtgtggtagcacgcccctgtagtcccggctacctgggaggtggaggtgggaggatcacctcagcctggggaggttaaggctgtagtgagctgtgatcataccactgcactccagcctgcttggtagagtgagaccctgtctcaaaaaaataaataaaaattaaaaaggaagtgaccagttcattcatagttattaacacttctgcttgtgtgtcacttctactcgccttcacttggctgaagaaagtcatatggccaggcctgccagcaatgtggtagagaagtgtggttaattcttccatctggagatgctataagtcacgtgacaatgggggatataatcctctttcagggaggttagcgaataattgaaaacaatataatctaacataatggaagactatatttaactcaaaaaatttaatggcctgtgttctgattcagaaatagtttttagaattggttaaatctgcactttgggttttattttgaaaagattatgcctcagaaatctgcctagatatggaaaacagggtctagtttttggacaggactgattaatcttttatgaattggagagctgtaccaacaacttggtaactttccattagttgtttcccatggctccagatctgtattttaatcaagaagttacacttcttcctctcttgacttttatatcttgattttgcatgcattgttagtatcctattggtcagatgatttttgtttaattgcctgatttaatatggttttggcagccaattaacagtggatgctactgtcaagagaagggtagagatggggccttttgacagaaataaaatttattaaggcctcatcagtctgtcttggtatttttctttcaaaaatgaaactgatgaactgttgctgatgttcttactaggaaatttctgtcttatataaaagatatgaaatcggaattctttgaagcaagatgacaaaataaagtcatacattgctgtgaggaacagaacgtttgtgcctcaattggttattcaccatctacatgttgagattctttttgtgggggatcttggccatttctgcatgttcaccctcacactcctttttatgaggtgtgggggccatctacttaggcaagagtcttaggtagcttctgtaatttttatgagaaagctgaagtctcttctgcttggttgacttttaaaaagtaggtgcaccaagcctcagctggtgtcagactgctgcacttggggttcttcctgagctcttaacctgcttccagctcttagtgaaaacttgtttttgggagatggtgttcattcatgaaatttcatcaaacactgggcacttggaattctctactttcttttccctccagattctttttttttttttttttttggagacagagttttgctcgtcacccaggctggagtgcaatggtgtgatcttgggtcactttaacctctgccttctgggttcaagcgattctcctgcctcagcctcccgagtagctggggattacaggtgtgcgccaccacgcgtggctgatttttgtattattggtagagatggggtttcaccatggtggccaggctggtctcgaactcctgacctcaggagatccacccacctcagcctgccaaagtgctgggattacaggcatgagccactgtgcctggctcagattcttttattgaatgaacgtctactatgtcttcagcttccattatttagaaatagagaagagtttaagaaacagccacaggcagctcatacatggtgatcccttttgcctctctcagtggcccttttttggagaactgttagaaaagttgctgtaggccttggtattagaaaatgttggcacatttcttgggaaaatgtttgatttgttgaataatgtaaatattgtaagagattgtgatttcctcattgctttgaccaaatttatatcccactgttaaaaagaaatggagaatttcatgatggttatttactaatttaggtctcattttacgattctgttttcccttttgctgaatttatttatttttaaattaaaggtaaatatagttacatctagttttgaaagatgccgcaagtgtttttggaccaaggttgggtacagatacatatatcgtggttccttcatgcagttgaaagttttaagaggactctgtgtgggggagtgcacatacacacagctggatagcactcctaacgctcctttctgtgctcactccgtctctttcatggttttcacaagcagagcatatgctctgtggcatactgggggtactcagtactctgtctcagtgctgagacttggagaaaggcattctttttgagcccttttgctcatgaggaagggggtcctggtgtaccccagggtttgttctccaggcctgggacccacagtggggttgaactggcagaaggcaaagaccataatggttacttctgcagggacagatctggaagggacttcatgctgacttttgggtttttaagttggtattttctgatgagtgactttggtatctcatagaattctgtaaactctaatgcactccttaagcttagcaatgtgtgcctgcctgtgctctcctgaccaccagcctctgacctaccctggttttcacttcattactcctcccttggtgctgacagctcatgggaattaagccagaattggcccaaaagctaaatgcctgcactgctgagctgtggtttcccatgaaaatgccttccctgagttaatgttagccttttgcttgtattgatggataatgcaaaacatgatcatctgtaaggtctcagttcttgatctcttttctgtagacactcattctcgtggtgacctcatcttctctcatggctttaagtgtggttgatattccaatcattatcacatttaggtctccagctctgacttttttctccagttccactctgtaaggcccaactccttccccagtatctacacccgagtgtgtggtggccacctcaaattcaacgtcacccaaacagaatttcttatttcccccaaactccttctccccacagacttctagtggtaaaacccctaaactttgtaatcatcttcactcccctatctcatacaccctacctttaattcagtagcaaatcctgtttcaccttcaaatatatgtagaatctgcatcgtcctccctctttccactgccaccatcctctctcacctcaattactgcactagcctgatacctggactctctgcttcccttgcaatccattctcaacagccatcttttaaaaacaaaagtcacattgtggcactgcgtagactctctgttggctccttgtttctatgggaggaaaagtttttacagtgaactccatggctgtccttgcccggtcccttgttattctgtagcctctcctgtgctcgcccccacctctgctcttccacaggtgtcccttttgcctcccttagggcctttgcactggctccttcctggggctggagtgctctgtcctcacctcagtgaggtccttgctcagatgtcaccatgtcagtgctgtgattattcagagttataacctgtcttctcctggcactccaggtctctcttaatccgcttggcctcttcttttttttttccatatcaaaaattaaccagtattattatggaatttacctattatatttattgtttattttcagcatatcccagtagaatacgggcttttccagggcaggaacctttagctggtttgctggttggtggtacatcaagctcctagaacggaactggaaacgcagaagacacttaaataggtatttgctgttaaatgagctgctgataaggatttactatgctgttcagaacccattatgtgaggaaatatatatttcagttcactgttaggaaaacgtttatttccttgatgaacagggactcccaacttacctgattccctcttctgctttggctaccaggatgccaggaactaagtgtcatgctcagttgtgaaagtgattggcttcaacttgctggtgaagtaatacaacccttcccttcctttcccttttccccagcctttacttgattaagtcgttctgtagttttttgttgttttttttttcttgacaataactctgccttttattgtttgacttttcaagtaactttttggagtgtatgtgtataagaattcaagtcaatcttcaaaggaagagaattcatttattacagagatttgtttatcttagcttacggctggttttattttagctttggccaggttggcaccattgtttcaagtagtatgtcacttattgtggggttttttgtttgtttgtttttgaaactgtgtcttggcctgtcacccaggctgaagtgcagtgctgcgatctcagctcactgcaacctccgcctcccaggttcaagcgattcttttgcctcagccttccaggtagctgggattacaggtgtccactacgacacccggctaatttttgtacttttaatagagacggcatttcaccatgttggccagctggtctcaaactcctgacctcaggtgatctgctggtcttggtcttccaaagtgctgggattatgggtgtgagccaccgtgcccggctcgttactggttttgatcagtgttctgaaatagtaattttgggtatgctgtctctctacaggcttctgtttgattgaatttcatttatacaggtattaacatgcttgtaaactactattgtctattgctttattgctttggttagtcaatcccaaactcttgctgccttttttttttttttttttttttgaggcagagtctcactctgtcacccaggctggagagcactggctcactgcaccaatctcagctcactgcaacctccgcctcctgggttcaagccattctcctgcctcagcctcccaagtagctgggactacaggcatgcgccaccacacctggctaatttttatatttttagtagagacggggttttgccatgttggccaggctggtctcaaactcctgccctcaggtaatccacccaccttggcctcccaaagtgctgggattacaggcgtgagctactgctcccagccaactcttgcttcttaaacccaaggaccctgatttctgacagaatatgtatacatacgtgtgtgtgtgtgtgtgtgtgtgtgtgtgtgtgtatttatttgagacagagtcttgctctgtggcccaggccaaagtgaagtgcagtggcatgatcttggctcactgcaacttccacctccctggttcaagcgattctcatgcctcagcctcctgagtagctgggattgctgggatgcgccgccatgccctgctaatttttgtatttttttagtagagatgggtttcagcatgttggccaggctggtctcgaactcgtggcctcaagtgatctgcctgcctccgcttcccaaagtgaggcatacaaaaagccgtagaatttcatatttttgagctggccagatttgtcaatggctctaataagtgttgcatttttatttaaggaggcatgtggtgatgttagccctgtgatataggagaataagcagcaaaggttgggctggtttccctgctcccctggctgccgtttctccattagaactggaattggggatttcacaaggacctcttggaaaacttcacagttagttttaaaaaaaaatgcatttgtcacccagaggatcaatatttttctaaaatttctaaaataaaggatcagtttgtttctgaaatttggttacctgaagccattgacaaattagttgtttcttattcaggttacttttaattgagttgtgcatgcaaacccacatgtatccctctctgcctctgaggagaatggggcctttcttggagaacacaaaagtaggaattctgattttattttgtgatcttagtcactttacaattataaaaattttggagctaatgagaaacctgaaaaattctgaagtcttcaaggagtgtgatcctggtgctgtctctcaggcatttctcccagagaacgggacggcagagcaatgactgttccccagcccacaggtaggagctggtgggcagcaccagcagcagtagacctagaagtcttagacttagatgtgatttgaaatatggcttttattatgggagcagcacacataagaccatcattggttctcatatgggaaaaacccttgaatattggctctaggacagattttaaggctgggtgtggtggctcgtgcctgtaatcccaacactttgggaggccgaggctggaggattgcttgaggccatgaattcaagaccagtctgggcaacctagcaagaccctttctgtacaaaaaaataaaaattacaaaaaattatttaaatgaaatttagcaatgttttatgtacgtgtcttctcatacttcaaaaagtcaagttgttctacaaaaccgtccatgaaaacagtagctttctgccctgcttttcccacctgattccctctcctcagaggaatctctcatctatcttctgatgttgaaccataagaaaatgctgatatttgactgctttagatctgtgaaaatgactgtatcttgagaaagcatgcttatcatgtcatttcttgatttttttaaattcaattttggatatttactttcctcacactgtggaagatgaagatataactcttatgacttcccccaacacgtctcttctcctgctgtaatattaatatgatttttgtttgattaatatataatgtttatagtattatttagactggaaataattcacagccaagacatgtaatttaaatatttccttcctcatacagcttttgcccacccagagttaatcattgttttgagtgcttgttttaagtacctgtcactgactcattcccaaactgaagcctaaccttcctttctgtgtgtttgcacacctcagggtagctgtccattcatcctttcttcctgaaggcgtcccttctgaagtttccaggccgttctgtaccttctctctgtttctcttccctggatactatggtatcctcctcctttgtggtttcttttggtctctggtttttgtgtgttttttgtttgtttgtttgtttgtttttgaaatggagtttcactcttgtcgccctggctggagtgcagtggcgcgatcttggctcgcggcagcctacgccacccagtttgaagtgattctccttcctcagcccctcaagtagctgggattacaggcaggcgccaacacacccagctaattatgtatttttggtagagatggggtttcactatgttggccaggctagtcttgaactcctgacctcaggtgatctgcccacctctgcctcgcagagtgctggaattacaggtgtaagccactacactcggctgctctctggtcttggtagagagcattggccaacagcttctgcacaaggttacaagggagatagtctccttgagatttggcatatctaaattgtcttttttttttttttcttttaccttcacacttactagtttggccaggtgtacagttctagtttgaaagtccttttccctcagaactttaaagagattgttcccttaagttccagctttttattaaaaaaaaaaaaatagagtttcccctcacttctctttaaaagtttttaggggcggggcgcgatggctcatgcctgtaatcacagcactcctgatcacaaggtcaggagattgagaccatcctggccaacatggtgaaaccctgtctgtactaaaaatacaaaaaattagccaggcgtggtggcgggcgcctgtatagtcccagctactcgggaggctgaggcgggagaatggcatgaacccgggaggtggagcttgcagtgagccgagatcgtgccactgcactccatcgagcctgggcaacagagcgagactccgtctcgggaaaaaaaaaaaaaaaactttttaggatttttctttttgtccaagtattctgattggtctttttgcattcatttttctgggcacacaatggccttctcaaactgggaacttaatgtttttcaattattggaacatttaaaaaattatatttagataactttccctcttttcattgaatttgcattttctaatgttggtggtccttctgggcaatcctctgattatcttacctttttctctcctattttctatgtcttggtctttttattccattttctggtggatttcctcagctttaccttacaaccattttactgaattaaaaaataacttttttttttttttttttttttttttttttgagacggagtctcactctgtcacccaggctggagtgcagtggcttgatctcggctcactgcagtctctgccttctgggttgaaggttgaagcaattctccagtctcagcctctcaagtagctgcgttacaggtgcccgccaccatgcccagctaatttttgtatttttagtagagacctggtttcaccatgttggccaggctggtctcaaactcctgacctcaggtgatccagccgcctcggcctcccaaagtgctgggattacaggcatgagccaccatgccattttcaagctaatatgtctcaatttttttttctttgaggcaggatcttatttgtaagccaggctggaatgcagtcttatgatcactgctcactgcagccttgacctcctgggcttaagcaatcatcccacctcagcctcccgagtagctgggactacaggtgcataccaccacgtccagctaatttattatttgttgtagagatagggtctcactatgtttcccaggctggtcttgaactcctggactcaagtgatcctcctgccttggcctcccagagtgctggggttacaggtgtgagccactgtgcctggcccatggctcagatttaaaagatgtaaaaggtgtatagtgaaaagccacccacttcctgtactagctaccatattctctctttacaggcaactggtattcctccttccagagataactctgttaatatatatatatatacacacacacacacacacacatatacacacacacacagacacacacacacatatatacactttttttttttttgagacggagtcttgctctgtcgccaggctggagtgcaatggcgccaccatgcccagctaatttttgtattttcagtagagatgggctttcaccatgttggccaggatggtgttgatctctcgacctcgtgatccacttgccttcgccttccaaagtgctgggattacaggtgtgagccaccgcgcccggcctcatacatatttttaaaatgtgtgtatatgatcatattctctctccctgtgaaatcacagatgataatagacttcatatattgttatgcatctttttttcatagaaccatgtgtcttcagactgctccatgtggaggtatgggtttctttttaaaatcattttaaagagcagcatagtatgattttaaactccatattttgtttaatcagtttcctattgatttgctacatccaacaatgctgcaaggggtaactttgtacgtgtattatgctcacacgtgatagtgccatgtgtgatgaatatggaattaccaggtgaatgcatatgtgcatttgtacttctcacagatgttactccagctgcctttcatggaagctgtgctaacttatgctctcacaggcaaggcatgaaagcacttgtttctttatatcgttgccagtacagtatgttatgacatttcttaatctttaccaatctgttaagtaaaaaatggtatctcatctgtttttaatttgcatttctcttaggagaatgagcatattttcataaatttataagagctgtttgtatttgtgtttctgcgaactgttcatatcctttgccattgggctgttaccaagttgtatgacattatacctaagggaaataagcccctcatgtgataagaattggagttgtttgcagtttgttcatcttttgattcgggttatattacatttttccatgttggtgaatttattagcagcttattttaaagtctttggatttaatatcatgaagagaaaaaggcgttccccatcttaaaattattatttttaaaatgtccagggtttcttttggtacttttgtagtttcaatatttttatatttaaattatttatccatattgaatttattttagtacatatggatccaagtttactttttttcccagatggctactggttttcccagtcatttattaatagtccattttccctctgactaaatcccccatgcctatgtgtctgtttcttgacttctgtttcttgacttctgttgtgttgctctgcctagctctgtgatgttgagctattcatgttttagttgtgacactattctaattgttaagaatatgtttgtattagggaggattgggcttgtattaaatattttattgttgatgttaattgtcagttttgtagtggtatttaaaaatgaattatgtggctgggagcggtggctcatgcctataatcctagcactttggaaggcccaggaaggtggagtgcttgagcccaggagttcaagaccagcctggacaatatgatgaaactctgtctctatgaaaaatacaaaattagccagacgtggtggggcatgcctgtagttccagctacttggcaggctgaggctgcagtgagtcatgattgtggcactgcactccatcgtgggtgacagagtgagacaacatctcaataaaataaaataattttaaaaaatgaattatgcaaactttaaaggaaactgatcatattttatgtaactcaaagaatgtttagggacctaggctggtaaaggtcagagttttctaactcaaggtttgcttccttttttttttaaatccctccaatgagggggaaacagatgctaaaacaatagtgagaagtacttaattggctgggtgtagtggttcatgcctataatcccaggactttgggaagcccatgcaggaggatcacttgaggccaggagtttgagaccagcctgggcaacaaagcaagaaccttccctctataaaaaatacccagatgtggtggtgcgtgcctatagtcccagctactgaggagactgaggtgcgagggttgcttaaacccaggaggtggaggctgcagtgagctgtaattgtacccctacactccatcctgggtgacagagtgagaccctgtctcaaaaaagtaaaaataaagtagtacttaatttgggatcaagatcggcttacaaatcagaacattcaggcttgaggaagagaaaaagcaattaaataggtcaacaattgcaaagcaaaactcaatttgagagttggataaagagatttgattgtggggactctgtcatttgagatgcaactcttggtccagtctcaggtgatgaaaatacagcatcagtagttaactggagtacagcagcattggtgcctttctttctgtgaaaaaagtctttatttgcctaagatgtagaaaagagactgtagtgaaccagagaccattttattctgaactgtggcagaataaaacgccttctggcgtctgtcctcactgttactctgaaatagcccatatatcgggaaaaaatgtggctgcttctgtgtgtgtgtgttgtgtgtgtgtgggccagattgttgttgtgttacattgtgataccaagagagaagagaacttttgtctagatgctcacctgagacatccacctggcctccaagcagcatgcacatgagtgaggaatttcaacaacttgtttttttcctgtaagataataagtgtaaaacattcattggacatgagcacaaacacagaggcgttatagactagactgtaaaatcgtctgtgggccactctgagcccctgtggtcagtcctttccttggatgactctaaaggggacttgggccccacttaggcataacggtgaacagagatttaaaaggagtttgagagcattcgtgtacagagatttaaaaggagtttgagagcatttgtctttttttttttttttttttttgagacagagtttcactcttgttgcccaggctggagtgcagtggcaccatctcggctcaccgcaacctctgtctcactggttcaagcgattctcctgcctcaagcactttttttttttttttttttttttttaccatttcaatcattttgagtgtatagttcattgatgttaagtatgtttacattgttgtgccaccatcatcaccatccatctccagaactctttcatcttcctaaatagaaactctgcacccattcaacccttaactccccatttccctccactccctccagcccctggtaacaaccattctacgttctaactgttttatttttaaatttagacatatagttgatactcagaagcttaacattccttatatgaaagtcttcaccaagctacttggcgtgagcatcttatttgccctttaagccttaccctgggaataaaatatagcctttatcactgtttttggaatatcttggaagtgcgtaaaactgcttcagtttattatgtagaagtgcatttccagatttctggagtgtggatcgaagattttcataccagcagtagggtctcaaccttgtttttcttatctcttggcaagaaagcaaagctggccattggggtataataaaccttgtgtacacagctgcaggagggaacagggaggtggctgtgcttggaggccgggtgttttgccgacgataatggggcatctctggcaccatgttgctggtcggaacagttttggagttggattttgtcctgcagtgatgtctttgaagaggaaagcacttttgaatatttgcattgctttgaagccagtgccatggagatattgtgacttattgccagtcagaggcaaagctgagtgtgtgaggttttgaacaaaggttgttgaaaaaaggagataatcattaattttttcagtaaaattcattgaaccccaagggcaatttggaggggtcatagctgtttttagaatctgttgctaatcactgtatatcgtagatattaagcctaggttaagagcattagtgtgggtacagagtttagatttgccagtttgtgactttaggcatgtttaacctttctaagtctgtttttccatctgaagaatggacatagagaaaatttatcactgggctttttgtgggggacagatgaggtaaggcataatgcatttaaagtggcaggcacagtctaaatactacctagtgctcctgcacaggcatagaaaatggaaaattgtttatatattttaccctcctccaaaacactcttagaccatctgatttttatttgacttatctgaatcctgaatagtttttactggatcatactctggtatctggactgtccctggtttgaaggtggtgctgctgggtgagaagccaaggatgagagaggctgtgttttggaggcccagtctgtcaaaactgaggtggcatttctagttcctgatagagtgagacagatgcaaaggtcatgggagctttgaacagtttctatgcattatgtgttgtttttcatcttctggaagtgggctggaatttgttttcagcagctaagttcattatgtagttgcctctaagccatgcctccccttttccatgtttgtgaaaagcaaaacaaaaccaccaggcacattatcttttacgaggacctggagattgactagctgacacccccagatttcacatttatgttgagataaggagaataatgtaagtcacccagactttttgtcattctgcatttttattcacagggatgaacagaagcttgcagattgggagaaaggggggggcagaaccagttgttttcaggtggacccaaataatgcatctgctttgataactgcctatctcgatttgcttggaaagggcatagagtaataaatagtttgtgggagtgtgaagaatgagcctttagactgacccaacttgtggaaattcagaaaatgcagaaatgtacgttcttccagcttgtgaatgttgaacaatggaattgttagaagaacttttgaaacttgttctttttttgaaagtattattgtgctcggttggctacatgtgctttggtctcaaaaatttgtgccttaatcacattgctggggaggctgtggatttcactatcaacagaaagtaatgtaagatgtgatatcttttcagcaggacctaaggagattttctcgaaagaaaaggggaaaatgccgctcttaagcaaaaaatctggaccatgttggcagacatacgtctttgaaacataccagcagagaattatttaatcatttgccccttagttttatcttgatcactcctagcgtgattttttccccctcttagttatgcagcagcctactggctgacatttaactattgattgttcatcctggggaatgaattactgtgatttatagtcaagggtacagatgtaaagagacagaaaggatcagatgtttctagtgccttttttcttcctctgatggcttctcccagaaacttgataaaagcaccaacactaaaacatgtttacaataagaaagctgtttattcatcttaagtagaaaattctataagtttatgtaaaattttgcccatgtgggaacaattagtcttttaatttgagttgtgtattgtaattccatggatggagatgggtggaggttgggccgaggggaagctgaggtaagaagccagaccagagaatttaaaatgatgtctttctttgaggatgccccctttgcccctcctgctgggcctcgcagccgtgggattggccacatcacttcctgtccaagttggcactgagagtggcacagtaactctgcccagtgttctcagactgcagtgggcaagtttccagcaatagagtcacccaaagaaacaacgcagcctcctttttttctttctctgttgcctagggcagttttcctcagacctcagtacctatgtcccttgcttttggaataaccccattaggtccccaaaccttgcctttgatgtatgtggcttcttgaggatcccctacatttgcatctgtttccttcccttatgcaaaggccctacgtcttccctgggagaagagtcctcgggggctttcctgtgggagaaaggaaggatctattcctgcccacacttctttctctccagatagagaaatagctcacatttttggtgcctactctgtactgggcactgtactgtgagttttcatgtgtgacctcacaggtactatgatcatctccaagtgacgttcagagaggtggtctgccccaggtcacagggctaaaattagtaacatgtaaggaaaatggctttactctcagcgtgagatgaaacagacaatacagtacacctgctgagtgacagagttgtccctgagttgttagggcctttgcccgccttggagctccacttgcttggtgcacagtaggcagcaaatgggctgtagaatcatggtatttgtgatttcctgtgtccttgacagttgagatattctctaaggctatttatgttctctctaccatgctcgtcacaagcagtcttctgggtcctcacaagcagtctttattgtttatatttctattaacaggtctgttcaaggcaacgtaaacctttcctaccatgttcctcaaaattcttccaagctccttcactacccaattccaaaaccacttccacattttttggtatttgttataacagcaccccacttccaggtactaaagtcttttagttttctattcctgctgtaataaaacccacaaatttcatgcttaaaacagcacgtgtggggcgcggtggctcacatctgtaatcccagcacttcaggaggctgaggtgggcggatcacttgaggtcaggagttaaagaccatcctggttaacatggtgaaactctgtctctactaaaaaatataaaaaaaatagccagacatggtggcgggcacctgtaatcccagctactcgggaagctgaggcaagagaatcacttgaaacccaggaggcagagtttgcagtgagctgagattatgccactgcactccaacttgggcaacagagcgagactgtctgagaaaaaaaatacacaaaagcacacatttttttatattacagttgtgtagatcagaagttggacacaggtctcactggaataaaatcaagaagtcagcaggaccagttccttctgaaggttttggggagaatctgtttccttactgctgcagcttctagaggttgcctgtattccttggcttgtgacccgtttcttcatcttcaaagccaccactggcaaatttagtcccttttacgcctgacatttcttctggctcctcttatgtgatcccatctttctgtctctgaccacagaaataaaagactttttaaaaagactcattagattgggtccatctagataatccaggaaaatctctccatcccaaagtccttaatcttaatgccgtctgcacaatgacttttgccatgaatgtaacatagtcacaggtttgggaattagaagttgggcacctttggggggcgcatttttctgcctgccacacatgataaggtgtagacacaatacagttaactctcttagttcgcagtcggcacccctttaagtaaagtgtgtggtttctaatcaagcattttattcagggtgcatctgttccacctggctggcagcacgcaccttgcaggtcaggtgtgagatgagcaagacccattggaagactggaagctacctccttctctcttttaggacaaggaagcgagagagaagcgaggagaccacttgagttgtgactctcctgcttatggtgaaattaagaactaaaactaaaacaacaggaaccctttcataacggaaatactgaagtataaaatgaaaccacctcctaaacaactctttttcctttgaaaacaaagctaagctgcgttgatgcttgcacctctgctcttgcgtgggaaaattggacccctctgtgacatttggtatgttactgagcagggttcccttggggaggacgagaagcctcctctccacttgacacttggaatttgataccagttcctgtctgacagctggttagcctgtcaggccctcacaagttaaatcttgtctcagaaaataatttgctagaagatcaaagcatggatgggataaattaatttttcaacaagccacaggtttgggataattgtctctcaagtgttgctaatgtctttgataaacaagtaatttgggggggctctttttttctcttgagattataaatcttgattgattcatatgttgaaaaagaactctgaaagcttgcacctaagatgaagccctggaataacctgaaataataataataggtatatttcaacacctgtgccattcggagcagtgattctcaacaggtgggggtgggagatcgatttttgccccccaggggcatttggcagtgtttggagacatttttggttgccatgattttggggaggggtgctactggcatctagggagtagaggccagagatgcccagaatagcccacaacaaagagttatagaatgtcagtagtgctgaggtggagaactcttgattgagaaaggagtgttttctattttacttattttcgtgtgtcttaacactattcctggatttaatttctttgaggatagggtccatccttttattttctcactcaacacaacaagttgccctgagtaggctcaaacatttatttactgttgattcccctctctcttgttaagctattcatccttttttttttctgtcttggagcagagctattgagggcagcactgaaaagcagatggtagagctgtggcagaatcaacatggttgggagagcggaaagaacacaagctctggacttctctcagccccttctttctcgtctgtaaaaaaaaaaaagttaataatagtgcccaacttaggatgattgtacttgagaaagatcgtgttgcaaaaaatggggatgtagtaagtgctcagtaatgccttctcaggcagctgagcaggagactgtgtgcaaggccctctatctcagggccctgtttttttgtaaaaagttgagtaaaggaggggcagacatcttacacatttcagaattgttatcagttctccaggaagaagagggaaagaaaaacatttatagcatttcagtaaagattactccatgattgacaaaacaattttgaggatcctaagaggcacattctgcctcaggctggagcagtttttaaaactaaattgacagcaactagttcaagttggaacagtcctaacttaattatagatacctgcagaggttccttcaaacaggtgggtttcaacagcgtggtgctatctagcaaaagctattgtttgcttagttatttgtttgagagtcagcttagaacataaggaaggagtcagagttggggtggaattctgtctctgattggatcagagcctccattttcctaattgtaatatggaaataatgattgtccctcagaggatggttataagggacaacatatttgttacacatttggcatagtaagtacttcataaatgacacctataaaagtttttgtttgaaaattttccagcttttgttttttatttatttattttttgagacagtctcactgtgttgcccaggctggagtacagtgacacaatctcagctcactgcagcctccacctcctgggttcaagcaattctcctgcctcagcctcccgagtagctgggattacaggcatgagccaccacacctggctaatatttatatttttggtagcgacgggatttcaccatgttggcccagctggtcttgaactcctggcctcaagtgatccacctgcctcggcctccctaagtgctgggattataggcatgagccatcatgcctggctgaaaactttccagtttttaaatgtcatgcatgtttttgctcaagaacgctttggctgtttggggcattttgtagttccatacaatatttttttccgctgtaaaaaattacattggaattttaataggaatagtattaaatctgtaggtcacttcggggagtatgaacagttttaacagtgttaattcttccaacccatgaatacaggatatctttccatttatttatgtcttcagtttcttttagcaatgttttatagttttcagcatacagatctttcacctccttggttaaatttattactaagtatttcattctttcttttttttgagacagggtctcactctgtcacctgagctagagtgcagtggtgcgatcacagcttactgcagcattgaactcctgggctcaagtgatcctcttgcctcagcctcccaagtaactgtgactgcaggtgtgtaccaccatgcctggctgatttttaaatttttttgtagagacatctctgcgttacccaggctggtcttgaactcctggactcaagcagtccttctgccttggcttcccaaagtgctaggattacaggtgtgaaccattgcacacggccttattctctcttgatgctattgtaaatgaaatcattttctttattttttagatagttcattattagtatatataatagaagtgctactgatttttatatgttgattttagtatcctacaacttcactgagtttattctaacaatcttttggtgaagttctgaaggttttctatatataagattatatcatctgcaaacagagacagagtaacttcttgctttccatttttgatgtattttatttttcttgcctaatagctctggctaaaacttctagtactatattgaatagaagtggttaagagtgggcatcctgttttgctcctgatcttagaggaaaggctttcagctttttaccactgagtatgatattagctacgggcatgccgtatgtggcctttattatgtcgaggtccattctttatacctaatctgttgagagtttttatcatgaaaggatgttgaattctttcaaatgatttttatacatctattgagatgatcccttgatttttatcctcgattttgttaacgtggtattagttaattttaattaatttgcatatgttgaaccatctttgcatcccagggataaatcccatttgttcatggtgtatgatccttttaatgtgcttttgaatttggtttgctggtattatattgaggatttttgcttctctagtcatcaaggacattgacccataattttattttcttgtagtgtccttgctggccttgcaaaatgagtttggaagggttgattccatcctcttcagttgttggaaagagtttaagaagggttggtgttaattcttctctttaaatatttgatgaaattcaccagtgaagccgtgacatcctgggatattctttgttgagaggtttgtgatttctgattcaatctccttacttactattggtctcttcagattttctatttctgtattattcagccttggtgtaagttgtatgtttctaggaatttatccatttgttctaggttatctaattggttggcatatatttgtctatagtagtatcttatataatcctttgtatttttgtggtatcaattgtaatgtctcatctttcatgtataattttgtcttttagttcagctaaaggtttgtcagttttatcttttcaaaaactcctggtttcattaatgttcatttttttccttctgctgactttgggctgttccttttctaattccttgaggtgtaaagttaagtgtatttgagctctttcttccttaatataggagttgattgctgtaaacttccttgtagtgctgcttttgctgcatctcttaagttttggtttgttgaaaaacgaaaaaaaaacacaaaaaaacagagagctggaggcatcatgctacttgacttcaaaatatactaaaaagctgtcatcaaaacagcatagtagtggtgtagaaacagacatatagaccaatggaacagaatagagaccccagaaataattcatatttacagtcggttggctctttgacaaagttgccaagaacacacaatggggaaaagagagtcttttcaataaatggtgttggaaaaactgggcatccacatacagaaaaattaaacccctttctcacaccatatacaaaaatcaactcaaaatggactaaagattgggggcatggctcaggggtagaggatttgactgcaaaatggactaaagacttagtaagatccaaaagtataaaactacttgaagaacacacagagaaaaagcttcttgacattagcctgggcaatgatgttttggatatgacctcaaaagtatcacagaagcaaacatagacaaatgggattgtgttaaactaaaaaaaaaattctgcatagaaaaggaaacaaacaatagaatgaagagatggcctgtagaatgggataaaatggttgcagaccatacatctgataaggggttaatatataaaatatacaaggaacccatacaactcaatagcaagaaaataaataaccggattaaaaaaatgaacaggccgggcgcggtggctcacgcctgtaatcccagcactttgggaggtcgaggcgggcggatcacgaggtcaggagatcgagaccatcctggctaacacggtgaaaccccgtctctactaaaaatacaaaaaattagccgggcgtggtagcgggcccctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaatgaacagaggaccttaatagaaatttctcaatagaagacatacagatgaccaacagatacatgaaaagtgctcaatatcactaatcagggaaatgcaaattaaaaccacagtgagtggccagatgcagtggctcatgcctgtaaatcccagcactttgggaggccgaggcaggcagatcacttgaggtcaggagttcaagactggcctagccacatggcaaaacctcgtctctactaaaaaatacaaaaccacagtgaggtatcatctcacatctactagaatggatattatcaaaggcaaaaggtaacaagtgtgttgggaaaatgtgagataaagggaccctcttagactgttgatgagaatgttagtacaaccaatatggaaaatagtatgagtatggaagttctgcagaaaataaaaactgaacttccatatgatccagcaatcctacttctgggtatacatccaaaggaattgaaatcaaagagatacctgtacttctgtgtccctcgcagcatgattcacaatagtcaagttatggagacagtggaagtgttcatcagtagatgaatgggtaaagaaaatgtggtatatgtgtacactggaatactcttcacccttacaaaagaagaaatcctgtcatttgcagcaatatagatgaacctattcataaatgaaatagccaggcacagaaagacagatactgcattttctcacttatatgtggtatccaagaaagtcaaactctcacagaagctgagagcggagtggtggttgtcaggggctgggagatgagcggtgcttgggagggcgttggttaaaggtaaaaagtttcagttaagttaaatatgttctggagatctattgtacagtgtggtgactgtagttaatgtatacttggaaattactaagagattagctctcaaatgttctcaccacaaataagtgcgaggtgggtatgttaattagctagatttaatttcacgaggtctatgtacatcaaaccatgtatattgtaaatatatacaatttttattttttaattataaccttaataaaagtgggaggaaaagtgataaacggtaataagcccttaaaggtaataagttaacttgtcacccaacgtatttattaatttttctatacaatgtaatgtgcttggagaacattgaggccgggcacggtggctcatgcttgtaatctcagcactttgggaggccaaggtgggcggatcacttgaggacaggagtttgagaccagcctggccaacatggtgaaaccccatgtctattaaaactacaaaaaaaaatagctgtgcatggtaacgggcgcttgttatcccagctactcgggaggctgaggcaggagaattgcttgaacccaggaagtggaggttgcagtgaatcaagatcacaccattgcactccagcctgggcaacaagagtgaaactctgtctcaaaaaaaaaaaaaaaaaaaattgaaaatccgcaagcttcagaagacacactactgcgtgtttgtccttctacggaagtcagtacagatctcaatgacttgttctcatttcaccagaaaatgaccattgtgcattatgctgtcagtgcagatggaaaactagcagcagtttacaaagtttccacttgaaaaaacataactctaattgatttaaaaaagtagttgattgttgcaagacttgacatttctctagttaatttctatgcctgttgttttgccccttaccgtcttcaaaatctgaatccaaatccagggcttctctattaggaggctccatatcatatctctttaatcctgataatttctcagttttttgtttcctacctacctggctattttcttacgctatctttatttgcttagtaaatataacatttcatgttctattttattttattttattttattattttattttttatttttgagacaatgttctgttgcccaggctggagtgcagtggcatgaccatggctcactgcaacctccatctcctaggctcaagtgatcttcccacctcagcctcctgagtagctgggaccacaggtgtgcaccaccatacccggctaatttttttattttttgtagagacagggttttgccatgttgcccagactggtctcgaactcctggaatcaagcaagccaccccccacttggcctcccgaagtgctaggagtacaggcaagagccactgcacctggccctgttaacttcttatgtcatttccccactttaatatatttgagggctagttctgtgtcatgtatgtattttaacatcactaccgcatctggtgcagagaggggcattctgtagtcttcgtacttcttatcttcactattgctgatgagccataacaaatttgagatgagcaattaatagatggaccggccaacaaacactatgtggaggaataagtgaggccaaagctgatggatgatgcaaagtgaggacgtaacatatttcgctggggaaccagacagatatgcagagtaagcgctctgataggggaagtacgggctgttatgggcgcttcatactgggaacattaatgggaggtggaggtcgtagttgaagctgaaacctgttgggtgaggtggagttcgccaggtgaagtggtagacttggggaagaggagaggagggggagcatcctgtgtttagaaccaaagagagtttagtgtgtgattattgggtgggggtgggagggtaggtcataaagggcctggtaaactgttaagaaattttaaactttatctcaagagttgtgggaaatcactggcaagttttaagttggtaggtgaagtgctggctggaggaatccctccagcttgggtatgtgaggatggcctgagaacggaggcacctgcagtaatcccccagtgagagacactgtagcctgagctgaccttggggctagaaaaaggggacaaatggcggctgaggaggagaatctctgtgagttgattgaatggggagaggcaaacatcaagcccagtgcccagacttctgggaggatctggctgctactcagtatggcggttgaggaggagaatctctgtgagttgattgaatggggagaggcaaacatcaagcccagtgcccagacttctgggaggatctggctgctactcagtgaaaggaagcctgggaggtttgggagggcagatggatgagctcatttatggacagattgagttcaagcatctacagatcattgaaggggaaatgtgagcttgaaccctgcatttgaagttcagaaaagagaaagagcagaatgaattgagttctgggagtctttcccatgtggatagtaactgcagcggatgaggtgataagatcacctagttagaggtgggggagcagaagagggcttagggcagaactctgaagagcaacctgcaaaggagactgaggaggaatggacagaaagggtggaggaaatcttcatgggtgcttttcaaggaggcagtggttaccagcattagctcctgcagagccaagagaattgagtcattttgctgggcttagcaacaagaactttcagggacttcatggcagcgtgacagcatatggagatgcagtactgttggcctgtacagagcctttttttttttttttttttttttttttaaattccctgagatgtagtctcgctgctctgtcgcccaggatggagcgcagtgactcgatctcggctcactgcaacctctgcctcacgggttcaggtgattcttctgcctcagcctcccaagtagctgggattacaggcatgcaccaccatgcccggctaatttttttgtatttttagtagagacagggttttgctatgttggccaggctggtctcgaactcctgacctcaagtgatccacccgccttggcctccaaagtgctgggattacaggtgtgagccaccacaccctgccagtacagagcctttgaagacattagaaaatgtgtgcctttctggatggacacagtccctggcttggtgagtggaccgtgcatgggacttcagctcttatgtgccaccttagctgggtgcacttgtttagtgtgcagaatacaccttccatgcgtggtggcctaggatatatctgcacttctcaatcgaaggcaatgttgcctcccagggaatatttggcaatatccgaagaaatttatgattgttatagctgaatcagagagggtaggtgctactgtcatctagtgtgtaaaggccagagatgctgctaaacactctgcagtgtccaggacaacccctgacaacaaagaattatccagccccaaacaccagttgtgctgagaaacgctggtgtctgtgaccctttcaggctcatgggaaaaggcggtcagagagggtgatagctggaggtgggtggacctgagaacaggctccttacatactttgctgcagtctcatttgcttgtggcagttttcaccttgcctctcctacctctctaccatagaactcttactcatcatgttataggttttcatttgtttattcttatgtagccattttcactattccctctcccacccccactcccccaagcagtaaattctgtaatgcaaggcaatcttgtgtccttatttctgtttctgggcacactgtaaaacatctgtattttaatagtatctgtcaggaaattctattttggcaaccaagtacgggctaatctaaagtagcccatacttgagtgctatgttgataaggctctaatgcatagttagccccttgactgtcaggcttggaaaaaagacaggaagtattccttgtctttggaaatgagcctactctggctttgggaaggaaagagtacaaatggttctcaccagatagggttgcagcagctctcccagcattttgggaacaaatcaggtcattatctcaacaatgtcaaaattgtgttcccagatcggttgttgtttgaaacatttggggctgatgcggaggaggagaattaattagcagctccctctgttggtgttctttttcagccttctcacattgcagcacgagagtcccttagacatgctggctgctcatttgataatctgtgttttgctcagtacaaaaggttgctggctaagttttgtgagcccctctaacgtcaggctggcagtatcttgggttcaattaacaagaaagtctacagtaacattttgtcaatggggaaggacttgaattcacagaactgtctcggaaagccctgggtaagtttgaagagcaaagttgccttttctgttttcagaaatattttaccccgcaacgatgtgtaaatctaaagcctgtgcaagaatgaaaacgagcttgagtattaagatttggcacagtgtgtgcaagcaatgagactgggttaaaaacaggaagtgtcttaatttaaagatggtgatggggagacggattaaaataaactgctggccatgttgaatctgagataggcaagccttggttgtgggcacattcccttctgaattactctatgcagatatattttaggcctctttctattaaattgtctttcacatggtttcaaagatagggctagtgataagaattctcttcctgcatggtgggtaccattatataaacggtatgagcatgcttttcttgtgtctctgtataactgcttggtctggcactccacaaaatagtaaaacacatttctgcagtggactagcccatgctgtgaaagaggaaggtggtggtggacaaaaagtggtaagttttaggctgaaggatgttgatgttaaactttatttctgattatggcagtctttcatcatgtaatttaagaagcctgagatcatctgacttttttttatgttttttttctttaggactgcaggaagtgttgataaacatctgtttaagttgtctataccatgaaatccataatcttccttcataactatgatagcatatggttttctatagttaggaaaactatttctcatgtatttcatggtttggccaaatccttttattacattagtactaaaaaattccttaggatttctagagaaaataatatgtattatggataaataagggaaagtaagataattcttaaaccttagtatcagcagtcattctaaaccacattacacatcttcagtaaaagtggttacaaaagatttttctcacttcaaaagatccgccagggaagagtcccagctttttcttggtgttattttaggtattaactcaggagggcttcctgaaggtttgtcagtgagatagttggggggttcctgagctttttattgttgtacgtgaacttggtacttacttctttggcttttaaactctcagcagcacgtacagatgccctcacatgctttctgggatgactttaacgctaaatagcaggggtgtttctcaagaatgtttaagaaaagaaagcagacatttgtttgcacaaacagatatttgtgacttctgtgaaaaaattccaatagttgtaatataggaaatttttataaacaaacacccctaccaactaacccatcgtgtatttttatgtgtgtatagaaaaaatgaaaggatatactaaaatgttaattgcatagtttctctgggaattgaatttaattaaaatttttttatcaagatttttaaagttttataatgaccacgttatgtttatgtaataaaaataaaatagaggctaggcacagtggctcacacctgtaatcccagcactttgggaggctgagatgggaggattgcttgagtccaggagttcgagaccagcctgggcagcatagtaacaccctatctttatttttaaaaaataaaataagagagggggacaataaatgcaaatatataaatgacagaaattttatggtctggtcaaagaactatcattgcatgaaattatagatatggtcatgtaaggttaccttttttcattataattccaccaataattctaaagtttcttttctttttttttttctacttcttccacagaaaaacaggacaaagaaacctgtgtgaattttcagcttttcaccttctctgattttatttcttcctcactcttcctttgacagtcctcgcagtccgcctgagagagtagagaagaccccctcccagaaccttcctgtaaggtctccccgctgacttcctgtagtggatgtgactgtgtgccaggtgcctgccgaagacccctgtcactgactgtgccctttgggaaagagtcaacaatggcctcctcctatggctgacttcgttcatgttcaggctctccagcttgctagtgagaattgccaaggattggttcatggcaggatagaactaaactgatagatgaaagctccacagtgcttcaagacggggtcccgttcatgttaagcagttttccttccttcaaaataaaaaactagcagtccttagggaggacagttttttccttccttttcctattctggctccaacagctgtctcaacacagcccgagatggggagcagcctggcttccaccggcaatagctgtattgtgggagtgtgaaagagaagccaccttttcctccctctgcccaagccacctggcccctttgtcctttctcctcctcgtcctctgaggtatgagtggctgtgactgtatgacataggaactatgaagcggggtgaggggacggtttggtgcgtaaatcctcacgcaggtggcggttattgtctgtgtggaggaaataagcccggttcttcctgggactgctttcatttccctctagcttccagagggtaaaatgaaccttaatggaggttggggggtggcacgcacaaagtcctgggttgagggggcagtggtcagaaagttccctagggtaatatacaaaggagaattaacactggggacactgaggtgggttttggtcctttccacataactgacacctttcaaagcaaggacttgctttctcgtgaggaatgtcagcagtcgcaacaccactgggttggatgcaggataattattcagaatcacgagttacctgtttgcaagcaatcacattgcaggtgggataaataagcagacagtctgtggtaggttcccccaccccaaccgcctcccctccccccagggatactgtaattttaagtattgttttggatattggtaattctaaagctccaatcttaactgggttttatgaaagccgttatagggtgtttattaccaaaaaaacctccttcttatttaataatacagtgcctagccactcctttttccctgcatccgtacatgaagcctgattgcagatctcgaacagtatatttctttgagctaaacagcaagaacagataaggtatcttatcaaaacaccacgccaggtggcgtggctcacagctataatcccagcaatttgggaagctgaggtgggaggattggttgaggtcaggagtttgaggccgcaatgagttatcgcgccactgcactccagcctcagcaacagagggagaccctgtctctaataaaacaaaaacattacaccattgtcagaaagtgatttgttcttctttgttggattaaattctctcacgtgcaaggtagtggccagcagcctaagaagatacacaagctcttcactgtagatgtttggcggtgtgggagttacaaggttaattatgagcgtaaggcccaggcatcttttcttcctaacaatttcatttcatcctatttctttttccattctttctccgaactgtctatactttattaaagtcttctttttcccagactccagaataatttcctgtgatatgttttagcagtttctccaggaaaaggctccaggagtctttaaatccagccctctttctgctgtatctttgtgcctcacatcttgagagaagttgagtggtagaaagtaaaggaaagcagaaaaagagatgggtcagggaggaaagccaagatggaaaatggatgggaatgaatgaggaacatgatgtgggttggggtgtcaattcatggttaatacaacatgtgtggctcagtataaccagattgtcataagaagctcaggcagctctccccctctgttgcctggggcttttcgcagttacaataaaagtggaaagatgaagaataagggcaagcagaagacacacacatttgcctgtttccctctttttgtccagattgagtagatgggaggcagggctgttacccatgatggtgtttcataccagagtcaatctactagtttgcttggttttataggcgtgattcccaaattttgaatctgaagttagctgtcagtttaaattcagagggtccgcagttgtttttcaggtttttcttgattctgcctttggaaaccaggaagatgttgaatttacttttcatctgacaatattgcacatctgtgaacccaactgatctgaaagtgtttacctcttaactctgtgaagttagctggttattctggatggctgggacaatggtgaggaccgtttataatggttactctcacctgtgctccagacgctccacttggtgctagaaatacagcagtgaacagacatggttcttgcctccacacagcttgcagtttagtagggcagactgacgacattaaaaagataccatcggtgttgttataatggtgataagagttacaaaataaggggccaggtgcagtgtctcacacctgtaatcccagcactttgagaggccaaggcaggaggattgcttgagcccaggagttggagaccaccctgggcaacatagtaagaccttgtttctacaaaaaaaaaaaaaaatcaaaaattagctgggtgtgttgatgtgcacctgtggtcccagctactcaggaggctgagttgggaggatcacttgagctcagaaggtcaaggctgcaacgagctatgatcgcaccactgtattccagcctgggtaagtgagaccctgtctcaaaaaaacaaaaataaagggagcatgtaacagtaggatctaatctagcctaggcaagtacggcattcttgagaagtgacttaagacctgaaggactgatcgaattgtctgtgtgaagattggcagcgggtgctctgagggggaaaagcggaaatagcatatgcagacaccctgaggtagaaagggagctctggcctgcttgtgtgattactgtgggagaatgaacaggaagaagacgaaagtagaagcaagaagaccaattaggaggttccaaggacctgcctaactaaggtcagttagccggtgattgcccaagccaagactcaaactcatttttatgaaggccgcacaccctcatctcctcagcagttgttaaacaatatttgataatggtgttcatgtcaacctggcacatgtctagaagattcttaagtgactttttcttttcacatggctttttgaccttttaaatataatatgttttaatatgacgttattagctgcacaaaggaagggaactgctcatttgaatgaaccagaagaaacttggaattttgcctgccttctgcttcagccctgccaaaatgtaatttctttaattcatcaaatcacattcttgactaatctgctcaagtctgtactatgccttggcctttttccctgtgacaatttagggatctttaaagaaaatattttgaaatgttttctcttgatcagggtgcttgtggttaggtattgcatacactgcttttatttgcagaatgagctatttttctaccatgtgatcctttgttagaaatgaacatgattgtggctggccgcagtggctcacgcctgtaatcctaggactttgggaagccaaggcaagaggatagcttgagcccaggagtttgagaccagcctgggcaacatagcgagaccccttctctacaaaaaaattagaaaattatccaggcctggtggcacacacctgtaatcccagctacttgggaggctgaggtggcaggatcgcttgagcctaggaggttgaggctgcagtgagccatgattgtgttactgcactccagcctgggtgacagacagcgagaccctgtctcaaaaagaatgcaattgtaattttgtcacctttatttaaaaaaatcatttatcaggtggttgcaatgaaaagcaatttagttgtttacaacctctaccttccagggacttaagtgtgttcagaagtatttaaaatgaaataattatcttagctaataatgataaaattactgtggagcattgagggctactttgtgccaggcaatcagctttaaacacctttgattttctccctatgatgaggggtatactgtgatttttattaaacatttggggaaactgaggcttaaagtggctgagttttctaagagcacgcaggtggaaagtgatcaagctgagtcctcagcttcatatcttctcagggtccttgatcttccgcaccctgtagttctggttcattttaggcaattatcagaagtcacctcaaatgccaagaacctgtgtaacacaggggatgaagtaaatgtgagcaatgtaatgaagcgtttccttataaactgttgtaaggattttgttccagagatgaagtatgagaaaaatataagccaattgttcagtttcatattagtcaccctcttctactgaactttggtaaattcaaagcttccctctatacgaatttacttttataggaatattacaaaatctatactaagaaatattagaaaataacctgtacttaataggtttaatggaaattaaacccaaatataatggaaatctgaatgaatgctcatttaaaaaaatataatttatagcagtggttctcaaactttagcgtgcatttgggtcctctggagcattatgttaaaacacagatagctgggctccaaccccagaccttctgattcaggagttctgggactggcgtacaaatgtacatttttgacaagttaccagctgtatgagggttctccaaagagacagcataggtatattaggaaggagattcattataggaattggctcatgtgattacgaaggccaggaagtcccaggatgttccccaagaagtctcaagatctgccatctgcaaactagagaacaagaaggccattggtgtaattcagtctgagtctgagggctgagaacctgggagcacctggcgtaagtttccatctccatctgagtctgaagatccaagaaccaggtgcgctgatgtctgagggcaggaaaagatagaagttccagctcaagcagagagcaagtatttgcctttcctctccctttttgttctattctggccctcactgattggatgacacccatccacactgatgagcatccatgttggcggtcttaacccttttcccacttagaaaaaaagtgcggtttgtggccagtgcttatttaattttacataaacaggctgttggaggctaaagcaaatcggactgattttcagtgtgaaaataaaatagaaaatattatttctaaacagaactaacatcacaaccatctgaattatcagaatcatctatttcagaaaaatcggattcatcaaatgaatcttccatcaactgttagagaacgatgttaacatcactcataggaatgctatgttttctaggatttgacattttcagcaattgagaattactatattttgtaaatggaaatgccactactaaaaacagaatcctataaataggatgatgtcttttgtttccaaagtcgatatactagaacgatgtgaaaatttaaaaaacgagatctttcgtggcaaggttatcttggggtaaacactgcagctgcaagcaccatgggcaagtattctcagggcaaacaggaagagagttagtgaagtctactaattcaaatgctgatctcttcttggcacacccagaagtaatgttttaccggctgcctgggcatccgtttgcccagtcaagttggcacgtgaaattaacctgcataccaggtaatgtttctgctgctggcctagcgaccacactttgagaacaactaataagtcataagacagtagaacccctggatagtaataagtgctcgtgaaatgagctggccagtagctaatccctgagaaagccatttcctagtcttataccacgtcagtaatccaaagcaggatggcgatctgaagtcctgaagagtcaagggtgatacgatgactctatggagccatcaccactattgggaagacagtggggacacctgcctcccctaccttccacaccatgtacatgatggcacgtgacttagatgtgcaaactgtgcagtgtcagctttgtgatgataaactcttccactcagtctgctatgtatatggcatagtcactatactgctaaattaaataaatcaaatgagtgaacataaatcaggattcagataccaattaggtaaaatactatagtttgtatatgatggggattatcctttttctggaatgtttcagcatccaacctttgctgcgtttgtcttcttgcagtgactgagaattagctgaaataactgtaaaagcgtaagattcccatttggctggagatgaaatcacagaggttggtttactaagccttaagaaattcctttagatttgatgtgtccagacttgtactggaatatgaaatattcaatttgacaagatctgtgagttcctagtacatacgtgtttttagaaatgtgtttctcaaaatacaattaggaaaaaatccctttgaaatgctaaaactacctttagtggtgataaagatgccgacaaccccttctgtttaaataaaaacaaacaacttttaaccttcatgatgttataataacatcattaacttgtgtagacaaacatcagtgctcacatttaaagtaatcattaaacattttcagagttatacttaaaatgactttttaatcatactataaaatactgctgcaaagttgttggtggggtactaagttgtagttcttatttcttctttctctacagtctgttttggctctaccttggggggaaaatacccaaagaattgtaactgaatacagaagcattttaaaaaatcttattttaaagaggaggagaaattttagagctatttctgataataaacctcaaaaagtgagaagtattagaatttatcttggttaattttctttttttaattaacgagcatgcattgcttatataaaacttttctctgtatgtgtctgtatctgatgcagttagaagttcaatgtgagtttagtgattcccagggaagacttagggaaccttggtttctgagttgtgctctcctctgactacgtggtgagtcttagtctctggagtcagccagatccagatcttagtctcatggagttagccatgatcattttaaacttataattattaaagtgctatgatgtacaaaggtgcttatgaaactaaaatttgaggaattagatacaatgactatgcggttttgctttttagtaactgtttctcattacttcattgatccaaagtgagatttttaaagctaaagtccttgttccattaagataattctgtcatttgtccagttactctccttactcaaattgctagcccctttggtacttttctctctagctcttgccctgcttcatgatgttcctgaatagttttagttttctttgtttatttttccactttcttgggccagacctccaatttaattcttttagttgaatgagctgctttctcgcttgttacagactcacttagggctcattcctccctgccttagtcccagtatggtctcagtaatgacatgcagtatggggactttggactcctgtttgaacaaaccagctttgagatgataaaaatttgaatatgaattgagttcttgaagataagaaattgttaattttgttaggtttgttaatggcatggtagttactctaaaaacaaatttctgggcgagtgtagtggctcatgcctgcaatcctagtactttgagaggccaaggcaggaggatcacatgagcctgagaggttgagcctgcagtgagatgaaattgcgccagtgcacttcagcctgtgtgacagagcaagaccatgtctcaaaaggaaaaaaaaaaaaaaaaaaaatttattcattagttataaatgcacactgatgttcttataagtgaaaagatatattgttttggttttgctttaagattccagcaaatataaaacagaaaaagagggaatatattaaaaaggctggcaaaatatgtatcattgttgaagcttagtgatgggtgcattgtattcaatatagtattctcttttgtgtatatttgaagtttttcatgatagaaggtttaaaaatttagaacaaaaatgaatgtggaggttcaggatcctaccagatgtttctaaatgaactttaagtgacaatggggaaaaatgtccatatcatcctggagtttaaggcagggaattcttggtagggggctattgaaaaatagccaaactgttagtcaaaaatgtacatatgatctcatggccacagatagtaatgtagaagacagatcacgaaagtactaatccttgggtgaggaagaacaggagaaggcagcccaagaacttaactgaggccccaagaactaaggaaatctgttttgtaaaaggacctgtacggccaggtgtggtggctgacacctgtaatcccagcactttgggaggctgaggtgggaggactgtgtgagcccagaagtttgaggccagcctgggctggtttaattaaattagctgggcatggtggcacacgcctgtggtctcagcgacttgggcggctgaggtagaaggattgtttgagcctgggtggttgaggctacagtgagctatgatcgcgccactgcattccatcctgggtgacagagcaagactctctcaaaaaacaaacaaacaaacctatacgaacaatggtaggaatgtcaaggaacccaggagtgaagatcggattagtcagatgctgtgagaggaggtggaaaaaaccagtgtagaatgggcaggcacctttgaaaaggctagaggaaaattttggaagggcattaaggaggagcatagcaaagaagtctagacctatgacttggagctgttctgttatataaataggatatccagagatagcaaactgctcactgcaggaaataggggaaatagaggataatttggaagaacaccccactgttattatttgtggcagttatgttctataaagtcgctgtggacataattagtgaatactgagccattgctcctaggggaacaatacagagttagattcctgtgagcctctggttataacgattttgtcagctgtcaaccgatcaatacatagccttgttttgcatgtgtttctgtttaaagataccttgtttaatatacattgttgattcattaacattgacctcatggcgaagagcactgtatctcatgcctaaatgaagcttagccaatgcgtctcttcttcctaaggcacatcatggccttgttgtgattaagaacattagacgacactaaggcatgatgtttggggctcattttaaacagcaaaatcaccaagaaacccacaaaaatgaaaaaaaaaagccctaaaaactagccacaaaagggacatttgttaatagtataagggctagaacaaagagtgtaggctggttttttggcttcagctgggtacatgtatgtggagtgactcaaatattttggtgtgtacttgcttcagtggcacatatactaaaattggaatgatacggagaagattagtatggcccctgtgcaaggatgacacaaattcgtgaagcgttccttaataaaaaaagaaaaaaaaattttggttctctccacctgtgcgcaaatgaccatgagcattagtcttggggttataaataagttttagtagatgaatttgcaaatgtggaatccgtgaataataaggatgtactgtattttttcatctttatttcttaattaacaactgtgatctgtattttaaatgagcctttttgggggagcttgataggcattgagtgtttttcccaaagatttgtcaccttcttgtgagttgtctagtctgttcttttggttttatagatttattctaaactaaaagttaatggtagttgccatttataatttcttgcagaggtttttgcagagatcatccatttaatatttttgtgcattgaaggttttaattgtacagtcaacactgtcattcacttgtgattttcattttttccaagcttagaaaacttgaaggatgatgacttttttattggagaggttaaaaaaaaaaagtaggtaaaagtgatggatgcttaggctgagggtggtgactgaatatgtggtacttgaaattgagtttgagtgtccaggcctggtttcattatatcttgggacacttaaaaaagtcttgcagaggcaatctgcttgaaaatgctgtataaaccttaaacctctaaattgtaaaatgtaagtgcataataatttctgatttgtagacttctgttgacaatctttcaagacgggagaagggtgaaaaagacggaaaagacaaacagatatttttcagaaatgaaaaacatgtacattttctgacatagggaatgagagatttttctaaatgtgacccagaaggctttcaggtgatttcctaacaagatttgagttttctcggattaaatatggttgtggctctctaccatgtgccccagtcttatctttgttatgccccttcacacatactctgttcttcacatactcttccttctgctggctagtgcttccctgtttctggaactttcttaagcatttttaccatgtattatagttatttgtattgtagttacgtgtcatccttcttcgtcttagaagagaagtttccatctgactccatgttttctattgtagaccctagttcagtgccttttaaacagcagatatggaataatcctctaatggaataaatggggagaagaagggatagtttgtggttacctgggaaagcagtgtggttaagtcagcatgggtttctcaagaacaagcctttcttgaattaacctcatttcctgtataaatcagatacttattggagagagaatttgggtaatgttgttgttagaggatatcagaataaaaaaactacatgtttcattaagttcttaggattttttatggataagttggaaaagcatgggcttgattgtaataagatagatgaatgtgttgcaggttgattaactgttgactttgtgcaattcactgccttgccagtgctattctaacttttccatcagggaactattaaggaagaggaaagtttatactttattttggagggtttagagggttgagggtacaggaattgaaggttggattgtgggcaggatgtagggagactttagaggcacagccaggagcgaaatgtctttgaagactcatgttttcacataaagatgcattcactttgtatttttaacatgcccatgtttgttttaaaatactttaaattatcaccagataaaatgtttgagtagccctttcccaatgtcatgatattctagtttgagaagagtggtctttgatcaagaaaggtggatcaaatttgtgtctatcccattgttgggagggaagctaaccaactggatgtcagacatcaggatagaaaaaaaaaaaggctgcaaaaagttgaaggcaatcaacatgaacaaatacacaattaagctctactgaatgcagcttcctagagtcgggggaaagttgcatgtttatagaatgggagacctggatcagtagcagctcttgttaaaaagattgaaggtttcagccaaccatttgatatgggtggccttctctggcagctttaatggcacagtactcagaattaaggagataatcatcccgttgttttctgacttcgttaggctacctccgagggcttgttttcaaacaagttctacattttaagagggtaagccagggaaataaatggactagaaactatgccctaccaggaatagttgaaaggctatcggggtggaaaggagagcaaagttaattctcaacttcaggggggcaggattggaatttatgggtagacataagaaggatatgtttttctatttcaatcaattaagaatttttgctttgtaaacacacataaaatggatatcatatactatttagtaatcacttttttcacttgatagagcatgtatatcttatgtaactatttgatatgttcatatgatttttaatggctacatagcatctctctgtatgagtgcactcttatttattaaaaccatccctgacagttactttggtcatttccaatttcttagtataaacaacaactctacaatgaagatatctcaaatacactcatcactgtgcatttgttgagttgtttccttaggacaaattcttagcagcaggacagctgagtcagcattggtactatttacttatggcttttgaatacttattgccaaactgcttcttaccagtaataggaaccgcatgtgttaaagaagtcagattaccccaaattagagatgttgtcataggattttggcagtgggttgaatgttggacagtgatctaaggctccttaaaaaatgcatgaaagttttagtgtaggaccagatgactgtttcatctagaactttcacatttcagtcttactatgtaagtcacactgttaaagaaaactgtcaagagtctgtaacagagaaaatactgcagacgttttctgtattcagaaagcactgtagaaattgaccaaggaagagaggctcatggcaggcaacaacgcaatgctgttaggttgcatgtatgatagaaatagtaaaggaatctttcagcagattaaccattttataacttaggtaagttggggttttccaagtaagtaaattgcattttctttttttttttttttttttttgagacggagtctcgctctgtcgcccaggccggactgcggactgcagtggcgcaatctcggctcactgcaagctccgcttcccgggttcacgccattctcctgcctcagcctcccgaatagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccaagtaaattgcattttctacaccctgccagagctgggtaacaactgcttctggggaagatgggaacggacaaaaagctgctctagatcatgttcccagtaaagagctcaaagtgattttgcacgtgttttatcctcatgacctaaagctcagctgcagtgagatggtgtagtgcactgagattatcagcaaaggggattccagcttcactgcttgagtaagccactgggcctctctgagctgtagtttcttaacctgcataggagatgaattaccaatacaagtcagagagttacagtgaggatttcctgagatgatatattggatagtactttctaacctgtaaaatgctttacaaatattagttgtcaagttagacaaccgatgctagtggagatttccaatttaaagctttctaatggatgaaagagctagtgaacttcatcacggcagaagttgggtctgattttgcttgattttgccttgatgtttggctcatagttgcaattcactaaatatttgttgaatgaaaaaaatgaaattagcatttcattgttttattaacacattagagaggcacccatgaaaatgtgtgcttctcatctttgtggagtaagtactgctattcattcttacaagcagggaagcagatccatcaattctcaaatcactctcacagccagattctgcatttttcaggtgatttctaattacatgaaagagattagatcaagtactcttttttggttatttaagaggaaagatggaaccaagcctgtgttctgtagctctattgtgtaaaatcacttcgagcaaatgaatgaaatattttgtcagactttttttttttttttacttactgacccttaatagaaaataattttatgtgtagccctccccagagtctctgttgccaggaagctaatgttgctatccctaatacggcaactttgtctatttttctgttctttgtgcattgtgtttggtcttaaactgtgaatattccattaactgagaactctgaacagccattgtgtaactggagtgatagtctgtgtcagttcaatgcattgtacttgagaataaacatgctgttttatttgtggtgggacttctctcattgccactagtaatatgttgttaactgaaaatataaggctattaataagcctcataagtactttgcattgttgaaacaatccttcagtgtaggatcacatgattttgtagatatgtatgtgtgtgtctatattttcaaataggcagtagacccattcgtttcttatccttgggtgtgaggtcagaagtgtcagtgaaattgagtccagaattgtagttatgcgtgctttcctagggagaggtttctcttctttttaatcagaatctcaaaattgctctatggttcagaaatgtttagggaccactgacgcagcaaattcagttcagcccggatagtttatttgatctgtggtgactgtgtcactagaaagtgatataaaatacctagactagcacagggcacacataggttctacacaaatatttgttggaaacccaataaaaatcactggtgctttttttctttcttccctgtaacacattatggcctgtgaacctctagaagacaggatctttgtcttacttagtctttggcagctgtgttaacttctcgcgtctgtctcctagtgtcatagaatgtgcactttctttctttttttttttttttgagacagagtcttgctctgtcgcccaggctggagtgcggtggcgcaatctcggctcactgcaagctccgcctcccgggttcacgccattctcctgcctcagcctcctcagtagctgggattacagacgcccgccaccacgcccggctaatttttttgtgttttttagtagagacggggtttcactgtgttagccaggatggtcttgacctcctgacctcatgactccgcccgcctcagcctcccaaagtgctgggattacaggagggagccaccgtgcccggccagaatgcactttctgtagcaaagtagaagttgtaaaactttttctcaccagacacccttatacatacaaaacaatctgaacatgtgtcctcaacgtagacacctagttataaattatatacgtgtacatatctctattgaggatatatgttcagattgttttatgctaatatgaaacatacatagttgcaatgttgagagatgaaaagtaatgttttagcatgtattgataaccatgatggctttatattaatattaaaagctatacctatttctgcccatgcctacttttggtgttctcataatctgagcatgcgctcagctctggctctttgcagccgctcttccacctcctaacactctttcaggagatgcccttactgttaactgcttattctctgtgcttcttaattcatattcttgagagtcagcatctaattgactcagttcaccttatcattccaggtcaactcatgtgagtctcattgacatacagtgttgtttttggcttctcttgggaagcccactctggtccacacaggtgactgcatgaagtgggaaatgaagacacttggcacagacatggctgttcaggtaacaaagagtgtgtgcagggcggcttcactgagaaggagcctggtgaggctggaatggtgactgctttcaccattagacaaatgtcagtgggtagagaagagagaccaaagtgtgactttagaaacagaaaaatccccttttcttcctttgcaaatccatacctatatattttgaagaccactaggcatgtcaggtaaactttcagcaatttaaattaatcagagagctggagaacatctattcctgttaagatctttcccacccattcaactccctgactagttactgctaaagagaaaaatggtagcagcttcatctttaagacttaagccatagttcttgcaatgggaaagtcaaccctaaagaatggtttcatgtttgctcccattctaccttgtgcagacagtagtttaaggatgtcttctgcagagcataacttgtgtagtcacccaaaagggtcttccagttcactgagaccatggtattgcagtaaagaaagagtttaattgacgaagaggtggctagccgcatgggagatggagttatcactcaaattaatctccctgaagttttgggggttgaggtttttcaaggatagttcggtggacaggggactatagaatggatgttgctgattggctggggatgccatcataggagtgtggaaaacagccctcatttgctgagtctgcctctgggttaggggccataggaccagttgagtcatgagtcgcaggtccaggtggagtcagccagtcgtcaaaaatgcagcagtctgaaaagacatctcaaaaggccaatcttaggttccgcaagagtgatgctatttaccacagtaattggggaagttacaaatcttgtgacttccagaacaatggctggttatcatttatacctacgcttttaacaaaacttttattttaggttcaggggtgcatgtgcaggtttgttaatatgggtaaactcgtgtcatgggggtttgttgtacagattgtttcatcacccaggtgttaagttaataatacatagttatttttcttcaccctctgcttcctccccaacctccaccctccattaggctgcagtgtctgttgttgtcctctatgtgcccatgtgttctcatcatttagctcccatttataagtgacaacgtgtagtatttggttttctgttcctgcgttagtttgctgtgggtgatggcttccagctatccatgcaaaggacatgatcttattcttttttatggctgcatagtatttcatggtgtatatgttccacattttctttatccactgtaccactgatgggcgtttaggttgattccatgtctttgctattgtgaatagtgctgcagtgagcatatgtgtgcatgcatctttatgatagaatgatttatatttcttttggtgtacacccagtaatgggatttctgggtggaatgggagttatatttttagaactttgaagactcatcacattgtcttccacagtggttgaactaatttatacttccaccaatactgtgtaaatgttcctttttctctgcaacctcgccagcacctgttatgttttgatttcttgataatagccattctgacaggtgcgagatggtatctccttgtggttgttatttgcgtttctctaatgatcggtaatgttgagctttttttccacatacttgttggccgcatgtgtgtcttcttttgaaaggtgtctgttcatgcctttgcctactttttaatggagttgtttttttcttataaatttaagttccgtgtaggtgctggatattagacttttgtcagatggatagtttgccaaaattttctcccattctgtaggttgtctgtttactttgttgatagtttcttttgctgtgcagaagccttttagtttaattagatcccatttgtcaatttttgcttttgttggaattccttttgacattctcgtcacgaaatctttgcccattcctatgtccggaatggtattgcttaggttatcatccaggtttttgagtattacatttaagtttttaatccttcttgagttgatttttgtatatgatgtaaggaaggggtccagtttcaattttctgcacatggctagccagttatcacagcaccatttattcaacagggagtcctttccccattgcttgtttttgtcaggtttgtcaaagatcagatagttgtaggtatgcggccttatttctgggttctctcgtctgttcccttggtctgtgtgtctggttttgtaccagtgccatgctgttttggttattgtagcccagtagtgtagtttgaagttgggtagtgtaatgcctccagctttgttctttttgcttaggattgccttctatgcctacatcttagcagaattcaggcccttctcataaccctaaccttgtggtgtttcattagctttacaaagttgatttagttttggaaagtgctattctcattcttgctttaaagttaaactataaactaaattttccccgaagttagctttgcccatgcccaggaatgacgaaggacaacttggaggttagaagcaagggtcagatatctcttactgtcacagttttgcaaaagcagtttcacttccctcttctaagtaccttctgcattgattggagccagcaaagagaacttttgcagcatttcttagtttgaatgtgccatataaatgaaacatgtttggaaatgtgaaaccaagtcatccatgagaatgttttcctctgaaaggcagcacttcttgataagtcccttcctcatggaactttggtgcagtgttggcccattttaaaatttattggttacccagggagatgcccgagcttatcagaattagagtctctcatttgagtacgttcttgcagtatagaagtttgcagatgttttataactttaagaggcccagtggtattgaatttagagttaatttttaaaactggctccaaagtcaccagcatggacaaaacttacagtcttccaaagagagagtgccaaagttcaacgcttggcattgttggtttttttttttctttgtgcccatatcaggtagctatgattatcttcattttacagagaagaaaacaaagctcaagagttaatttgactaaattcacagatgagtgaagtatgaggtagagagtgatcctgtgtgagaatagtttacatttatcttgatgtggttataaccactaccttatctataatgcatgttaaaaatcaacttctcaagattttttacaccaaaggcaaaaatattcaaatgttgatatagtcccttccattcatttttatatttttgtttaaaatcttcaacatcatacccagttttcaacctaactttataaagtaagcatttccttaatcttcataaacatgtttaagatatgtatcataatttaacaaattattaagtttctgaaatttttacagtagtgaggcagtggatgtatttatgtgtaagtctgtggggtttttttcctgtctctcccatagaggcagagacttgctctgtgacccaggctggagtgcagtggcatgatcgtcactctgttgcccaggttggagtgcagtggtgcagtcatggcatgctttaacctcaaactcctgggctcaagctatcatcccgcctcagcctgctgaatagctaggactacaggtgtgcatcaccatgcctgcctaattttctaaaatttttttgtagagacaaaatctcaatatgttgcccaggctgatctcgaactcctggcctcccaccttaacctcccaaagcactgggattacaggtgtgagccaccatgcctggccaaggttgattttttaaaaacattatttccttagtatgtgtatgattagaagcaaaattacaggtcagaagtcacattttaaaagatcatgaccacttaaaaaacccttaatatgttttgccaaatttatatcttttaaaaatgggatcgatttccacactcatcggggtatatttgagtatgtagctcactgtagacagagctcctggggagggaggaatggctctggtgctcttctacccacctgtagaggttcagctggggaccagctccactgtggggcattgggaggctgttagtgcagaggtatcttctcagtatctgcctgacacactactgtatccagctgcctgacccagtcctgcccacctgccttcctttcttcctgcctcccctctgttttatcaactttgtctcaaaaaacatagcttcctatctctatatgttcgtctcctatttatggtccctcagtatgttatagtgcttgctaaggtttgaatgtcccatgtgaatctcatgttgaaacttaacccccaatgtggcaatattgagaggtggggcctttaagaggtggctctgccctcatgaatggattaatccattcatggattaatggattaatgggttatcaggggagtagggctggtggcttttaagaagaggaagggacctgagctagcacactcggccgcctcaccatgtgattccctgtgctgcctccagactctgtcaagtccccaccagcaagaaggccctcaccagatgcagccctagactttggacttctcagcctttgtacctgtaagaaataaataccttttctgtataaattacccagtttcaggtattctgttataagcaacagaaaattgactgagacaatacgtatattctaattgtgttcacttttctttcatctagacttaccagaagtttacttctctggttggcttttcaaggaagcttttgaatttcacttctattttttctattaatgcattcattattagtgaagtattttgtaatcatttttcaaacagattgggtgttttttttttctcatttcaatatgtagttcacttatgttaattatttagggcttacatttttctctgttctcaaccttcatcagattccgtaacacttgatacgttgtaaggtttctgttttcattcattatacaccttccccaccccaggccttttcattactttcaacacagtctcgtattaggatttatgttttttaaaacaattatttaggagaatagaatagtttttttctccttgtattgggttttttgtttgtttagatgtctgttgtttctgtgatggctttgttttaatctgtgcttggagagtgctctctcattgctactttggagaatgtattattctttggcctagtatgattgtgtgtgtacatttggggacaaaatgtttttgtggagataatgtagacttaaaattttaaatccgtagctgtattttcgtcacaatgaaaatttgatgtccttagtaagccccgaatagaaagccttgacttgctttttgagcatagttaacagtgttgagataagagaggtttgctggcagttgcactgatggctgcactgttgtccagtgggcccagctgggtgtacagctcgccgtataaacagaaatctagacacaggtccctagaagcctaatctgtgacctagaccctgtctctgaggtactcttaccagaaagttaatctgttagaggatctttcatcagcataaaaggcagaaataattttctaaatgctgttgataaaatgtgagtgcatgctgcttcattcgattatggaaactgagcattggagacttattctcctttttaacaccacttgcctccagtaacttacactaattgtcatctataccaagcctttgaaaatttgtagtttttgtaagtttttaggaaatatgcatgctaattagataatgcctaaattatgttgcttttcatgtgaatttagtaaagtcatttaagacccgttggcttagtttttcatgagactttctaaacatgcttaatctctgcatactattttaataataatgtaagtttttgactttttgctattataatgggcagtgaatatatttgtgctgaaatctgtgtggaatttttttgaacatcattttcttactgtatattattagaggtgaaatgtttgggtcaggagttacaaacatatatatttttaaaaaactactctaaagatccttgatacattttgtcaaattgatttcttgtaaaaatgggaccagtttgcacctctgttgtggtatgagagagtgcccatctccttggggacctagccccttgatggttccagcactccatcgaaaaccagctccactgtggggtgttttgtgtgacatggtggtgtcatatgtcttctctgcaagaaaaggcattgttagcaaggcaaacagaaatactcgatacagttatgtataaaccagaggaagcctttgccagagagattgttgacaattgctagagggtatgataatgcagaagttacagagtgttcctttggcaacacgtgttaatggatttgttccagtgttggagccctttttaatgaaaattctcaacacctacactggaaaaataataaaataaaaagccttagtcaggaatgtattgcttgttaagatttagccaaggaagtcacatgttatttaacaaggtagattacttttttctttgtagtaggcaaggaaacagctatgcttcacttctaaataaaaaaaaaaaaaattttaaaaacgttttttaaaaagaaaaacgtgactaagataactgtctcattcccaggcactttttaatctcatataaatttacatttagagacttaacagtttggcttttttgaatgaatgccagaaatacagttggactatagagtctcagctgagaagcagacacatggagcaaggtatgttctgtcatttatcagaaaagttaaagaattcattttgtttaaaaggcagcacatagattattcagagagagaaaaatatgggtttataggaaaattcttatgtatttggtaaggactctgagtttgtactttagcttcatgtctcataaatcaagtcccaagttcaccaggtgatagtattcccaggttacttgtgggtgtaggtgcagaacaactcggaactttgtggttgggcatctttttctgccgtccaactttggaggttgctgggaggagatgcttattttccttttttagggcatttcagtttaaaacaaattaaaaatggaaagtcaatgttttccctccactaatacaactcttaacttatggttgtaataaacagtgattttttttttttttttttttctaagagacagggtcttgctcttttcccaggcttgagtgcagtggagaaattgtagttcactacagccttaaactcctgggctcaaggcatcctcctgcctcagcctcttgaacagctaggactacttgcttgtgctgccatacccagctatttcggatcatgaggtcaagagatcgagaccatcctggctaacacagtgaaaccccgtctctactaaaaaatagaaaaaaattagctgggcgtggtagtgggttcctgtagtcccagctactcgggaagctgagacaggagactggcgtgaacctgggaggtggagcttgcagtgagccgagatcgctccactgcactccagcatgagtgacagagcgagactccatctcaaaaaaaaaaaattttttttgtagagacagggtctcgatatgttgcccaggctggtcttgaattcctggcctcaggcaatcctcctgccatggcctcccaaagcactgggattacaatatggacataagccaccatgtccagccctacttttgcttttttgaaggacatgtgtgttaagcagaaatttctaaagtcagtgcattttttgcatcagaacatgttttaactcatgagttaaaacatcgctgtttctggcataacggtcttcccacatttccatctttatattaaaaatttctgaaataaaatttctttttgggctagaaaaaggtaagattggatcaagtgatccatttaggacttgccttttcatactttgcagtctcattactattatcacaatgtatgtcctaatacaataaagttgaggtttaaccaaaagttctcttttcttctggcatgctttgtgagaaaatatttgagctggtgtaaattgtaattactggcagatatggaagagagtctgacttggagtattcatgatgctgatatgctgctgcagtcagtcaagtgctgcgtgagttgatgtcattaccaaaggacagtctctataatcagagaataaagtataatttgtaaatgtggaggagctagaggaacaacttgatttcacttgtcactaaacttatctaataaataaaaatgaggatttattattattattattatttttttgagacagagtctcgctctgtcacccaggctggagtgcagtggcgcaatcttggctcactgcaagctccacctcctgggttcacgccattctcttgcctcagcttcccgagtagctgggactacaggtgcccgccaccacgcgtggctaatttttttgtatttttagtagaaatagggtttcaccgtgttagccaggatggtctcgatctcttgacctcgtgatccgccctcctcggcctcccaaagtgctgggattacaggcatgagccaccgcgcccggtcaaggattttttttttaaagccagaagtaatataagtcggtatcagtgagaaaaggtggtgaggatagcagggattaagtaagtcgcgggcattttatttttatcttaaagaaaatgttaaaatggttgacgttttctagctcaacactcccacccccacctcacccattgattgatggtttgctttcgaaatcctgagtgaaaagacaggaattacttcattgtgctgagagtgactgatgtcagaaggtcagttttcctacatttacaagattcatacacacttctgaaaggttttctgttagactgggtggactgtagatgaacagggcactttttgttttgtaattgcatttagctttaattagaggtttagagtagaaagctgagagttgcttggaggagccaaccaggagattaatgggctgtgcccatccgccgcagctctgtgcttccaagaagtttgccagggtaacctggatttgtctttattgtactggaaggagtcttgtcctgtagaagtagaaatcactgatgcatcactaacatcatgtggcctttgttctctgccgcacatgtttgaaaagcgcagctcgcacccactcttcccttaggaaagggggccgaagctctgtacctgtaacattccataaaggctaaggatcatgaggatgttgagtgggcagggccccagcggtctttactgaaataccagagcctgcactctgataatgaatgaggctcgagggaacattcctttggcatattttaatgcttgacctagttgactggggtgctctgggaaaatgagcctcacttcctgcttttccaccttaaattgaagtatggggtgctctgggaaaatgagcctcacttcctgcttttccaccttaaattgaagtatgtcatttatatgattgttaatattgaaatgagcagctgtaccactctgttctcaacagggaggaagcctttttatttgtaatgtttgaaaatattctttctcagccgcgcgtggtggcttatgcctgtaatcccagcactttgggaggctgaggcgggtggatcctgaggtgaggagttcaagaccagcccggccaacacaatgaaaccccatctctactaaaaatacaaaaattagccaggcatggtggcacgtgcctgtggtcccagctacttgggaggttgaggcaggagaatcgctgaccctgcgaggtgggaggttgcagtgagccgagattgcaccactgcactccaacttaggtgacagagtgagactccgtctcaaaaaaaaaaaaaaaagaaaaaaaatattttttctttttttaagtgtatatattttttaagttgaaacctgtgtttgccttgtctttatgcccacaggggaacttgaagtcattttacatatcaaaagcatcttctcaggttattctgaattttgagaaggctaacatttgctaggctttatgtttaaaaaaacaaaaacagaaaaagatcctgggcttctcccatcttgcttggcaaatgaggagtctagggtacttgtcttaaatgttctgacatatttcaattaaagcagtgaacaatattctcaaagacaaggcagcagctgatacttggtaatgtccttaaaactgcatagtaataaccttcagtgagatttgtataatttggagataagctccacttatatctgtaaagttaaagcacagagaaagttagtacagtatttgcctgaggtcagtcacgcagttggtgacaaaagccactattcttagtacttcatgagacttctgttttatataatagattacagaggccaggcacagtggctcttgcctgtaattccagcactttgggagactgagctgggaggatcatttgagcccaggagtttgagaccagcttgggcaacatagcaagaccctgtctctacagggaaaaaaaaaaaaaaaaagccaggaatggtgatgcacacctgtgttccagctgctcaggagactgaggtgggaggattgcttgagcctgggaggttgaggctgcagttagccatgatcatgtcactgcactccagcctgggcaacagagcaagaccctgtctcaaaaaaaattaattacagagatagtgttctagttaatagcaaggaaagaatggcttaagcaataagcttggccgggcacagtggctcatgcctgtaatcccagcactttgggaggccaaggcgggcccgatcacttgaggtcaggagttcaagaccagcctggtcaacatggtgaaatcctgtctctattaaaaatacaaaaattagtcagatgtagtggtgtatgcctataatcccagccacttgagaggctgaggcaggaagatcgcttgaacccagtatgtggaggttacagtgagctgagattgtgccactggactccagcgtaggcaacagagtgcaactgcatctcaaaacaaaaaacaataagtttaatgaatgattcccaaagtatggtctatggaccagcatcattcacatcatctgggaacttattagaaattttaaatttttaggccctatcagacctactgcttactctgaaggtgggagtctaggaatctgtgtttttacaaagccctccacatacttctgattcatgataaagtttcagtaccactagcttcataccatccttttataattttatgagtttaaatgctcagggctgctgagataacatacccttgggtcctgagtgtatacaaggtaagaagcagctggcagcctccttgaaggcccagcatagacaaccttactggcctcccttttaatatacagataggtaagaaagcagaagaggaaccaatatttgctctgctaggcactgtgcctatctttcccacagttcccttgcatttagccctcatgccaatcatatgcttgtcatagtgtgctccttatatgttttgggtacttcatcattttctagttgtaatctcagtcttgagagcaggctcagacgtttgcttcgattctttcactggcaatcacggagacttgacattgtttcatttaggggactgtacatttcctcatggggcatgcagtttgtgttggagatacagaaagcttcatcttgaacttggtgcttcttcctggaacagtaattttatttcaggtttgtgggagaggaagaggagggaccttgttttttttttgcaaaccatgacattccctgtacgtaccatgtacctggtgcatgataaataactgttaaatagatttctatactattaacagaaagcttgtattgtgtccggaattggttccttcaggtggtttcttggtctcactgacttcaagaatgaagccatagaccctcacggtgagtgttacagttcttaaagatggtgtgtccggagtttgttccttcagatgttcagatgagtccttagtttcttccttccagtgggttcatggcctcgctgacttgaggagtgaatctgcagacctttgcagtgttacaggtcatgaaggtagtgcagacccaaagactgagcagcagcaagatttattgtgaagagcgaaagaacaaagcttccacagcatggaagggaacccaagcgggttgcctctgctggctctggtggccagattttattcccttatttggccccgcccacgtcctgctgattggtccattttacagagtgctgattggcccattttacagagagctgattgatccattttacagagtgctgattggtgtgttattacagagtgctgattggtgcatttacaaacctttagctagacacagagtgctgactggtgtgtttacaaacctttagacacagagcgctgattggtgcgtttttacagagtgctgattggcgcgcttacaaacctttagctagacacagagtgctaattggtgtgtttacaatcctttaactagacagaaaagttctccaagtccgcacccgacccagaagctcagccggcttcacctctcagtatcatctcccagatagcttgtgcccacccttcagacttctttgtttaaggcagttattctcaaaatgtcccttgaccagaaacagcatcacttggaaacttggtagaagtacacattctcaagttccaccccaaacctcttgaatcagaaattctgagggtagggcccaggaatttatgtttcaacaagtcttgcaggtgattttgatttatgctagcatttgagaaccactggctttacgcatgagaagtaggattttaaaattgtactttttattataattttctgggaaagtaaagctgtttcacctgtaaactttgggaataggagcaccctgaagctcacaatggcatcctgcaaagccccaaagagtgctagttgttgatcattacctgtgcacacatcattccctcactcagagcccagctaggaggcctcctttcaccttgtaaccaggtcacccctagatgtgatcacttcctccacaagaactgagagagaagagaagaacaccagaggatactgaactggccatactggggcttatggtttaaagggcagaactgagccaaatgaggactcctcagaaaattgctttctcgttggatcaccccagaaataaatcagtaaaagcattcaccttttgttttatttgcttcaaacaaagtaggaaacattcttcttgctttatatatctagataccaagtaaggaagtatgatttggattcttgagtctctttattttatttttcaactgtgtgtgtgtgtgtgtgtgtgtttgcctttgctaagccatggagggtaaaaaatgaaatatattagcaacattgttgacatggaccacagacaattaaatgtttcatttcttattaatcctgaaagaaaaagccttttttttttgttgggcggcagggagggggtgcagtcctctatacaaaaatcttaaaaactaaatatatctattctaattgttttcccctggaacatcatcatagtttaggagtatatctcaatgttgattttaaaaaataaatatgtaaacagctagatttatgcactgttaaagcatcagtgcaagttttaggaaaaaatcaagcatgacaattgaaaataaaataaccattactaagttggactcttctttaccctcaagaaattgtacttggatgtttatgggagaaattattccaaatcctaccagttctgtcagaaaactaatattactctacataatcattttctcccacctctgtataatatttaacttttatttgaaatgtaggctcaagctatgctaaaaatcccatctcgaagatgacgagcttatccatggggaggggatggagggcagagcactctcataactctaggaatttgactgttatatcttgacttaataaatgtctgcagctgaaaataggaaaaattgactatatgcatgtttgaacacatagacataaaaaatgccagctgaagcagagtattccgcatgcaagccaagaaaaatcgggttcagtgaggcacagtttggcagggaaggcacactgaagctgcagggatgggaggtctagtaactggggaggtattcagttgagggctggtgccctccacgtagccttccccgacccacccaccctgggtctgcttccctctgcccccagtgtgggctcccgtagcacagctgggtattagcttggtaatggggaaaggatggtattcaactgggaatctttggcttctaggaacaaaacaaacttggggaggatgttatcaggatactgaagtcctccccaaaatccaggatcttcagagaaaacctaagaatcaaaaatagaaaagcacaggaagttgaaggactctgtctctgtgtgttgtccctgcttctctcagctccatcctcacctttctgcactccagctctgttgtgtcgtccacagcatgcaacacacagatccagctccatctggagcccgcctgtcagctcctcagccccaattttaaaaccctaggggagaagcatcttctcagcataggtctcacatctttatgtggtccagtgagccatggtgggggaggtaggtgggtgcagggaggcagtatgggaggtccacctctgaccctgtggcccagtcagaagaccccaaagagaggagtagcttgcatagatggaacaaaagcattctccctatgttattccgttcacatgttgctgtgggttcattaaccccacacttagaaagtaatcatctttggctctaagaaaatctggaggttggacctgaaaaacctcaggccagacagtgaatcagtcctggattgtgctgaattttctaatatgactccaccccatgaggcttcatgactgtcagcatctgctgtctccagtgatgctgtgtccgaaattggtgggttcttggtctcacagacttcaagaatgaagccacagacccttgcggtgagtgttacagttcttaaagatggtgtgtccgaagtttgttccttctgatgttcgtacgtgttcagagtttcttcattctggtaggttcgtggtctcactggcttcaggagtgaagctgcagaccttcgcggtgagtgtaacagctcttaaggcggcgcgtctggagttgttcgttcctccggtctggagttgttcattcctcccggtgggttcgtggtctcgctggcctcaggagtgaagctgcagaccttcctggtgttacagctcataaaggcagcgcggacccgaagagtgagcagcagcaagatttattgcaaagagtgaaagaacaaagcttccacactgtgggaggggacctgagcaggttgccactgctggctcaggcatctgcttttattctcttatctggccccacccacatcctgttgattggtcaattttacagagagctgattggtccattttgacagggtgctgattggtgcatttacaatccctgagctagacgcaaaagttctccaagtccccactagatcagctagacacagagcactgactggtgcatttgcaaaccttgagctagacacagagtgctgattggtgtatttacaatcccttagctagacataaaggttctccaagtgcccactagactcaggagtccagctggcttcacctagtggatcccgcactggggccgcaggcggagctgcctgccagtcccgcgctgtgcgcccgcactcctgagcccttgggtagtcaatgggattgggcgccgcggagcagggggcggtgctcgttggggaggcttgggctgcgctggagcccacggcatctgggggaggctccggcatggtgggctgcaggtcccgagccttgccccacggggaggcagctgaggcctggtgagaattggagcgcagcgctggcaggctgacactgctagggaacccagcgcaccctccgcagctgctggctggagtgctaagcccctcactgcccaggggccggccgctccaagtgtggggcccgccgagcccacacctacccagaactcctggcctacccagaactcctggcccgcgagcgttgtgtgcagccccagttcccacccacggctttccctccacatctccccgcaagcagagggagccggctccggcctcggccagcccagagaggggctcccacagtgcagcggcgggctgaagggctcctcaagcacggccagagggggcgccgagagcaggcaagggctgacagcacgttgtcacctctcaatgcctatcttaaacagaccctttacatggcattggtggcaagtgagactggaaattctttgtgaaatgcttgcatgatacaagagccttctcgtaaatctgttttaaaagtgtcctttattctgaataccattttgatccgtgatccactgatggaagtcaatgatgttgaactaagaaaatacataggttactagctatgaaccattcttcattagtgcacttgcttggtaatgggttaatttgaattgggaatgaatcttagtccacaaactagaggtgcagagaatattgcagtttgctaaatagacttaatcttgactttaagcttctactgctttcaggtagcagaaagattcacctcgattattcttggatttctttcccatatcaccctcccagagttgtgccaaggttccaggctttactaatgtcatgatgtcaggaaggcctgagaagttatccgtttacaccagtccctactgcttctgggctgcatttgaggctagggagggtgctttgtcagcatccagccatcctcctggggttgctgcacacctcagggtgcagccagagtgcaggtatggccatctgccactcagagtttcacagtcattcacttccaagatctcccttaagtgtgagagatcttgctatcttctcacctgcttttctcctcaagaaggtaagccagagccctcgacccttgtgaatgaggaaatttcagagagaaaaacattggaactccccctgccccagagttggtaactgctcaaatgctggctgccgccaggtggtgcaagaggcgctgcttctctgtggtcacctagcagcagtctcctgtggccagttccccacgtagaggtggcaactgcccttcttcatggctacttgctggaggtttgtgggaggaggggagtatggggggtgtgtgtggctttacctgccccaaattgtcaggaggatttgaggcatttctttgttgttgttgttgtttggctgtttccaaaacccatttggaaacctgttattccgtaagagtagccttcaaattcttaagcattttctataaatcttcagtgaactaataaaagtatttccttttcccttttctggcaatgggtagtctagttctgttaatattcctgcaaagaaactcatctaccagcctcactcacactgtgcacttttgccctcagaatcctcagtggctagcctaattgactacaaccagtttagatgatcagctaccttccttttgccattatttcagatgctgccttgcccatagcacaaccaatgcatttaaaaaataaaaacatttggggtgggagaactatgattaaataaaggagatctctgtagagtatggcaaagcttgcacacaactttaataaaaatatgctgtcttgagtaaccagcatattacagaggctctgtgaatgcctcttcatctagaatttcagtacaagctgtacataaaatatttatacagcacagtgtgctttgcccctcacaaaagcgtgggttcagatgtacactgttactatagacgtcactaacatataagccggtgaagaacctttaatgtatttgtaatgttagcaaagtatctgtcatcagattaaacttgtagtgactgataatgtagccttggctcctagccaaaaatattttttttgatatcagaatgacacttaatagtaaagatatgtcatagaggaaggggaagaagagaatttactagagaaacttaaaagactggttggtgcagaacctagtaacttggtttgtggctggcagaaatgggagtagtccctgggattacttctaaggaggaaattttactacaaacacagctgggaataattctgttaccaagtcttttttaggatcaatacagagcttatttgtaaaaattaaaatctaactatcactttattgtctatgggtatctgttacattttatctgtaaaagaggaatggaaatgcctgcctagtaggttcatcataaggactgagaggatacgggaccttattaagtcctcagtaagtagcagcaattttgcttttgtttttatgatgattacttccactcatgactttacctgcatgttctttaatcttcaaaatagattagtgaagtagtgatgtttccattttagaaataaaatacgctggggaaacgaattgtaatacacatgacaaagcttaatattagtatccttctatgaaggatccctcagtatccttatataaagatcctttatggctctaatatgcttcagttgattttgttccttgtaggcaaaagtttcaataaatatactgttttctctccattatcaaggatatatggattaatattaatatataaatatataaatccattatatagtaatatatattaacatatacttcctttattaatatcctggatatatgaaattaatatcttggatatatgaaaaggtattccagatcaataagatgaacacagtagtagaaaaatagagaacatgaacaagagtgtaaaaaggtgcgaagtgttcaaccccaaagatatgctaatcaaaatttaaaaattaaatctatacaatacaatttaaaaaataacattacccattgttagagggggtgtggaggagtgggtattgtcatgtgccactgggtcaaacattgtgtagggcaaattaacaatatcagatcctcacattttctgtacatttgaccttgaccttatcccaggcaaatacttgatggtatagtgaaggatatctttctcagcattacatatataatcaaaaataagaggtgacttaagtgcttcaagggaatttattaaaatggattattgatcagtcattaaaaatgaaagcatacaagactattaaatggtacagaatttctatcagaataagtgggaaaaacaagttacaagtaatatcatatgatttacttttagtgaaacttacatgcacttacacatttgtgtattatgtttatgtgtcatgcatacatataaaagtggaaggcggttcaacaaagtgctaattatcctcatgatttttattttttctttgatttttatgaacttacagtaaagaacaaagtactactttgaaggaagaaaaattattttttaataattcagcataaattacataggttatccaaagatagtaatatggtatttgatctgaacctagacttctgttctgttgatttgacacattttggtgtctttccttttatgttaaataagtaactatcatttacctacagcagaagaagaatataacttagcatttgagacttgataacatagagctgttgaatagttctgtaagatttgttagggaaccaaaaccaggcatgtgaggatggtgctggaagagaaaaggcgggaagggtttgcagtcaactgtcagttatcttcagctttcaggctcgctgcacatggacaggtgaggaccaagggaagaagagcaagcttgggtatttggttgagctgttaagttcagggttagaaaatgaccagcacaaaccttttggcttgagagccaaagttcttggcaggaagtctctgcttgtttccgtttgccttcctcccagtttctcctcaatgccttgcagtcagcatcctgtatctgccattttgaaaactgcccttaggggtcatgagtgacccccttccttattgttaaacccagtgacattttgtccttatctgcagcatttgatgtgttactcaactctctttgggcttgtgtgcctctccacccttgtggttattctcctgcctctgtaaccactcagtgtcttcttccatgtcccttgacccttcactgtgtcttctactgattccccttagaactttcatttacccctggagcttcaaccatcatcttcaggtaaaactctagcaacaagtcatctttgcccgctgtgcatcatccttgctgccattgagagtttggtcttaaaatggtacttgcaattagaacacgttcactttgtcacaaaatctgacagacattggacatacttagaattcatatctggcttcctgagacagctgtcagattgtctaccaatggtctacccattgatgatggaacaagctccttgtatcagcctcaaataaaaatgatggaattaataaaagacgcttaccttaaggcacaaaggcctatgaatttcaaaaagcattgacagaaccgatccaaaaaatatgtagtttgtaaaaactctaatacaatccacactgaagtaaaaagcttaacttagaataatccaaatagtctttgtcagctggacagctaatcttggtgaacatggaagagtagacaataatgttaaggcattgtgtgagggttaaattgtttgcgaggtcggcattgctggggcttcggattcaaactgggccttgaaagagggggtaagaaaagtctatggggaactgatgggcacaaaggcagggtgtaagtgtttgttcttgggaaaatgatcagactaatctgattgaatagaagacgtttattggaaattaaaggaagataaagtagtgatagataatggaagaactgaaggtcaacaggggagtttatatgtgatggaagagaaaatcattatcactagggatgtagatgtaagaaaacgttaggtttggaagttataagacaagagaacttcaaagtttgtgggattctgtaaggtgggatgggaataagcaatattgttgagtacctgctgtgtgatctgtaaggcataagatgtcattattattttacagcaagctttggagtagatgtactagttcccattttatgcatagtgagatggaattttgagcagacatacttgtctaagtttggcagagtggctggaccaggattcatgcccagtgacatctgacttcaaagcacagtgaggatggagaatgttgagaccagttcttcattttacagtcaaggggatgggcccaggcctattcaaggttacaggaataggatgaaagcaatttctctgtaagagagagtggataggctgtgatctgcagagggtccaagttagaggctcttgttataaacagatgaggtatgccaaggaagttgggttcagcagtgtgataggagtgaaaaagaaggggtagagagcagctggacattcggggaaagtggtggtgactgttagtggaaggtaatgacgagagagatgacttgaaaacagttccgaggttttagtcccagggaactgccattaacagttttaggagaaaagccatgtgtgtgttatggagtggtctgagtaagtatgatagacattaaaaaatacataaaaatagagtggtatgcatgtgctgaattatgtttgtactaccaaacacacggaggaggagaacagaacagaaggtggaaagctatgagggatccagcgcttttctttgcagtggtggagagtcacgagagcaaatagctagcctttacctaaagcaaaagggactctttgcatgatatcttaggctcccttttattctggcctgcccctgcacccccagcaggaaagtggcttaactgtactttgatttccaaaatgcgtagcagtctctagtattgattcccctctcctgcagatctcaagcctaaaaatgagtattgttccattacatttccctcaaaaacatttctttttcctttcagaatgatggtcactatactggatggacttctgaactagtgaattactttcatcttttgatcacactaggaaattgtccacggagttgaaatatttattgcagtaatttctggccttacataattaagataacatatcgtttttttctttataactatcatgaagttgtcatgtttgtttcctttaactttgctttttagaggtacgaatctgttccctagtcttttatgctccaatgatctgttcagactgctcttgatctacaaatgtatgattgagaaaagacttttataggatgaaatatgagcaagctgttttactctgaagaataaaagtgaattgtattactctgcagattaagtcaataaataccccattttcataaacacaatatgcacagactagataatactagggaaacttgatacatcaaaaggagtattaagactgaaaaaaatggagatactcaatttattgcaggctttattcaataaacctagaaaatagagagtttaaatcaaaatctgttactctgtttctagagataatcaatgttaaaattgtactatattattttccaagtttttagaatatgtgcatgtgttgttgtgttagctttctctatttttgcaacttgagtaacatttattacatgcttgtgctgtgccaagctaaataccaagcattttatatatattaatttattctcataacccttggtacttttattatcctcatttacacacaggacaattgaagctcagagaaattagccaggcacagtggctcactcctgtaatgccagcactttaggaggccaaggcaggcagatcacttgaggtcagaagtttgagaccagcctggccaacatggcgaaaccccgtctctaataaaaatacaaaaattagctgggcgtggtggcacatgcctgtaatcccagctactagagaggctgaggcaggagaattgcttgaacctgggaggcagaggttgcattgtgctgagattgcaccattgcactctagcctgggtgacagagctagacttggtctcaagaaaaaaaaaaagaaagaaagaaagaaatgacttgcccatgttcacatagctggtaaacccacactggttcagaacttaaaccagtgagataccaaagcccatatcagtgggcttttttacatacttcttttccttaataaaatgcttatttcttttttctacagcatcattttaaatgacagcatagtattcagttatatggaaatgtaatggtttctctatcccatctccttttattagacatttatattgtttcttgttatttacttttagaaataacattgcagtgaacatctgtcatgcacatctatgattatttccttaggataaattgccagaagtggcattgctgaacaatgatagaatgtagcactcaggtgttgatgtattctgttaatttactctgttgatgtactgttttctcgaaaggccacaccagtttataatctcagtagcagtatattgaagtacctggtaactttcagctctcagcaacattggtagttagcaatttgaaaaaaaaaagtgtttgtttttaaaaaacattctaggtattcctttttaagtccatattatctcttgcctctaatgctgtagtagtcatgatctccttactggtttatttctatctagcacccactttgccactaacagaatcggatagggcacggactgtagagttagatgcctgggttcaaatcatgactgtgctgtgcctcaatttccccgtaagtaaaatgaaaatagtaataaaagccctctggtaaagtactttagaacagtgcctgacttttggtatgtgttcagtaattgttggcctactagtattgtcttccagaagtccctgcttatatgattaaaaaaacccaaggttatacttgtttttgaattgtaattattaccaaatcagtaaatcacagtagaaactaaagtgctgaccttgaagcattgttagtgttaacactgtgaccaacctgaagatcacaaattaccttccgtgactcagttgatgctgagaggtcagggatagagtaataacaggaataactagaatgttaaagtgctttatattaagctgccagtgcacttccacacacattatctcattcgatcctcacaacacagctgtgaaggagatggagcgggtattattaatctcatcttacagaggaggaaattgacttggaggattaagtggcttgctcactgatggttgtggaaatggtcagtggcagagctgaatgtgtactctgggccttctgactgtaaatacttactcttgatgcttcataacatcatgataagctaaggaggtgcaggtgtagatgcccaggtctggagatttgctggaaaagaaggagcaaaagaggatgccactgggaggagggagcagagttggggtaaggaaacttagatatactaaaagagagggaggtacccagcggggagagaggtggggaaggagtcataaagaaagggaaaaacagggggccaggacttccgtgactacagggctggctgaatagatcagggtggagggcttcatctttgagactgaaggaatgcgtcccctgagccaggaaggagggaggagatggagcaagtagacacaggtgatttgaaatagaaaggaacattaagagggctgaaggattgtggcctgaatgaagaaagaaggaagtatttatttctggagagtaaaagtggtaggtttggggttttagatttgagaaagggaaaccatttagagtatctgtgtgggaaatgggccaaggaattagaaatgcctgccagagacctctgcaggatgcaggaaggacccagataaaaacgtctgggctccaagtcgacagattctgtgaaccccttaggcatgctgaggatttccttgccagatgatgtaactatctgaggatgtttctttgtgagctcagtgctagacaggcacaggagcagtattaggatggaaacatttcttaattgcttgaggagtgaggaaaaaaacggcactctgcaataaccctcttgtttccaaataccaaagcagctgttgggctgtgctcctgtctaggtaccttttcctcaggagttaagtgccacatgatgatatttatggttgctttttagggggtacatggttttttaattagtgaagaccgagtagcaatagttttgttttgtgttctaatagcctttgttattatagtcagggaggtgaagtgaggagatgatagatgctttcctaatctgtgaaatgaggagttggactaggcaggtgctccccaaagtccctttctaacattaccattttctcatccaactccagtctacgctgcctcctctccatttcctcctttaccagacagtttagtgtgtctcaagttatattttatggtgctttagatatatatatgtatatttttgcttagagacttcatgcattattattagagacttcatgcagtatgtagtgactgtagaaaaatgaaagatgtatcgataaataaaagacctgttaaaaatatgtaactttaccaccattaaataaccactgtttatattcttccggagatttttttttttaggtgtgtatgcctaaataagattcttaaatacagaaatgcaccctgcttttctcagttgaaaattataaacctctctgcttatcagtagtcactgctgtgtaattattaaaggttgatgaagactctgtttcaggaatgtattttaacaaatctcactttggacatatgcattaatgtacattcttctaactgtatttgtgaggctgctctgaattattttcttataaaattaggaaagaggtttaatatataatacacattgcctggaagactgaaccgatttacagttccatcaccagtatgcgagaggtctcttttcccacacccttaacattggatagtggagtttaaaacaaacaaacaaaaaaaccttaccagttttatagacagatgaacatcttttcatatgccatttatattcctttgtgagttttctgttcatatcctttgcccatttctccagaggggtatttgctatttttgttactgacttgcagcaacgagattttaaagatttaaaatttttaaatgtcttttattataaaagtatgttagttgttttgataatttctttgaatttttatactgcttttaaatgtatataaatatttaattttaggttgtcaaatctttttctttatggtttccatataggctaactaggaagtaagaatgccttggtatttgttgcccattgtcagttctttacatagcagagtaatctctttcaagtgtgatcacatcttggcatacccctgcctgagctcgtcatggcattcttgttatcatggcctgcagggcctggcacgatcttgcttttcctgctgtaaagccccacctcttgtcactcacccttgaacactatgttccagccccactggtctcttctcagtccagggaatatgccaacctccttcctgtccctgaaattctgcaggtgcagtttctttgcttgggaaatgtgtgcacacgcgcacacacacacactcttttgagcacttgtcaatatgcaattatttatttatttttgagatgcagtctcgcctaggctggagttctgtggtgcgatcttggctcactctgcaacctctgcctcctgggttcaagtgattctcctgcctcagcctagcaagtagctgggattacaggtgcccactacgacgcccagctaatttttgtatttttagtagagtcggggtttcaccgtgttagccaggctgatctcaaactcctgacctcaggtgatccacccacctcagcctctgaaaatgctgggattacaggagtgagccactgtgcccagccacaattatcatttcttattaacttactcttttcctgtttccccctccagcctgtaacaccataggggcagggaccttgtctgtgttgaccacagcgaggtctctagtgcttaacatgtggtatttgtaggagatcggtcagggtggtggaagaaattgtaggaaaagatgcaaaccttcttggaagaggttttgcaaaagcttcaaaaaagggtttggctgaaggcagccaaattctcttacctggagcctgagagcaaaggttagataataaggggatgtaaaggaattgatctagataagttagtttacttaggcctcagaacctggcctttaatcatctgtgcgcaggactgctctttcccagggagcagcgggaagccgggggagggggaaccatgttaattacccacaagtgtgttgactcaaagactttgtcattacatccatactgaataaatgcccgcagcactggcttgtcagggccacagctgctatgactctttctttctgtgagcaccccgatcccctagtccgctctttcactggatacctgtgtctaagtacgttttttcatccatcgctcagccagaatctgccggtcagacctggcaagtatttatagaagaaatgaatcaatattacatctctaaccacaagattgcacaggcatttaactatatttaccttattgtagttttatggtttcatctcacattttaaaatattttatctgtatgaaacttagtttgaaatgtgacttgagataggaattaaaattaatttctttcccaaatgaatagccacctgcaatttttgtagttcttgtttattagagagtccttactcaaagtatagtccttaagcactattatattgttttttctttcttctgtttgcttttctctccttgggtagtcctttgtgcaaaacgtaaatgcagaaactgctcattgacttgagccaaattgctcatgagcatgctggttcaataccaagaaagatgatcttggcgtcacccaccatagcctaccttctaagaagaaagaagacatcatgtgactgacttagggagttgtactatttgttcaatatctaatgctagtagacaatcttgttttagataattctggccgccagtttttttaaactgttggaacctggaaatttgaacattccagtgactacctttcctaactgcctcttatctctagatgtggaataaaaatcctttggcagaccatgtgttccagtttttggtttggaaaatatggattattattcttttccttattttaactctgaaaattaaaattaatgacaaaagtcagatgtgcccattctcacatattcaaacaataaaacatacagacaaaaaaaggattcttgtatcccactttttgatcctattcctaatataaccactgctgagtttattgtatatactttcagacattttttatgcttagtggatatattagatctttatacattccccccccccatatacttgcatttttttttttgactaatgtcataaactttgttatacacctcagtgggatttaaaaacacctgaagcctttgttttttggctggtggcaaaaaaaccagagtaacttagagaagttacccattgatgttttcacagggctttaaacacgaagacctgatttgtttgtgtaaatcgttggatgtaatcttacagaggaccagggcttgagcaccttcagaaacatggtatcatctgatcatgatgatttccatcccacgacagaggaagaaatggagactccaaagggacagaagtgaattcttccaaatttatgaaaatgaacacttagctaaaatgtgttcactgggttatgacaagtaactggacttctagggaatgggatggcaggtggggtgctatcagtttataaaattttttgtaaccttgtctcttatttctgcttccctcccccagccatgggaacacaagataaatttggagtaggtgagggtggagagcaaagtgactccctgggctgtgcccttcacactggttttagaaagcatgcagctgactgccctggggtctgatctatggtgctgcgctcgagagaactgtaaggtctgctgtaagtgatgggggctgtggacttatgcagaagtgcacttgttgggggttttcacagtacccaccttattatactagagaggcaggtttcattgcttaaggggacaatttatggcaataggcttatctccttgttttagctctttatgtttttctgcctttaataaaatgtgaagtcacaaagcaattaaatagtagtgtagttttcaggcaggaggtggagaaaggctaactagggggaaaaggccaacatgattgacagaggctggctggagatttacattgagaataactcgttcttcaaaactttcttcattttctggtgagaattagggacaaatcatataccagaaggatggatgattaaaaatgtaggagttatgatttctttttgactttgtaagtctctaaatcctccaccttaacatagagttctcatttcaaaatgggaaccagccctgccagagactaaagtgagccagaaatactctaaagtcttaaatagttaataagtgtgagattgtttatattttgtaaaatgtcttaagatacaatgaaatggagaatccctgagtgtttttttgatttcctaaactctgatccacaattatagatgtgtctgaaggttcaaaaatattgaacgtgatttcagttgtttctagaatttaaaaaaattaataatttttaataatgacactttaaatgaggagaaggcttttaaaaccaaatataaaaatctggagagttcagattccctgtctctcctctttcaacctttaatgtataaaacaaatccttttgattcagccactgtgtattgataatggcttatttattacaatcagaggaattaaacaaagatatgtagatactttgtcatcttttcttattatagaaacagtttgattttaagaatttttattcagaacgcagattcgaaaagaaaaaaaagaatttttagaaaagttgccttttaatttaaatttcttgttttgtcctaataatcacattgaaatagccaaaacaaataatataaattaaaatgcaacgatggcccggcatggtggcacatgactgtagtcccagctactcaggaagctaaggccagcagattgcttgagcccaggagttcaagaccagttggggcaacatggtgagaccctgtctctacttttaaaatgtggtgattggtacctgttgagagaagggttaactgaaagttattcacatggcccagaaagtggctgaaaagtgctctttctggtgtgaatttctcttgctgtgaaagcactctgaaggggagacctaatgccattgcaggagcacttcagctccaaacttgagcgttgcaatcagaacaagaacccgaggaaaagcctgcaaaatgagcctgctgcgatatagggtgtgcttttggacagttatacataagaatttttttcttttttcttttttcttttgtttgagacagtgtctcactctgttgcccaggctagagagcagtggcgtgatcattgcttactgaagcctcaaattcctgggctcaagcagtcctcccacctcagtctcctgagtagctgggactgcaggaatgcaccaccacatctggctaatttattttttgtagaggtgaagtcttgctttgttgcccaggttggtctcaaactcctggactcaggtgatcctcctgcatggacctcccaaagtgctgggattataggcatgagccactgtgcccagcctcatgagaagatttatgatgatagatagaagaattattaatttccacagtttgacaaatgataacaaatagcttttacagtttgagcatcccctatcccaaacgcttgggactagaagtatttcggactttggacttttttgaatttgggaatatttgcatatacataatgaaattccttggggatgagacacaagtctaaataacaagttcgtttatgtttcatatacaccttatatacaaagactgaaggtaactttatacaatatttttaataattttgtgcatgaaataaagttttgaccgcattttggctgtaacctgtcacatgaggtcaggtgtgaaatttccacttttggtgtcatgtcagcattcaaaaagtgttggattttggagcatttctatttcagatttttggattaaggacgttcaacttgtatgccaaattagtaaatattttttgagttcctacccacatccctgtgtatgggctctagaagcagccatggtttagtttcctcacctgtaagggagggtgtagaacttcttttaatgtacatcactgtaggttaagttcgggtagagaaaagactaaaggcaaccaaggctggctgtcctctgagcccctatgctaagctgaactaggcttttgtttctggcaatggatcattttgctgtcacggagccagtgattatttaccacccctggttttgagtaggtttccttttcccctggcaatagctcttagagtgtttcacagagaggcaacgggattcagaagatgcccgtttacactggtaccactgtctcgttatgtcatggtaaagtaatgaagtccaccatcattactttaccagttccccattggtgttttggtcttccctatacattttttttaacttttatttatttttaatgagatgaaattcacataatataacaataggcagtttaataattgacaattcagatgtatttagtacattcataatattgtgtagctgccacctctctctagttccaaaacatttttgtcactacaaaagaaaaccccgtacccagtaatcagtaacacactattctctcctctctctcatccctgacaatcattaatctgctttcagtctctatgaatttacaattctagataccacatgtaaaataaatgttctcatacaatatgtgaccttttgtgtctggcttctttcacttagtatattcatccatgttgtaatgtcttagccattttatggctgaatagtccatggtacggatatatcataatttgtttatccattcatctgttgatagatttttgattttttccccaccttttaattcttatgaataaggctgctatgaacatgggtgtgtaagtacttgagtccctgttttcagttcttttaggttcatacttagaggtgtaattgctgggttatatggcaagtctgtgtaacctttttgcaaaactgttttccacagggccaaaccatttctagtcccaccaacaatgtacaaggttccaatttttccatatccttgcaaacatttattttccctttttaaaaaaattatagtcgtccttgtgggtataaagtagtattttattatggttttgatttatattttcctaatgattaatggtatttatctttccatgtacacattggccatttgtatatcttctttggagacatgtctgttgaagtcctttgcccatttaaaaattgttatttgttgttgacttgtaagagtgctttatatattctggatactagacccttaatagatatgtgatttgcacatagtttttctcatttttaaggttttctttttttttaatttttatttatttttttttagacagagtcttgctctgttgcccaggctggagtacagtggcaagatcttggctcactgcaacctctgtctcctgggttcaagtgattctcctgcctcagcctcctgggtagctgggattacaggcatgcatcaccacgcctggctaatttttttgtatttttagtagagatggggtttcaccgtgttggccaggctatcttgaactcttgacctcaggtgatccacccgcctcagcctcccaaaatgctgggattacaggtgtgagccaccacccctggcctccctatgttttcttctaagaagttatgcttttattttttatacttaggttgttaattcattttgagttaatttttcatatggtatggggtaggggcccaactttattcttttgtatgtagatatctagttttcccagcaccacttgctgaagagacagtatttccccatttgaatggtctttgtacccttgttaaaaatctattggccatatatgtgagattttatttctggactcttttttctattggtccatatatttatccctatactagtactacaccgtttttgattactgtagctttgtagtaagttttgaaattgagaagtgagagttcttcaacttttttcttttttttagtgttgttttggctatttggatccctttcagcttcatacgaatttaaggatctgttttttcatttctgcaaaaagggctgttggagttttgataaggagtacattgaatctgcagattatttggagtaatattgtcatcttaacaatattaagacttccaatccatgaatataggatgtatttccatttatttaggtcttattcttcagcagtgtcttgtaatttccagtgtgtaagtcttttgcctcctgtgttaaatttgttcctaggtttttttgttttgttttgttggttttcttttttttttttttttttttttttttttttgagacagtctcattctgttgcccaggctggagtgcggtggcacgacctcggctcactgcaacctcctcctcctgggttcaagcgattctcatgcctcagcctcctgagtagctgagattacaggcgcacaccactacgcccagctaattttttgtatttttaatagagatagagtcttgacgtgttggccagactggtctcggactcctgacctcaggtgatccgccctcctccatctcccaaagtgctagaattacgggcatgagccaccatgcccggccatccctaggtattttattctttatatgcaattataaatataattgttttcttaatttactttatgaatgatttgtatttattattattatttttttttttttttgagacggagtttcgcttttgtcacccaggctggagtgcaatggtgcgatcttggctcaccacagcctccacctcccagggtcaagcaattctcctgcctcagcctcctgagtagctgggattacaggcacacaccaccatgcttgactaattttttattgttagtagagacggggtttttccatgttggtcaggctggtcttgaactcctgacctcaggtgatctgcccatcccagcctcccaaagtgctgggattatagttgtgagccaccacacccggcaagaaatattatttttattttttaaaaaataatctctagtggttattttaaaattcaaggtaagaaccccactattcctccaaatattctgtagagtggtctctgttaagtttgatatacatccttctacatgttttccatgcatttatatacaaacatactttcttactgtgaataaagtcatatactttgtctaaattttaacttactattttacataattatagattgtgtctttctctgctagtttacttatttctcttaaatgctgcagagtaacccatcatactgatatgctacgtagctgacccttgaacatcatgggtccacttatatgcaggtccacgtgcaggtctgcttttatgcagatattttcaacccaacatggattgaaaatagagtacttgagggatgcaaaacttgcataaagagagaattgacttttcatatacgcaggttcttcagggctggctacagaacttcagtatgtgaggatttgggtatttgcaggcagtcatggaaccagtcctccttgtatatcgagggatgactgtactttgtttaaggctttattttaatgatcatttagtgtggtgttggtgttttatagtataaataatgcaacagttaacaattttatacccacatcaacgtatgtccatgtaagtctttaaggtaataagaattgctgaggcaaaaaaaattaccttaaatttttttaaagttttgtgttaggcataacacataatttactatcttaactgtttttttaattgcacaattcagtaatgttgtttacattcacattattgcgcaaccagtctctaaaactctttttcatctttcaaaacaaaagcgctatatctgttatacaacaactccccacccccctcttcccctggcagccattctactttctgtctctgtaattttgactattctaggtacctcataagtggaatcacacgctgtctgtctttttgtggctggcttattttacccagtgtaatgtcctcaagggtcatctatgttgtaacatgtgtccaaatttcattcctttctaaggctgaataatattccattgtagcatcacattgagtaattaaatgcttggaaagaaagaagaaaaagaagggtatgtctgactcttttcattcccatacaatgtggtaacatacgtaataatctaaatagaatataaataaataaaatgaagtccttttaggtatgtgtatgagctatataaacaggtatttttaaatgcattgtggatccaacttcatattagtaggtgaggaaacaactagtagcacataaatgcttcttgggcttcttgcacacttgccctccatacacctcacctcatgcccaacataactttcattatccctccacccattgctggcagtcatttttaaatagctttggattttatgccaaaagatcttctacttgttgacagattctgtgaatacccagtgttcgcttcttttgcactttccaagaaagatgagtttgggaatttgctaacatgttctaaagttaaagctttttgttctgggataactgaaaagtttagttatccaaaaggcagcccaccttcatttttcaggagggtcactgtgatgttctgtctttctgagtctcatgtctcatacctttctgtgctctgtcataattaactaaagcagaaggagggagatccttttgtaaaatgcccaaagaaaagaaagccagatggaagtgaggagtaagagtaaccacagttgctttcctcttccatcagtctttaaaaactttttattttgaaataatgttagatttagagaaatgttgcaaaggtagtacggggctcccatacccttcactcagtttctcctaatgttgttatcttacataaccatattgaactatcgttaatataattatcaaaattgggaatctaaattggtctaatacttccagctaaacaacagaccttactagcattctatccagttttccgctatcctttctttatgttccatgatccaatccaagatccacattgtattgagtagttctgactctttaaactcccacagtttgtgacagttccttgtcattccctgtcagttatttctggttagttattttgtggaatgactagatttggggctgtctgatgtttcctagtgtttacctttaagttatgcttttttttgttttgaaagaagaccacaaaagcaatgatgtatcttttttattgcctcataactggttacttgatgtcagtttcccttattgctagtgctattcgtgtggactcatcatggacagttacttcattctgtgggttataacccaatattatcatcattattttcttcttcaaattattctagctttggccactgggagctccttcaggctgactctgatgtccttttgacatgcttccatcttttttcaagtacttcctcacattatggcatcccctgatgctctaggctaatcttgtattttccttgccctacttttggaatcagtcacttccctaaggagcctgggtccttttactggacaatggtgtttagaaaccaatatctgagtaccagacgtgcacattgcaactggggtggctttttgtcttccatgagttttatggtgagctctttcctgtgaacatggttgtaccaggtctgaaactcgtttttaacacttctaggtagtcagtcactttgatgtaaagtcattttgatcacttaatgttgagttgttaaaatcaatgcacataccctgtagaaaaataggttctttatcaatggaatagattaactttttgtggaaaaatacttttacattgataggatagcattagcatccagacatttttgacattccttcaataactattcctgagtttctgactctcatttttagcccattccatttttatttattttattttattttattttttgagacggagtctcgctctgttgccaggctggtgtgcagtggtgtggtcttggctcactgcaacctcccgctcctgggttcaagcgactctcctgcctcagcctcccaagtagctgggactacaggcatgcaccaccatgcccagctaatttttgtatttttagtagagatgtggtttcaccatgttggccaggatggtctcaatctcttgacctcatgatccgcctgcctcagcctcccaaagtgctgggattataggtgtgagctgttgcacccggcccccattccatattttaatgagaatatcttttggttagttatagaggtaaatacctggatttacaatgtgtaactacagattcatcatcctataataaagtaactctttttgcataaacttttgataagttatttttgtccttataattttatgtgtgaagtctttacggtcagaggacattgacaaaatattttagattgaaagcctgttctccttgatgattcagtataacttcttttgactgcgcttttagttcttgcaaaatagatcttgtttagatgagattccagcatgactcctttgtaatttttcatatttttgctattacatctcaactcttgaagagctatttctgtgaaaaccaaacatgcagtcaaggcacattccacgtgtggctgatggggttatcatagttacaaatcatatttatccacagtgataattatcttccttagcgttttgttctacttcagagctcatttgtgggccttaccacctgtttcttacatatggggaaagagtctcttattctcttttggaatatagatctaagagtagatttatatcaggatttgaaagatgaatctttttcaaggatgtttttcctctggaccgtggcattgtgtaagaaatttccctactcatcccatccctggggcacattaatttggagatgatgttaaatgtgtcagagtgtggcacaaatctcaactggcagataaagcctagtattgaattgttttcagttcagaaacgtggctggctgactttgaccctgaatgtgtaaattatctttgcagcaataagaacttgaagtagctttgatagctaatcatagtatgataactcagccagaagaattcactaagagcagtttgtgtgtcttccatctaatgtaaaggttagtaatgtaagtcatattcttggtgcctttagacctagttatgcagagagacatcacattgacattcagtaattcttactcttaacagttccttaactctaaaatcatctttttccttacctttccctagttctagaacagcaaaatattttacttagattctatcattaattaatatactcgtttgaatttttctcttctaaaaaatgtaggccaggcatggtggctttacacctgtaatcccaggactttgggaggtcgaggcgggcggatcacctgaggtctggagtccgagaccagtctggccaatgtggcgaaacccaccccgtctctactaaaaatacaaaaattagctgggtgtggtggtgtgcgccatagtcccagctactctggaggctgaggcaggagaatcacttgaacccgggaggcagaggttgcagtgagccaagatcacgtcactgtattccagcttgggtgacagagcaagactctgtctcaaaaaaaaaaaaaaaaaagtaaaattattttggccttaccatgcttggtttctttgtctttgttttttcattcactttatgtttggggaggagaatggagtgtcagtgatttcagcaaaaagttggggtaccagttcataataaattagtgtctaagattaatgttacagctgatattcaaagtaccaaatacgttattgttctgattattctggtccttaaatttgtctctttcctggagacgtggtaaacaataatgatgattctaataatgaccatttattgaatgagcactatgtgtcagacattgtactggtgatgtggtttggctgtgtgtccctacccaaatctcatctcaaattgtaatccccacgtgttgagggagggacctgatgggaggtgattggatcatgaggatggtttaccccatgctgtcctcctgatagcgagggagttctcatgagatctaatggtttaaaagtgtttggcagtttcacccttgcacccatgtctctctctgtctctcctgctgtcatgtgaagaagaggtccttgcctccccttggccttccaccgtgattataagtttcctggccgggtgcagtggctcacacctgtaatcccagcactttgagagaccaacgcgggcagatcacttgaggtcaggagttcaagaccagtctggccaacatggcgaaacctgtctctactgaaaaaacaaaaattagccgggcgggtggcgcacacctgtaatctcagctgttcgggaagctgaggcaggagaatcgattgaacctgacagatggaggttacagtgagccaagattgtgccactgcacttcagcctgtgtaacagagtgagactctctcaaaaaataatgataatagtaagtttcctaaggcttccccagccatgcagaactgtgagtcaattaaaccttttttcttcataaattgctcagtctcaggtagttctttatagcagtgtgaaaatggactaatgcaattgggcaatgtctgacagtttgcaaataccatctcatttgtttttaatagaaacctcctgctgagagtggtggctcacgcctgtaatcccagctctttgggaggccgaggcaggcagatcacatggtcaggagtttgagaccagcctgaccaacatgatgaaacctgtctctactaaaaatagaaaaattagctgggtgtggtggtacgcgcctgtaatcccagctacttaggagactgaggcaggagaatcacttgaacgtgggaggcagaggttgcagtgagcccagattgaaccactgcactccagcctgggcaacaaagtgagactccgtctcaaaaaaaaaaaaaaaaaaaatctaatactagccatgaggaaagataatcactctcagatagtaaagcatttgcttagccatatgttaagctctgaattcagatgaaggggcatctaaaacaggcagagagcatcaggaagggcttcctggaggagaaagtgcgtacactcagtctttaagagcacgtgggaggaaaaaccagtgaagtcctcctgctgtagacagaatgatcagcctgggcaaaggtgtagaggggtaagagagcgttaaacatgaggcagctgtgtaatattgtttcctgtaatctcttctgtacaggtggagaggtagcaagagacccaaatgatgaatggctgtgagtgccatgccatagcaaaattctgggttttaaaagagaataagcatgatcaggctggggatgttgaggaggggaaagaagggggatagagatggagaccacccagtggcccgctctccctcagtgctttggattatggggaaatgaacagagagccactgtgcccagattttattatgggttgagcagtgatcaagatgggagagagaaatggtaatgggactaactggcccatacaccagatggcatttgaggggaaggccgggtctgtgttgtcagggggccctgtgttctgactcccttcccattagaataggtggtgattaaacaagctatgccacaccctaaattctggttctgggttttactattcagtcagttttatcaaattaagatgatcatgtcttcccttctgaaaaattataggggaagaaaaaccatagaactttcccccagtatatagcattgaattacacatattcctacacacacacacacacacacacacacacacacacacacaccactcacacatatatacgtacatacatatataatagaatttttatataatatgtaaaattttaaaaatatatatttttagaagggctgggggtggtgggggcggtggctcacacctgaaatcccagcactttgggaggccgaggtgggcaaatcacctgaggtcaggaattcgagactagcctgactaacatggtgaaaccccgtctctactaaaaatacaaaattagccgggtgtggtggtgcatgcctgtaatctcagctactcaggaggttgagacaggagaatcacttgaacccaggaggtggaggttgcagtgagctgagatcccgccattgtactccagtctgggcaacaacagcaaaactctgtctcagaaaaaaaatatatgtgtgtgttttataaacctataaaatatgtgtgtgtgtgtgtgtatatatttatatatttatatatattacatatatatatatgtttagaaaataaaagatgcagtatgtcagtgctttcttatgacagttgcagctacaaaggaagattaaagctttttaaaaagtagaatttttatctgtttgtggagaggactgaaaccagtaagctcttgaaatgttttcatcctctcatcaaatatatatggacctgccatatgccaggtactgttcttactactgtggaaatagcagaaaggaaaaacaaagtccctgctctcagaaggtttagaatgagataaggcaggctactgagttggcttaaaaactaagaggaaactagtgaagtgtagttgcccgttcacatttttatttttttaagtattttatgcccacggaaaactgtgggactgggacttgaattctaattttatgttttcttgggttattctttaaaacagggtcttagactagtaattaatacagtgtcactctctttcaccttcctcaattcctttgcatgcttgttaggtcattcagagtggcactaaggtaaactttggcatatcaaaatccacttgaaagcagatggttagcaaggggcagtgacttatgcctgtaatcccagcattttgggaggccaaggcgggtggatcacttgaggtcagaagttcaagaccagcctggccaatatggtgagaacccgtctctactataaatacaaaaattagctggtgtggcgacgcacacctgtagtcccagctatttgggacggtgaggcaggagaatcgcttgaatccgggaagcagaggttgcagtgagccaagatcgtgccattgcactccagcctgggcgttacagcaagactccatctcaaaaaaaaaaaaaaaaaaaaaaaggagatggctatgcttgttaaacactgtttcagttgagtacctctcctgtgggcttgttggttcttgtgcagattcctgctcctgcccaagtccaggactagctgcacatacctgcacatgtgcctcacccagtccaggacggctagccttgttctcttcacccagcccagcagcagagtgctaggaaactttgctggcagggctgtaagaacctctgtagtttcttcccatttccttgttctcctaacttactatgctgggaggaaataatatggtgtggtaacgattttaggcaaagaaaaaaagcgccgaaatggatgtggtggtaaaattaggccaatcttttggaagcaccttagcaacctcctttcatgttcttggtacctttacctggttgtattgtaatgttcatttttccttgtgaacatctctctgtgtgtgtgtatgtgtataatttatctagtaccatggaatctttgaaggaaagactaaaaaactttcagaattattattattattattattattttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgaaaactttcagaattataacaataagtttcatttgttgtatagcacattctacgtgaccatagaccaactctcctttatcaatatttgtgtattctcttaaagagctaaaagaaatcattttttaaaaattctttatatctaatgttggccaatgttacctataagaaaagatcattgtttcagagcatgtgagatgaagatgattgactttagggcatttacatgtgggaactgtcaaggtagttgaagtttacaagagtgggctctctctctagtcacttcgggaggaatgccatcatcaggacatcatcacgactgactgatttggtcagtctgtctttcatcaagtcagggagataaacagaattgaaaaattgttcacaaaggttgtcagttattagggtgtggctgacgaaccacacctgaagagctacctagatgaaggcaactcacagagttacttaacaacctccaccccagttgatggtccagagtgtttccaagggaggtgaactaagccaatgttgagactgagtgggataaggccatggtgacatgcataatagatgcattcatacacattgcttcaatagagcattttcttggatggaagcatgggaaataacacatgggcgtatactcacgcttgttgttagctttcggggtcactgctgatatccttccttgttcagttaccctttgggacttgaactcctgcaagatcgttgaaaatcttcatgttctcagaactcaaagggaagaagacttgacccctaacccttcagaaagctggctgaaaaaaaaaaagattgtccataaatagcaattggctttacctagtattatttaccacattattaaactgctaattgcagtggtgtttttataatgccactatattattttaatttagaaaacattttataagtttattgtttgtaaattaaatagatttgcttaacagttctttgggaattccttaaactttattgctagctacaagtcctttttaaatagaatcaataggctgggcatcgtggctcacgcctgtaatcccagcactttgggaggccgaggagggcggatcacctgaggtcaggagttcaaaaccagcctggccaacatggtgaaaccccatctctactaaaaatacaaaaaattagctgggtgtggtggcgtgcacccttagtcccggctactcaaagggctgagacaggagaatcatttgaaccccaggaggtggaggttgcaatgagctgagatcgctccactgtactccagcctgggtgacaagagtgagacgctgtcccaaaaaataaataaataaaataaaataatgaatagactcaatagacattgatcctgctaacatattttgccttttaatctattggtacttcttttattccctttaaagttaattctaaataaaggagaagtatcttaatttggttaatatcatagtttggaactatggcaaaattattttttctcaggctactttctagtaagtattttatatttattcactaaagaaaatttttaaaatttcaaattacgtagaattgtaccactctcacatagaaatgtttttatctttcttatacatatatttatgtggtttgatttttatttggaatgcttgttttacttgaggtgtcaggactttccactcatttatgaagcctttacaattataatgataaatactgttacattaatgtacaataatttataaaactgactttctcatgtttaaaatttagatcgtgtctaattctttgctactttaagtatcattgcagtgaaatcttcaggccataataagttacttccttgcgataagttcacaggaataactagattaaaggtatgaatacattttaatttggttgaacacttacgtttatcaaaaactctttacaaaagtaacacaattatcctaataaattagaatattagaagtatataagatgaaaaaacattctcactgaacttcagtcctgctctccaaagtgaaccatgatgagaccttaagcaaatgttatatataatgagaaaagatagtcctgaagaattgagtgatatggaagtgataatggtgtactatatgggtgaaaaaataaagtactggtttagatacatgatttaagaaatagaatcctgacagttccctctgtggataagccatagaggtgtccagtgttggtttaatatagcagctggtttgaccgagtaccctctgctgcgtcaggtaatgttaaatgatgtccatgcccccttgactctgatcaagacatggctacaacctgcagtttccagctttcctgggtttaagggccattgaagaatccttgtagataagagaagaattgtacattccaggaactggaggcatagctagccttggaaagctcggagggttagttgagacagctttagacttgcacatctgtgacctgagtatctttgagacttgatttcatcttctagacccagaggcagagatcatgtttgtggttatttttctgggaactgagactgggcaaagggaaagaggccagtacgcaagagtgctgtttataaatggttaacatcgtccccagtcccgtagaagaagaatgaaatggtattctcctgtttggtggttttatttgattgtttttgaattctttgtctctgacagaaggcatcttctgtatcctttatgttgtcactcactttattactctggcattattataattaggttaccttatcactccacctgccagccctatctccatccccaagacctgaagggacggttggcttgacatgtgaggaggttttttggccttcagagatgtcgctgtcagccccctgagttccatttgttagtattgggtccagcccacagctttctactaaaaacaacaggcaaactaaagaatcttttagtaagtcacagacaattgtcactgaaccaagagcccagcccacggggccagttcctcaccgactctatgccttaatttccaatgtgtaagcttggatgactacacttatctccaggattcagtgtaggacatagaaaaaagtacaggactcaagtaatgattgaacttggaataaaaaccttaaggcccatgtcctctgtctctcatgcttttcagatgtgtcttagtgcctgctccttgcacagaagctgaatccaaacaagccactgaggaagttacatttcacttcacttcttaataacataggtatgtcgatcccattagataggagtgtgtctaaaattcagaacctttgacactaattatctgactgtcaaatgacagtgtcattctattttgcaggcatttttgatagtttatcttcccagtaatatttttgtaatcttcatcaccttgaccatctaactcttttttttggagacaaagtctttctctgttgcccaggctggagtgcagcggtgcagtctcagctcactgcaacctccgcctcccgggttcaaccgattttcctgcctcagcctcctgagtagctgggattacaggcgcatgccaccacacccggctaattttttgtatgtttagtagagatggggtttcaccgtgttagccaggatggtctcgatctcctgaccttgtgatccgccagtctcggcctcccagggtgctgggattacaggcgtgagccaccgcgcccggccgaccatctaactcttatgtgcccttgcctgtacatataaaagtacatttaaaaataggattggctttcatttgcataatgaacacacatattacccatagtacctcccacacaaagccacctatgcctcttaaattgcactttgttaataggaaactatctgttgttttgtgcttttggcagctgtagagaaaatacacaaagccaggtgttgtggctcttgggtaagactgagaatgtgatttttgcaatctgtgtttttttaatagccagttattggagataagaaagagaaattcagtacaaagtctaagatgtcccagtgatgcactctgactgggtgtcattatctcaacaggaatgaatgtagttcaacagtatgtaggcccggtttcttagacatgatgtctgctgaaatggtgataaggtatcccacattatcggtgtttttttgaagacagcctttagggtttcagtgtcatcatctttatgccttttgctaaaacagtttatgttctgccttttagtaagcctttatgttaaaaacgtttcatattaaaaaaagttatcatttggaatacataggtcaactatctaggaatgggacaaagtacagaaacaatgagacaggatttgtgggatgagaaattaaaaaagcagtcccttcagctgaagaagctgcttagaaatttaagccggacatctcaggcggccatactggaatggaatgtggaaaaggtagcagttatatgtgagcaatacctttgactgtgacactctttcgaaccccagtttagaccagcagcagctctcctaatggggagtcaagaagtagtaagagaccctaagagtcatataagacacaaatcacctttgcctgtgatatttgccatacatatgcctatggttacatgcagaggatcccaacaggagcatcatacacacagcaaataacactaatgtgttttatttatatgtaccaaattaaaggggcatacaaaataaaatttttaaatgagtgggtgaagatattgggacagaaggaagatatcaagaggaggaaatatggagtaaagatagaggtagcatgtactgtaaaagatcttgtaagtagaccagaataggccagtaatttggctccatgcttcctagcagccaaggcaaagaagtaattgtgaccagatacatagttcacagcatctttaagattcagtaagctagcaactcaagaaaagcacaagtagtcaccatatagggacaagtggaccatgctgtgaacagcacactagatagcaagtacagctgtaacaatcgttgctggagatagagcagagcttcagtcctttatgacaagcttgtccaacccatggcccacaggctgcatgtggcccaggacagctttgaatgcagcccaacacaaatttgtaaacttcttaaaacatgagatttttttaaagctcataagctatcattagtgttagtgtattttatttgtggcccaagacaattcttctagtgtggcccagggaagccaaaacgttggactcccctgctgtatggaaaatcgaatttgtttacattctcctgttgtattcatttttgaaattttgctaattcctaaaaggaatccacagagagcaaactctctattactaacttttttcctcttctcaatgtaaattaagtagtatttcaaatgagattaaaaacaggatacttcttgaactttactttaaaaatacaggttcatgagccccttaagttttgtgactttctgttgtaaaaaagactgtattcactagatggcagtgtcaccagccttttgggaagttaaatatgagtgtgactgtcctaagtactaaacatgggtaaaagtaggaagaccatttaactgagcataaaggatctcatttctgcgccctacaggaaagagtagttctcctttttctcctcccctcttatttgaggccgggaagaaggcgctgtgcatagcgctccaagcatctctgggtggcactggagggccatttttcacaaggagcaagtcggccagcagagtgctcagttcttggtcatgccagtggctgcagggtttccagccacttgtccttgcttctttgtttctgaactttcagtccggggcaggagttactgacaagagttcacaaaccagctgtgagataatggtgtattgataaggtacaaaagtgtgtttagcagatggggataatttttcgaccctcagtgtttgtttaaattgtttctagcatgaaagcaatatgatctctctcaggaaatgagattgttttctctattcaggtaataggatcttttacccatttccatctttgaggagtgattatatacttctgcagtttttttaaatgaaaaagatttatttttaaatcatactggcataaagttaatggtattttgttaaattttaggatttttacagcatatcttggctgacactgatcttggtcctatcctagtggcaatctcttaacagttgtgctgctggtgttatgagtaggacagttcctcattgtgtgggactgtctcgtgtgcggcagggtattctgcattcctggcccttgcccactaaatgccggaagtgcccctcagacatgactgcccagtaacactcccatgcatttccgtgtgcctcctggggtggggccagtactctctagtgttgaaaactgctgggctagagattttggtgtaggttgtgggccttgtggatttagtgaacatgatcttttaaagaaatgtatataaatgtactttatatttttaaaaaatcactacagcccatcaccttaaacttctgctcattcatatttatatatgtattctgattgtgattactcctacatacaattcttaatatagtacaaaattgtacatatataattttatggtacccatcccccccctgccctttttttgagacagggtctcaggctggagtgcagtgatgcaatcatggctcactgcagcctccgtttcctgggcccaagcaattctcttactcagccttccgagtagctggtaccaaaggtgtgcgccaccatacccagctaatttttaattttttgtagagggtctccctgtgttgcccagactggtcctgaactcctggcctcaagcaagtcctcctgcattggccttccaaagtgctgggattatagtcttgagctaccgcgcctggcatagtatcatctttttgataccaacatactataaatatattttattgcattttatttgaaactgttaatagacacataatttgctgatgaattgtattctttgctcttttagtccatctggcatcatatgctcttcctttttgctagaattccctctttttttctttctacagaagtatcactgggtgggagaaagccttacctgtgatggtttgagtacccacattttaaaattatgctagttaagaagagggggaataatgttgtttcttttctctttttcttatcaaatagactaaaaaggctactcaagggctggaatttgattcccacttgttcttgtggtacctagcacagagtcagtcccatagtatatcctttaggtaaagacttaattaattggtgtgctttcagtttattttccctggttggtctttgcatttgtccagttaacaccagcttctggatattagatcaccataaagtccaagacatgaagaacaaatgttatatattctctttgacatttaaagacagaagatagtggtagaggagatcccaagtgatacctaacctagctaaagacccatgaggaatgaaagaacgaacagggaaaacaactgctgaatccaggtggaaaaatgctggcctacttctggtccttggtatgccaggatccaaaggtggtgccagctgatagcatatgttcaacagctgtgttgatgccatttgcctgcccagacaagcctcttgaggcatgaaagcctaaggaaggtttctcatattaaggatcaacagggactcttctgtatccgtcctaccagtgtcacctccccacccagcatcagccgagcaccacatccactgaagctcaataaagaaatgtttaatgctgaagagtttcaatcaacaagatgaaattttcaggtttaggtaaacttaggaactggcttgggttactagacttccaaattttatccggtcctaccttattgcatgacataaccgtgaggactaaagtgaaggcttttcagcagtcacttcagtgagtcctcagcatttaggtgatactgtatcaactcgtgtctgaagcaacttggatttaagatagtagatcttgtgctgattattagaatggacatcctgaacaccacttaaattaccatcaaactgcatagccagatctttaatttacgaaacctctattttgtcacttctccaagctgtcatttaagctaaaagctgctgtctttacacatataaatcaaagaaatatttcatttatattcacttgatacctaccaaatttcaccactggaatttctgaatactttatatcctctatccttccatccaggcttggctttactaagtgtcctttctaagccactcattatcaatcaagatagtaattattctgcaagaccccaaatctcagtggctttcaacaacacacactgatttttttactcatatgctacacgtccattatttgtcagctgcagctgtgttcagtgttgacctcaacctgtgatggagcagcctctgcttatgtcgctgctgttctttatagcagaggaaggaaagaaagcaaggcaaagttccacactagcccttaaaacttcttcctggaagtgagacatggtatttctgctaccacttcattggttaaagcaagtcacaatgccacacccgagttgagtgagggtggggatatgtgattcttccttaggaaggagcaggaaattttggtgaatagtaatgtaatctaccacatgtttaaaatgcagtcccttctctagaagatctcagtagtctaagagagaataatttttttttaatatactaccgtaagtgaatgttaggtcagttaggtcgatttttttttcattcttgcaaggaatcattatgtctaataaaatataataaagagtttatggtatatttgaactgtccttaatgttattttactgagtccagttcttttggcagtggtttagtttctttaacaatctgtattctacaacttcactcgttgccttccttgtttaacatttatttttcaaaaccagacatgtcttttgtcttcaaaggataaatggaattggttaggagaaggattggggaggaggggggttgtggcaaatgtctaaaacctatgttttattcccttattttctcaaaaatgttagctcatgttcacacgggtttatctgtttagtctaagaagtagttacttttgctgtctggccaaagaggttcaggaccctggagctttgttctttgggaccctgaaggcagcctggcaggcagagcccagtatcacctttacagctacttgatggtgatcaagagccagctgctcttctttcacctggctgttgggggaggcacaccaatatgggtgggcaggaaaagttacttcccaggctgaaattttcccaccgtaaacttaggctgataggctgacagtctgcacctctcttcctcagcagacattccgatcagcaggccagtttgtgacgcgtgcatgtgcacacttcagattgcttcttccactttcctctttcctgctcaggtttctcataggagtaggctccatgtaagacttctgtcttttgtgaaaaagaaagcacgtatttatagaatggaatttcttactgaaagagggtgcgggcagaatggaggatgacatgaatcctgactcagtaacatttatggaaccactctctggatgccacacttactgtgggcagttaccaaaaaaatcagtttggcctacctgcctcctaatataatttaccctgcacacaaggcagtatcttgaaggttatttcagtagtacccacggaattctgcttcctttaggtaaggaaaagtattcccaagaacaaaatatacaggttaaagcccatgtaatataaaattatggcattcattgaagaaaatacaggctattctaattccagatcacatttatttatttatttacgagacagagtctcgccctgtcacacaggctaaagtgcagtggcgtgatctcagctcactgcaacctccacctgctggttcaagcaattctcctgcctcagcctcccgagtagctgggactacaggcacacgccaccacacccagttaatttttgtatttttactagagacagggtttcaccatatcggccaggctggtctgaaactcctgacctgaagtgatctgcccacctcagcctcccaaagtgcttagattacagtcgtgagctaccatgcctggccccagattacatttttaaaatgaagaaacagatattttctcttagtcaaaatacttatcggaacaattttttttaaagcaaagattgcatcatttaaaaaaacatattcactcctaggcatctgaatcactgcttcacatgcacagtagacattcgtgaaattatttttttaaatgatgatgaatgccagggcttgctttttttaaaaaaaagtctccaaccacaacatccaaactggtcatttgggaagtgatgcttccattcagtaagaaagctcctgcacactgggtgaacaggcggtgttttctcctctcatcgctgacatttaatacctgtcttgaggcaaaattgtctccaccttattaatccatggctcctcacgagccttaaaacagagaataaaacttgtcaaagaagaaaaatagaaaattagagaaaataacctcactacttattttcaggcaccttgtgacttaagaaaatgtttttaaatgtggactctacattttatgaacttaaatttagtgtctgttggtcaaaatccacaggacctttaggagagaaaatggccataactaagtacaagcctctctttttaaatgcttacccaggtcagttaaaagcttccttgtagttctgaatcctcagttcttgctttacagccaatacttaaaaggaacaggggagagctacagtgcttttgaatttcagagaggcctcttatttgtgcctcaagaatagtttgtataaatgttatatttcaagccacacagtacttaaaaccatcacactgtttagtttatctagttgggtagaagagggggcaagagaacaaagcagtattaaattagggcagcagcatcagggacaggctgatgtgagagcaccttctttcttgggatgggtagagtataattgtccctttgcctatcgtcagatttgggtggcccagttgctttaaattttgaaaacatgggagtattaacgcaaagaagagccaacattagttcagaatagctgaattcatcattcttttggaaccagttttgctactgtataatgataatagctcttcagcattcatctagtgagtgataaagataagtgatgatccacaagaaagtttacctttgacttgtgggtgctcacggactgcagaatgcagatgttcgtagatcagccgtactgtaattttcaaggatttaatatgcaatacattcctatattaagatgttgaaacattaaaatattaataatttgcaatgatttttaaatactttaaacaggctcttccactggtgagattgtttttccaagcagagttagctagtttaaattctttcgttgtggctgggtgcagtgactcacgcttgtaatcccagcattttgggagtctgaggcgagcagatcacctgaagtcaggagttcgagaccagcctggccaacatggcaaaaccctgtgtctactaaaaataagaaaattagcctagtgtggtggtgtgcgcctgtaatcccagctgctagggaggctgaggcaggagaatcgcttgaacctcggaggcagaggttgagccaagatcacaccactgcactccagcctgggcaacagagcaagactcccatctaaaaaaaaaaaaaattgttttgttgtattctcagttgtctatttcaggtctaggcaggcaagaaaactttgtcaggtacactggtgtcttccaaaatgtgcatcgtaccctctattactcagtgtcattaatcacatccattcctttcccaccctgtcttggaataggacattaactcttcaacgatctgccccctaaataaaacctgctttcttgggccatagtaaacaacacgtaattctttgcgagaaaagcaaaatagtgataattataatttttttttttggaacggagtctcgcactgtcacccgggctggagaacaatgaatggcgtgatttcggctcacggcaacctacacctcccaggttcaagcgattctcctgcctctgcctcctgagtagctgggattacgggcgcctgccaccacacccggctaattttttggtatttttttagtagagatggggtttcactatgttggccaggctggtctcaaatgcctgacctcatgatccagctgccttggcttcccagagtgctgggattacaggcgtgagccaacttttaaaaattaaaaaaatttttaaaaaccaactttttaaattttcaaaaaccaattttaaaaaccaatttttaaaaagccaacttttaaaaatttaatattggagcataatagaattcagcaatataagatttgattgggaataagaaataacatctcttttaaaaatgactacagccctcttaacaattttactcttaaccaattttggggtaccagtttactaattgatcaaattccagattggaaattagtcatcatttgattaaccagagttaagcctcttgaatcaaattctctaatttattatctcccatctgatctaaattcttttttaggggataaattgccaaaacgctttcagaatgcccagtactagaaatctaagctattcaattcagtctcttctctgttttcaggctcctttcctgaccctttggagaacctaatatatttagctaaaaatttttctttggggcctcacctaataaaggtaaatagaaaactgatagctatcacataacatacatattggttaataattgcaaccaaaagtaaattaataattttgagctatttatattagctctgccaaaattacatcattaaatttggccttatgaagcattgctgactgtagtaaaaacaagtgtgagcaaagtcttcatatgcactgagtctggtttcagttccacgtaatactgacttggcaagtgtggaaattctcatgtcatcattaccaaaaaaaagtgagttcacacagggatttctgatcaagtgacccattactgcgggaaaaaaccacacatacaaaagcctttgaccccagtaattttgtattggtatatttaccctgatcttaaactgcaaggaatgtccgcaattagagtttttctttgttttctaagtctgaaacttgataatccatttctgccttcccatgacgagtggacattcctccagccagtggtgagttcctctttccttcgctctcagcaagagcatgggttgccctcccatctcgtaagcagagcctaccacaaacgcagctcaaatctcagtttccagccctgcttactcactcgcttgttcctgaatccccacattacccatcatggcatcttactctgtagacttcacatgtgaactttgccctcgccggtggaaggggtacagtccagatgggagatgaaatccaaatgctccaccaaagggctttggtttgttctggggagccctggtgctgccgaagcctcttgggaaggaaggagggaagaggagaagaaaagatactaagtttggttttcattaaaaatttttccaggttttctttaaactgataggttcagggtctttttcatacaacagtctacttttagagcttttgttcgtttgttgtgtcatgggaatttataagggatggaaggaaaagggggacaaggaatggtctaatttcggtcagtagaagaatacctgaaacctgtttaaatttatttggaactaatgacttctacttttagtatccataaaagacttcccttggagcacaaagaagttaataatctgtgtatattgtcacttcatgctcttcttaagcgctgtgtgttggggcactgctctaggtgtggtgaaagactgctacaggataaataagtcatggtcactgccctggaaagaagcttaaaatccagtgggagtaaatgataaatgcataatgacctaaatgtcagatggatctagtacgtacctggaggattgcatagaagcatcctgacaagggtgccaagaatacgcaatgggggaaaggacagtctcttcgaagaatactgttgggaaaactggatatccacctgccaaaaaataaaattggacccttaacaccatatacaaaaatcaacttgaaatggattaagacttaactgtaagaggccgggtgcagtggctcatgcctgtaatcccagcactttgggaggctgaggctggcggatcacaaggtcaggagtttgagaccagcctggccaacatagtgaaaccccatctttactaaaaatacaaaaaatgagccaggcgtggtggcagcacctgtaatcccagctaatcgggaggctgaggcaggagaatggcttgaacctgggaggcggaggttgcagtgagctgagatcatgccattgcactccagcctgggtgacagaccgagactccatctcaaaaaaaaagaaaagaaagacttaatggtaaggcctgaaaccatataatttctagaagaaaacacaggggaaaaaagcttcttgacattggccttggcaatgattttgttgctgttacctcaaagcacaggcaacaaaagcaaaaacatacaagtgggactacatcaagccaaaaagcttctgcacggcaaaggaaacaaccaacaaaatgaaaaggtaacatacaggctgggagagaatgtctacaaaccatatatctggtaaaaggtcaatgtccataatatacgagaaactcgtacaactcaatactaaaataaaaaaaaaagtggaggtggggcaaaggaccttaatagacacttttccaaagaagacacacaaatagccaacaggtaaatgaaaagatgcttgccaggtacggtggctcatgcctgtaatctcaccattttgggaagccgaggcaggtggattgcttgagtccaggagttccagaccaacctggacaacatggtgaacccctgtctctacaagaaatacaaaaattagctaggcgtggtggcatgcacctatagtctcagttacccattagactgaggtgaggaggctgaggcaggaggatcacctgaacccgaagaggtcgagactgcattgagccaagatcatgccactgccctccagcctgggcaacagagtgagattgtgtctcaaaaaaaaaaaagaaaaagaaaaaaaaaagaaaaatggtgcttgacatcactaatcattagagaaatgcaaatcaaaaccacaatgagatattatctcacatttgttaggatgcctgttatcaaaaagacaaaatataacaagttttgacaaggatatggaggaaagggaacccttgtacgctattagggtgaaaattggtacagccattatggacattggtatggaagttttgtaaaaatcaactatatgatccagcagtcccacttgtggatatatgtttaaaagacatcaaattagtatgtcaaagagatatcttcacttccatatttatttcagcattactcacaatagcaaagatatggaaacaacccaagtgccatttatcttaggaatggttaaagaaaatgtggtatatatatacaggatagaataatatttagccataaaaataaggaaagcctgccatttgcaacaacatggatgaacctggaggacattatgctaagtggaataatccagacacagaaaaacaaatactgtatgatctcagttatatgtagaatataaaaacgttgaatccacaagccaagagtagaatggtgattgtcagggtctggggcatgggagaaacggtgagatgctggtcaaagggtacaagctttcatttataagatgaatatgttctggagattagggagcgtccttagtcttttccctctccatgcagagggtaactatgtgtgatgacagatgtgttgattaatttgattatgggaatcaatatgcaatctatatttatatcaaataatcacattgtatactttgaatacgtataatttctattaattattcctcaataaaattaggaaaatcagaagcatcctaaaagttgcattaaaaacaatgatgaaaacaggccgggtgtggtggctcatgcctgtaatcccagcactttgagaggctgaggtgggtgatcacttgagatcaggagtttgagaccagcctggccaacatagtgaaaccccatctctactaaaaatacaaaaattagtcgggcgtagtcattcctgtagtcccagctactcgggaggctgaggcaggagaatcacttgaacctgggaggtggagggtgcagtgagctaagatcacgccactgtaccccagcctgggtgacagagcgagactctgtctcaaaaaacaaacaaaaacaatatcccctttaaaaacgcaatgaaaaaaatagctgccttaccaagccaccagtgagagcccatctctgaggaaaaggggtgtgcagccggacaggcttcagtttaaaagcttaaaccttgacttggacttactttatgccctgagcaagctatttaacttttttgttccttaatttctaaattatgaaatggcagtggaatgaaatggaagatgaaattgtgccttgttcgatgccctggggtctgaaaggtgctcctaagggtgtacagcagttagcaccgttagcgtcctgggcaaacccacagcccgcagatctcttatttggcagcgaattcctgcagatcagctctaagagccagatttcctcatggaggaaaagactgctactgtcacgggaaagatttgtttaaacatattttttagtacagttttataagtccttatcaagtagggccagcccccagataaaaaccgttaagtatttatctgtaagccagaggttgagaataggaaacatttgaatctttaagaacttgagtccaacaaaaatactggctaacagcctgactgaggtgaaataaaccttgtttccagttttccagaaaaattgtttattactgggcaaatcttgggcctccaagattgcctatatttttgtttttcttttctcttaatctacaggaaacttctgggttgggccttctcatagttatccgttgttaaaagttctatatttctacaaaccttcttgtgcgaggagtatctggaaaaaaaaaacaacattgagatcactctttaaaaattagtgttttagacaggtttctggttttctctgctttgttaactgaaacagcccccatagaaacattctgaaagacttaatcaaacaagtattcagaataaaatgaatgggaagaagttttgagtctccttgatcaaacatggacctgtgctttaaaaagctgagcccctgagtttgttgcactgtgtacttaaagtctgtgacagtttagcctctttctaggctgcccatatctctcaccactcggttcatttcccggttttaaccactccccacggtccccagatgatcattttcatcctgagcctcttattcccaccttcagtcacttcagaaactcccctgcactccattcaactttctggacctcccctttaatgtttgccatttgtgcattctacagctcggtgcacttgttttctgacctcaagagtcaggagaggagctatcccagcttcaattcctcatcaataaggtacagaaaatactctctaggattactgaagaaatgaaataagcaactgtattttaagtattttatgtactgtaaaagcattgtgcgtccgggtgcagtggttcatgcctgtaatcccagcactttaggaggccgaggcaggcagatcatctgaggtcgggagtgactggccaacatggtgaaaccccatttctactaaaaataaaaaagttagccaggcgtggtggtacatgcctgtagtcccagctactcggaaggctgaggcgggagaattgcttgaattcaggaggcagaggttgcagtgagccgggtgacagagcgagactccatctcaaaaaggaaacaaaaaaaagctgtgccaataaaattatacttattattctagatacaaatattctgaatgctcctttagtcagattctgtgttttctgttttgtttttgtaattttcacttaggaggaggctgtacataaatcaagcccttagtaaatccttatttagtgaataaataaatactgccaacatctggccccagccctatttggcctcaaatttctgagggctggttaccactattgctgaaaatagaaaaggagaaacaaaaaacaaaacccaccaattcaggacagaatatatttgtgcttaaacaagcacacagtactctcacatccaccctcggtctccctgaaactcagacctgcaaaactaggatacaagctgtaatgacatgatgctttcacaatagcagattgaagttagactccagaagacagctttacagtgtgttaaaccagatagaagacaggcggctgctattggtgttttacactggtgtacatcggtgcttctcagtctcttcacattctaactcattccttttggtgttctgtgtagctattttggtctttatttcatatttatttgatttgctcttttcttgtaccctttattccaagggggaaaaaaaggtgggggttggacaacagagaatgaacagcacagaattcctttccttaaatactgccatcctgggaaatctagaatcatgaaatgtaagatacagattgtgccctagatcctcctgtcctactcttcattttatggacaagtccatccagaaacctgtgatggatgagggcagagcctggaagaaccccagtctccattccctcctccttctccctaaaccacaaagcctgatttgagtacccagggctacccaggttggaaatagaagtcctcatcttctgcccaggatttctcactcctagccacagagcttctgccccctcctagccacagagcttctgccccctcccactggaagcattgtgcccaggagaggacctttttctcttatctctgctggtaagcttgattatcaggatattcctggggacctagaatttaatctcttctccaaagctgctctttgatggtgttgagggtgtttttgccagtaatgaacaatcttcttgttttgaagctgccttttatcttgtttaatacattgtaaagttgtcttctggagtcttcttcagtctgctattttgaaagcatcatgtcattccagctcgtatcttggttttgcaggtatgagtttcagggggaccagagggtggatgggagagtgctgtgtgcttgtttaattaagcacaagtatatcctgtcttggattggtgggttttgttcttgtttttccctttctattttcagcaatagtgataaccagccctcaggaattttaggccaaatagggctagggccagatgctggcagtatttatatattcactaaataaaaatttactaagggcttgatttatatacagcccccgctaagtgaaaattacaacaaaaaaaaaagaaaaacacagaatctgactaaaggagcattcagaatatttgtatctagaataacaagtataattttattggcacaatgcttttacagtatataaaacacttaaaatacagttgcttatttcatttcctcagtaatcctagagagtatttcctgcatcttattgatgaggaattgaagctgggatagcttctctcctgactcttgaagtccgaaaacaagtggacggagctgtagcactaagcctcagcctgctcgtcttcaacctgctcctggctgcagagtcttgattgactctgcctgtctccagtgtgctttcattcccttcagtgggtaacttgtcagacctcatcttgtttttgagactttggtttctgtcttgccttcttcctaactttggtattcttagttccaaatcctgaataactcctgtaatgggcctcccagtagggggggttcctgtatttatattcacagatgtacgtattttaatagttaacatctgaaatcagtatacatcttaaagttgccatggaagttcatttcttcagtgtctgcctctgctcgtcacttgaggtgctggtaaactaagaccaaagtttagattccctgcttgagggcacttgaaccacagtggtggtgagttcagaatgcaaatgagagtaactactgacttaggattcaaatcttcaggggagattcctcccctctctgcccagttcccaggttgaaacatccaaggctctttgccatccctttctgcatggcgggtttctttgtggccatttggttccctggattcaagtggtccctgatacctgttcagtttaccatcttgggccgggcatggtggctcactcctgtaatcctagcattttgggaggtcaaagtgcgcagatcacttgaggccaggagttcaaaaccagcctggccaacatggcgaaaccccatctctactaaaaatacaaaaaattagctgggcatggtgatgggcgcctgtaatcccagctactcaggaggctgaggcaggagaatcacttgaacccaggaggtgaggttgcagtgagccaagatcatgccaccgcactccagcctgggcaacagggcacaactgtttccaaaaaaaaaaaaaaaaatcccatcttgcatgcttttcctttctctgtagtatgtaaaataatgtatgtttgtgatcagtgagatctcagatctgataaaatgcagtgttttgtcatgagagttgctcccagccgctgatggggttgccttgttcagcactttttagcaccaggggagtaagccatgttcttgctccccctccctcaggctgaggctttgcttgatcacctgctaagacaaaaaccagagtgggtcacgagtcactctctctcttcccccagccacagtggcagctgcctaacttggtttcttgctggtgcacacatgtgacagaaatacaatgttaataaatatttctacgtgtaatggagaaacaagccataaaagtagctgtttgccatctgctcagatacattattaggaaaggcaatgacattttatgattcagtaacttaactattctcctgccttctgtaaaggcccatcacatataaataaattataaacatccaaacacatcctgagagaagtgcattggtctctgaagcagaaacaaatgatacctgattctcccttctcccagaggagatctcaaacaactcagttacagtgcctcacagttgtaacctatagtacaaacgtgttggagatataacaccttgtatacgtatgtagagagaattggcataacaaagtagagaggagaattagacgaatgggcaccccaatcagtgattcagggagaggaccatattttaaacagcaggcaatgactcatttactgagtgttttctgtgtgtcaggcactgtactacgcactttgttcatctataagtggaagaatgcttgtttttcaagaacaaagggaataataagaataaaagtgaaggccaggcgcactggctcacgcctgtaatcccagcactttgggaggctgagaaaggccgatcacttaaggccaggagttcaagaccaccctggccaacatggcaaaacgctgtctccactagaaaatacaaaaattagcagacgtggtggcatgtgcctatagtcccagctactcaggaggcataggtgggaggactgcttgaggctgggagttcgaggctgcagtgagctgaggttgcaccactgcattccagcctgggcaacagagcgagactctgtcttaaaaaaaagaaaaaaaacgagttggggggcaggcacggtggctcacgcctgtaatcccagcactttggaggctgaggcggatcatgaggttaagagatggagaccatcctggctaacatggtgaaaccccatctctactaaaagttcaaaaaaattagccaggcatggtggcgggcgcctgtagtcccagctactcgggaggctgaggcgggagaatggcgtaaacccgggaggcggagcttgcagtgagctgagatcccgccactgcactgcagcctgggcgacagagcgagactcagaaggataaaaagtaataacctgaagagtagcttcgtttcaggtggaaggtgagagaggctgcagaaagcttagggctgggcgcggtggctcatgcctgtaatcccagcactttgggaggccaaggcggtcagatcacctgaggtcaggagtttgagaccagcctggccaacatggtaaaaccctgtgtctactaaaaatacaaaaatttagccaggtgtggtggcaggcgcctgtaatcccagctccttgggaggctgaggcacgagaatcacttgaacccgggatgtagaggagctccttgggaggctgaggcacgagaatcacttgaacccgggatgtagaggttgtaatgagccgagatcatgccgccacaccctagcctgggtgacagagcaagactctgtctcaaaaaacaaaacaaaacaaaaagtgcttagtcaatatctggttgttgattgtttaaggaaaaggccaagtgagggtatgactggttggtagaaatatgtatcttggtataagcagttctaggagtgatatgtgtcttttgctgctgttattgttgtttctgttcagcgttaatacgttttgcattgtaccacaaatatttccttactcctttgcctttgagacaaagggcatgagtttataagttgagttgaaaatagattaaatatatagtacagcctatgcccagcaagcagaattatctatgcaagttatgcagcccacacggaaaaagaaatgctgtgcggcctcattagcaccccaggatttgtggggctccccctgggcagccttaaccaggaaaatttcatagtctccttggcattccatccaagatttaagacttctcctttcatctccttgaggaccatcaactatacccttgagctcagccatcccacgcactgaggcttatctgtacttccagcccagacctccctcctaattccccactatacctgtgcactgaaacaccctcttaggatctccttcttccacattcctcctcctctaggcaaggcaagtcgttttcctcatctcagccagagcagtagttactgaaaactaacccaatatggtggcttctgagctcaggtgtctttcagtgactcctgctgcttccaaaataaagtccaactgtttagcttggcatgcaaaacctgtagtcatccatcccttgcatatttaactcctcacacaccccattctgtggtctcttcttccctttgcatctgctctgggtgctctttgaagactgtacttcctcccctttggggccaatttagtcatctttaagcctcatttcaggggtggtgtcctcagataacccttcttcacataccagtttgggttatctaccgctgtggctctatagctctcagctcacaccaataggataagtatttaacatactgttaaattacagtatgccatgataacttctcttccatcattctgtattgcatgagtacaaagactgtgtcattaatccctgtctccgtagcattgtgtctagcctttaacagtcacttaataaaggcaatgaaaaggaaataacatttgaccttcaatttaagtttgactaggtatggtcaaacgttagaaagtggcagtgaacttcttttgaagtcagaattcatattttcctttaacatcagatattggcagccagcttttccagattttcttggccaaaaatattactaaaattgcatgcccctagattttgatatctaggatgatacatctacagcatgtaattatttgtctcaataattgagctttaccttagggctctaagagaagaggttaaaggaatcagtggtttagtaattgtattgttaatcttaaaatgaaagttgaatggaaaatattttaaaaactggttaagaagataattattgagagcatggaaaagataattactacatatactgtaactggtgaagatggaggttttatgaaaaataaagcagcttgtaattttttacaacttctttcaaatgcaccttggactgccaaggtgagaggcaggggaggacattttcattccgtggagtcacactgaggatttatcttgtaattgattatcacattatctgctttgatcctcatgagataatgagagtggtgttttgttttgttttgtttttctttgagatggagtctctctctgttgcccaggctgtagtgcagtggtgagatctcggctcactgcagcctacacctcctgggttcaggtgattctcctgcctctgccattcgagtagctgggtttacaggcatgcgccaccgcacccggctaatttttttttgtagtcttagtagacacggggtttcgccatgtttgccaggctggtctggaactcctgacctcaggtgatccacctgcctcagcctcccaaagtgctgggattacaggcgtgagccactgctcccagcctgagagtgagtgttttagcaaagcaaaacggcagaggtaacatggccccctccctccacatcttatgaggtttcctaccattttctgtccaatcgtgactttttctacactcacttttagtgccccataagaaggatatttaatgaaaccttttatggactattgataagaacccaacccttgaccgggcgcagtggctcacgcctgcaatcccagcactttgagagccgaggcgggcagatcagaaggtcaggagatcgagaccatcccggctaacacggtgaaatcgcatctctactaaaaatacaaaaaaaattagccgggcgtggtggcgggcgcctgtagtcccagctacttgggaggctgaggcaggagaatggcgtgaacccgggaggcggaggttgcagtgagccgtgatcgcgcccctgcactccagcctgggtgacagagcgagactccgtctcaaaaacaaaacaaaacaaaaaaaacacctttttttgtcttgccattcaagttacttccaacagtgctaccccttctcccaagactcttaatgtagtctgtctgtccatagcattgtatccagattcctgaacctggcatatgagctctcaataattcattctgactcatctttccaggcttactgtttaaatatgttttatttattaatgtttgagacagggtctcgctttgtcacccaggctagtgtgcagtggcatgttcatagctcattgcagccctgaactcctagactcaaagggtgttcctgccttagcctcccaagtagctgagattacaagcacatgccaccacacctggctaagtttttatttttagtagggacagggtctccttatgttgcccaggctgggcccaactcctagcttcaagtgatcctctggcctcagcctcccacagtgctgggattataggcatgagccactgcactgagccataaatagatgcaagtcaaaatccaagaaaaccttgaaacaaattgccttacatggtaagaaaggtttatctttttcataagttcagaaatgaacttctggggttaattaatttgtaattgcccaattgcacacacaaagccaattcactgagactgtgatattgcagtaaagaaagagtttaatgaatgctaggccagcaatgtggaaaatggagttattattcaaatcaatctccccaaaggctcagagagttagggctcttcaaggatagtttggtgagcggaggacttagggaatgggtgctgctgattggttgaggatgaaatcatagggatgtgcaaaatggtctaatcctgtgccacctcacctgcactgagtccatctctggacttccttggttgagttatgagtcctggctcccggtggggtcactcggttgcctgaatgcaaaagtctgacaagcatctcaaaagactaatcttaggttctatagtagtgatgttatctataggagcaattggggaagtcacaaaccttgcaacctctggccacctgacttctgagcagtaagagattatagaaagtatgcttacatgttagcagaattcaggcccctcccattattctagtcttgtggcctttattagtcttacaaaggcagtttcagcacctgaacaaggaagggaatgagtttcagggagggactgttatcatccttgtttcaaagttaaattacaaactaaatttctcccgtggttatcttagcccatgcccaggaatgaaccagcctgtgaggccagaagcaagatggagttgaaccatgctagatttctctcaatgtcatcatttttgcaaaaggactttcagatttagtggcccactgatatcattaggggcccaggttcttattgtcacttcactctgccatccactatgcactggtacatcctgagacttgctctgcctcttggcaaaatggctacagaagtgccaggcatcacatctagacagggcatcttgtggctcttgtaggagtaaggaaacatttccagacgcaccctagagaacatcttacatttcactgaccaaaaatgagtcacatggtcctttacaaaccaatcacaggtaaagggaatgccgttattatggtaaccagcatgggggaacaggtggagagtcaaccaccaggactacagggcttccttttctccctttgtatgtccctcttccatcctgacctcatggtgaccctaaaaagtctgtgcctgcctaccaccaaacctgctctctgcccctctagattttaggtacccagccccccaggcctatacccgagttcgctttgctccatggaactttccttgcgcactccctgttctacccctttgccacctgtgtgaaggtcatatctctctagctggaccctgaggtcctttggggcatgcctgcgctgctctctattccttcatgtgcttcgtagagaaccacagaccctgactttatttgtgcaaaccttttccccaaaatgctaagactaataccacgcacagatggaagtactcttacatcctagtcatatcagccccttgagactggagctagtcttcaaaatggaataatagtgttccctttttattattagaatagtaagaattctatatgagtagaataagaaaaagttaatgtggcattcacaatttattaatgtcccttcatccatttacccacattcctttttattcttttttttttttttttttttttgagacggagtcttactctgttgcccaggctggagtgcagtggcacgatctcagctcactgcaacctctgcttcccgggttcaggtgattctcctgtctcagcctcccgagtagctggcggtacaggtgcacaccactttagtagagacaggtttcactttattggtcagactggtcttgaactcctggcctcaggtgatccacctgcatcagcctcccaaagtgctgggattacaggtgtgagccaccgtgcctggctttattccttcttaatgaggcacaaactcagtttctgcgtggtacatatagcctttagattttcatagttttactgtttttctgatattctcagacaaataaatggttgtacatcagaattattggaggagctttcaaacaatatgcctatccaagtatcaattaaagattcagtttcagttggcctgggttagggcctagggtgtttttgtaaaagttctcagggattctagtggcggccaggttgagagctctgctcttagatctttatatgcagaactctcctggctgagaattatcagaataatttcaaacttttcagagctcttatccagactgctgccatatattactgcttctcatattagcactgctgatcatgcagggtatgtcctggtttcttttgtgtttgatggctaaatatccaccttcccttttatctttttcctgcctggattgtaaacatctcatttctcttctgttccacagcattcaggacaatattaaagagatcatggaggctcagtcagttcccatcaacagagtccgaaacgttgtccacttcataacttgctgggcattctgtcctgtacacctttaaacaaccttcctggctgggtgcggtggctcacacctgtaatcccaacactttgggaggccaaggcaggcggatcacgaggtcaggagttcgagaccagtctggccaacataatgaaaccccatatctactaaaaatacaaaaaattagccagatatggtggtgtgtgcttgtaatcccagctactcaggaggctgaggcaggagaatcgcatgaacccgggaggtggaggttgcagtgagccgagattgccattggactccagccaggcgacagcgcgagactccgtctcaaaataaaaacataaacaaaacagaaacccttcctttaggcccagagagccaacctttccctcagagactgtttttaaaccaagccactttagactttgccagtccttctgtagtcccctattcaaaactttgtttatacctttcaggaatattttatctagtactttattgatttcatccagttatgtgccccttctctccattttttgacagtttctactttattccactcctccaacaactccttaatttctgctgtatcagcagagcctctcctaggtaattggaagagttgtccttctctcaaccctattctttctcaagtttgctattcccaggtcttctgttgccttcaaacactaccaagtagtctcattatctattcacaataatgatgtgaaagcttttgttccagcatttgttgaatgttcattttttctctggcctttcatcatctgtgacagtactttgtttagaaaatggagggtagggtggcacttgtatagcccattttgtatggttcaacattcatttcattgtgactaatgatgactgatagctgatgtcataagtagtgtttcttgcagcaaagtttcataaattttagcatgcatcacaatcacttggggtacttaactcaagtacgtattgctgggacttaccttcagggatatctaagtcaccaagtctggggtgaagcctgagaatttgtatttctgttaagttcccagatgatgctaatgctttatctggggaccacacttgagaaccactgtcctatgggatcaagaaataagccaggaacgagtgtatattttttctagttaaatatttaatgttaagatgtttagaatttttttagggaggtgcttgtcagatacttttcctaatagtgggtactcagagtatttcatgtgagactaccaatgtcatatattttaaaaactattagactgggacagatgggaaattgccttcagcataagaaaagccaatatttttcataagtcccaaaagcagcttttggggttggttgattcagtggttcaatgaaaccatcagagactctggttcctactctttattccactgtgccatggaccatgtgctggtacatcttcagactcactctgcatggtgacagaatggctgtagaagtgccaggcatcacatccaggttacatacagatgcacactgtttaatagccaagcttatgcagtatcagtaactattagagaaactgaaatggaggatccagaacttcttatcaaatataatccttaagatacaaacaaagcagtcattgaatagtttcttagcccattttctgtggcttatgatagaattcctaaaactgaatggcatataaagaaatttatttcttatagctatggaggctgagaagtccaagatcagggggacatgtggtaaacgccttcttgctgataccagtaaagcctgctgagctggagtgtcacttgaatcatattcgccacttttgctttctcttcctacatgggtcctgaggttttgctctcatcatcatcttgcctttcagtaaggtaactaacttgttaccctctgctatgtcagagagattgtttgtttcaggataaacatataaacagagtttcagataaatctcttatttcctggccactggggctcgagttatattgttagcaccagctctgtaaagtgcctcaatgtgttttttcaaccaaaggcaaaatatttggcaaagaatatgttggttctttacctccaggttctgggcaaactttgagtttccattcttttgagatagatggactttgttgtctttcataaacttgttaaatttgcgatctgcccttgaagaggcacttggttccttctaattcttttctgtagattcctctgattctccatcagcgtatggaaattttctcttctatcccttccagagaattattcttctctctgccattcaatttgactgtgttactgccaggaagagacagataaaagggcatcagcaatgtcgacaacttaggagtagttcattcctttttcctatggctgagcaagtggatttgactgtacttatttttgtgtattttaatatgttcacctgagcaaagtcagtgatctagaagcttcataaaatgaatagtgcataacagaaatcacacctcagtgtaagtcttaccttcctacaggagtcccataaaaacactcttaggacatgctttccccccacacatctgattgctgaacactttgtttcactaggcttcaacaggtctcttcaaagctgtcattttacttcagctgggattacattccaccctatttcacttaaatatacaccttccctttaattttctctcattcttatcattggcagtaatcagtgtggcaagagttcactttcttttcacatggagatttgatctttgattattttatttttatttatttattattattatttttgagacagagactcactctatcacccgggctagagtgcagtggcacgatctgcaacctcctcctccctggctcaagggattcttttgcctcagcctcccaagtagctgggattacaggcacacaccatcacacctggctagtttttgtattcttagtagagacagggtttcaccatgttggccaggctggtcttgaactcctggcctcaagtcttctgcccacctcggcctcccaaagttctgggattacaggcacgagccactgcgcctggcctgatcttagatgatttaccaaacagtgccacaccctctgccttctgtgtgtgtctcaggctgtaagtaaagtctccgtcttagtccattcaggctgctgtaacaaaatgctacagactgtgtaatttataagcagcataaatttattgctcacagttctgaagtctgggaattccaagatcaagatgacagcagattcagtatctggtgagggcctgttcctcaaggatagtgccttctatgtccttacatggcagatgggcaaaagagctaacaagcttcctcaaaccctttgtaagggcactaatcccatttgtgagggttctaccctgatgatttaatcacctcccagaggacccatccttaatgccatcccgttgaaggttgggtttcaaaatgtaaatcttgggagacacaaaacattgagaaccatagcagtctctcagacctcgttgtactcagcttcattttaggataactccacatttgagttaagaaaccaagagtttgtattcccaactctatgcttcatgaggttaaagactcttggcttctcattctcactgctcaggcaggggtagtccatctgaatggaaactcctttttggggggcacacatcatttttattttattttatatttctgagacagagtctcgctctgtcgcctgggctggagtgtgtgatctcggctctctgcagcctccacctcctgggttcaggcgattctcctgcatcagcctcccgattagctgggattacaggtgcatgccatcacgcccagctaattttttttttttttatacagagtcagtctctgtctcccagactggagtgcaatggtgtaatctcggattactgcaacctccgcctcccaggttcaagtgattcttccacctcagcctcctgagtagctgggattacaggcgcctaccatcatgcccagctaatttttgtatttttgtacagatggggtttcattatgttggccaggctggtcttgaactcctgatctcaggtgatccacctgcctcggcctccccaagtgctgggtttacaggtgtgagccaccacgcccggcctaatttttttttttttttgagatggagtcttgctctgttgcccaggctgcagtacagtggtgcaatcttggctcactgcaagctctgcctgccgggtccacaccattctcctgccttggcctcccgagtagctggacctacatgtgcccgccaccaggcccagctaattttttgtatttttagtagagacagggtttcaccatgttagccaggatggtctcgatctcctgaccttgttatctgcccgcctcggcctcccaaagtccagggattacaggcgtgagccaccgcgcctggccaccacttttaaatgtctgtgttgcagtgaaattttaaaagagagagctaaattttgatgtcagtttttaaatagatgctgccaagagccatgttgatagcccaaaccaattttccatttataccagtgatatacttcaagcctgaaaaatgtagtccagtgtgggaagaagccctgtgatggtgagaaatgcagtaagaaactgggttctcccatggaactgataattaatgcaatcagatatgaacagtatgtttaaggatagtctggacatgaatgtgtataatctgtctttatcagataaacaaataaaagtcttttacctaatcgtcgtttcctgagttagaagaatcctccttatcagatacctgctttggtcattggaaggaaagtagaacatccatcttggtggtgatccttgtttcttagtactctgtatatcctttccaagagacaggtttcttttatgaaatggctaagatcatctccaccaccatgaacaacatgcaaatggagctgctgcacaaagtttagggagttctaagcgttgggattccaaggcatattaccctgtactgaagaaactcggaacagaggcatcctcaaatcctaactgcaaggaagcgtagcctgtgtcctttgttgatggaggaatgattcagtgagaaagaacacagtgatttttttctctacctatcttacatcttactctcttgccatttcttgtaacaccttttcatcctgtcttaaccttcagctaccagcttaccctgatcgtaatgacaaggaaattcatacattttggttttttaaggactactttattaaggtataattcacaaaccatgcagtccaccctttaaagtatacgatgcaatggtttttagtaaattaacataatcgtgtaaccattggcataaacaacattagaacattttcatcaccccaaaaaagaaaacccatacccattggcaatcaaaagccgatttcctccccaaccaccacacaccccccagcactaggcaatcattattctactttctgtgtccatgggtatattaaatactgtgttgtaactggagataggatgcccatagtcagaaagcttgagctcacatgaactgttggcttggatttctgtgcggattaaaccagcttacttctgacacggcagatgctgggctttttaacctctttcctcattgtgcttcctgacttgttacctctgtatcataaaagcatgaaaggtcgtagaataaatgagtctgcagaaaactgcgtggttaagttaccccatttgtgttttacaaagatagcggaagggaataacctttgagggtcacatacaaaaagccatttcctcatcctccctaaccttaaaaagtcgacattatttttacagcagcttctctaaattgacttacacttgaacaaactaaaaactacaagaagagtagagcttagctggcaggcctggttttgaacaagtgtttgattttgctaatcttggtagtgcataaggtcacttttgtaaatttcctgtagaaaaattcttggttcttggacacactcagctactagaacagagagatggtttatattttttctatgaattaccagctgataaaattcccctcctttgagtgggagaaaaattcaagccagacaagaacttttgtggcaggtaactcttacttgaaatttatttggatttctagaggcaaattaatttctctctctgtctttcacaataaataggtgcctgtcaccttttttttttctctatctagtgagctgcttctatagatggaagaaagttagtccttccttttggtattttgagagttttatttttaggcctctccttggctgtcttttctccttgtaaagccagtgtcgaagtaatggcaatggtaagtatgcttagcgttctaaatttttttaatgcatgtttattactaagtaatttatctccttttcttctactttatagctccatattaaatatggtggcaccttttaataaaaaagaggaaagcctatttggaaacatataaaaatagcacaggataggtcatttttcagattctggtcagatcaccatttggaaagatcttattctttaaagcaaaagttttgaaccaaggatctgttgaagatggggagtgactctcattcatctccatcttcctttgaaatttcatacagattttttggtgtgtgtttgtgtgtgtctgtattttctaatgagaagatccataactttcataagcatcaaagccactgcctttaaatatctttttgattacttttactgtagttattgttttaagatctgctttttgccatttaaaaacatctttcaaatactagttaactcttaaatgtttttttgcagaataagatcctttttgcagtactttttgttgttgtttaatacctacccaaaattttggtccaagctctaggggcctcctcccgaagaatttggtttaaaagcaaaagatttttaacataaataaaccagaatttgctttttttctttttgatttttttttttttttttttttggtagtgatagggtctctctgtgttgcccaagctggtctcgaactcctgggccaatcctcctgcataggccttccaaagtgtgaggattaccggtgtgagccaatgtgcctagcattgatttgtgggggttttttgttttttttgggttttttttagagacagagtctcgctctgttgcccaggctggagtgcagtgggatgatcttggctcactgcaggctccgcctcctgggttcaaacaattctcctgcctcagcctcctgagtagctgggattacaggtgcctgctactgtgcccggctaatttttgtatttttggtagagacggggtttcaccatgttgcccaggctggtctcgaactcctgacttcagttgaggcacccgccttggcctcccaaagtgctgggattacaggcgtgagctgccacgcctggccttgatttgtttttgcatgtgagaaaatgtatgtcctagtgtagtgtggtgtgtcattagaagcatgatttgttcttaccaatgcagtgattacattggttcttctacattcagtagaatgctaataatgtggtaatgctagtcgccagtcttcttaatctctataacagaggaagcagaagtagagcagatcctatcctagccttgtaggtctagagaccgaactatagtgtcttctgggaaagcacttaaacaaaacacaggtttataaattgttatggtcactaatgtttcagtcaagatggtgactacctatgatttgtgtgtatgtgctacccttttgagaagcattaattagtccgttctctcactgctataaagaaatactggagactgggcaatttataaagaaaaggggtttaattggctcagggttccgcaggccaggaagcatggtggcttctggggaggcctcaggaaacttagaatcatggcagaaggcaaaggggaagcaggcacgttttacgtggccagagcaggaggaagagagaggagagaggtgctacacgcttttaaataaccagatctcacagtaattcactgactcactgtcaccagaacagcacccaggggatggtgctggcccattcatgagaactctgcccccatgatccaatcacctcccactaggccccaccttcaacactcgggattactgttcaacatgagacttgatggggacacagatctaaaccatatcaagcattaatattactattaacctgtgtgaaaaggaactgaattctgctgtgacattttttgtttaagaattaggcctagcaggtgtggtggctcacgcctgtaatcccagcacttcgggaggccgaggtgggcggattgcctgagctcaggagttcaagaccagcctgggcaacatggtgaaaccctctctctactaaaatacaaaagaatattagccaggaatggcggtgtgcacctgtagtcccagctactctggaggctcaggcaggagaattgtttgaacctgggaggcagaggttgcagtgagcggagatcacaccactgcactccagcctcagcaacggggcaagactccatctctacaaaaaaaaaaaaaaaaaaaagaattaggcttagggagtgcatggtggctcacgtctgtaatctcagcactttgggaagctgaggtgggcagatcgcttagggtcaggagttcaagatcagcctggccaacatggcaaaaccccgtctatacaaaactacaaaaattagcaagccatggtggtggacatctgtaatcccagctactgagaagtctgaggcaggagaattgcttgaacctgggaggtggaggttgtagtgatccaagatcataccactacactccaggctgtgtgacacaatgagactgtgtcttaaaaaaaaaaaaaaaaaaaaaaggccttaagataaaaaacagtgaaataaaagaagtcatatttttaagaaatgaaatccctaatgtttaaaaattatttaatgtataaaattatcaatttttatacattagggatttcatttttttaaatatgacttcaggctgggcgtggtggctcatgcctgtaatcccagcactttgtgaggccaaggtgggcggatcacctgagatcaggagttcgaaaccagcctggccaacgtggtgaaaccccatttctactaaaaatacggaaattagccgggtgtggtggtggcatgcacctgtaatcctgaccagccagctgagatcgtgccactgcacttcagcttgggcgacagagcaagactccatctcaaaaaatgtgtatattatatatatatgacttcatagacacacattggtctatacaacaaaaacaaagcattaggaaattatctcatgatttagccacaaaattaaaagatttatttcaacaaacacttattgaatgcttacccatttgactggatgatgcgtaggaataacaagaggtctgaggcatagtagtagacccatggagctgatagtttcagggcagggtagacatctaataaagtctttgtttccttttgtaagtttctctaagtttgtttaggatacctattttgacagccatacagatcttcagaaaatagggattatcaccagacaccacaaggaaataggtggaaaaatatttaaaaataaattgtaagccaagcatggtggcccatgcctgtaatctcagcatgtgatttgggaggccaaggctagaggatcacttgaggccaggagttcaagaccagtctgggcaacatagcaagacctatatctacctaaaaaaaaaatttaagaaaatttaaaataagtaaataaattgtagtaaaaatgtaggttatgtttcttcgtctgaaaataagctattctgaaaagctaagctttcccaatggtacatgagttctctctctaattatatcttctgtattcctctctcacttgaataattttcttttgaaaactttctgaagttatatgctttcagactttgtaaaataatatgttgaacatgattaatcatctctcagttaggttcattattttcaatcatattattgtattgtgctgtgataacaatgtccctagaaactggacagtttatagagcagttcgcctgatcatttttgttttttaagtatctttttttttttttttaaagacagtctctctctgtcacccaggctggagtgcagtggcacgatctcagctcactgcaatctccgcctcccgggttaaagcaattcttggtctcagtctcccaagcagctgggatgggactacaggtgcatgccaccacgcctggctaatttttttttgtatttttagtagagacagggtttcaccatgttggccaggctgctctcaaactcctgacctgaagtaatccacccgcctcagcctcccaaagtattgggattaccggcgtgagctactatgcacaccccttaaacatcattgtaaaaatcacttcccttgctataggaatttggctttgagttactaggccttccagaagccatccccatgactttgttatctggcctaagccataggtggggagtggggagggagacatccaaagttaattagaaccaagtataaatttgccatggatttaagccttctgtataagataaattcatccatagtatttttggattactttatttacttgattatttatttacttatttgattatttctgttctcattaattttctaattatgactagacaactaagttctgggtaagatatgtcattattacgtaatgatgtcttattcttggcattataaatgactatactgtgttgtagttttattatatttatgacatatgagaaataaataataggaactttaagaagactctatcacttcatatctctttggtctctttctctgtctttaacattggtcaggttccaaactagtgaaaactacagaaacaagtgcagttttctagtatagtctttcatcttacgaaaatatatttaatccccactcttttttaagtttcactttgccttaaggggagtggtcttaagaaaactcttagtatagttgtgagtatccatagtgtcaaatgaggggaaacattgtaacaatgttaggagccaaagttctcaccacaatctcatcagatgtcctgagctattttttacttgttaactcagaacaacaaatactaaagaaagtgccaaacaacctcaattcttctggctcacacttatatatagcagagatacgaaatagcccgcaatcccagatcttccatgggtaattttgggaaagtgtttttcatagagatgttgaagtccatggaaatcaggtagaacactaaaggacccggttgacccagtacattgcaaccctctgctctcatgtgcacctcacacacagccagtctacggattagagaccaccatttctgggggttgttatcttttttttttttttttttttgatacagagtcttgctctgtcgccaggctggagtggtgcagtggtgcaatcttggctcactgcaacctccgcatcccgggttcaagcaattctcctgcctcagcctcccgagtagctgggaccacaggcacacaccaccacgcctgggtaatttttatatttttagtagagacggggtgtcatcatgttggtaaggatggtctcaatctcttgaccctgtgatccgcctgccccagcctcccaaagtgctgagattacaggcgtgagccaccacgcctggccagttcttttcctttaacttgtattaactgcatagtagttagtttctctttcttctttctttaataggatcatctcaacatatttaaaaactatgccgtatatgtataagatttgccacctctgggtcattaaatggcatcacagacatagaaatgtaccaattccttttttatgaaatttatccattcatgcaaaagaagtatgataattaaaaataattttgaacattgggtatcctaggctctgagcgcgaggctctcagaaaattaaaatgacatcatcatcgtacttgcaaagcttaaagcccagtggggaagagcaacatgatagtaacaaaggtagagtgtaataagtgcggttgcagaatcgcaggccaaggggagctcacgtctttgagcttcaatttctttatctgttgcgggggagagtatctcatgaagctgttttgaagcttatctaagacaatgcatgtgaaaacactgtaaaattataaagctgcggacatgtcagttgtcatgtttggtttaaaatagaagctgggagactctttattctgaaaccatgtagataatccagggatgagactctagttaaagtgaggaaaacaatgtacttgcatgtcaattgcagttcctgggagaatgtttgtattattaggagactctcattccagaaatcattttgttggcatttatactaagtggcgatgacactgagaacagcacagcttcatctgacatctgacgttattgtcagcctttcttagtacccatggtatgtttttactgtatctcgtgaataagataatatattaagtctcctggcatataaggatatatgtaagatacgtgttgtatagttggtttctagagtgtcttcatagcagtcttccagtatttctatttattgctattccctctccacctctgtttctttcccattagttctttacaggtagggagattatatgtcccagtttgcctgtcctggtttatgtctcttgtccctacatcccatctacttaacattttaacaccctcgaaagcgtcccaatttggacctcaccttatctggtcaccctggctcaaagcatagaagaaaattaaatgaagagccagcaaattagtgaaattgtacagatgtgtgataactgacttcagtcactgagctgagctgatttacagagtgtggatttggtccagtaatatcttggaatgcagcttacagatgtaagtaagtagtgcctgattatagctacacactatagcaggtttcctaatgagctgttaaaacgaaagcatgtgtttgttcactgtggcacagaacagtagctttgacacttcagtagttttcaccatagcatggcttgttggggcttgaagactggcattccttcttaaaggcccatcaaggttttcattcactgtgagctatgtgttaagctggtactgatctcgtttttgaccatcattcacccatggcagccaaccagggaggtgtaaaatgcttttgtccccctgcccacatatgcacctcctttggtgtgacccatgggatgacagttgcgatgcagcttgaaaggatggctctacattgcagcttctctgcgtcatccccgttgcccttttagaatgagaaaagaggattgaaaggttcaaaagcctagagagaaaattctgcagtcctgtgtttttctgagcagagggaaaggtgctacttcgtaagactgcttgcaatccccaatataatagaataaaactgtccctactgccagcattaatatgaaatttgtataaaggtggagggattactttactgttttattaatatgcaatcccaatattttcattgcagggcagcttgcaaattcattgcaaattatgctgagttaaaatcaaatacataaatctacctttctctgttggcagctgtattggagtttgggattggcctctgtgcttattagagccaaagaatgtatattatttaattcttgcaaagtgaaagtaaaagatcaggaaataaagacaaatcaggggaatggaacatttttagtgcgattcctcttttactctccagcaagggaaagtggcttaaagatctctgttaaaacagtgcttctcacactttaatgtgagactcttgttatgtagattcttactcctgggtctaggatgggggcctaagattctgcatttctaactagctgtagagcatgctggtgctgctggaccacaggccatgacttgagtagcaggttgtcaggaagtgtgtgcttcagtgggctgtgactctgcatatccctgttgtgaaatatgcagatgagagtggcacacaccagaccctcaactggcaggaggagctgtgttttagctagaggttagggtgagagggaccacccagacttgtaaagcttaagtattgtccccggtctctttaccagtcttaaggtatccctaacagaggcccaatgttcctgctaatgaaatgaataaagaaatgttgcagtccatggatttgtaattccagtaacggcttattttacatctattaaaggctacaaggaaagaagtggagggaagggctggaagactaagaaaataggaaatgagaagaaatgcacaaaggagagttgcatttcctcctgcttctgtcaaaggaaaaaaagatgttatgtgccttctctttccacctctaaataaagcaacagggccaccactaactagtttgtgtgactatattctggctatttaacctctgctatttcacaaaaagtcctcatctgtgaaaggaggaatttggaatcgggacagttttcggaaccccttcaattgttaaagcatagcgactaagaattttatggtcatacaacactaaaaatcatacatatgtccttaggaatggggttttatttctgtaagagcacctccaaaacaagtggtgtgttaatacatgtgcattttatatttttctttatattctttgttctcttccttttaagaaaatctagtttgtttcattgcttcaaaattcctgaaaaattttctgtctttttatataatacagagttggctgtgttaatttctgcttccatcatactaatttaggaaacgtggcctaacagtggcaggaatagctagaactttcttctgtgacttactggcattttccctaagcatctgcatgtgttgggtgtatgtgtaagtaccatgcattggatacatcctctgttgaaaggataaaggaatgcttgttcgttccacaagttaccttggctccaactctgttccatactcagcctgttctctcaacacaatgatgtcttcagtcttaggacagaagtctggagttcattcacatctctattttgattaattgttttacacatcaggctccatataatgtagtggataatgaaatgctctaagtgagttagggattttcagttcttagacttgtggatgagagaatttcaaaaattatctacaaatttaccaacatagataatgtttgtatgatatacagaggttgagttttataaaatataaattgctctgagccagaaatgaaaaataaatgtagaatcccatgataaaaaactaaagttgctatattaaaattaatagtatactgggatttttgaaacattgttttgaggatgtgtttactatgttcaaagcaataaatttaggaatggaatctagtttcattagccctgctataacattttggagagaatataaattaatacctgctttttgaaggacaacctgacattatccattagaatgtgtaggccctattttcttcatctcacagattcatttcttgtaatttacccatttataattaattattgcaaatatgtgtttggaattattggacaggtacagaaagctatatgtagaagtacattcatcagagtgtttgcagtgtgggccaggtgcgacggtttactcctgtaatcccagcactttgggaggctaaggcgggtggatcatctgaggtcaggagttcgagaccagcctggccaacatggtgaaaccccgtatctactaaaaatacaaaaaaattagccagacatagtggtctgcacctgtaatcccagctactcaggaggctgaggcaagagaatcacttgaatctggtaggcagagtttgcagtgagccgagatcgtgccattgcactccagcctgggcgacaagagcgaaactgtgtctcaaaagtaaaataaagtgtttgcagtgtgaagaaacaatctaaatattcaacaataaaggaaggtcaaatgagacaaagatgaaaggggaatactatgcagccataaaagagagatgtggttgttatcttaggaagatgactataatatgaagttaaaagttacaaaggaacatttgggaagaatgtataggtacatacatgcttataaaaccacaagaaagaactgggaagcaatacaccaaagcgttgatagtagtagaattacggctgattttttactttctctgtcatgcatttctttattgttgaatatttagtactagtacatggagagggaatagaaaacttaatttggaagggatggggaaaaagtagccaccctgggagctgagttagaggagaacacagagcccaggtgtttcagcatctgttccggcgttggcggtgggaattctctgaatagtcctcactgtgccagagaagctttctgcgcacagctgggtcctgtgaggcaagacctgtgtcctgctgactcatacacagcatcccatatggccttaactttatttagcaacgtcagctcaaggaagccttgtgttccctttgggcccaggatttagaagagcataatcatagaatgtctgtcaggcctggaagtgtcattagggctgtcctagtctggacatgaagagtctgaggcccagagcatttaagtaacgttcccagagtcccagaggtagttcgaggccaactggaaatgaaaatgcggttcccaggctcgtggtctctctagtgctactactttgcttgtctccaagctctgctctggtggatgagtctccagttctcacaagcagtttttaaggccagagcaaaaggtttccaggtaagagaattttttttgtcatataagagaagattaaattaataggacttttgttcagatctgcattcagtgagatacatggaaattcagaggttattgactttccttgggtctggcctcttttggatatttaataaaggctgcaaaacctttcccttgaacgatgcaagtttgctgaaaaccacaaaactttgcatttgatttcggaggtttcaagagccctgtaaagcctgtccctgggttctgaatgtcctttgtcttgtgctcccctgttttcaagcagttcttttgcatttggaggtaacagaactgtgatctggtttggttttcatacctttgttgcagatatgttttcttcaaataaaaaagaaggagaggatagcaactaggaagatgaacaagcctcatcacattggatacttagtgttgtctttgtgtttacagttgctgttagattgtcattccaataaaagtaaaattatgtaatactttttaaagctcccatcacactagcacaactgctttcattttttgcagagtgtgccaccctgttcctttccacatggatacttcctggttacagccaaagactgttcattatgccctttcatgcttccacatgaaagacacaaactgaggctgaaattgagtggcttcttaccagaaattaggtatttgaataagagcagatcgtttttacttaaaagatgtaagttttgaaaatgaccacatgcagcagttaacacactgatgactggacttacctgaagagtctctgattcagtagcccgttgtggggcccaagcatttctaataagtcctcaggtgatgctgacatcactggtccacggccagactttgagaaacagtggcccagagaataacagtcttagaaggcagggtgttttccaaattttgctgaagacaagaatcagttgagaatgtttgttagaaatgtaaattttaacaccatgtcagactcactgaatcaaaatctctgggagaatcttggaatagtatattaccagatctggaggaactactattctcttgctatcaggtaagccccatagagtgtcacttgtttgcaaaccactcacaggacaatagaattttttttttcaaacactaactcaaccagaagggacaatgtaatatatttaccactcaatcgtttctcatccattgtctgctttgaccctatgagcccatgagcacctagcagcatccacatttttaaatgaattttaagtcacccttctaagacataaatatttttgtttcaggtaccaatatattgtttgaaagagataccagaatacctgctttctgagaatttcctcaagttttactgagttcctttttaataagcatagtcacaatatgcatttgtgtgtgtgtgtgtgagagagagagagagagagagagagagagagagataaagggaggaaggaaaaagaaatgtggttttctgccaagttcaagttccctagtgatggtgatgctgctgatctcggaacacgttttgagaaccactggaatagaccaataactctcaaatgtagcagttggaatctcctggaggagctttgaaatatacttctgctcaggtctcacccccagagattagttcaattggtctttgatgagacctagacagtaattctaataatcatccagccgggcgtggtagctcacgcctgtaaccccagcactctaggaggccaaggcgagtggatcacctgcggtcaggagctcgggaccagcctggctaacgtggtgaaacctcgtctctactaaaaatacaagaaattagtcgggcatgatggcacacgcttgtaatcccagctactcgggaggctgaggcaggagaatcgcttgaacccgggaggcagaggttgcggtgagtggagatcactccattgcactccagcctgggaaacaagagcaaaattctgtctaaaaaaaaaaaaaaaaaaaaatccaagattgtgaaccattactgtaggttgctccagataaaaggtaatgggttaggaagcttaagacttgatgaggaaaaataaaggttaaaccagtgctccttccacttcagtgtgcatacaaatcacctgggggtcttgctggaatgcagattgattctgtaggtctagggtagggcccaaaatgctgcttttttaaatcaagtcaggcagatgctgctaagattgcccaggggtctacactttgagtagtgaggtggttagaaagtgttgacctatgtaagtgcttatcaacacacagtttttatatatttttacgtagtatagaacaaataaaagcaatgtcattgagatttcagataccttagaaacaataaatattttgccattaatgactatttcccttcccttgatggctaaaacgttttgtttttgcttctccctacctgcttactcagagtttcaatcaaatgtttgtaaattaattttgctttagtatgacacatgtagtaacaggcctttcccctttgtaactgagtcccaggattcacggagtttgaggatcttgccttctggcttcctccttgcctcagaccctgccctttaggggttactgccctaagaggctgaaagtttagtaatgccccagagcctcgttgcaggagctagtcacttttggcactttcttgctgtcagaccgcaggctctgggagccagtcttcttgggacatggcttcatcctgtgtctctggcttgagcccaacctttcaggcctgggttaggggtgaagccttttatctggcaggtcccacagtctggcgcctttcccagcgtggtggagttgagaccttgctgtcagagcctgttcagaaggagagagggagagacaagaccttcgcgtgaggaggaaagagtttaagtcccgtctgtggaatctgtttcccctggcttgttgaattttctcagctgaacatggcagaagtggttgatatttgaattagaggctatgaaagtgtccttgggaaatgggtggggctgagccagtggtcttcccttttgcctctacctcatgctgaccaggggacaaggctctgtctcctgggtgtggcctgtcattggtcagtctgtgaccatactgctattctccaaggcattcctcaacagaatgggatcaggctttttcagtcatttcccatttttaaaggacatctccatggcagatgcccctactccctcccggtgcctgaatatttgcctgtctagcgtgggtaggtgaacgtcagcagaactcttgaagaatcactaaagggatgtgcttgtcctagcaggagagcctgtgacaataaaaaagcagagaatgttctgagtctcctgtattaaaaagggaaaagcttaagtgaggtttatttccactaaaggatagcaacataaggcagcttgacctttagtgtgactggagcaccgtaaatgctacttctacttttttcctttttttttattgtggtgaaaaacacatagcatagatttgccctctgaatgtttaagtgtacacttcattattgttaactgtatgcacaatgccatgacagatctctagaacttttccatttcacatgactaaaatgctgtgctcatcaaacaactctgtttccccctgtgccagccgctggcaccaacctttctactttctgtttctatgactttaattacatgtatgtgtcatagaaatttggctttttgtgattggcttatttcacttagcatagtgtcttcaagtttccattctattcatgttgtagcatgtgatagaatttccttttttgtaggctagataatagtccattgtatgcatataccacattttccttaggcattcatctgttaatggacttttaggttgcttctgcatgttggtcattgtgaataattctgtagtgaacatggggatgcaaatgtctcttcgagttcctgtttttagttcttttgggcatatacccagaagtagggttcttgaatctcatggtagttctatttcttatttttttgaggaacctctatactgttttctgtagcagctgcaccattttacagtttcaccaacaactctcaccaatgtagggttccagtttctctacatgctaccgatgctttgtttttttgttgttgtttgttcttgtttttttttaatagtggccatcctaatgagtatgaggtgatactgtggttttgatttggttctgcctttttaaactccaaattcagtctctggttacagcttttcccataaccattttcaggtgaggtgcgtatgctgcgttggtaacataaatttaacattgtgagagcttttatcaggcagcaaattgtaaagccccttctaggtcagacagttgacctctgtaaagcttaagttaggaacttttatgttcttaataaaacacaagaaaatatgggaaatttccatttggcatgagcctttctgttttcttggtggtggtggtgtgggggtggtataggctctccctaaattgcccaggctggaatgcagtggctcttcacaggtgcaatcatagctcactacagcctcgaactcctgtctcagcctcacaagtactgggactacaggcatgaaccaccatacccagttccattctgctttaaacagtggaaaaaatacatgtattttttaaatggaagggttggttatatcttcaatgtgaaatcctctatgtgaaatctaaataaactattcctggaatgtccagtgtcctttccccgtgatgataaacaaagcccagagctgcctctctttaaagatagtaagaagcctatgcataaacaaaacacttaaaaataagatcatttattttattttactcatccgcttaaacccatcaatgacttttaacttagaagaaaacctagtcttcctactatgaccaacaggactaagcaaatctcataacctagcctctgcttacctctcacttcagcccaacctactctttccctctcttaaaaactcagtagctgaaatatatggagctctttctggccccgagcctccagaccttttaaagaaaaaaaaagattgtaattttgatgaagaccgcattgtcaatttttatttctatggctcttacttttggtattatgtctagacctctctaagccctaggtcttaaagatcttctaggttttcttaagttttatagttttttttttaattttagatttaagattcatttggaattaacttttgtataagacagacggttaagaagattcattattttgactatagataccagattgctgtagcactgtttgttgaaaagactttccttccttttctgaaagagtttttcttttctgaaatgcctttgtcaaaaatcgcataggcacatctgtgtgggtctatttctgggctgtatgctgttcctgggaccatttttaccttccacctttcccctagttaactcctacttatccttcaggtcttagtttcaatgttgtttccgtggaaagacccttaaggaccacccattcctatacatctgcataccctcaacttcagtcctaaggaagggtacctctgttattctcactcaacacctgtttttttctccttcgtagcatttagcataatacgtttataactttttttgtttgtgcacatatagttcgtgcctataagcctcaaaaaggcaagaactgagtttattttgttcaccactgtagtgcccagcactgtgcctattacatgctgagttctcagtcaatatttttgaataaatgagtgaaacaaagttaggcttcctgggggatgttttctaaatccctaggtatcattttcttaaaattagaggatattcttggctcttggagccttagggcataatttttttcccagttaacccatctttgaagatagggattttgagaacttttggcctacctcagggtcacctagcgggttatcaaaatgcagattgcagggccccaaacccagagttcctgcttcagtaggtctgggatgggccccaaaatttggatttctaataagttcccagaaaataatgctgatgctgctgttctgggaacccactttgagaactgtattagtctgttcttgtactgctatgaagaactacctgagactgggtaatttataaagaaaaaaggcttaatcgactcacagttccacaggctgtaaagaagcatggctgggaagcgtcaggaaacttacagtcatggtggatggcgaaggggaaggtggcacgtcctatgtggtgggagcaggagaaaaagagggaagaaggtaatgctatgcactttcaaacaaccagttctcgggggaagtccgcccccatgatctaatcacttcccaccaggcccctcttccagcacggaggattataactcataagatttgggtggggacacaaatccaaaccgtatcaagcactagtgttttaacgttaagaatctgaagaggcccgagtcactgagccgccactgccaaggactcatctcccccttctcccgccaccgcccgcttttgcagccatttccactgaggaaaaacaatcgtatgtccacagtccagaacctccactctttccacccctttgctgatacaagtaagggtgatacctgtcctgctggcactgaggattatatccatataagaattcatccaacagagaaatggcaggaagacccttactactgtccaagggactgctgatgattatgataaaaagaaaccaatgaaggcatttaaaaagaaatttgcctgcaatgatactgtaattgagcatccagaatatggaggtcattcagctacagggtgaccagcacaagaacatgtgccagttcctcttagagattggaatggctaaggacaaccagctaaatgttcatgggttttaactgctgtggctcgctgaagcttgaatgaggttttccttgcaatgagtagaatttcctttctgtcccttgtcacaagtttaaaaacctcacagctttgtataatgtaaccatttgtggtctgcttttaacttgacctagtgtaattccttcatgcagtaaacttgaaagagccatgctgtctagtcttgaagtccctcatttaaacagaggtcaagcagtaggcgcctggcagtgtcaagtctgaaacaaagcaatactgtcatgtttcagccacacctagacccctaagatcatagacaactacgtctggccagaagctcctccgctctccctctgcagagttccctgccctaagagactgtcaccacccgaacaatcctcggtgaatctaagaggagaggatggggtaaggcagcaacagcaactctaccactggaagggagcctttggtggtcaaagaaagatcccctggtgtctataacctgaccaggtgcagagttttagagaggcccccttcccaatagcgaggtgataggacatctggcttgccacaaaggtctttttgaccagacatgccctagctaagggatgtccaaacaccagaatgtgagaccaaccttccatcaaagttaaacctttgacaagggaacaaatctcaaaactgatgtaccagtcatgtagctagctgtagagcttgcaacttaatggcaacagctgtccaatttcatggaaagtaaccaactggttttgaggtttgtttgtttttttcccctccagttttaatgttatgtgtaatgtatttaaaccccttttttaaatttaagttctagggtacatgtgcacaacatgcaggcttgttacgtatgcatacatgtgccatgttggtgtgctgtacccattagctcgtcatttacattaggtatttctcttaatgctatccctcctctcttccccctccccacaacaggccccagtgtgtgatgttcaccgccctgtgtccaagtgtgctcattgttcagttcccacctatgagtgagaacatgcagtgtctggttttctgtccttgcaatagtttgctcagaatgatggtttccagcttcatccatgtccctacaaaggacatgaactcatcctttttaatggcggtatagtattccatggtgtatatgtgccacgttttattaatccagtctatcattgatgggcatttgggttggttccaagtctctgctattgtgaatagtgccgcaataaacatacatatgcatgtgtctttatagcagcatgatttataatcctttgggtatatatccagtaatgggatcactgggtcaagtggtatttctaattctagatcgttgaggaatcaccacactgtcttttacaatggttgaactagtttacactcccaccaactgtgtaaaagtgttcctgtttctccacatcctctttagcacctgttgttccctgacattttaatgattgccattctaactggtgtgagatggtatctcattgtggttttgatttgcatttctctgatggccagtgatgatgagcattttttcatgtgtctgttggctgcataaatgtcttcttttgagaagtgtctgttcatgtccttcgcccactttttgatggggttgtttgattttttcttgtaaatttgtttaagttctttgtagaatctggatattagccctttgtcagatgggtagaagccaaatgatgagtgaactcccattcacaattgcttgaaagagaataaaatacctaggaatccaacttacaagggatgtgaaggacctcttcaaggagaagtacaaaccactgctcaacaaaataaaagaggacacagacaaatggaagaacattccatgcttatgaataggaagaatcaatattgtgaaaatgaccatactgcccaaggtaatttataggttcagtgccatccccatcaagctaccaatgactttcttcacaaaattgggaaaaactactttaaagttcatatggaaccaaaaaagagcccgcattgccaagacagtcctaagcaaaaagaacaaagctggaggcatcacgctacctgactttaaactatactacaaggcttcggtaaccaaaacagcatggtactggtaccaaaacagagatagacactaatggaatggaacagaggcctcagaaataacaccacacatctacaaccatctgatctttgacaaacacaagaaatgaagaaagcattccctgtttaataagtggggctgggaaaactggctaactatatttagaaagctgaaactgcatcccttccttacaccttatacaaaagttaattttttttttttttgagacagggtcttgctctgtcacccaggctggagtgcagtggcgcgatctcagctcactgcaatctccacctcctgggttgaagtgattctcctgcctcagtctcccgagtagctgggattacaggcacccgccaccacgcctggctaatttttgtatttttagtagagatggggtttcaccttgttggccaggttggtctcaaactcctgacctcaggtgatccacccaccttggcctcccaaagtcctaggattacaggcgtgagccaccacgccaggcctaaacccttatttaactaaaacttgttttcagaaaaaaataaatctgaggatgtgttacatgtcccccttttacttagtgacagtcccaggcacacacgagcttgtcattaacaatattcatcaatttaagagttgatcagagaaggtcatacaagaatccaatctcagtggaattaaaggaaaaatttttgctaagcagaaaataaatgagaactgtacatttaaaataaataaatgaacagaaagcctttcaaatcgtactaaactaacttatatctgtggctactacattgttgttctttaatgcttaaataggtaaaagcactgatgttttagttgaaactaccagcagtaggaatgcttgctcagtaagagcaagaccccactaacacagtcatatttataaagtcaaggtttaggtgtctgccagggtctgttttccctaaatctattacaaacaaatgaaagcaaatcagtaaatactgttttaatgtacctataccgagtcataaaattattttcctcccaagtcaggaagaaacataaagttggttaactgaaaaagagaaagtttaatcattctgattttcattctgatgctcttctttagactatctattgctgctttcttttgtagcagaacagctgattttccgcctaggttttcatgatctgataaaccttcaccatagacagtttcttggaaagaaactctggaagtgtcagttatctttaaatgttcaggaagctgcgtgggtctcagacccagctggagcagagccagcacgggattctgaaagcatttgcaggctctgagatggttttaacctgttccttggcagtgcagcccttgtgtacactcttggaaagatactgatgtttactttcatgatgtagaatggatgagcagtgaaggtttctaggaaggttgaacacactcatgcccactttgggacacaaggaggcagatgctctcatgggaactcttcaaataaggtcgtatggtttggctgtatcctcacccagatctcatcttgaattgtagttcccataatctcgtgtgttgtgggagggactcgatgggaggtaattgaatcatgggggcagttaccctgattctgttcttgtaatagtgagttttcatgagatctttacacttgattaatgttaactgtagttgtcctactgatctatcgaacaccaagtcttatttcttctaagtgtatttgtacccattaatctactgctcttcattccccatccccactacccttcccagcctccggtaaccactagtctactctctatcctcatgagattcagttttgtagctcccacatatgagtgagaacatgcgacattgtctttctgtgctttgcttgtttcactgaacataatgacccccagtttcatccatcttgctccaaatgacaggatttaattctttttatggctggataatattctattgtgtatttttaccacactttctttttaaatatttattattattttgtagagacagagtcctgctatgttgtccaggctggtctcaaactcctggactcaagcgatccacctgccttggcctccacattttctttattcatccattgatggacacttaggttgattccatattttgtctattatggatagtgctgcaataaacatgcaagtacagatctctcttcaatatattggttttctttcttttagagaaatactcagtagtggaattgctggatcatatagtattctacttttacatttttgaggaacctctgaagtgttttctatagtggctgtactaatttacattcccaccaacaatgtgtgaggatttttctttctctgcatcctcaccagcatgttattccctgtcttttttgataaaagctattctaattggggtgagattatacctcatcgtggttttgatttgcattttctggataattactgatgttgagcacttcttataccctttgttcatttgtcctctgttgagaaatacctgttcaggccttttgccctttttaaaatcagattaatgactttttgctattgagttgtttgagctccttatatattctggttatttatcttgtcagatgggtagtttgcaaatactttctctcattctatgggttgtttcttcaccttgtttgagtgtttcctttgctgtgcagaagcttttcagcttgatgtaatcccatttgtccattttcgtttttgttgcctatgcttttgagaacttaaacaaaaaatttttgcccagaccaatgtcctggagcatttccccaatgttttcttttattagttttataatttcaggtgttagatttaagtctaaatccatttgtatttgatatttgtacatggtgagagatagaggtctagtttcattcttctacatacagttgtccagttttcccagtgccatttattgaagagactgtcctttccctgttgcatattgttggcacctctgtcaaaaattagttggctgcaaatggcatggatttatatctgggttcactattctgttcagtcggtgtttgtgtctgttttttatgccagtaccgtgctgatctggctactatagccttgtagtatatttttaagtcaagtagtgtgaggcctccagctttgctctttttgctcaagattgctttggttatttgtggttccatataaaatttaggattgtctgctctgtttctatggggaatattgttggtattttgatagggattacattgaatcagtaaactgctttgggtaggattgtcattttaacaatattctttcaatccatgagcatggaataatatcttctccattttttgattcatcttctatttatttaatcagttttttatagtgatccttgtaaagatctttcacagctttggttaaattgattctcaggggccaggcacagtggctgacacctgcaatcccaacacttcgagaggccaaagcgggagaattgcttgagcccaggagtttgaggccagcctgggcagcatagtgtgacctcatctctaaaaaaaaatcaaaatattagccagacgtggtggcatgtgcctgtggttgcagctacttgggaggctgaagtcagaggatcgcttgagaccaagaaatcaagactgcagtgctcactgcattggtgacagagtgcaaacctgggtgacagagcaaaaccctgtctcaaaaaaaaaaacaaaatattcctgggtattttacattctgtgtagatacaataaattagattactttctttctttttcagattgttcactattggtatatataaatgctactgaattttgtatgttggctttgtatcctgcagctttactgaattcacttattacttctaatagttttttggtttttaaaaatagaagatcctgtcgtttacattcaaagcgaatttgacttctttctttccaatatgaacacctttatttttttttcttgactaactggccaggacttccgctttatgttgaatgaaagtagtgaaagtgcacccccttgtcttgttccagatcttagtggaaagccttttaggttttccctgtttggtatgatgttggctgtggatttatcatatatggcctttattattttgaggtatgtttcctctgtacccggtttgttgagggtttttatcaaaagggatattgaattttattgaatacttttcagcacttattgaaatgatcatatggtttttgttcttggttctgttaatgtgtatcacatttactgatttgcatatgctgaaccatctttgcatccctggggtgaatcccacttgataatgttgaatgatctttttaatatcttgctgaattcagtttgttaatattttttgttgaggatttttctatctgtgttcatcagtgaaattagcctattgttgtcttttttttttttttttttttttttggtggccttatctggttttggtatcagggtaatgcccgccttgccggatgagtttgagcattccttcctcttcaatttttttttttttgaagactttgagtagaattattatagttcttcttgaaatgtttaatagaattaatcagatcctcgacttttctttgataggagagttttaattatagctttgatcttattacttgctattggtttgtcgaggttttctctttcttcgtggttcaattttggttgtatatgtccaggaatgtatctttgtcttctagatttttcaatttgttggcaattgtctctaatgattctttgtactcctatggtctctgttgttttgtatcttttttgtttctgattttatttatttgggtcctctctttttagttagtcttgctaaagttttgtcagtttttttttaactaaacttttgttttgttgatcttcagtaatgttttaatctcaatttcatttatttttgctctgatctttattatttcctttctcctagtaaatttgggtttggcttggtcttgcttttctagttccttgagatgctccattattagtccattattaggttgtcttttggtagtctttcaacttttttgatgtagatgtttattgctataaacctccctcttagtactgtgtttactgtatcccatagatttggatatgttgtgtttctatttttatttgttttgagaaatttttaaatgttcttatttcttcatcaactcattgtttattcaggagcatgttgtttaatttccatgtttttgtttaatttccaaaggtttttttgttttgtttttttttttgagatggagtctccctctgtcatccaggctggagtgcagtggtgcaatctgcaacctccacctcctgggttcaagtgattctcctgcctcagcctcccaagtagctgggattacaggtgtacaccaccacacccagctaatttttgtatttttaatgagacagggttttgccatgttagtcaggctggtcccgaactcctgacatcagatgatccacccacctcagcctcccaaagtactgggattacaggcatgagccaccacacctagcccaaaattcctcttgttattgatatctagttttattccattgtggtcagaaaggatacttgatatgatttctacttttaaaaatttgttgagacttgttttgtggcctaaaatatggtttattctggggaatgttccatgtactgatgaaacgtgtattctgaatagttgagtgaagtgtgttttataaatatcagttggacctatttggtctgatgtgtagtttgatacaatggtttctttgttaattttctgtctagatgatctgttcattggtgaaaatggggtatttgacgtcctccactattattgtattataatctctctctctctttgtatctattaatgtttgctttatatacttgggagctgaatttcagtccatcaaatgtattaatcagttctaagatttctgtttgattttttgaataatgtctctttgttaaatttctctgataaatttctgaatggagaattaccgttttgtttcttgttttctggttgttttgtaactcttctcctcctttcttcctgtcatcctttatggttaagtgactttctctggtactatgttttaatttgttggggttttttttagtgtgtttatcataggtttttacattgtggttaccatgaggcttatagaaaacatcttatagataaaacaagttattttaaagagatgacagcttatcttagataagcagtccccagtctgttttggcgccagggaccagtttcatggaagacattttttccatagatcaggcagtggggatggttttgggatgaaactgttctacctcagatcatcaggcattagatcctcataaggaacgctcaacctagatccttcgcacttgcagttcacaatagggtttgcactcttatgagaatctatgctgctaatgatctgacaggaggtggagcaggcagtgctgtgtgacctggttcctaacatgcgacggaccagtactggtccatggctcaggagttggagatccctgtcttagatcacaaaaaaaagaataaataaaaaactttaaaacaaccctccatctttaattccatcccctgacattttgacttttgtgggcctgaatttacgtattttgatattgcctatctcttaacagattgctgtagctgttagggtttttgatagatttgtcttctaggtgtcatactagaattatgggtaacttatgggtggactgcacatgacaattagagtatttgaatattctgggggtttctatacttgatgttacctgtaggttttataccttcaaatgttttctttttgcacattaatgttttttcatttcagattgaagaaccatctttaacatttcttgtaagacagatctagtagtggtaaattctcttagcttttgtttgtcagaaaaagactatctctccttcatacttgaaggatatttctgctgtttgctggataaagtatttgaggatagcagggttttttggggttttttctttcagcactttgaaaatatcattccacttcctcctgacttacggtttccattgagaagtgtgttgccaactgaagtggagtttctttgtatgttatatcctccttttttcttgctgcttttagtatcctctttttgtccttgacctttgagagttttattattatatgccttgggtgtagttttatttgggtcaaatctgtttagtgttttctgaccttcctctacctggatatttttctcatattttggaaagttttctgttattatttattgagtaagcttttttctacccctcactcttgctcaactttctcttgaacaccaataattcttagatttggtcttttaaggtaattttctatatcttgtaggcaatctttgtataatatatttccattcattttactttttctcctctatgtaatttcaaagagcctgtctttgggctgactgattctttcctctgcttgatgcattctgctgttgagagcctccaataaatttttcagttagcaaatatatttttcaatttcaagattcgtttgattttttatcacttcaatctctgttaaattcctctgataagtttctgaattgcttttctttgttgtcttggagatccctgagtttctgtgaaactgctattttgaattcttggtcagagagctcatgaatcaccatctcattagggtcagtcactggttccttgctttatacatttggggaggtcatggttccatgttcttatggatatatgtctgtgtctttgcattaaaggatttattatttattccaatcttctctgtctagtctgttttggtttttactggtatgtttgcttagagattatttgtaatttagctgttgaatttcttacacatttttcccgctaggtcactgcctctttttcagcactaaatggtacttaaaacccaggtttgcctctgttcttctagcaaaggatcagaggattgcctggctggaatgggggaggttgcaaaggagctatccctgtggtatggaaaggctggctaggagttcatgcccaagagacctgtggaatctacctcctacagcatagtgctgccgaacacccactctgatttggcgtctcctttggttgagttacagagcggagcttccagggctggagatggtaatcctgcctccttcctttgtgtccggctgtccacagggtggtatctcccttcaggcactcctgatgcttctcatgggttgaggcatggataggtctcctgccaaagaagccaagatggtaggcaagttgtgtgtccaacttaatctcactttttccagtgtagaatctgagttgggggaagttttacatgtgcttgataccaagcagattgggggaagggtgtcacagatatgaaaatctgattctcttactgtctgctggagtttttttttttttttttttttttttttttacttctcagtggccccaggaactgaccgattctctttcatgagttctgagagattgctggtgataatctcgatggtgtatatttattttggttattctgtggggagaagtgaagccagctttcatctacatttttaaagtataattcttattttgagtggcaagaatctgattccagtatcctgccttagtttttatgcatttttgaaattcctaccattgcatttagaaccttctacctggtggagttttttttttgtttgttttttgtttttcagttttggaagtatttgattttttgaaacagttgacattcatataaagaacaaggttgataatcaagcctgctctagtaattctgtgcagtctagaaaagagtgtactggggccgggcgcggtggctcacacctgtaatcccagccctttgggaggccgaggcatgcagatcacaaggtcaggagatcaagaccatcctggctaacacggtgaaaccgcatctctactgaaaatacaaaaattagctggacgtggtggaggctgaggcaggagaatggcgtgaacccgggaggcggagcttgcagcgtgccgagatggcgccactgtgctccagcctgggtgacagagcgaaactccgtctcaaaaaaaaaaaagagtgtactggttaagtactgagaagcatttcctgtgtgtctcatgtaagtacttcaggctcttaaatgtgttactccaaggaataaggttgcaaatacagttgctctaaaaacatattataccagcctggccaacatggtgaaaccccatctctactaaaaatgcaaaaattagctgggcatggtggtacacacctgtaatcccagctgcttgggaggctgaggcaggagaatcacctgaacctgggaggcggaggttgcagtgagctgagatcgcgccactgcactccagcctgggctacagagcaagactccgtctcaaaaaagaaaaaaaattacataaaattccgagatgcagctttcttatctaaaaaggatttgcgcaaagcctccttgcagtaagcatataggtaactaaggtgtctaccttacgtatatgcatcactcatttatgccctaagttctcatttgttaaaacaatagtgcccttactctaaatcacataatcacaagagccctagggctgaattgctcagctttaaatgtcagcactgtcatactagctgtgtgatgtgagcaagttctaaaactccctgtgcttgtttcttatgtatacaatggagagaaggggtagtactttgtagggttgttgtgaagtttaaacaaggtaataactgttaagtgtttttaaaagtcccttgaatgtaacaattgcatcagtggtaaggtatgcatttttctcatatggcctctgaaatgaggatgtgtcttataatgaatgtaatttcttaataagcattttatcatttagtgacatcttttttattagtagtacttaatgttacactttgggtgacattttatatttcaataactaatagtaagaggtctattaacattagctgccatcaacattaccatcaatattatcatcagcattatcttgtttctaactgagatagtggcatttgatagtttagcagtgctagagtatatatcaaatctcaattttatctaactacttgtttgcattggtgtatttttatcaaagttctagtgtgctgtttttcatatttgtatcattttagctaatgtaaagtatttatggggtcagctcatgcaatgtttccgtcattcattgtaccttacttggcgatctactaaaacatgcatcagcatccttcagtctcccgaaataaatagacacaaagacaaattctttattttctctgttgatgtattttcctaaatcgtttcgcaggagtggtttctttcttagctaggagaactaagccaccattgtaccacttaagatttactggtttgcactgtcctctgagggagaaaagaagcaatttattgatctgtaacacaggaatggactgtggccaaaccttttctggtttatacaatgcaccgacataagaatctgcatagcattaagaagaatgagcactcacaatttgaggccgcctgtcagcatgaataataactgagaaaaatcaatacacaatatacaactgttctctttgcacagacactgccaggattcacacccagtgacagtgtcttcttttttttttttttttttttttttttgagacagggtctctcactctgctgtgcaggctggaatgcagtggcgtgatctcggctcaccgcaacctctgcctccctgttcaagtgattcttgtgcctcagcctcccaagtagctgggatcacaggcgtgtaccaccctacccagctaatttttgtagttgtagtagagatgggattttgccatgttggccagcctggtcttgaactcctggcctcaagtgatccacccacctcggcctcccaaagtgctgggattataggcgtgagccaccgtgcccggccaacagtgtcttgttattttaccagtgatatgcttacagttcctaattttaggcttcctccttattttggttttattgttcagtttggggaagggtgggaggcaccaatttggatctgagaaaaagatcttctgccagatgaaagagtttcaataacaggagaggaccttgggccaaagtttattaagcttgactaggaagattctgggcacatctccatccaaataccttgacacatacttcattcacccctagcacatgcagcttgtcccttcttgtcttctgtttgccttcaaggttttacatggtggtatttacaagccgttatggagcaagagtgcaaacacacaaggctagcaaggggccagtaaacagggtttggcttagggttttgtggttgttagcttttaaaagcatacttagttgaataattccagaaactgggcttctttcctttgccccttcatttgcccctccctctctggtcttcccagtctccacttttttttttgtttaaataaaactgcgtttgtcagaaatgtatagacattcactcctattcttaaaagacagtgtttatccctaatgcctgccttttgattcagccagcagtgactgtgcacacagaggttattgctctccaagttcaatgttgtggacctgaaccagtgcctctgtttccaagagaaagtcaggtgattaccccttcatcagggagattggagccatcctatccttctggtgtgtcaccagccagaaactaaggatcagcagggagtggatggtttagaatctcctctctccaggtgaacacaatgctagtcagtgtagctggaaaagccacgcagcgggcaggcttgtcagaagcaatctgtttaaaaaaaaaaaaaaagagagagagaaaaaagggtccttttgaatttacactgagttgctttcacagtagttagctttgaactgtggtgcaaacccatttaaacaatgagggaaatttcactaagtggcaagaaattctcaccctgtgtgatcaaagcaatcagccatttccttttctttcctttttatttacttatatttctgaccccttataatcttcatgattgtagcctgatagtttccttttttgaatagcatttaaaaaaataccttttcttttccctgagggttttaaagcaaataagacagaaggggtctaaatttttagttttgttttttgagacagtctcgttctgtcgcccaggctggggtgcagtggtgcaatctcagctcactgcaatctccgtctcccaggttcaagtggttctggtgcctcagcctcccgagtagctgggattacaggcgtgcaccaccagccttggctaatttttgtattttttagtagagaagaggttttgccatgttggccaggctggtctcaaactcctgacctcaggtgatctgcctgcgtcagcctcccacagtgctgggattacaggtgtgagccaccgcacctggcctaaatatttatttttaataatgattattattacaaaagtaagaaaagagctaaaatccatgatttcatcacccagaggcaaccaccacagtgaacattttggtacaattacttctcatcgtttaaatgtgtacatatacacatacatatttttaataaaattaggtttaggatagtatacagttttgtttttcttttaaccaacatactttgaatattttgccttattaaaaacttatatgatttcaatggctgcattagaattagtgtatacagatattattttggcattctgttgttaagaggtcatgtgggtttctgaattgacactttaattctcaacttagaatttatttctcccaacttcttctgatttcatgggtctagagtcagagtttgggcacaatggaaatgggatttctatatgtactgttgtttactgtttgctagtatttttcgaaaggtatttgcaaaaaccaaaggggaaacagtatacttttttgtatttttttttctttttttgttttaaattttgtgattgaaatataagtcttattatggtaatctcaggtaacttttaaatagaaatatcaatgcaaaatgaatatattgcccaatgtggaccccggtgtttcagaactatgtgccatgctctatcattttgttactggaaaggggtcttaatccagaccccaagatcttggatctctcacaagaaggaattagaggtgaatccatagagtaaagtaaaagcaagtttattaagaaaataaaggaataaagaatggctactccataggcagagcaggagcgtaggctgctcaactgattatacacacagttacttcttgatgctaaacaagaggtggattattcttgtgttttgcaggaaaggggtgggtagttcctggaagtgaggggtcctcccctttttagaccatataggataacttcctgacattgccatggcatttgtaaactgtcctgctgctggtgggaatgttttttagcatgctaatgcattataattagcatataatgagcagtgagaatgaccagagatcactttcatctccatcttggttttggtgggttttggacggcttctttaccacaacctgttttatcagcaaggtctttgtgacctgtatcttgtgctgacctgtctcatcctgtgactaagaatgcctaacctcctgggaatttagacttaaaataaaggtctcagccttattttatctagcccctactcaagatggagttgctctggtccgaatgcctctaataatttgaagtttatccaacggcacagtgggagataatgaatttttgtttaagaggaggaggactgactggatcagatttgtgctttagaaaggtggttgcatgtaagaaagaggcgttggtagaaagacttcggatatctcaaaagaatttccatgaagttaatctttttaaaaatgtaaacatttggtgcaataattgctttgaaattgcagttgaataaatgaactttttgaaccagaatttggaaaggaagatatgcttaaaaaccaaaaatatttcgtagagtgctacacattaggaagtcatttgtatttggtgaccactttcctaaaatagtctcatttctagagaaccaattttgtttcccatagattattatgtgtagagaccccctttcagtatgtagccactggtacatccgtgggtgttatctccatactgccaggtccaatgcagtcacctcctggatctatagtctttctccccccattccgatttcctttctctgttagcagtcatctttgtaaacagaagtctaagatttagtttgtacattttttaaatgatccattttgatggggctctctttattgtttcaggttgaatgcctttgagaacttgatgcataaaatttgcatgactcctcactcctttctggatctctcattggactcaagccagcatggctcacaccacaaaggttaacggcagtgcctcaggtaaccctgtgctctggagtttgtgtgttaaatgtatgtcttttctcaaactaattttttattctctttaataatgaacggataatagcaagttgcctagataactaggatttcaaagcaattttctgtccattgaagtttgggtttgttttgttttactctcagaaaatttgcttttatcttagagtcttgcactgaaatcaattgagtaaattattacctaagtcaattctgttgaagtgttgaaagacaaatgtaaatactgaatgctgatgcaaatgtaatgtatactcctcttgcacttctttctgagggattgaatgaggagagaggaaattagtttggatgcttaaaaccaattcctagtagccactcccaagcagcttttgtttgatgttgctaaacaaagagaaaggagggaagagaagtatatattctgtaaaatgattctcttaggaatatgcaacaagccatattatgaatcataaagacctgtatttgaattcttattttggttatattagagacttacatagtttcactttctgttccaatattgcttctgtgagattcgggagaaatctgtacacgaaatgcagagaagatcctcctaagagacacatcaccatagggacaacctgcccaaaatggcgtgccaagtgttcatttcttttttgagttatgtgccaaatagctgaatgagtaagaatagtaattgtctatgcagaaattttttctgagcgtctgagtccagactcctacgtctgctggctctgaacaccttcaaatgacaacattatatactggagcaagtgtagaattggagccaggaaacctgaatttgagtcctagttccagcactaaccgtgaaatattgggcagggctatttctccacatgtaaaccatcggtaagtatatccacctgccggtttaggaccagtgagcgcaccagaaacatacttagaggagctatgtaagccgtaaagcacttttgaagacaacagcaggaagtgacctctaaagtgggcattcccagcccatgaatgtgactttttattctagcggtctcagctgcaattatctcctctgggtagaacactataacccaaacccagataaactcagttatttgttctgggatgactgatctttccctgtccattccatttttgaccttttttactgcccagcttcttgagacttttatagattctgctgtgggactgctatcaataataaagacatgaatgataatatctaacattcattgaacacttaaatgcaccatggtgcctaaaatgctttgcctgcattttcatacttaatcctcacaataatctaatgagattaagctattattttactgtcatcatcatccctatgtaatgtcacagagaagttcagggacttactgtaaatgaagtaagaaaaatcagaattatgggcagtggctcacacctgtaatcccagcattttgggaggccgagggggatggatcacccaaggtcggtagttcaagaccagcctggccaacatgacgaaaccccatctctacaaaaatacaaaaattagccaggcatggtggcgcatgcctgtaatcccagctacttaggaggctaagacaggaatggctggaacctgggaggcagaggttgcagtgggcccagattgcactactgccctccagcctgagtgacagagtgagactccatatcaaaaaataaaataaatcagaattatgatgactttctccagtaaaatatttggtgagagaggagattgaaacattatgaaatttcaagtgtagtgggtgggttttaattccctctgatgatgtggtttcctcccttgccctccatttgcttccattcacatgctcaggggaaggggtgtttaagattgttggtgcctcaagacctcaaccttcttctggtgccttgggcaaaatcctttcttcatgggtttagatacctaccccactaattcctttccaacttggtttgttctgtacttaccttttttctttgttcctgagatctaataagcaagctgtaacttttccttcccacctggtatcctgcctaacaggtctgggcattgaggttgaaggcaaaagaaagctctccgatttgtgactttcagggtgtcagagtatgaattgttactgcagacagttatctggactgtgcaggggaagattttttacttattctagtcaccatgacccatgtacatctataagcaaatctaattagagactcaaccataaacagtaatatatatgcaaacatacatatatgtgtgtatgtgtctgtatatgtatatacacacatagtaatatatacatacatatatgtatatacaaacacaaatgtgtgtacaccatatatatgacactcatagaaaaaaaaaatttttttttgagatggagtcttgctctgtcacccaggctggagtgcagtggcacgatatcggctcactgcaacctctgcctcctgggttcaagtgattcttgtgcctcagcctcccacgcagctgggattacaggcccatgccatcacgcctggccaatttttgtatttttagtagagatgaggtttcaccatgttaaccaggctggggttgaactcatgacttcaggtgatctgcctacctcggcactttgggattacaggcatgagccaccgcacccagctgaaaatttaaaagtatagatgtgtgttgtattgtctgaaaaccaaaacaaaagcaagaattactggtgataataccacctagaaataaatgtcttcctattttttatatagttgtcaaatgttatatatttcacatggttgagaatatgttaataaaaatcattcctttaccttttcccactttgtattacaaaggaaacacctctccaatgtttaaaaaaatactcaatgtaagagatgcgggttataaatacacttctgtgcatgtaaataacatttagagaacctagatgaagatgagataaagagggcttcatggcagctagtgagggccaattactggtctcctatgagaaaaggataagctatttgggtttagtaggagtttcagatgtggagtaaattatatgtttcttcaatttccaaaaattgctgcttgggcttcatagagcatgaggggaaatttcatgtgacgatggagtcagggcagtggcaaaagaagcactttccatagtgttagtaataaaacaagcaaaagaggagcctctgggaaagggcaaaccatgcccttggcacaaaatacatccgacgactgatcatctcaagttgacatccccatgtaacatttaaatgggataaggggtgattcacaaccttttatactctgacttccccttggagtccctcacggaggctgggtaaaagaaactgcttttaaaacgagctattcattaatgctgtaatttgtaaaatgtattatgccacacttcagacatacaaaatgtgtgaaagttatataacaagcacctttgtacacactacttagcttaagaaataaaccttattaatataggccagatatacatgagcacctactacgtgctgttttaggtactggggatacagcagtgaaccaaagaggcaaaaatttctgccctcaaggattgtacattctagggacagttaaagtctcctgtgtacacggttgccagaagaaaaaatactaagcacgtgttcatcgtttatctaaaattcggtttaatggtgctccactttcgtgcgcggccctacctgtgtaccccttgcagattgcacccctgcccttcctcaccgccagcccatcaaaatcaatcttccctcgtagtgttacctctttttcaccagatcctccatcctacttctcttgattggtacagtactgttttcattaattcaaaacattttaggccagatggggtggcgcagacgtgtaatcccaacactttggaaggccgaggagggaggattgcttgaggccaggagttcaagaccggtgtggggaacatagccagactccatctctacaaaaaaaaatttttttaaattagccaggcatagtggtatgcacctgtagtcccagctactcaggaggctgaggtgggaggattgcttgagcccagtagtctgaggctgcagtgagttatgatggtaccactgcactccagcctgggtgacagagccagaccctatctctaaagcaaaaaacaaaaaacattttattatggtactgctaacagtactgcagcgtcttttgttaaggaggtaagagcatcataaattgctcttgactgttctctcatagccagctaggaagtaaatggtgattgttggttaggaaaatagctgtgtttctttggggtgtagggatgaggcagtctgctttttccccaagtttctgaatcatgttgtaaactgaatgcactgattgatacctctctaaacactaatgttgtgaaactttaattagagcttagatatgctttagaagccaaataacaagtggcttatttgtgaaagaaagataataatagctatcctaccttcttcacaaggtggttgtgcagggaaaaaaagaatagctgtaaaaacactttttaaaacacaaagtgctggtcatatgtcaggggatagcaccattccccttgttctcttgtccttgtcatgagccgctgatcaggaaacatcccaggtaccctcatgtcaggccctgctggacgccatgatattggggccagagttgtattaacatcctcattaaacccagttaaatgacataaatggatgagcactgggaggtgactttttatgcctgctcttatcatctttatttttgctactagttgccttccccaattgattatagcttttccctcatgctctttctttttttgcagcctggatatatattttttcagacagatacatatttatttattaaagatgcttattgaattgcattaaaatgttatttaggctgggcacggtggcttacgcctgtaattccagcactttgggaggccgatgcaggtggatcacctgaggtcaggagctcgagaccagcctggccaacatggtgaaaacccgtctctactaaaaatataaaaactagctgggtgtggtggtgggcgcctgtaattccagctactcgggaggctgaggcaggagaattgcttgaacccgggagacgaaggttgcagtgtcccgacacagtgctactgcactccagcctccatgacaaagtgagactccgtctcaaaaaaaaaaaaagaaaagttatttaaattaatgataacataaaatttgacaggaaaccagaagagaagaattactcaaaattccacactaggtcttatttttagtatttatttttcatgcttttcaggctaacaaacttaaacacagtttcaataagcttttataatttggatatcagctcttgactttaacattctttgcatttttccaagtcttcatggaaaatagttttcaaattattattttcaatgactgtataatattccttatggtgtttctaccagttgaagtattctttttttgtttggatgtttggactgcttccacattttccctatggtagatgatgttgcagagaacatcttccctggtcatttttctcctccttttttattatttcccaacaatttcaaagaagcaggatgactgggttaaagggcacaatgttttcatggctttagtaactgttgtggggcttgaatctcgttatcttggtcagttatttggctccagcttttgtctctatgctgatcttaaatgagtacaaaggccactgataagaccgggtcagccagacagagccaggctcatggcagggtaggcagaatgctgcagtgcggtgcaccccactctcgcttgtgtaaatatttttctgggcaggagcgtttctcaaacagaactctgagcccactgcggtgaacctgatagcaggaattacgtgctatttgtcaagtataagactagtttgcagtgactggtctggctagaacccacctggtgttttctgagatcatctgtaaggaaacacacagcacagcagaggcagtgtgcgcccgtggtggtgagtcttagacctgtcatctgtgttagcattaccccgaaggcagagagtttgctgattagaaactatggctgctttaattcatgggtaccctccgtgacttttcagggtctcctggttgaatgaatttgcagaaggattaaaatgtgtgttcttatttgtgctttgtattctcccataagtagtgtgttggaggctattagaatagctgagagggtaaaacataaacacataggtaggagcctgacataaacacataggtaggagcctgccataagcacgtaggtaagaactaaaagggtgtgtttccatttcagttgtccagccttccttccatactctcagatgacaaaacacaagttgctgagctcacacagctaatgactaagccagaagttggacatggagaacatttttcctttgttcaaggttatttattatgttgacatttaaaatcagaagtgtgatatctgtgaagttctgattaaacagatcaagtgaaaaggatgtagttcagaaaactgcataaaaccctaaagtacagtgtttaaaaataaaacgtcctccctgatagggattatgttggtaagttactttttttcttagtatggattatttcaaattaataaacatattgttattcctttatttattgcatcatacagcttcatcctagtattagtgtgtttaataattgcatttaattagattatgcatttcaactttcaatgaaactgtagctgttagtcttttgaaggctaatttcacgctgaaatttatagatgaaataattttcttatagtggtggtgtttgagaagataatgtaactacttcttagatttcaatttcataacccttaaaatgttgggaccacctacaaatgggggacaccctgggttttgaagtcttgcctgtgtggttaatcagaacctcagaattcacccagcccccggagaggttttgaaaagcccctggctcatcagagcttgcttgtttcataaactcttaaggctttgttttaacctgtagccagcttcgccttataagctttcttgccccaagccttgagccagtcataatggcttaagcatcagatttcagacaggcgattagctctccagctaagccaagaaaggatgatttatcttccagtgagtaccagcctatttgagtgtaggaaggagaaaaatctgtgctcctgctcctgggtactgggcaaagaaaccctttggttggggatttttgcctggtaccaactttataggtgccaacaagaaagaaagaaaaaaacacatacaaaataaacacccaacagggagattcgctgtgttaagaactcgagctgttgctattattctaagagactgggtagccagtcaaagggttaaaacagcccttcctacaaggatttgaaaactctgtgctctgctcttcctcagcagacttctcgttgtgagtattggcatttatttctgattatgcacttcccctctttcttgaatgagttgggtgggctagctgagcccatcaaaggtatagctcatttgcttccttttccagggtttgccttcttcctgtgtctgggataatttcagttcatctcctttgtgcagtttctgagaaaggtttgtatgggcttagaggaaaatgatcgtgactaaagctcacagtcaccgctttggctccttttctataaaaggtggtttgatttgatctggcatgaaaaatattatcataattctcaaattcacagaaacgataagttcttgctctttcctgaccaaaaaaaaaaattaattgcattgggtagacttctctaataaaacctttaaggagacccatccaggaaatcagattttataagattcattcaaacagttgtagaaattctaagttcaaaaaccaaaagcagactcttttctttttccttccttggcttctctgttggatatttttggagtgagccttaactgagttactcatttccacatgctttaggaaaagtatgctcatgttttacaggctaagcctggttctgcttttgagctgcagttcattatgaatccggaaaacacaggtttttgaaatgcggcccatttgtacatatagcattagtcatctcagctggtagttctatacgatgagttatctcaccacttaaaaataagtacgctgctattttgagatttaaaaatatatatagtgaccagatttcttaccctagttaaagcaagccatggctgaaactcagattaaacaatattctataaaaatgagagaaggccactctaatcaacagatagaaaaacagaactatagacataagggagagctgtgctaagggacaaattgttggatttgtaggatttgttcgtatcctgaaagttaaatctttgtactcttaccttgtttatggccagatttgcctgatccctgatttccctcccaactggatcagaggttgtggaattggaatttcaccatacaaacctttacttaaaggaggtagtactagagtaaccatttatgggaacagtttgctactaatagttactagtactgagtttattttagttcctttttcatgattttattccattggaaaagttttctctcagggatcttttctactttggacatgatctctgttaggcagaatcaaaagatagctgtgtggctttctgaatttagtctcacaatatttggtttagttgataaatcccatccatcagctttgcaaataattttgtgaaaacattgattcagcttgtcctgcccaattttcccatccctgcccagtttactgagtgccttttccatttgcatccactgtccattaggccaaggcgtttgaagtgtttctgtacagcaggtacatttaagactctccaggaagaaagggggaagaatattccaaactgaaaacatcaaagagagagatggggtatttccagtaacttatatgcccagtgcttaatatcttaaaaaccctactcatgtgcatcagctcttacttttttctaactaaaaccagaaaaaagttctctcttcctctgttctcagtatccccctcatgtaagtctgtctacccaacacggtgcagccgatttatttatttttccctcagcatttttaggtggattgactgggatgctttattcaactcagggacgcaccacgaatatgttttttggggcaacccgtttggcatgttccccctcagctgtgaggacaaagactggtttgtcttcttgtgacctggcagaggaggcagaagtacctgctgagcttatgcagcatgtaccccaaccggtgccccacctcttcaagtggtgaatcagcctgatgatacactgatttttagaacacgctagggtggagacctggaagtctgtacactggtcggggagggagggatggtttgcatgtcaaaccatttcaacaatgcagcttacaggaaaaaaaaattaattgcaaaacactgtgatgccctttgccaccagatttttccattagcaccacactttatacagcttccaagtctgccccagggacaactgtttggcagtgtgaggggaaatggcagcatcacgtcataagtgcaatgattgttacctatgagcctatccggtaagggatctgagtgggcccaagcatcacacacgtgctggagctgagtgttctctgaggaacatgctaggatgttacttgggtgctagaaaacagcagctggaattcacaacacctcaggacactgattgtaaatgaagaatcctgagactaaacatcttctagaaaggtaaagggggcttagggctgggggcttttcctctgggctcttatcctttggtatgttgtccctggatgctttgagatgagactttgcagatactgctgaatttcttttcttttctttttttttaatactgctgcatttcaattggggtgttgtttggggactactggaaggaatgttatgaaactccatagaaatacttcaattcagtgagttcattcattcagtggctcacttttaaatgaccatacagatgtatttggcagaatacatctttgccattttccttctttgtgtaatggaccagccccgaggctgcgagcattggtccttctttgcctttttctccctgctttgtggttttgtgtatgtaaggatggctggcaagattaaggatcattgagctttgtattttctgttatttttctgtctccccaaacattttcactttcacaaactttaatctctaactattattcccttatcttaactctgaacttttgttttggacttattttgtctgaaatcatggtctatttccgtttcttcagttcttgtgtctgtaaaaatcacagtaggccttaccggaggtccatgactacaggtactcagagaccagctgtatccaaagagttgtgtaagataggggcatctgctccctcccagtgctgttgcccagccccaccctgccctgttccccagttagtgtctttgctttcttgacctggatatctttcccatatctattaatataagcccttcttatccttcaagtcttgctgcctctcttacctctcccaacaggcattctcagatactcccaatgggagttcctctcttcctcttctttattccttttattctgttattattctattattatttctattaaataattgccatcagttgcttttaattaagagttacggttgtgtgcgtcactaatcttataaacttgagtgttttaagaggcaagaatcatgtcatcttcttcgtatgcccaacaatgccttgcttagtagtccttgtagagtcaacagattcaatgttcaaccagcaaatatttgcagagcacctactttgtgctggcatgatgctgggcatataatacaggtcaaaaatcaggcccagcacctgcctaagaatttgtgggcctgagccctgccagttgccaatctgatgtgctatattctttgcagttttcttccagccttttcccgtaagttcccagttggtcgctctgtgaattcatgtgtgacacttcacctgggtgtgtttcctgggtgaacagatggcttttactgtgtcacacacacactcttgcgttctgcctcctctcgtgaaagttgtagttatctgctttctctccctcacttgctctaaggcaggcttaagatggtgttgttgctgggtgtggtggctcatgcttgtaatcccaacactttgggaggccaaggcaggcagatcagttgaagtcaggagtttgagatctgcctggccaacggggtgaaaccccgtctctactaaaaatacaaaaattagctgggcgtcgcagcgggcacctgtaatcccaactacttgggaggctgaggcaggagaatagcttgaacccgagaggtggaggtcgcagtgagccgagatctgcacttcagcctgagcgacagagcgagactctgtctcaaaaaaaaaaaaaaagagtgagaaagaaagatggtattgtctgttaagtgccttgggttccagagagaggtgaccaggtatgttgtggctgtcttaaggggaagattattgtcaggggccatttggaaagttcttcctggctgccatggcctttcattgctttttgtggcatgttagcagcacaaccagatagggaggaggtggtactccagttggttccttttgtctcaggcttattctctggtgcagcttggtgggctggttgcaaccgtaggtaagaacctgagctggtagcccctgggggtatggctggctggcctgctttccttctttcccactgttttcttgggaaggtctctacagacctcacctcttttaggtgtgaggagataaatagtccttattatcccttatttacagccttcatagagtctttgtagtaatctaagttaaggtcttaatgttcttatttagttctgtgtccccccaattcatttggtattggcttttcttaatgctgatttcaaatcttggatgaaaatatattatgagaccatctcttctttagatgtgacaaaggtaataaccatggggcaatccagactgtgaagaaagcctaaggtgtagaaagcccatgcgacactagttttaagccttcacatgtgtttggggaaatgcgtttgttgaataaaggataagaagacagaagactttttatttttcttgtcttttaaggtaggaccatcagatagcatcgtcttcctaaagtcactctcctgacaagaatcagacccctctgccggggcacaccctcctcatgtggaaggcagggtggcctctccttggaaaatctcccctcatgttaagtcttctgagcggatcctgctaatccaggcatgtaaaggaggagtcctcatccaagacccaacatggtgcacacctcacaggaggaggaatggaaaagcaggcacctttgctggactttccttttaatcccctaaatcctgtcacaccctaagactatgaaagagatgggtggagaagagccttggtgctgtggaaagggccatacccactttctccctcattgcagctcacagtgtaggtctcacacccatcccaagcacctaaggggaggggtcggttaaagcagcacaatacagtatttgaactcttcaggggtttggggaagtccaatataacagaaataacccaggccctcagcgtggggtagcagagcatcctcctttcactctgtctctttctaaggcaaatactcataggtagagtttttgcaaggtaagcttacctgagccagaaagggtgggaggaatgtgagattgttttgattgttgtccttgggttttgttgttgctgttgttattgttgtttataagaactacaagaggctgggcacggtggctcatgcctgtaatcccagcactttgggaggctgaggtgggtggatcacctgaggtcaggagtttgagaccaggctggccaacatggtgaaaccccatctcttctaaaaatacaaaaaaaaaaaaaaaaaaaaaaactagctgggtgtgttggcaggcccctgtaatcccagctatttaggagactgaggcaggagaattggttgaacccgggaggcagaggttgcagtgagccgagatcccgccattgtactccagcctgggtgacggagcgagactctgtctcaaaaaaaagaaaaaaaaaaaaaaggctacaagagagaatgtccctagtttatggcttttcagtaccaaaatagtatgcattcagcagtagagtaagcagtagcagtagaatagcaccatgcttatgcatgacataagcttcatctgtaaaaggctgaagtaatcataccttgctgtagggttgttgtgaggattaaatgagttcgtgtatgtataaggcacctgcagcagtggagtccagaagaattgtgcacagtgggtggtggggaaagatgagggcagggaacattgggggaggaaagtaaattcaatggatgtcaggaaataggcatcttgacctgtccacagtgtaattcaggccaccactcactacttaatttaactttgttcttatctctagactaatggagcaggctctctgggggaaaagtgttgctgcagtaatcctgttaagtgtaagaactgaaggttcaggttgaagtctcaaagttccaaagccaccatcccagggataaagactgtgctggtatacgctcagccagcctggtaccacagaaggcttttgtctccagcaggttccttttctcactgggcgtcaccttttctggctactctccgcctgtcagaggccaagccttgagtatatcttcatcttcccacatcttacttggcttctttctttgtatgtatattgaaagagtaaaggcagataggtgtgtgtttctctcttcagtgggaacctttgtgactgatggtttccaggcagaagaggttcaaatttttaattgtttcccttcccaacccttgtcatcgtctgataaaggactaggcatttatttgcatacaatgactttttctggtggacctcaccttcacagaagcacagaggcaaacacccatagggtcagatacaagctactttagcaaaatgattgactttgactgctttatgtaatctaaactcttaccagaacacaatatttatgaatgtagcagatttttttttttgcaggatcaagaaacactacattcagtactttattcgtttaacttttaagaacaagtcttttgatagttttaaaattgtatgtgtgtgtgtgtatatatatatatatttatttattattattttttttaatagagacaaggtctcactattttgcttaggctggtctcaaactcctgagctcaagtgatcctcctgccttggcctcccaaagtgctaggattgcgggcatgagccactgcacccagccgatattaaatcttagtttggaatataataatgtaactaaataataccagaatttttttttttttttttttgagaccagagtctcactctgtcacccaggctggagtacagtagcatgatcatagctcactgcagcctcaacctcccaggctcaagtaatcctcccagtctcagctcccgagaaactgagactacaggggcaagccagcacacctagctaattttttttttttttttggtagagacagagtgtcactgtgtcatccaggctggtctcaaactcctgggctcaagtaatcctccttcctcagcttgccaaagaattgggattacacgcatgagccaccatgccccccaaaaagggttcttttaaatgccttcttcacctttgtctaagtacattgggtaaatgtggcactagttgaacaagatttactgaattttatcacagggcaggcaggcaaagccagttctaaacaataaaacagagatcaacaaagatgacggatgactctaaatagcctgttttgtaaaattcaaaacgggacagctgtgtagagagaggcacagttttataagaattcactggacctgcctagtttggctcatcttggtgcctgcacatgccctgccttattccatttactttccttctgtctcatctcctactggtgaccacagttactgatgggagaccttaaaggtgattatctttgagacacatactttcctgtgtgaagacacaaagattaaactctataagaccatggcacttatttgggcttggggcttggtttataccaaataaaccaacagattaaaaaataacaaactaaaaacaaagtttcaagtgccaggtattttgaaatagcagatccaaataatttcatattactttacacaacaagacctccattagtaagagatttgggttagattttttcttccttttttttttttttactttaaactttattgagctgttttacataccatagaattcacccattttaagtgtatggtttgataagttttagtatatgtggacagttgtatatccacaatccagttttagaacatacccataacactaaaaattctcttgaggtttatgttatcatttacttttgacagaaatgttttcttctgcttttgaaaaaaaaaaaaattctgggccatgtgtggtggttcatgcctgtaatcccagcactttgggaagccaaagctggaggacttcttgagctcaggcattcgagcccaacctgggcaacatagtaagaccccatcactacaagaaaaatacagaaattagctgagcatggtgtcgtgctactctggaggctgaggtgggaggatcacatgagcccaggaggttgaggctacagtgagctgtgattgcaccgctgtactccagcctaagtgacagagtgatacactatctcaaaaaagaactttttttttttttaggtaatgaatttaaatcattaggggaacataccattcttactaactttttgaaacaaaaacaaaggttgctcgaagatgttatgaataaaatgtttaagagtatgagggtacagagcaagggaaggaggcttgggcctatggtttacgaatggtgattgtttttagccttctaattatatgttgcattaaataagaagaaaccaaaaaggaaccacttgcctccattccagcctcggttcagcataaaactcaatcatttccttcacaagccagctgctgtgctatagctcaaattgtaacagagagcctttctctgcagtggagggttagggaaagagggagtaagtcagcacaaacaatgaggaaacatttgctgcctttctgatttcttcctagaattaacaggcttacagctgcatttctaggtcagcatttcatatgcctgaagagtatgaggatagtttgaaaaatcagaaggaagatgagagagggctttgcctcttttttaagatcttgctagcagttttgtttgttggtaatttttgctgtctcactgacgccaagagtcctggaattaaaccccgtggccagcaggctgttagttcgtcaggaaattccaaatgggtataaataaattctctgcaacagctcctgggctctttgcctgctaatgtgtggagtccctttaatgctgagggaagtttgcctgagacctggcttcctgctcgctgaaaatcacagttattttgtttctgggtgggtaagtaagaatgcccacaaaagaaagagaggaggagagcatgatgtttgggtgggggttggtgaaatataaactcgagctctgtgtgttgtgaaaaagatttgcttttacttcaagctagaaagaataacccagtacttgatttttggtccagtgaaaatttcagctttacctatggctttaacataaagatgtcattgttgcaggagtgaatggttgtacatatatatatgctaagatttgagtttttgagtttaaggtttagttcaattcaataatttccttttttgttgctaaatccatctttgggtatttgttttcagctctgtttttccaatagggagttgctcaatattcattaaagctggcttcttgtataaacactataaaacaaaataaggacagggattcatacaaatactagctttccactaccaccccacctccccctggccaaaaaactgtaatgttttgttagaaaagcctgttttatccctaagttagccagtgctccttttctgcttttcacagaattactctctgaactggcacatttcttttttacgcttagaacagcatgttacttttgaagaaagtttggaaaataacagtccaagctcattctcttctgtgcatgcatgattgatttgggctgtatttcagcaacaacttttaaaatgagacagtggacattagagagcagcatagttggggttgcacttaggagcccatggcattttggctgttttgagacagatttggggtaaagagttgctgcatcttgtagttggcactgaacactggagaagagggccactgtataaaccgcaaggcccctgttaccatcacatgcctccctagcacaatgtgccctttattaagacaggccgttccactactgagaatagtaaccctttccgctgtcttcccctcactcttacgtgcagcctggcttctggcctcttaacccatgcccagagtagaattggcaatacccaggagggacactgcactggggattgttaggtcatgccagttaggatgcagctggaaaggtgctgctgagtgggacgtgcagaggggaagactgcaggctctgtctgcctgagctcatctggtctgacacctgccgtgattcatttttcttcatgccatgttaagaaattttgtatcaagtctagtcgacagttactcatagcctggaagcaactttggaaatcagagttccactgacccccctcattttaagggtatgaatcacatcactgcattgtatgattccagggctctcttgcccatggctcgtgcatgaactaggaagtgatcatagttcctgttcttgttttatgaaaacaatagtataccttcccccaacctaggcaggccattcaggacgactaccctggaggtgctctgggtggcttaaagcaccgtctttgcacagtgtgttagagagcactgtgccctgaggacttcgggagagctgcagaatgagtgttcagaataatcggcactcacctttgccctcatgttgtgagatggagatattttaacctggccataatatgctttaaaagttggggggtgtttgtctgcttttgcttttatttccttcctgtgctggactgggactcccccttatctaactggtacataccactctgcccaagcagtgcgtgtgcacacacacatcccctacagctccctgctggcatctccttcatacactcttaagaagaagaaaccaatgtagaactcaagattttagcagacttacttggtcttgaacaagtatcacaaataccttaaaccctgacttcgtgggggggggggcaaggtatagaggaggaagggttctggatcctctctggggggccagggttgtgttcttctccagacaacagagggtgatccagtaccactagtagtgacaatagaacccacccattgttctaagtgacaacacactgatgcaggtactattattttctcaaacaattggaatatagtctaatttgccgacagctgcaaagcagcagagccaggattcaaacccaggcagtctggccccagagtgcctgcttcaaatcactacatctcttcctctgttatacttattcatcagtagatgcctagatgtggggctttacacttcagcagatactaagagggccatgtaccaagcgccaagtactgaggaatacaaacataaatactgcttgagggccaggcgcggtggctcatgcctgtaatcccagcactttgggaagcccggctcacgaggccaggagatcgagaccatcctggctaacatggtgaaacgccgtctctactaaaaatacaaaaaattagccgggcgtggtggcgggcgcctgtagtcccagctactcgggaggctgaggcaggagaatggcgtgaacccgggaggcggagtttgcagggagccgagatcacgccactgcactccagcctgggtgacagagcgagactccgtctcaaaaaaaaaaaaaaaactgcttgacttctgcctcccctagacacttagagtctggtagagaaacacaggcatgtgcttgctaactgtaacacagttccgcgtatataggcaaagtgacttaggaaacaagagggaagaaggggaccagttattcccaggacagagcagttgagggtaagtagggctttacaaaaatgaggtatctgggttgggccctttaggacaatgcagctgattttgacagatgggagagtgtggggaagggtgtgctgggtagaggggatagaatgagcaaagatagataagcttgaaaatttctcagtacgttgaggtttggggtggggaggaacctgggaggtgctggattggggctaaattgttgacatttcgtgccacagaaaagagcttttaggctttcttctttaaagtggagctcctggcacatcactttgcaaggatagtgattgagaagttgtagacgtttccaggaatacctgaaacaaatgtaaaatttctcaaataatatgtaatacaggaaagcaaagccatctgcccctgaaaacaggctgcatatttgcagtatgagtaacagcagagtctgggctgtgctccctagtggcaggctgactgcactcgtgcaccctaaggacattgatgcacagatgaagaaaggaaagacagaaataaaatttatttttaaataattttaatcgtacataaaaagagctctcatgtcttcctcacccagactcagatttcccagtggttaacattttaccgtatttgttccatctgtgtgtgtgtgtgtgtgtgtgtgtgtgtctgtgtgtagaaatgcagttgtcatgtctttttggcctccttccatctgaaaagttctcgtttttacctttttttcatggccatgatggttttaaaaagagaggcctgacattctgtagaatgtgtttcaggcagggtccaggccatgccttcttggcaggacagtgcaaaagtgatgctctgctcttccccatgcagatacatgatgtcaactttgatcacctggtcgaggtggttatttgtcagctttctcatcatagagtcaccatttttttttatgattgacatttcatgccacagaaaagagcttttaggctttattctttaaaatggagctcctggcacatgactttgcaaggatagtaattgagaagttgtagacgtttccaggaatattttctggtgagatattctgagacgacatcagtatcttagtctttagtaggaaatctctacccactagccttagctagtgattcctacctgaatccgccactgttctaataattggtccatggtgattttctgttgacataattccttgtatatattagttggtattcctacatatttattatagcatgatggactcacaagtagatacctattctctggattgtaacttgttactatcattaatcatattattttcatgctcaaattatcctagatttggctagtgggggttcaaaagagtttgaatcaaatatacccttgacactggcattaaatagccaatctgatgtgtgctgacgattgagactaataactggtaggcggagggtgttatctgagttctagatatgtatttatctcagacagtatgggttacctgcaacaagatctgtggtaggcaggccaacagtaacactcgggaccctagaggcaagccaacctgaaattcagcttgtcagagaccatctggtgggtggaagttttgcgttttcagagtatattgtttaagttccccaggcctatcgtctacctttagctttccctgttggccaattcaggccctggtcagatgcgggtggataggtacacaaagctggaaacagcgtgctgcccgcctttctctcctgcctccagagacacttgttggctgtcagggtcggtgttgtcttagcctcacaggcattttcagtccttgctcttcccatcctagagtttcaaacacagagcgagtctgtgttctgcatctcaacatgctaaatcagaacctggattccctaaaatgttgtctcctgtttcttcctgccctcactcatgccatatccgtccttcccaggttagatttctcatacttcagtgaccttcagaaaaggaatcccatcacttttctctgcggtgagtcatccattggtttaaagaaaaaattttcttttttaatagcagaatgaggtaacagagccctagaagacaagcccagagaccggatcctggtctccagctcagcccagagtagctggaatttgtcagaccttctcagtttcctccgaagtattaggggcagacagagtcaaggctacaggctggctagcccagatgcagacagtgtcaaagttctcattgtggaataccaccagaacttatcttactattaccacttaccatctaattgggtaggtaaaattcatatggtgcaaaggagtttgttatacctagacaaaaattcatggggacttgaataatccatggaaaccctaatggagaatgctgaggagaattttaatctccagcatctagccagagcaatcttattaaaatgcaaatctgatcatttcactcccttgtttaaaacccttcaatagcttaccaatgcatctatgatgcaaaaacttgatccccagggtcctgtggaattagggctctgtctgtcccctttctgcctcactgcagtctttgcaaagtcctcttcccagttcttaaaagtggcaggttttgcatatgctctttcctctgcctagaatttctgccatccctccacacatccccaccacactgcccggtggactccttagctaccgctcccttgaagaaccctccctacccgtagcctaggcagggtccctgctgtgttccaacataacgcctgcattgtgctttcacaacacttaatacagttgttatttatgtgatcacttgtctgtctcctcctatacttcgtaagttctacccagacaggctctgtgtctgttttgcttagcacctagccgtgtttggcctattgcaggcacttaataaatatttgctgaatgaaagaatacatccatctttcagtgtaacaactgcatcttccttacatcagcaggaacaggtagatgtggaagatggagctggtatggagaagggtagtgatgggagacagtggaagatgtaggagtagtgtgcaggttaatgtctgttaaaaaagtccagataagattatctgtgagaggaaatccaaagatttgtggggagaagccaaaaggagttaggaagggttaggagtacacgaagcaagaccacattctaacttaatcatataaacaaaccaagcctgtaaaattgcagttatgctacatatgtgtcaactgacctgatatttcttaggaacttctggcatatacttttgctttctttaatgttacaattttatttgcatgaagtgtttaggtagctttttaaaacagctatactagcctgggcaacatagtgggacccccatctctataaaaaatttaaaaattagccgggtttggtcacacacatctgtagtcctagctactagagaggctgaggcaggaggatcgcttgagctggggagttcaaggctgcagtgagctgtgatcgtgccgctacactccagcctgagtgacagagcaagaccctgtctctaaaagaatgaatgaatacatacttacctacctacctacgtataacctgaagaggtattggtgaattgcagtaggcagtataaactctgtgaggagaagcatttcaggcttcttagaaaaagcctagcacgtggcaggtgcccatcatttgaatgcctgaatgaacgggttttatctgggagggaaaagagcaggcttaaaaacaactctttggtaaatgcaagagcaaaagaaaatctcatctgttatacatttcctttaaaccagaaggaggaacactcatattgctaccctttttattgtgtgttctctaacaaatggtgttcctcacacaaatttgatacaggtagcgaagctgctgggtctcaaagagcttagtgctaacagtgtcatcaggagataccacctgctaaacccgttcagaaggacgctgttgtacttcgctgtcttcttagaacactttccactcctggaaaagttgatgtgctaacttaattactctcatactctgagtaattagcttcatgagaacttgcctctcttcctgagttcatcctactggtttgctttcctgctgacgtgggatctttttgactgctttgaacagcaggatgcttacactctggggcttttaaatgtggaaatctgtgataattatgtacttctctaggactgactcagctcttcaagcaaaatcttcatgcttcatgtgagaggggacaataacattaatgggaattagcaaagttcttcagtttcaacagtcaggtgtggtatctggcgaagaaaaacacataaatagtgtgtgaaagttgtggcacaggggtgtaattatttttcacagcaccgtcagtcagtaactgggcctagagtgtgcagcagtgaaatcagaacaaagaagtcagtgtgtcctaattaatagataaagtaataatatcaaagtctcctccgttttaaagtccacaggacacattatttcaccccagtgctttttgctcatattaaagaatggctcattgtggtagagtatgtagaaagtattgaatgcttttctttactcaaaagtggcattttttatcacttgagcacttgagcgtagtgttattggccccaataggaaatgaaagacttgaagactacagatttttttttgaaatggagtttcactcttgcccaggctggagtgcaatgtcatgatcttggctcaccacaacctctgcctcacaggttcaagcaattttcctgcctcagcctcgcaagtacctgggattacaggcatgcaccaccatgctgggctaattttgtatttttagtagaggtggggtttctccatgttggtctcgaactccccacctcaggtgatccagccgccttggcctcccaaagtgctgggattacaggcatgagcctccgcgcccaatggaagaatacagattatatggccaaaatttcagttgctatctgtgaatttttattcttctcgctgtccccagcacaggctttctcagcctcagcgctactgacattatgagctagataattctttgttgggggaaggagggcctgtcttgtgcatggcaaaatgtgtgcagcagctctggcctctacacactagattcgggtagcaccccaagcagcgacaacaataaatatcttcaggcattgccaaatgtcccttcgcgggggcaaaatcacctccatgcctcgtttggttggtttaaaagaaaaattacctccagttgagaatcactgcaagcaggttagtactcgactagtttcctgcgatctaatcttcttcctggtgagtacgttaatttttatgtctttcaaaaccatgtattatttggacagcaagtttagtttcattaaaagttaaaatcatatagtactttatgaatctagatgaaatgatttttgaaatatccataactccatttcactttgttaatgcagaagaattgcaagcaaatttctcactgttcttgaggcagtaaattgggcccctctcacagagcactaagttttataggagatgaatatataaataaggagcagacttgccatcagtttgttgatttcaccttttctctgaacacagaggaatttggtctgaacttggagagttttctttaatcgatgccgttgcattggtgtttggttaccccaaattgcagagtgtgcaaacttagttgggagcgagagggaggaaatggactctgtgacccttggtgtctaggagtgagttggctcagagatgatgccaacctaagacaacatggagcccagtgttagttagcaggccatccacttaccttgagacgctggtataaattctggcaatgccagctgtcatgtagctgtttgcttcacttctgcctttaattacttttctatgcaccccatccccactagactgtgagccttgtgagaacagagactttgtccattttgttcggtgcccccagctccgagaacagtgcatggtaaatagtaagtgaagatccatagaaaactagagagatagagaaagagagacagagacagaaagcagaaattaattcatgtgcctttattatcaatatcaattataaatgtaagtcgaatgtgtgaataaatgttttattcggtctgcacttcccactgggtattataacattttaactggtcctattgaatgtagcctctttccctacgtcagtctcacgcacgcacaattgtcaagacgatctttgttgatgccttttagcccctagtttcagtggaaaaacttgccctgctccaggatgtgagattggtggcctctcctgtactcatcttcttccccttgtctaaccttggcattccttcagcagcaccaacaggttctgtcctggctcttcacctttttactctggtcatttaccttgtcttcagaactcatctctcgttaactcggttctgttttgatcactagtttacatactttcatactgcattgtgttttggttttttggagtgggggcggggttgttgttttttggggttttttcagacggagtctctctctgttgcccaggctggaatgcggtggtgcaatctcggttcactgtagcctccgcctcccaggttcaagcgattctcctgcctcagcctcccaagtagctgggtttacaggcatgtgccaccacacccagctaatttttgtattttcagtagagacagggtttcaccatgttggccaggctggtctcgaactcctgatctcaagtgaactgcccaccctggcctcccaaagtgctgggattacaggcatgagtctccactcatggcctgcattgttgatatatgcctttgtcactgatctcaattagtgttaagggtgtttggtagtcatctctcagctagactatatctgattttatttcttaaaaatttttcctcttactccttccactgaataggaccattttctgtagccaattaagctttcaataaatgtttatataatgaaagtagaggtggtgccaggagcagtctccaccactggatttccagacattcaaaaaatttttgtaaacaccagggacagccctccaattccagaatatttagttggaagctattactctcaggatttcagttgcagatatagccagtggaattttgactgtgcaaaagcaggcatagttctgttagtccaaaaaggcttagttaagagtctctttataacccaggtagatttttttttttaaactgctcttttttttttgagacggagtcttgctctgtcacccaggctggaatgcagtggcgtgatcttgacacactgcaacctccacctctctggttcaagcaattcccctgcctcagcctcctgaatagctgggattacaggtgcacaccaccatgcccagctaaattttttgcatttttagtagagacctggtttcaccatgttggacagactggtcttgaactcctgacctcaggcaatctgcccacctcggcctcccaaagtgctgggattacaggcgtgagccactgtgcccggccaaaactgttgtttttatacttcctcttgatcctgaattaataatttaagttttattgtaacacttttccagttaataatttagcgtctttctcctttttaagatctagtcttaatttttgagagggaaagggggaagaactgtagtacctgttagaattcagtgtaactccaagtaaacaagacccaaaacaaacgatagctaaaacaaaatagacctttatatctttttcacttaaaagtatagaggtaggctttttagaaatgttatagtagctctgatccacaaagtcctttgaggcccaagttccttctagtacatcgttcctccacccctagatatgaactcatgtttcaaagttacactagtgttctagtcatcacatctgcattccaggcagcaggatggaggaaggcacaaagaagaacataggtgaaaggattatttctgtgtttcttaatggaggttcctggggtatactacatgacacttctgcttacagacttttatttgcccctattagtgtggaaggaggggataatgcatactaaagaacatcaagctgtctttgccatggccacccctattcattcacctcccaagtgaactttctcattttattgcagtcaattccatttgccttccaaacagagacttcttgtaatatattttaagacaaatgcccaggccaggtatagtggcttacacctgtaattccagcatgttgagaggctgaggtgggaggattgcttgaggccaggagttcaagaccagcctgagcaaaatagcaagaactcatctctattaaaaataattttaaaaaattaaaattagccaggcgtggtgctacatacctatagttcccagctactcaggaagctgaggcgggaggatcacttgagcccaggagatagagactatagtgagccatgatcgcaccacgtcactccagcctgggcaacagagtcggaccctgtctcaaaaaaaaaaaaaaaaaaaaaaaaagagcaatacccacgtgttgtaaaaattataaaatataaagaataaaaatcatctataattccacaacctaaagataacaactgaaacaatatcatggaagaaatgtccttaacactaatatttaacgaacaacttctgtcttcagagcatcaagatgtttttcaaagtttattatcttattctgttggccaggcacagtggctcacagctgtaatcccagcactttgggaggccgaggcaggcagattacctgaggtcaggagtttgagaccagcctggccaacatagtgaaaccccatctctactaaaaatacaaaaagtagctgggcgtggtggcacacgcctgtaatcccagctcctcgggaggacgaggcaggagaatcccttgaaccagggaggtggaggttgcagtgagccaagatggcgccactgcactctagcaagtttattatgttatactatatattcagttatttattccttcagtaaacgttgtcagacatctcctttcttcccagcatgttgataattggtgtgtggttgggagaggaagcaatgaaaaaaaaaatgtatattttttttgggggggtgggggcggagatgaagttttgctcttgttgcccaggctggagtgcaatgtgtgtgatcttggctcactgcaaccttcacctcccaggttcaagcgattctcctgcctcagcctcccaagtagctgggattacaggtgcccgccactatgcttgggtaattttttatatttttagtggagatggggtttcaccatgttggccaggttggtctcgagctcctgaccttcaagtgatccaccctcctcggtctcccaaagtgctgggattacaggcatgagccagcgtgctctccaaaaaaaattttttttaattaagttttttgctctctgggtgcttatagtctggtacaaaagacaaaaaagtgttttcgtcttgttaaagttgggaaataaatcagggactcataagtgcctaatttatgttgatgtatgtaaacatacactagaaaacaggatattaaaaaaataatgacaccgggtagttttattgtagaataatttttaccatggacaattgtttgtgaaaatgacaccttgaaaacacatcttacttttttacttgctggagaatgaaacttgaattacaagtcctttgggtagcctggtttgagcagtattaggaaataagcaagcctaacttagttaaattctaacctcttctgattcccagaagtccaaagttcatttgggggtaatacaacgtgatacatgctttttgtgatttctacaaggtgaactaaagaaataactaaagatggaccagttaggttttggtaaaaactgtgataagttttgttgtgttttaaatactgatgttgagtcagttcatctttcctactgaaaatccttaagtgggaaaagtatagaaaaagtaggagttacaccaaaatattaacgcttgccacttgatggtaggatctgagtgccctttttttacgttctttaaattatctgtatgtggcttttttttttttttaatgttttacaagcatgtactactttcgtatctggaaaaaggtttgtttttctttcattttttaagaagaacttttcatcagtggcaaaggctcagttgaaattaatgataaaggataactacttgccacgtgtcataagcccagggctgagaagagtcaggcagtgctctggaaccagtgagtgctgcccggatcctgagaacccgcagagaacagtggggctgattgtgcctctgcacctcctcaggtgaccgagggctgggcaggaggacacagactctttcatgaagcagtgactagtataggaaaaacagagcctctctgtagagatgcttaaagtgctagctttatttaaaaatcagctggcaaagcgggagtgaagaacacacattttcagaagataccggtttcctgttttcattaagaaaacagggaatgcggaacagctgagtgcggcgggggtggtgtcactgcagccggagggagacctcgccggtgaaagctcagcctatggcatccgagcgtggccggccaagtttacacgaatgttgaaacttctcctcacggggtgaggatcgagggcgcccgaggccgggtccggctgagctggagcgagctgtgcggggcagcgcgggctggcggggagcgcggcgggcgccacgtggtaggtgagctgcgagcggcgtggggcggccaccgctggccgaattccggggggcctgggcgaggggggccggccgggaaggtgcgcactgctgggccgcttcactccaccgcaggcctacgggagtccagcttagacccgccggctcccacacacacatcccgggaggcccggatcagcctgcctgacagccaagctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggaatttcagacagtcctggagacaggtctggctgctgcagcttctctcctgttaatggaatttcagacagtcctggagacaggtctggctgctgcagcttctctcctgttaatggaatttcagacagtactggagacaggtctggctgcatattttgagtgatcaccttctccatgtggagatgaaagttaaaagggaaagagagaaggacagctacgttcttttaacacgagcacaagtttccaggcacagccctcccgaccagccctcccattcttaggctagagcatgactgctgctgggcacttctttcacatagaattcacttcccacacgtgttagaatcgaacagctagagcaatttaatattgttttaaattgggacgtaaggaatatacgtcctttttattcctctgcttggcaatcttatttttgtactttctttccaacatttgggaagaaagcgggcagatggaagcagaagtgttcttcacagcattcacactgtcgggtgtaaatgttcggcagtgctgggggttgggagggcagacagcaaccaggtttgctggaagttacttcaaactggacagcagtcaagtgggtttgtatactcaggagagggcagggagactgatggcttacattttcactcattgcttttgagttctttccatagctctaaaaatgcgcagcttattagcgtggctctgggaaaacaacacatgacctgatcctacaatttaaaaaaataaaaatgaccttgcttttaagtttgaaatgcatagcccaggtcagcgacaaggtctgcgctttgaaaggttcttgtgtttcctcttttaaatgtctggtttagccttaagtagtatttactgagtgccacatgatccagtggttggagtatgtaggttttgcccttatcttcattctttgcatctgtttgaactcatgacaatacaaaacaaggtgttcctgggatagggaatgttttgtccaaaaggagtcaacacggagaaaactcttcctacagttaagacagggtttggttttgtttttaaatgaggagagaaactgagaagtggaaaacacaaaatagagttgaagtctttcctctgtgtgcttctactcatgctgccagagttaatcactaaatatcccatgccccagctttctcagccggggaggtgccaaggcaaattgtaagcccatggaggtagtcaggagctgagtgcccttgacctccatttagaaaggcagcccagtctgcaaaagacagcagcagggacatctcatcccaggcctcctggttatgctgctgactttgtctgtctgctactgacttttagtttttttgtgtgcctcagataacactttgaaaaacaggaatcttaatgtctgctgtctatattccaagagactgtagatgaccaatgaaattatctactggacaatgctttcatgtcttttttttttttttttttaattgagacggagtttttgctctgttgcccaggctagaatgcaatggtgtgacctcgcctcactgcaacctccacctcctggattcaagcaattctcctgcctcagcctcccaagtaactgggattacaggcgcctgccaccatgcccagccaattttttatttttagtagggacgaggttttaccacgtgttggccaggctggtctcaaactcttgacctcaggtgatccacccgccttggcctcccaaagtgctgggattacaggagtgagcaccgtgcccagcctttcgtgtcttttataatgaattcttttaaaaatatttagtaaggacttactatgtgcttgtctcttaatcattatctctgagtactgatggacataaagatggaaaaagatggaaatagtagacattttagactacaaaagtggggaaagaggggagtgagggttgaaaaattacctattgagtacggtgtgcactatttgggtgatgtgtacactagaagctcaaagctcatcattacacaatatatccttgtaacaagcctgcacatgtactccctgaatctaacatacagttttaaaaaataatacaatcattatctcattacattgtttttaagcctgtgagttaaatatttgcatctccatttttactcagggagaaactgaagttaagagaggtttattaacttgcttacccaagccgggcgcagtggctcacgcctgtaatcccagcactttgggaggccaggttgggtggatcacctaaggtcaggagttcgagaccagcctggccaacatggtgaaaccctgtctctactaaaagtgtaaaaattagccaggcgtggtggtgcacccctgtaatcccagcaactcaggaggctgaggtaggagaattgcttgatcccaggagacggaggctgcagtgaaccgagatcatgccattgcagctccagcctgggtgacagaatgacctgtctcaaaaaaaaaaaaaacaaaaaaaaacaaaaaaaacttgcttacccagctgttgtagatccaggttcaaaacataggtgtgtcaactcttaaaatcataccagcttgctgtactgcaacaaacacaaatattagtttttaccattaggtgtattgcatgtcattataatattcttttctccctcttctaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggtaggtggtaccctgaggacctgggaatgaggaaggatgggggaaaatgtctttccagaagctaaggattattttttaactgctggaaccatttttggaggagaaatggagaaagttttagagtggtaatctgtagaatgaaaactaagaatcaaaatccataagcacctctgctgatgcttattatctggtagcctcactggcctctggctgaggactaacgctggaagaaaagtaaactggtgttggctggcctagaggttgtcttctggggctgctagtttggtaagatgctttattctttgtctttcagttatttacttgctcattatttatagaactgcctttaaaaaatcctaccctgtttgtacccactattaccagtatattagcaattgaaatactggcataaaatgttttcagttaaaacgtttatgagaggagagactccattaattcattctttaattcagcaaataattattgaatttgagccaggtgcaatggtacacatccgtagtcccagctactctagaggctgaggcgggaggattgctagagcccagaaatttgagaccagcctgggcaacatagtaagacctccatttctaaaaaaatatgaagtaaaaatcattattacttggattcctactctgtctcaagctataggctgtgaagatagtgtgaacaaaacagaacagagcccctgtccctgcggtgcttacattctaggtggggtgcaggatatagacagtagacctataacatgtcaggaggcgataaatactgtgaagaaattaactccggttatgggaacagcgagtggtagtggtcagggtgagggctgtttgagatgaggtggtcaaacttggagagaagggagtcttttcccactcattttttttttttttttttgagacagagtcgctctgtcacccaggctggagggtggtggtgccatctcggctcactgcaacctctgcctctcaggtacaagcgattcttgtgtctcaacctcctgagtagctgggactacaggtgcccaccactatgcccagccacttttgtattttagtagagatagggtttcaccacattggtcaggctgatcttgaactcctgacctcaggtgatctacccacctcggcctcccaaagtgctgggattacagacatgagccaccacacctggcccgataggcgcttacatttttgtctgtcttattctttctcgtattcattgggattcctgctcactcttccttcttgaaattgaagctaataatcagaaagccaccctggatgattttatggcttacagtaattccctgtgagccttaccaacctgattttgcttgtgaccatgtgcactgcctctcacagtgtataacatcatcctcagcttaggaccacactgcctggcttccgtttctggctctccaattctcatgaatcagtgtgacctgggaaagagtgtgcattagattaattttacatgaaaatgtgtgatacagacttaagccatccacagaaattccagtctttctattagtgtctgatggggcaatgattaaaatagactgaaatatattatttttatatcttcctaggtttccactttcaaacctgaattattgttagttttcagtatctgtgctataggacagttagtttgttgtggaagaaaaaaatgaatatgacagctcatgtgtggggtttttgccttttagaatccaaagagtctaataaacatacagggaagtcattttagaataaacaggattaaaaatgatctgtagactcaaacagagtctgcaagaactcatgccatgtctgctttgacatccttttaaaaatcatgatgtcagatgaagtcaaaataaaattcttaaatacctccagacagatggcacagtggatcatccattataaaagcattttgttcccagccttcctccctcctccccaaactggggtttctatttcacattcttgccagaaatattcagctgtaaccctgaagtaatttgctgaccctctgagcacggagaccagggagcaagttcggtctggctgtgtgacagtgttttttggtctatttccagtcacactgacatgccacacatcactggttagatccaaccctgctaacaaacacctaattaatcagctaaaatacagaagacctacagcacttgtgaacaaaacaataaatatttttaacagcacttatttagtcacaatggcagcccctctcagagcacacaagaacaaattttaagtatttctgtaatgcacatcatatttgtgttttcaccattttgtttaacgttctaatgaggaattaattaggttaggaaatgaacgcagagtattccatttttgttatctggcatttgtcatgtggactgaaaattaaagcaacttgatatagtaaagtggagatgctcaacacttagaagctttgagaatccaggtggcccagggtgcactgtgcattcctgtgcacaccataccatagagaatagcactcaccacagtctagaatgtatttctgaaccaaaagatatactggagtatagaagggtattcatctcaatgtttgttttccccaaataaaacagtagggaatttgggtctgacacctaccaaaaagagcatataaatgatcacttatatgaacctaacacagtattctaatttaaggaagttgttcagtttgggctctgaagctagacagtgtgggttcacattctttctctgtcactagaacagattgtctttgttccttcacagggttgtaatgaagattcagtgagtcaataggagtaaagcacagagtataaatgctcaatgaaagttggctgacgttgttgttatggttagagtatttccagaaatagaaatgtagatctagaacaaatgatgccacacagaaattgtacaagtggtcttttgttttcagcctaaatttttatcttcattattctgggtgatgcccctacccaattattatacctctccaactaaccattgtatcaatataaagaagtacatagataacaatgggaaacacaaaattgataaatgttcagtccagagtcattcagaatccgtgtcaaagctcaaaacgaagtatattagcggccaatccatagaattctgttcatttctcctagagttgaagatttgatgatggtgtcacttttcagtatgcaaaaaagtgttatttttagcagcatcataatgcttaacactatatttaatttcttaaaattacaactagagcatgcatcataagaaattaatagttcaagcataggcaacgtagtgagaccttgtctctacaaaaaaattttttttaattatctggtcatgttatcctgtgcctgtagcctcagctactcaggaaactgaggtaggatgatctcttgagcccaggaggttgatttgaggctgcagtgagctgtgatcacaccactacactccagcctgggtgacagaatgagaccttgtctgtgggtgggggtggtggggggagattgtgcacggtggctcacacctgtaattctagcattctgagagctgaggctggcagagtgcttgagcccaggagttcgagaccatcctgggcaatatggtaaaaccccgtctttactaaaaatacaaaaatttgccaggcgtgatggcagatgcccgtagtcccagctactcaggaggctgaggtgggaagatcaccggcgccctagaggtggaggctgcagtgagccatgattgtcacccactctagcctgggtgacagagtgagaccctgtctcaaaaaaagaaaagaaaaaggaaaaagaaattaaaagttcagaagagcatataataaaagagttaaagcctccctggcacactcctgtggtagcccgcgtgtgtttggtatttacagatgtccatgcttgcacgtctgtattttagaaacatatatttttgtaataaaatttgaatcatacatagtccgcctctttgttttttcacctaaaaggtcacgaacatttttctaggatttgagagacaatgtcttggttttgatggaattggaacctgatagtgaccagaggtgttctgtattttttaattcctgatagtatgagtttaatgcatttaatattttcttttataaaataaaaaagttaagaggaaatgagtttctgttataacaaaaatgttggtaaaaaaaagtttattcttcctgtaaatcagttggattgttttcgtttgaggcatagattagtgttttctttttttaattactattttcttctagagagggaagaggagagagaaaattccagataaatgacttacagatactctaaaaatatataactgtctctgagcaaatacaaacaaaactataacagtggaatttaactgcctgccccatgatttatagaacattcatctctcatactgaaaagacctgctttttaaaatcagcttccgtatttatactcttagttatcttagttcatcaaaagttaatgaactcgaagtcattcccataactatgaaagtaagttgtagacaagagatctgagccaaagcaaaagtagtcattacaaaatacgtttctaggtagttttctcctcgttcaaataatatatcatttacctgtcttagcacttggcttcttaatcactttcttttaatgctcaaaagcaccaaaacaatgcaatccaagtgtttctgggaccctgcagatataaaaatatgatgtaggtagtggaaggcctagaagtcagaagagctgacctctcatactggctgtgtaggtaacttgctgtgtcttttttttttttttttttttttttttactcttaagacagggtctcactctgtcacccaggctagagtgcagtggcatgatcacagcttgctgtagcctgaacttcccgagctctaaccatcctccctcttcagcttcccaagttgctgggactacaggtgcatgccaccatacctggctaatttttgtatttttagagacaaggtctccccatgttgcccaggctggtcttgaacttttgggctcaagcaattcgcctgcctcagcctcccaaattattgggattacaggtgtgagccaccatgccaggccactgtatcattttagaaagggagattgtggacttccatggcctcctgtgtcaaataaatagggtgagattagtttttctcctacagtcccttcagcaggattattctgtacaagtgtgagttaactgtttatgttggtgaccacacatgtattagcattcaggctgaggtctgagaggagagcgtagaaacaacatatttgtcctttctcctctatcaaagctacatgcttttcctcacaaagtagtatgtaccaaaaaagaagatggtccttcatgaataatctctactgcctgttccccaaaccatcatttgggcttaaagagtgaattcatgctcgagcccttttttttttttttttttttttttgagacacagtcacactctgtcacccaggctggagtgcagtggtgcaatctcagctcatcgcaaccttcacctcctgggttcaagtgattgtcctgcctcagcctcctgaatagctgggactacaggcacacgccaccaggcccggctaaatttttttttattattatttttagtagagacggggtttaaccttgttggccaggctggtctcgatcttctaacctcatgatccacccacctcggcctcccaaagtgctgggattacaggcgtgagccagcgcgcccggcctcaagccctttttcttaaaaacaaacattatttcagatccctttgaatttttagtcatactttgggaaagtaacctaaatatttgaaaggactccataatgaattggaaatttcagtcctacctgttctcaatgagtaagtttagatgttctttaaaaattaaatcagaatgtcaagctgaaaatgtggcacagctacatggttagttagctggctacactcttcttttttgtgttttcagaaagttcttggcactatcaatacaaatgtagatcagcataccagaacagttggaataggtgaacagagcaacttttaaaatccattttaatatatttttttaaattgattttctaacaaatttggaaacccatggctatataccaataactaatacccattctggacagataaatgttacacagaagactggagaattgatctctttaaaacccattcagctctagttttgggtgattttttttttctttttttaagagatggggtcttgctttgtcacccagactagagtgcagtggcatgatccgggctcacgccactgcagcccccaacttctgggctcagggctcaagtgatcctcccaccttccagctctagtttcactgaattatttttcttgtaaaacagtttgcttttaacattcctttatgtcaaggacataaagttttcattttaagtggcttgtttttcattatagtcatctcatttgccttagaatttaatatatggataattataaaagctaagtgcacttcggaatgataattaatgcatcaaaggtgttcctcttattttccaggacactgagatttctgtcacttgttgtcctttagtgatcactaatctgaccaagtcgtaaaatgaggctcatgctttattggtgtttatggctgttataagtttgagttaatgatagaagacttcacagttgcccactctgctgtccattaacttcccagttgtgcctgtgaaaaccgttgccacctggtgagaattttgagcatctagaccagagtgccagaattctgaaggtgttttgtaattactccacatgttgctgtcgttttgttttgttgagacaaggtctcactctgtcttccaggctggagtgcagtggtgcaatcatagctcaccatagcccctaactgccaagctcaagctgtcctcacacgtgaacctcccaatagctaggactacagacacttaccaccatgcccagctgttttttgttttgttgtgttctgtttgttagagaggggggtctcactatgttgctcaggctgatctgcaactcccaggctcaagcaattaacctacctcagcctcactaagtgctgggattacaggcgtaagccaatgcacccagcctgttttttgtttttcctcagagacggggtttcattctgtcacccaggttggaatgcagtctcaatctcccagcctcaaaccatcctccagcctcagcccctcaaagtactgggattacaggtgtgagccactcccagcctgtaattactcctgtttttatccctattgttcagggagcatttactttctgtttagtatgaacatctaccattagtggcccagggctgttaattaaaccaccagcagttcctaaaaattcacatggatccaagttgatgggttgaaactagaggggagtctaaattcttaatttcagtagtcagcttttatattggttaatttaattcagtggatctcaatcctggcagcacaatagaatcacctagggagaagtttgaaaatactgatgcctgcaattggagacactagttgtattaccaaggctttgactggaatggcatgtttacagagtgctttggggaactgaagttgatctttagagccaatggaagccccttggaaaaactgacctccctcataccttgtcctttacagggttcctaacctgtggtaagtaaagaatgtcactttctgacaagctcaggagccccacgttattttgggacctcgggaaaagaggaagtcacctaatttatataggtatctgcaggcacaaataaattcttggctgggctcaagaggtttgtaaaaggtctaatttgagattccttatgaaaaatgtcagcaaagtcaatgtaaaagaaaaagggggggccatatggcaaatacttactcttgctgcactttatgcaaataattagcccaagcataataagactaaaacttattttggaaataaattggtcccactatgattggtctttggtagaaatagaaaaccagagagagaaaaattatgtttcagaaaaactatagtaccccttttattgactccagctttgtccacttttttggataaggtcatctgctgataactcaataattgattggttctcagggtcatttacctgggtccctcaaggcttcaggttggttctacagggactcctgaagctaggactttcacttcttgtggtagggcttactattaatcttacagtctgctgttcacttatgtgctgtactaaaactgtggataagaatgaccccaaccagacaccagtgaaggcatacggtcaacttgaagacggtttcactcctcttaccttgggggcaaccccttccccaacaatgttccataagcaagaagaaattagagctgtcattagcctttcccatctccatagctcacacctcaggattgaggtgtaccgaaacccaagggggtggggacattgaaactgcctttccaaaatcatgacagtaaaagaaacctgacatagctgactccgtcttacttctgacctccaagctgtccttgttcattcctaggcacaggccaagctaactgtgggtagaatttggtttataatttaaccttaaagcaaggatgataatagcccttcccaagactaaactgcctttgtaaaactaatgaaagcacacaaggttagaattatggacgggccctgaattctattttatttattttatttttttgagatggagtttcacttcaactgcaaataagtgttcattctctctctctctctctgtctctctgtctgtctgcctctcttgctctctctctctcatatctggacccatccagatcattgtatctacattttttaaagtctcaccctcgattcaggtgattctaaagggtagctagggttgaaacgactgaattttgtttgttggcctctttgttctttggctttcctggctgcacgttttcttcgttttgctcaaacacagcagtcatttgtcagtcttacattggtgcatgcggtgcctacaactacaagtgggtccttatcaagttcagagaattgtttataggccactcaagaccagccagagtttcaacaccatccaaagaacattttctggcaatataggtgaccaattccctctgacttgacaaaggagagccagtttggaatttaatgaggttcttttccttaccagttaagcctcagtagaatcctcatgacctttggttgaattacatggacacttattaaaggctctcaatggtcccgcactgttctaagcactggacaggacaccaaataagaatgtagcagggaggaactcaagatgctgaccatctcattgaggagacagggcatatttgaatctggaccgtaagtgctacaggacaatgatggggaaaaaagacatctctgtggaatggttggaatggtatcatagaaaaaagactagagaagatagaatttgggccaagccttgaaaagagtatgggtcgaattcagctggtgaaggatggcgaatttccagacctgtaggatgatctaattactccctactcacagagttggagtaattaagtcacaggaccactctgaacagaatggacagagtggaggagtagctgagaggtaaagttcccgcaggcaagatgaaaccttccaccttgacccttggatgcctgcaggaggaggtggaccttgattggagaagctttaaaaagccctagtttacaaaagtaagctgtggtgagaaaaattatagcacctggtattcctgggtgacactatctggaaggggtgggaggaaaggcttaccaggttgttagaaatgttctgtatctctgttacagaggtggttacacaggcgtatacatctaccaaattccatccgacttacacttaaaatcagtgcattttcgtggggcatgatcacaagcacctgggtcctgtgtcctagctactccaaaggccaaggtgggaggattgcttgagcccaggagttcaaggctacagttagctatgatcacattccattgcactctagcctgggtgacagtgtgagaccctgtctgtaattcattctgtgcattttattgtctataaattgtgtttgaattttttaaaaattttaagttgtatttaaacaaagagaacctatggattaaaagactttaaaataatagcaaccaatggaaatacatgactggaattctgatgcaaacaccctattaaagaaattttttagagactattggagattgggcacagtagctcatgcctgtaattccagtactttcagaggccaaggtgggtggatagcttgaacccagcagttcgagactagcctgggcaacatagtgaaacccatctctattaaaaatacgaaaaaaaaaaaaaaagaagccaggcgtggttttgtacgtctgtggtcccagctatttggggggctgaggtgggaggattgattaagcctgggagacaggttgcggtgagcagagatcacgccactgcactccagcctgggtgacagagtgagatgccatatcaaaaaaaaagactattggagaaatttgaatactgactggattatgtgataatcatacttatctttttttaagatttgatagttttagcctcaatggtttgcattttttagagttcttttagggacatatactgaaatatttatggatgaaaatgattgaatctctagctgttgcttcaaaataatccagtgtgagtgggcagagggagttatcagggaaaccagatgttttctaatcattgttgaagctagtaatgggaagacaggagtttattaaactattatctacttttgtatctgttttatggtttcaataatagtcaaaactatcatgtatttgcatttaaaaagtcattgttggttattgaagaggaaaatgcttcgtacaagcatttctctacaaagagtgttctggcggccaggcacggtggctcacacctgtaatcccagaactttgggaggccgaggtaggtaggtggatcacttgaggtcaggagttcgtgaccagcctagccaacatagtaaaatcccgtctctactaaaaatacaaaaaacagctgggcgtggtggcgggcacttgtaatcccagctactcaggaggctgaagcaggagaatcacttgaacccgggaggtggaggttgcagtgagcagagatcgcgccactgcattccaggctgggcgacagagcgagactcaatctcaaaaaaaacaagagtgttctggcattcagtgattaactagtgagactttttggaggccgctgcaatattttctaagtaatgatgaatggacttggagaaggaaaaatgaagataaatgccctgctttatctactttgcttaaaataagtcaaaggcacattaggcatttcatatttgcagttaggggacatcaagtcacatagtgtgaaacgttgtttggaccgctgaattcagtattgtgtgtatgtgtgttgaggaggaagttggagttgtaaaggaatcgtccaggtagcccccatgtcccacagctaaaggagaaagcattgtgctgttgatttggggacaggggactgttcaccgaattaggaaatgtgagttctcgttcagctctgtggcctggggcaagtcctgaacctagctggccttcagaatccttagctggaagtctggaattaaaaattaggtgatatcccttgaggtcaggagtttgaggccaggctaaccaacatggtaaaactcagtctctactaaaaatacaaaaattagccaggcatggttgtgcacacctgtagccccagctacttgggaggctgaggcaggagaatcgcttgaacccgggaggcggaggttgcagtgaactgagatcacgccacagccctcactccagcctgggtgacagagcaagactctgtctcaaaaaaaaaaaaaaaaaaatttagatgatctctaatgccttacattgaattttttgccagctctcactcttttactatagcgtcattgttttaaaccagtcaaagtagaccacctgcatcagtgattcttgtaggtggtggggaatgtcagaaatgccatcacttggcccccatcccagaactgcagaatgatctcctggcagcatgttcctgggaatctgcattttagccaatgtcacaggtgattcttatgaagaatagaactcagagcagttttagggcttgttattcgttctttttcttcatattgcctcaaaatacaatcaacacttaagctgcttttcttctaagaatctaagagatttcagagctttactttgaaagggataaagttgtgatcacctgacattgtgagtagatttaaatgtttaatttttgttagtaatttataaagtataatttaggaaatactagagacaaaaagaaaaaagttatagtagcctgtgactctttagccttagcaaagcagtgttaaatgggtttcctgtatatccttccatgatttttctaatacatacatatgtaaatataattatttactaatgccagtaggcagcaatgagaacaaaacctcttttgtatttttttttcccatgagtcaaacaaaagacttcagattcagatcaattctggtgtgctagggcaggcctttcctacaaggggtggagaggccagcctttcttctcttggtgggaatggcctgagctgtgttgtggggcaggccgctgatttgtgtgatgtatcattagagggaataagcccattgatcttttctagtttccgttaaacttgaactgagaggccaggcacggttgctcacgcctctaaccccagcactttgggaggctgaggcgggtggatcacctgaggtcaggagttcgagtccaacctggccaacatggtgaaaccgagtctctactaaaaatacaaaaattagctaggcatggtggcacttgcctgtagccccagctactcgggaggctgaggcaggagaatcgcttaaaccgggaaggcgcaggttgcagtgagccaagatcgcaccactgcactgtagcctagcaacagagtaagactctgtctcgaaagaagaaaacttgaacggagacaaaaattaaaaataaggccaggcgtggtggctcatgcctataatcccaacgctttgggaggtcaaggcgggcagatttcctgaggtcacaagttcaagaccagcctggccaacatggtaaaaccccgtctctactaacaatacaaaaattagccaggcatggtggcaggtgcccataatcccagctactcgggaggctgaggcacaagaatctcttgaaccaagaaggcagaggttgcagtgagccaggattgctccactgcactccagcctgggcaacagcacaagacaagacactctctcaattaaaataaaaaattatttaccaaagtaggtttattttctccgtattattgtatgacctatttttaatacacatcatgctcatctatgttaatattctcctatatcaagatttgtaatggccatatagaattcctctgtataaatataccagtgcttatatggttgtttcttacaagcagactgtctgcctctttttactgttttaaacatggaaacaatagccttctgtgtctttttgtacatccttaggataaaacttttagacaattaagtgaaataatttttcatttttaaaagtgattttgaacacagttaacccatattcactatagaaaaaatggcaaatccaaggaaatttttttttttttattagagtctcgctctgccgcccaggctggagtgcagtgggacgatcttggctcactgcaacctctgcctcccgggttcaagtgattctcctacctcagcctcccgagcagctctggattacaggcactcaccaccatgcccagctaatttttgtatttttgtagagatggagtttcaccatgttggccaggctggtctcaaactcctgacctcaagtaatctacctgcctcagcctcccaaagtgctggaattacaggcatgagccaccacgcccaggctaatccagggaaaaattaaaactaccatagctgtttcatttagcacagagtcagataacttttcatgtgtgtgtgtgtgtgtgtgtgtgtgtgtgtgtgtgtatgtgtgtgtgtggtaatgtattttaataggatcacacaatacatggaattttattatctgcttttttcaattaaccatatattacaaacatttttccacatcacccacattgaaaattctacaatatatctgtaaaccaaaaataaaattctaagccccctaaccaacggaatagatccctcctgtcagccaggggattccatagtaaacctgaaaaactagttcaggccatgatgggaaggaagtgtcaaacatgcctcattataccctcctccctttggaattcaggcacaactgaccagcattaacattaaaacagagatcttaggagtgacaaacagactctttataccaataagataacaaattccaacctgactctcctatagcatcacatgacagcagaccctaaaagaaaatgaagtattttaccctaaaatatatttcttcgatgtattttgtctttttttgttttgtttcttttgttttcttgagatggagtctccctctgtcactctgtcacccaggctggagtgcaatggcacgatctaggcactacaacctccacctccgggttcgagccattctcctgcctcagcctcccaagtagctgggactacaggcaccccccaccatgcgtggctaatttttgtatttttagtagagacggggtttcaccgtgttgaccaggctggtctcggactcttgacctcaggtgatccacctgccttggcctcccaaagtgctggggttaacaggcatgagccactgctcccggcctcttcgatgtatattgaaatggccctgcaaggctgtctcttgtggggaatatctacattatgtagtgaatccccttacctgtccaggccttttcctgatccaggagagattcagagtctggtacctatttaggtctgaaaagagacatttaccatctatatagaggtctgaaaagtgacgtttaccatctatgtagatgaagcctgctacctggaggcttcatctacataataagaaccttggtcttcacaaccccttatcttaacccagacactcctttctgttgattgcaggcctttagataataagttaactttttcaaccatttgccaatcagagtatctttgaatctaccgaagacctggaagcccacccttatttgagttcttccacctttctaaactagtgtataccttacatgcattgatttgtgtttgcctgtaacttctagtccactaaaatgtataaaattaagctgtaacccagccaccttgggcacatgttgtcaggacctcgtgagattgtgcttttggccttggtcattcatacttggctcagagtaaacctcttttttacagagtttgactcttttcattgacatatctgtatacattaattacaaaatattatttaatccaaattgcttcggtcagtatacagattttaagtggctaacatatacaaaagcactctagtagatttgttaagagaaagttgatcagaactgtttgatgccctcaaaatatttaccatctacaagggagtctaaaaccatcatacaagtcatcttgtacattgtatcacagatccccaggagaaggtacaaaagatgggctgtgagagttcagggcaagaacattgttagtgaaggagatcagggaagggtctgaagaggcagtgatgggagggtgcggctgtgtgaagatgggggaagaaaggtattccaggtagtagaagggcataagctgaggcatgctgccaggaaacaagagacccgcatctctatacagcgagtcctggcacttaatgggatgcagtccctgtcccagtaaggacgacaggaggagtgggaaatgaagttgcgggggtcagccagtaccaggttatggatagtttagaatctctggctctgcagtgtggactacatttcctgagcagtgggtgctttttaggcgttgtcacattttgttttagctggaataatgatggcattggagctggctgggagtaatgctctgaagcattgtgccagagtggaagtagtaatggaagaggggcagtaaaatgctacttccatgactagaaaccaaggctatgacggtagcagccaaaacagagaaaagaagaggtgctgtggagttagaatgacgaggcccggcagtctgcctacgctaatgaaatcaggaaagctggagcgtcaaaggggcttctgagttttggtggctgggataatagtcccattttaaattatgagtggcaagaattgtttttgttgaagcctgctttttcagtcctagcatcacacactctgtacctttctttttcctgataggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatggtaacttttctcactcacagtcattggcatcaggattctagggccagcattgccagcattccaatttaatgtcaatgtaccttttaaattgacctggaagaaagttaatatcgttatttggaaggtaggcccagaatatctttaaataaggttaccaaagaggccgggcatggtggctcacacctgtgatcccagcactttgggaggccaaggcaggcagatcatttgaggccaggagttcgagaccagcctggccaacatggtgaaaccccatctctactaaaaaatacaaaaattagccaggcatggtggtgcacacctgtagtcccagctactccggcggctgaggtgggagaatcacttgaacctgggaggtggaggttgcagtgagctgagatcacgccactgcactccagcctgggtgacagaaagaggccctgtctcaaaattacgaaagaaagctgtacaagaaagcttacctgatattacaaattatgaaatattttaaatagcattttattcacgttctggcaggcataagttttttcaggttatctcagctgaagaagaataataatccctgtttagtacgtaaatggtccttgaggctcgtgagacacgacatcactttataagcagtaaagccggatacaaatgtcagttttcactggctttgttatgtctggaaggactaattgatttttttcccatgtgaagaatgttattaatggaactttgaattattttctttgcatgcacacactttcccattgaattttgtggaaacttctcacatatatatgccaagatctacatttacatgcatgagaaaagaactgtacaggaaaaaagatcatttaacatgtatgggtgtgagttttcatttttattgccttgactttttcacagcatgtacaaacaatgaaagtacactgaagtccatcatgaagaagaaagatggtaacaaagattcaaatggcgcaaaaaagaatcttcagtttgttggcattaatggagggtaaggaaagatggtggttctagaggctaatgctgtcagtctcctttacctcctgcctaagtcacatttcaaggcgcctagtcggggaagcggccacagcgcagtgatgaaagattccctcctcagaaaggcagaaaggtgcatttgggctttgctttcctcctctggtgctgtctttaaggatttgtcactctcttaaggatacctgatgaagctgagcggtttacatctcctcacctctgatctgaaagaaatagtcttcagcgaacgcagcagggttcctgcactgtgttggacaacttgtacttacctatacgagaactcacaattgagcagaaaaagactgagagcatcactctctgggccaacgatcgtcatcttttccttcaaaatgggtccttttgcttagctctccatgtttacgacccaaattgtagggcctttcacaattgataaccacatcaccagtttgctttctaaatagaatggttattgtttgttccttctctttgcattggcccacgtacatagttaagcccctttgttgtcctacaattgaatcaaatcaatgaattgatacatggcccccacaagaaagaaataatacaaagtgtaccattagggtttaaccttatggtgcctgttttccaaatctagaagttttattcagtgataatggccaggagattttggagggcatacaccagaaaaactatcgattgcctatgtaatctattccccttgatactgggagaattaataggatgaaataggaagacatggggtgggggggggacaaaaagcacctaccgatctgttttccataaagtatgttttctcatgatttatgctaagccggagatgccattattttctttaacaagtgttacatgataccaattggttatatgataccgataaccagtttaagttagagtccattcaaaaccaccaggcatttaaatagaccttactttgaacttctaagtgcaggatctaaaaccactagtgaaatttctggagtcaattagcaaatcccttcatagaaatttctatcactgggtcttcgtgagcacaccttgcatctcctgaaatcccaattgccacctaggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtgtggtacattccccttccctcccttgcccctcccacatttaatgtactttggcaatagagttggccagttcagagcttttgtaattaaatgtttgcttttatctgttcctcagaggtatacacatcttgagatactaatatatacaagtgcagagtattacaactcttagatctcttatggtagaatggcctggtacctaatcacccttgttttctgaaaccttaactctgctatataatttaacatatggaaccacaatccactaaaacttgcattgtttgaacaccttaccttatatttaaagacattttaattttttggtggccagcctactttaagatttcagattttatgtttagccatttatcttgatacaggtgtatcattattacaggatcattgtgtggatgaggcctcagccaaagatcacatatactgtaaagatgatgcatatcacttacatgtttgtattttgttacacattgaatgatcaggaataccacaagaatggatttgggtatatcataaatagtagctgaaaaacactctggttggctgaaatatgtgcctcagaatgtaagttttcaagaccattagataaggatttgatgctcataaaatagagagtagaaaaggtggaaacttcagtatggtttttcagtatgtgaaatataaatagaacatttcagaaaacttacctctatttaatttggcaaatgaaagtttaactgcattaaaacaaggtaagtgtttttagtttatatttccaagtgtttcacatggctttttaacagctttgagatgtaatttatataccatatgtcatttttttacttttcatatgggttaaacacttgagtcaccaaatgtgggttcagatgtgtggtttactggtcagcacgatggatatatggtaatttgtggaaagtcaaggcaagaggatcgcttgagcacaggagtttgagactagcctggacaatatagtaagacctcatccctacaaaaatatcaattacctgggcatggtgtcacatgccagctgctctggaggataaggtgggaggatcacttgaaccctggaggttgaggctgcagtgagccagtgcactccagtctgggtgacagagcaagaccctgtctcagaaaaaaagtaatttgggtctccttcaacccccttaaaattaaaaatattttttaaaaacttagaacaggttgggcacagtggctcacacccataatgccaatactttgggaggctgaggcaggcaggcagatagcttgagcccaagagttcgagaccagcctgggcaacatggtgaaaccctgtctctacaaatacaaagccgggtgtggtggcacacacgtgtaatcccagttacttgggaagctgaggtaggaagattgcttgagcctgggacagcaaaactacagtgagccgtgattgcaccactgcactccagcctgggcaacagagtgagaccttgtctcaaaaaaaaaaaaaaaaaaaaaaaaacttaaaaatggcaaaaaaaaatctctaaatgttattccagaatgtcataaaggccaattggtgaagccgaatgtcaccctcccaaacaaggcctcaatctctggctggaggtgttggctctgcacagtggacgtaacccttagacccctaaggatttctgtgctgcctctgcccaagcaccttgtgccataatgacctgcctgggctggcttggggccacttgccttttaaaaatatatttttaaaagttgaagctgcgcagtgtcccacccctgtaatcccagcactgtgggaggccgaggcaggtggatcacctgaggtcaggagttcaaaaccagcctggccaacatagtgaaaccccgtctccactaaaaatacaaaaattagctgggcctggtggtgcacacctgtagtcccagctactagggaggctgaggcaggaggattgcttgaatccaggaggcggaggttgcagtgagccaagatcatgccactgcactccagcctgggcgacagagcatgaccctgtctcaaaaaaaaaattagatatttgggttgaaataaaaatgattttcttcttgtgaccaatcgtaacttgttttttctcctttcaggtatgaattaagtgaaaagatgttgtctgcatgcaacttactgaaaaatactataaatgaccccaaagctttgaccagcaaagatatggtgagtctgacctgcaaacaccatccccagtgtgtacaaagtgcatgagtgggttcattgtcaaggccagctgtaggctgcccgagctgttgcttgcatgcttttctcctgaactgtttccagcatgagtgggctgggtaaacatcatgtggtcttgctccctggatcacactgccagcgtttccttgaggcccaacttcggacatcctttacccaccctggacttttcctggggtggaggcatctgtgaggcgtacacttgcagacagaaagcagggctaattgcagtcagtcgtcatctttctacatatttcatttctatttatagaacagtaagatccagggagcagcatccaagaattttttttttaagttagcatatgtttttaaaagaaacctatctgagccaaggtcagcattcctttcagttatgaaactgtatgttatgctctgatgtggaatgcaggcggccactatttttaaacataaaaataaccgcacttgtcatctcgcagtctaagaaattcagagcaaacagcaaagagtttgtggttgccttagtgatcatgaatggtacaacataggacacaagtatttctatggcaatggttaatgtgacaccatggccaagaatgacatattctcatgtgtcgaagttatgtgcacattctttcataggccagactaaccccctggttgacagctgtcttttttattagtgcattgagaaaatgtaggatcccctaaggataccgaaatgcacagatactcaagtcccttatgtaaaatggtgtagtatttgcatataaactatgcatctactttaaattctgccatatattttaaatcatttctatatcataatacctaatacagggccaggtgcagtggctgacacctatgatcccaacacttcgggaggccgatgcaggtggatcacatgaggtctggagttcgagacgagcttagccaacatggtgaaaccctttctctactaaaaatacaaaaagttagccaggcatggtggtacacccgtgtaatcccagttactcgggagtctgaggctggagaattgcttgcacccgggaggtggtggttgcagtgagccaagattgcacctctgcactcaagcctgggtgacagagtgagactccatctgaaaaaaagcctggagtgcagtggcgtgatctcggctcactgcaagctccgcctcccgggttcgggccattctcctgcctcaccctccccagtagctgggactaccggcgtccaccacaacgcccggctaatttttttgtatttttagtagagaccgggtttcaccgtgttagtcaggatggtctcgatctcctgacctcgtggtccgcccatcttggcctcccaaagtgctgggatttacaggcatgacccaccgcgcctggcctcaaaaacttaacacaatgtaaatgctatataaatagttgttatactgtattgttttgtattacatattttttaaatattttcactctgccagtggttgaatctatggaaatggaacctgtagatacagagggccagctgtactaaataaaattgctggtcaagtccaggcacagtggctcacacctgtaatcccagcactttgagaggccaaggcagtggatcacttgagcccaggagttcagtttgagaccagcctgggcaacatggcaaaaccctgtctctacaaaaattagccaggtatgatggcatgtacccatggtcctagctacttgggaggctgaggcaagaagatagctggaggcccaggaagttcaggctgcagtgctccatcatcatgccactgcactccagcctgggagacagagtgacaccctctcaaaaaaaaaaaaaattcctagtcaaggggaaacatagaactacatattgaaattcttggatttgtattcatgaaaatacctggctataccctggtcactagtaaaaccataaaatctcactgcagggtcagtatttcccatcaggtttaacctaaacttaaaactggtgccttacaaccccagattttatagccatagtacacttttctttcactgttctcaaaatactaggttacgtggcctttgggaaggattctgttttcctgcatcctccaaattgccgagcatggtgtcatccacacacactgtgatgggtacatctttttaactgaattttcatttggtgtgaaagtgtttaaagtattgtgttgtgaaaagtagtggacgagtaaacacaatgccagggctagataatcatgtcaggacaccagttatttagcagtaatagaattagaatgaccagaagacataatttcccttctttcagtgtgacaactccagagaaacaggaatgtgaatatatacagaaaaaaaaggacactcttcaagtgacccaaaatgtgattgaaatggttaaaactaaataatcagtagcaggatgataaagagatggaagctctataatcccaactctaccttttctacagaaagaggacttcttgggttctggtgcttctgacataggctgtctttctttgatatatttttaaacttttaaagagtaagcacagcagaaatgaatattaaactcatatgaaggcccattgaaaagacactgtagtcatcctcatcaccagtactgactgctcagtctccactgagcttcatgtgacccagggttgagttgatcatccacaaagcaagtgccttcttcatgtgtccacagcctaaggaagtcagagtggagctgatgagagaatgaaattagttccagacggggttcccttttattttccctttccgtggttgaacagttgtatttgggattggggtgggaattgggttggctatacacgtacggtctcccaacctagtgctgtgctgaggagttgaaggaggtgagtttggtctggataggaaggaagcagcataattcagtgtaggctagttaatttcttcctaatttctatgaaaattgtttgcaaggccagtatgattacatcatattaatagcttaataaatggagccaagcctgagtgtttattctcatcacagaaactatgaaagcatggtattatccagtttttcagatgaggaaacggaagcagaataacttccctcgggtcataaagcttttaggtagcagagcctgcatttgaaactcagtggtctggctccagagcctctgcttctgcatggtgctgtctggtctcctttatagacattagaatctacacgtcatttaaaatcaggagaaatgtcccagtttggtgtttgaagcttctcttagggctgttggtttttgagagcagattctaactgcatatatatactttgactataaaaggacaggttacttgtgctttcaactaggtctcagaaagtctataaatagaagaactaacgaccacttggtgttttggcagaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccggtatgttggctgcccttccaccctctcttctctaacagtacttgggttgtgactcatctcagagaacctggttgagccactcctgaattctctgaccatgctaaaatcctttttattgcttttccacatgacatggcaagaattttcttgagtcattcataagaggcttgaagtttaaacaaaactgggtgacacagattctagatctgtttttgaaaggaggttttgaggatcttcttgctgcagttcagctgcattcaaaagtgagaggtgtatgcctggtaagaagcatgtctcacgttccctcctgagctgaatcatgcgggcttggccggtttgcactcaggaggcagagtgctgcttacaggcccagggtcacagccttggtgcgtgtggaccacttgatttgaccttactccatgactgctgtccttgcagaagtgtgtggttagtcaagatggggactaagcaaagccaccttaacagatggtcaaatgatcaccattctcaccaaaatatactgttattggggaaacagcatagagcaaagggcatgttattcttgtctctcaaccataatagaatagtagaaacttgttatcccagaatagagccagtggacatcttagacatgaagtgagggaggggcacatacacagatggtaccctcaagaaactgtgagctttcaacttcttgttcaaatggagcagcctgatgccacatagaccccaagtcttttaatttttgtaatacatatttttatttctagtatgtgacagagaagtcagagtatctcagtctgattaatgaggatgtagtgtgaaccttagaatatgcaatcatactgtccaattttctgaaattctgtcttcatccactgtccaatctcttctgctctgttttgggaacttggaattgatgcagagaagaaagccaagcagatttatccttcctttctcttataagtgtgtttgttccctctttttggagccatgttagggtataactgcttccatcttacaggaaggaatttcaagcccctcctcttcaggctttctagactataaacagagctggtgatacagtcagccagagtgattgtttaaacagaagtagataatatccagggaagctgaaaacaagatttcactatcactcctgacaggaacagcttagtatacccttagaagttgataaaacatcttggcaaattaaataattttaattccattgctggatggtttgggttaatcacttatcttaatggttactgctcccccttctaggctgagattctggctccataaggtgtagatctaggatgcttcagcatctatgcagagcagagtccgcaaagtccgaggtgctaaggagccccgaagcgcacacgaattcacctgcttctcctccacagggccttttattttctgcattaaaaacacccacttttaaaaacatgtccttagtatggagttgtttgggatcttaaggtaaatgttcatggtaccttttattttcctttatgatagaaacattctgaacattttaacttcatatttggtcccacataaaagctgctttctaacactcaccattccggtcatttcagagaaagtgccgaaggaacttttaaatgcccgaaggataattttatccctgaagactccttaagaattacaagaatagaaaaggtctggttcatcgattctgttaaggggacttaactgcatttgttctcgaccataaattctggagctggatgttatatgattggaattctgcttttcaggacccccgacaggccagagtagtaaattcagagtctcagaatgagtaatgtttggataagtaggtaccaccctgtccaacgttccatacgtaagcgtttgcaaacacttcgttcatgaatagctcactacctgcttcactttcctaaacacagctgagtgcctagattccaaaaatcgtttattctcaagagcaaccagtagaacaaccaccctgacttccaagccattgcatttcagccaccagttgcaaacaagatacgctgtggaagcttaccgttgtttctcttgcttcaggtgtcgtgaaatagggggaaaaaaagtttttggtttagtatgaaaacatctctcacatttccttctaagtcactcttggtctccagccacctggtaccatttcactgggctcctgtaaacaccatcccttcagtggcttcgtaagcggctgctattagaaggggctgcttcctaagagacttttttttttttttttttacagatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggttagtgcgcctggttcctgtgctcaggaatgcacccgtaaccagcagacaggactgcggtggccattctggcagagcaggcatagatgccacgcttccaccacagtgcacttgtttgcaggcctgccctgagtccatacactgcctggcactccttgctgaccaaacataccagggaaatatgggcttaaatttcacactggaaacttctccctcctttgccttgccttttgtccatttgcatagtttgcatggaaatactgttagttcccctacatataaatgattgcgcatccccatcagatgctcagtgactgttgcttcctgtctctgtgttgtactgtcttcatagcaaacagtgtcccaggtccagatgtgttcacagcttgacttttttttttttaagagacggtcttgctctgtcccccaggctggagtgcagtggcgggatcttggctcactgcaaccacccccggctccctggttgcagtgattctcctgccttagcctcccgagtagcagggactaacaggcacacaccaccacacctggcttttttttttttttttttgagactaagtctcattctgtcacccaggctggagtgcagtggtgcgatcttggctcactggaagctctgcctcccgggttcacaccattctcctgcctcagcctcccaagtagctgggactacaggcgcccacccccacgtccggcttattttttgtatttttagtagagacaaggtttcaccgtgttagccaggatggtcttgatctcctgacctcatgatccacctgactcagcctcctgaagtgctgggattacaggcgtgagctactgcgccagcccctggcttttttttaagtagagatggggtttcagtgttgcccaagctgctcttgaactcctgagctcagacaatctgcctgcctcagcctcccaaagtgctagggttacaggcgtgacccaccactccaggcccacagcttgacttttaaccaccacctgaacttccagccccttactctactgagacatcctccacgctaaaatgaagttggctccttactttatgcccttcctttgctcatagctcatgggaagctggtttctccctgcttgccaccacctgccccaagtagttccatcgccagttctttcccttctgtcaccacactcttccccctttccctagcacagccccactagaggccaccactgccagctcagtacgtacttctgaagtccttgtcatctcttcccataggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgtaagctgtctccattgggcctcctggccaggggtctgggggactctggacgggagctctgggagtgccttttggccaggagcgaccaaatcctcctctattctcctctgggatttgtgtcgccatctaggtgcctcccttcacagccaagcttggctacacttactgtgtgtgtgcaaactaacacgctcataaactagtacccaaagcagaataaataggccctaccccaaaaattcatgaaatgaaaaagtgatttaacgggcatgtccaagagcccctctactaaagggaaatcaatggatttgcactgcagaatcaaattcagtgtaggtgacttctgacaggtgcacttggaaatctggattatcattagaggctggggttacacggtgactaaaaccagttcctactatagtgaaccttttccacccaaagtgaacacactgacccatcaaagtgagtagcttgtgacacaacatatgccagagcctgcagagtagcttgacttcttgaagcgttttcccatttctgcttagtctgtcccatcaacaccactctgctctcttctcccagttcccaggctgtccacatttccagataactccttgaccgggaaactcaaccaaagggggtacttttgcgtgtctctaggccaaaggacaggagtggtgataggtagaaggtaggaactggcatgtaggcagtgagatggtgtaaaggtcacagaggtcgggttggcttggttccgtttttgaaagtttatctctgtggatcacaggtttggatcagagcttctttagctcaaaacaccaaaaagttaggaaaatatcctttgtaggtcagattcttctgggcccaagccagtagggagaaaaaccagcggagtttttcactggtatgagggactgactagcttcacactcagccatctccacaggagcacatggaagctgcagctgtagcagattcccttcttcccctctgtgggagggagagcttctgaccgacttctttcttccagaagagtttgttagctgtgctgtggtttttgtttgattttacttctattatctttcaaagcttttgaggggaaggatcataagattaaaccaaagagaactgtgtcctgctgctgctgctgaccagagggaaatccgtatttcaagactagataggctgggcacagtgggtcactcctgtaattccagcaccttgggaggctgagacaggaggatcgctcgagcccaggagttcaagaccagcctgggcaacatagtgagactcccatctctacaaaaaaaaaattatctaggtgtggtggtatgcacctgtagtctcagataccgtggtggttgaggcaggagaatcacttgagccctggaggtcaaggctaccgtgatctgtgatcgtgccactgcactgcagcctgggagacaaaccctgtctcaaaaaacacactagacagaagacaagttgtgttgttctttcccttgatactcctttatatccatttaaatccctgaaatttaatggaaatcaagcagttaagtgaagcttttttcacccatatgtagtgtttcccctcttatttccagaagttggatctgtgcaacccactgggattgcgtgcttacacacagatgttacttgtagccttaaaccgaggtggtttagggttttaggatcacagtgccctctctaagaggaaaggtaaaagatctttggcaaattgcagagtctctaaacacacactactgctgcttgcctggtcattcataattaattagaagaaaaaaaaactttctatccccatcttctgcttccccctcctggtgggcagaatggttgagtaagataatcctcttaactgggacctctggagggtggaggcttgcctcattcatcttcacatcctcaggccttcacccttagaggtcccaaaaaagtttcccagaagaccgaacgagtagggatatttggggaaccttgccaattattggagggtgttttgttctgttacctttcggttgtctggaggtttgagaaacccaacatggcttgttctttccatcttatcttaaggatggcagcactgcgctctcaatcgccctggaagcaggacacaaggacatcgctgttcttctgtatgcccatgtcaactttgcaaaagcccagtctccggtcagtgttgtgcatttggcatttgtaaataggctgaaatccaccagactggtggacccccttcctccaggaattgacgggagacagattttatgttgattcagaaaatggaagttttagtctggagcttaagagttcatcctttccgcctccaccccgcaaaaagcaggagaactaatgttttagcagaggctggaccttgcttgtccttgcaagacatatgctcacagcttcccatagaggttttgattctgtgcagaattatccagatagcagcccctgagcccatggggatatttcgccatggttctggcattgttcctgaagcagatggcaggcagcctgtagtccacagttcactctgagtgggaaggtgacttcccaggacagccggacatagcactgctgagcccagctggccttggagctgtggacacctgttccctgttctcagccagagctctcctggctcgggctcacagctgcttgttgcctgtggtgggccaagatcctatgtcacagggtacacatctgcctgaggtcacttattaacccccagtttttttcctttcctggtctctagggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctctttt

SEQ ID NO: 256 - DNA, 241412 bp, Homo sapiens; identical to SEQ ID NO: 255
  source 1..241412: mol_type = genomic DNA

SEQ ID NO: 257 - DNA, 39301 bp, Homo sapiens
  source 1..39301: mol_type = genomic DNA
tgattgtgcctctgcacctcctcaggtgaccgagggctgggcaggaggacacagactctttcatgaagcagtgactagtataggaaaaacagagcctctctgtagagatgcttaaagtgctagctttatttaaaaatcagctggcaaagcgggagtgaagaacacacattttcagaagataccggtttcctgttttcattaagaaaacagggaatgcggaacagctgagtgcggcgggggtggtgtcactgcagccggagggagacctcgccggtgaaagctcagcctatggcatccgagcgtggccggccaagtttacacgaatgttgaaacttctcctcacggggtgaggatcgagggcgcccgaggccgggtccggctgagctggagcgagctgtgcggggcagcgcgggctggcggggagcgcggcgggcgccacgtggtaggtgagctgcgagcggcgtggggcggccaccgctggccgaattccggggggcctgggcgaggggggccggccgggaaggtgcgcactgctgggccgcttcactccaccgcaggcctacgggagtccagcttagacccgccggctcccacacacacatcccgggaggcccggatcagcctgcctgacagccaagctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggaatttcagacagtcctggagacaggtctggctgctgcagcttctctcctgttaatggaatttcagacagtcctggagacaggtctggctgctgcagcttctctcctgttaatggaatttcagacagtactggagacaggtctggctgcatattttgagtgatcaccttctccatgtggagatgaaagttaaaagggaaagagagaaggacagctacgttcttttaacacgagcacaagtttccaggcacagccctcccgaccagccctcccattcttaggctagagcatgactgctgctgggcacttctttcacatagaattcacttcccacacgtgttagaatcgaacagctagagcaatttaatattgttttaaattgggacgtaaggaatatacgtcctttttattcctctgcttggcaatcttatttttgtactttctttccaacatttgggaagaaagcgggcagatggaagcagaagtgttcttcacagcattcacactgtcgggtgtaaatgttcggcagtgctgggggttgggagggcagacagcaaccaggtttgctggaagttacttcaaactggacagcagtcaagtgggtttgtatactcaggagagggcagggagactgatggcttacattttcactcattgcttttgagttctttccatagctctaaaaatgcgcagcttattagcgtggctctgggaaaacaacacatgacctgatcctacaatttaaaaaaataaaaatgaccttgcttttaagtttgaaatgcatagcccaggtcagcgacaaggtctgcgctttgaaaggttcttgtgtttcctcttttaaatgtctggtttagccttaagtagtatttactgagtgccacatgatccagtggttggagtatgtaggttttgcccttatcttcattctttgcatctgtttgaactcatgacaatacaaaacaaggtgttcctgggatagggaatgttttgtccaaaaggagtcaacacggagaaaactcttcctacagttaagacagggtttggttttgtttttaaatgaggagagaaactgagaagtggaaaacacaaaatagagttgaagtctttcctctgtgtgcttctactcatgctgccagagttaatcactaaatatcccatgccccagctttctcagccggggaggtgccaaggcaaattgtaagcccatggaggtagtcaggagctgagtgcccttgacctccatttagaaaggcagcccagtctgcaaaagacagcagcagggacatctcatcccaggcctcctggttatgctgctgactttgtctgtctgctactgacttttagtttttttgtgtgcctcagataacactttgaaaaacaggaatcttaatgtctgctgtctatattccaagagactgtagatgaccaatgaaattatctactggacaatgctttcatgtcttttttttttttttttttaattgagacggagtttttgctctgttgcccaggctagaatgcaatggtgtgacctcgcctcactgcaacctccacctcctggattcaagcaattctcctgcctcagcctcccaagtaactgggattacaggcgcctgccaccatgcccagccaattttttatttttagtagggacgaggttttaccacgtgttggccaggctggtctcaaactcttgacctcaggtgatccacccgccttggcctcccaaagtgctgggattacaggagtgagcaccgtgcccagcctttcgtgtcttttataatgaattcttttaaaaatatttagtaaggacttactatgtgcttgtctcttaatcattatctctgagtactgatggacataaagatggaaaaagatggaaatagtagacattttagactacaaaagtggggaaagaggggagtgagggttgaaaaattacctattgagtacggtgtgcactatttgggtgatgtgtacactagaagctcaaagctcatcattacacaatatatccttgtaacaagcctgcacatgtactccctgaatctaacatacagttttaaaaaataatacaatcattatctcattacattgtttttaagcctgtgagttaaatatttgcatctccatttttactcagggagaaactgaagttaagagaggtttattaacttgcttacccaagccgggcgcagtggctcacgcctgtaatcccagcactttgggaggccaggttgggtggatcacctaaggtcaggagttcgagaccagcctggccaacatggtgaaaccctgtctctactaaaagtgtaaaaattagccaggcgtggtggtgcacccctgtaatcccagcaactcaggaggctgaggtaggagaattgcttgatcccaggagacggaggctgcagtgaaccgagatcatgccattgcagctccagcctgggtgacagaatgacctgtctcaaaaaaaaaaaaaacaaaaaaaaacaaaaaaaacttgcttacccagctgttgtagatccaggttcaaaacataggtgtgtcaactcttaaaatcataccagcttgctgtactgcaacaaacacaaatattagtttttaccattaggtgtattgcatgtcattataatattcttttctccctcttctaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggtaggtggtaccctgaggacctgggaatgaggaaggatgggggaaaatgtctttccagaagctaaggattattttttaactgctggaaccatttttggaggagaaatggagaaagttttagagtggtaatctgtagaatgaaaactaagaatcaaaatccataagcacctctgctgatgcttattatctggtagcctcactggcctctggctgaggactaacgctggaagaaaagtaaactggtgttggctggcctagaggttgtcttctggggctgctagtttggtaagatgctttattctttgtctttcagttatttacttgctcattatttatagaactgcctttaaaaaatcctaccctgtttgtacccactattaccagtatattagcaattgaaatactggcataaaatgttttcagttaaaacgtttatgagaggagagactccattaattcattctttaattcagcaaataattattgaatttgagccaggtgcaatggtacacatccgtagtcccagctactctagaggctgaggcgggaggattgctagagcccagaaatttgagaccagcctgggcaacatagtaagacctccatttctaaaaaaatatgaagtaaaaatcattattacttggattcctactctgtctcaagctataggctgtgaagatagtgtgaacaaaacagaacagagcccctgtccctgcggtgcttacattctaggtggggtgcaggatatagacagtagacctataacatgtcaggaggcgataaatactgtgaagaaattaactccggttatgggaacagcgagtggtagtggtcagggtgagggctgtttgagatgaggtggtcaaacttggagagaagggagtcttttcccactcattttttttttttttttttgagacagagtcgctctgtcacccaggctggagggtggtggtgccatctcggctcactgcaacctctgcctctcaggtacaagcgattcttgtgtctcaacctcctgagtagctgggactacaggtgcccaccactatgcccagccacttttgtattttagtagagatagggtttcaccacattggtcaggctgatcttgaactcctgacctcaggtgatctacccacctcggcctcccaaagtgctgggattacagacatgagccaccacacctggcccgataggcgcttacatttttgtctgtcttattctttctcgtattcattgggattcctgctcactcttccttcttgaaattgaagctaataatcagaaagccaccctggatgattttatggcttacagtaattccctgtgagccttaccaacctgattttgcttgtgaccatgtgcactgcctctcacagtgtataacatcatcctcagcttaggaccacactgcctggcttccgtttctggctctccaattctcatgaatcagtgtgacctgggaaagagtgtgcattagattaattttacatgaaaatgtgtgatacagacttaagccatccacagaaattccagtctttctattagtgtctgatggggcaatgattaaaatagactgaaatatattatttttatatcttcctaggtttccactttcaaacctgaattattgttagttttcagtatctgtgctataggacagttagtttgttgtggaagaaaaaaatgaatatgacagctcatgtgtggggtttttgccttttagaatccaaagagtctaataaacatacagggaagtcattttagaataaacaggattaaaaatgatctgtagactcaaacagagtctgcaagaactcatgccatgtctgctttgacatccttttaaaaatcatgatgtcagatgaagtcaaaataaaattcttaaatacctccagacagatggcacagtggatcatccattataaaagcattttgttcccagccttcctccctcctccccaaactggggtttctatttcacattcttgccagaaatattcagctgtaaccctgaagtaatttgctgaccctctgagcacggagaccagggagcaagttcggtctggctgtgtgacagtgttttttggtctatttccagtcacactgacatgccacacatcactggttagatccaaccctgctaacaaacacctaattaatcagctaaaatacagaagacctacagcacttgtgaacaaaacaataaatatttttaacagcacttatttagtcacaatggcagcccctctcagagcacacaagaacaaattttaagtatttctgtaatgcacatcatatttgtgttttcaccattttgtttaacgttctaatgaggaattaattaggttaggaaatgaacgcagagtattccatttttgttatctggcatttgtcatgtggactgaaaattaaagcaacttgatatagtaaagtggagatgctcaacacttagaagctttgagaatccaggtggcccagggtgcactgtgcattcctgtgcacaccataccatagagaatagcactcaccacagtctagaatgtatttctgaaccaaaagatatactggagtatagaagggtattcatctcaatgtttgttttccccaaataaaacagtagggaatttgggtctgacacctaccaaaaagagcatataaatgatcacttatatgaacctaacacagtattctaatttaaggaagttgttcagtttgggctctgaagctagacagtgtgggttcacattctttctctgtcactagaacagattgtctttgttccttcacagggttgtaatgaagattcagtgagtcaataggagtaaagcacagagtataaatgctcaatgaaagttggctgacgttgttgttatggttagagtatttccagaaatagaaatgtagatctagaacaaatgatgccacacagaaattgtacaagtggtcttttgttttcagcctaaatttttatcttcattattctgggtgatgcccctacccaattattatacctctccaactaaccattgtatcaatataaagaagtacatagataacaatgggaaacacaaaattgataaatgttcagtccagagtcattcagaatccgtgtcaaagctcaaaacgaagtatattagcggccaatccatagaattctgttcatttctcctagagttgaagatttgatgatggtgtcacttttcagtatgcaaaaaagtgttatttttagcagcatcataatgcttaacactatatttaatttcttaaaattacaactagagcatgcatcataagaaattaatagttcaagcataggcaacgtagtgagaccttgtctctacaaaaaaattttttttaattatctggtcatgttatcctgtgcctgtagcctcagctactcaggaaactgaggtaggatgatctcttgagcccaggaggttgatttgaggctgcagtgagctgtgatcacaccactacactccagcctgggtgacagaatgagaccttgtctgtgggtgggggtggtggggggagattgtgcacggtggctcacacctgtaattctagcattctgagagctgaggctggcagagtgcttgagcccaggagttcgagaccatcctgggcaatatggtaaaaccccgtctttactaaaaatacaaaaatttgccaggcgtgatggcagatgcccgtagtcccagctactcaggaggctgaggtgggaagatcaccggcgccctagaggtggaggctgcagtgagccatgattgtcacccactctagcctgggtgacagagtgagaccctgtctcaaaaaaagaaaagaaaaaggaaaaagaaattaaaagttcagaagagcatataataaaagagttaaagcctccctggcacactcctgtggtagcccgcgtgtgtttggtatttacagatgtccatgcttgcacgtctgtattttagaaacatatatttttgtaataaaatttgaatcatacatagtccgcctctttgttttttcacctaaaaggtcacgaacatttttctaggatttgagagacaatgtcttggttttgatggaattggaacctgatagtgaccagaggtgttctgtattttttaattcctgatagtatgagtttaatgcatttaatattttcttttataaaataaaaaagttaagaggaaatgagtttctgttataacaaaaatgttggtaaaaaaaagtttattcttcctgtaaatcagttggattgttttcgtttgaggcatagattagtgttttctttttttaattactattttcttctagagagggaagaggagagagaaaattccagataaatgacttacagatactctaaaaatatataactgtctctgagcaaatacaaacaaaactataacagtggaatttaactgcctgccccatgatttatagaacattcatctctcatactgaaaagacctgctttttaaaatcagcttccgtatttatactcttagttatcttagttcatcaaaagttaatgaactcgaagtcattcccataactatgaaagtaagttgtagacaagagatctgagccaaagcaaaagtagtcattacaaaatacgtttctaggtagttttctcctcgttcaaataatatatcatttacctgtcttagcacttggcttcttaatcactttcttttaatgctcaaaagcaccaaaacaatgcaatccaagtgtttctgggaccctgcagatataaaaatatgatgtaggtagtggaaggcctagaagtcagaagagctgacctctcatactggctgtgtaggtaacttgctgtgtcttttttttttttttttttttttttttactcttaagacagggtctcactctgtcacccaggctagagtgcagtggcatgatcacagcttgctgtagcctgaacttcccgagctctaaccatcctccctcttcagcttcccaagttgctgggactacaggtgcatgccaccatacctggctaatttttgtatttttagagacaaggtctccccatgttgcccaggctggtcttgaacttttgggctcaagcaattcgcctgcctcagcctcccaaattattgggattacaggtgtgagccaccatgccaggccactgtatcattttagaaagggagattgtggacttccatggcctcctgtgtcaaataaatagggtgagattagtttttctcctacagtcccttcagcaggattattctgtacaagtgtgagttaactgtttatgttggtgaccacacatgtattagcattcaggctgaggtctgagaggagagcgtagaaacaacatatttgtcctttctcctctatcaaagctacatgcttttcctcacaaagtagtatgtaccaaaaaagaagatggtccttcatgaataatctctactgcctgttccccaaaccatcatttgggcttaaagagtgaattcatgctcgagcccttttttttttttttttttttttttgagacacagtcacactctgtcacccaggctggagtgcagtggtgcaatctcagctcatcgcaaccttcacctcctgggttcaagtgattgtcctgcctcagcctcctgaatagctgggactacaggcacacgccaccaggcccggctaaatttttttttattattatttttagtagagacggggtttaaccttgttggccaggctggtctcgatcttctaacctcatgatccacccacctcggcctcccaaagtgctgggattacaggcgtgagccagcgcgcccggcctcaagccctttttcttaaaaacaaacattatttcagatccctttgaatttttagtcatactttgggaaagtaacctaaatatttgaaaggactccataatgaattggaaatttcagtcctacctgttctcaatgagtaagtttagatgttctttaaaaattaaatcagaatgtcaagctgaaaatgtggcacagctacatggttagttagctggctacactcttcttttttgtgttttcagaaagttcttggcactatcaatacaaatgtagatcagcataccagaacagttggaataggtgaacagagcaacttttaaaatccattttaatatatttttttaaattgattttctaacaaatttggaaacccatggctatataccaataactaatacccattctggacagataaatgttacacagaagactggagaattgatctctttaaaacccattcagctctagttttgggtgattttttttttctttttttaagagatggggtcttgctttgtcacccagactagagtgcagtggcatgatccgggctcacgccactgcagcccccaacttctgggctcagggctcaagtgatcctcccaccttccagctctagtttcactgaattatttttcttgtaaaacagtttgcttttaacattcctttatgtcaaggacataaagttttcattttaagtggcttgtttttcattatagtcatctcatttgccttagaatttaatatatggataattataaaagctaagtgcacttcggaatgataattaatgcatcaaaggtgttcctcttattttccaggacactgagatttctgtcacttgttgtcctttagtgatcactaatctgaccaagtcgtaaaatgaggctcatgctttattggtgtttatggctgttataagtttgagttaatgatagaagacttcacagttgcccactctgctgtccattaacttcccagttgtgcctgtgaaaaccgttgccacctggtgagaattttgagcatctagaccagagtgccagaattctgaaggtgttttgtaattactccacatgttgctgtcgttttgttttgttgagacaaggtctcactctgtcttccaggctggagtgcagtggtgcaatcatagctcaccatagcccctaactgccaagctcaagctgtcctcacacgtgaacctcccaatagctaggactacagacacttaccaccatgcccagctgttttttgttttgttgtgttctgtttgttagagaggggggtctcactatgttgctcaggctgatctgcaactcccaggctcaagcaattaacctacctcagcctcactaagtgctgggattacaggcgtaagccaatgcacccagcctgttttttgtttttcctcagagacggggtttcattctgtcacccaggttggaatgcagtctcaatctcccagcctcaaaccatcctccagcctcagcccctcaaagtactgggattacaggtgtgagccactcccagcctgtaattactcctgtttttatccctattgttcagggagcatttactttctgtttagtatgaacatctaccattagtggcccagggctgttaattaaaccaccagcagttcctaaaaattcacatggatccaagttgatgggttgaaactagaggggagtctaaattcttaatttcagtagtcagcttttatattggttaatttaattcagtggatctcaatcctggcagcacaatagaatcacctagggagaagtttgaaaatactgatgcctgcaattggagacactagttgtattaccaaggctttgactggaatggcatgtttacagagtgctttggggaactgaagttgatctttagagccaatggaagccccttggaaaaactgacctccctcataccttgtcctttacagggttcctaacctgtggtaagtaaagaatgtcactttctgacaagctcaggagccccacgttattttgggacctcgggaaaagaggaagtcacctaatttatataggtatctgcaggcacaaataaattcttggctgggctcaagaggtttgtaaaaggtctaatttgagattccttatgaaaaatgtcagcaaagtcaatgtaaaagaaaaagggggggccatatggcaaatacttactcttgctgcactttatgcaaataattagcccaagcataataagactaaaacttattttggaaataaattggtcccactatgattggtctttggtagaaatagaaaaccagagagagaaaaattatgtttcagaaaaactatagtaccccttttattgactccagctttgtccacttttttggataaggtcatctgctgataactcaataattgattggttctcagggtcatttacctgggtccctcaaggcttcaggttggttctacagggactcctgaagctaggactttcacttcttgtggtagggcttactattaatcttacagtctgctgttcacttatgtgctgtactaaaactgtggataagaatgaccccaaccagacaccagtgaaggcatacggtcaacttgaagacggtttcactcctcttaccttgggggcaaccccttccccaacaatgttccataagcaagaagaaattagagctgtcattagcctttcccatctccatagctcacacctcaggattgaggtgtaccgaaacccaagggggtggggacattgaaactgcctttccaaaatcatgacagtaaaagaaacctgacatagctgactccgtcttacttctgacctccaagctgtccttgttcattcctaggcacaggccaagctaactgtgggtagaatttggtttataatttaaccttaaagcaaggatgataatagcccttcccaagactaaactgcctttgtaaaactaatgaaagcacacaaggttagaattatggacgggccctgaattctattttatttattttatttttttgagatggagtttcacttcaactgcaaataagtgttcattctctctctctctctctgtctctctgtctgtctgcctctcttgctctctctctctcatatctggacccatccagatcattgtatctacattttttaaagtctcaccctcgattcaggtgattctaaagggtagctagggttgaaacgactgaattttgtttgttggcctctttgttctttggctttcctggctgcacgttttcttcgttttgctcaaacacagcagtcatttgtcagtcttacattggtgcatgcggtgcctacaactacaagtgggtccttatcaagttcagagaattgtttataggccactcaagaccagccagagtttcaacaccatccaaagaacattttctggcaatataggtgaccaattccctctgacttgacaaaggagagccagtttggaatttaatgaggttcttttccttaccagttaagcctcagtagaatcctcatgacctttggttgaattacatggacacttattaaaggctctcaatggtcccgcactgttctaagcactggacaggacaccaaataagaatgtagcagggaggaactcaagatgctgaccatctcattgaggagacagggcatatttgaatctggaccgtaagtgctacaggacaatgatggggaaaaaagacatctctgtggaatggttggaatggtatcatagaaaaaagactagagaagatagaatttgggccaagccttgaaaagagtatgggtcgaattcagctggtgaaggatggcgaatttccagacctgtaggatgatctaattactccctactcacagagttggagtaattaagtcacaggaccactctgaacagaatggacagagtggaggagtagctgagaggtaaagttcccgcaggcaagatgaaaccttccaccttgacccttggatgcctgcaggaggaggtggaccttgattggagaagctttaaaaagccctagtttacaaaagtaagctgtggtgagaaaaattatagcacctggtattcctgggtgacactatctggaaggggtgggaggaaaggcttaccaggttgttagaaatgttctgtatctctgttacagaggtggttacacaggcgtatacatctaccaaattccatccgacttacacttaaaatcagtgcattttcgtggggcatgatcacaagcacctgggtcctgtgtcctagctactccaaaggccaaggtgggaggattgcttgagcccaggagttcaaggctacagttagctatgatcacattccattgcactctagcctgggtgacagtgtgagaccctgtctgtaattcattctgtgcattttattgtctataaattgtgtttgaattttttaaaaattttaagttgtatttaaacaaagagaacctatggattaaaagactttaaaataatagcaaccaatggaaatacatgactggaattctgatgcaaacaccctattaaagaaattttttagagactattggagattgggcacagtagctcatgcctgtaattccagtactttcagaggccaaggtgggtggatagcttgaacccagcagttcgagactagcctgggcaacatagtgaaacccatctctattaaaaatacgaaaaaaaaaaaaaaagaagccaggcgtggttttgtacgtctgtggtcccagctatttggggggctgaggtgggaggattgattaagcctgggagacaggttgcggtgagcagagatcacgccactgcactccagcctgggtgacagagtgagatgccatatcaaaaaaaaagactattggagaaatttgaatactgactggattatgtgataatcatacttatctttttttaagatttgatagttttagcctcaatggtttgcattttttagagttcttttagggacatatactgaaatatttatggatgaaaatgattgaatctctagctgttgcttcaaaataatccagtgtgagtgggcagagggagttatcagggaaaccagatgttttctaatcattgttgaagctagtaatgggaagacaggagtttattaaactattatctacttttgtatctgttttatggtttcaataatagtcaaaactatcatgtatttgcatttaaaaagtcattgttggttattgaagaggaaaatgcttcgtacaagcatttctctacaaagagtgttctggcggccaggcacggtggctcacacctgtaatcccagaactttgggaggccgaggtaggtaggtggatcacttgaggtcaggagttcgtgaccagcctagccaacatagtaaaatcccgtctctactaaaaatacaaaaaacagctgggcgtggtggcgggcacttgtaatcccagctactcaggaggctgaagcaggagaatcacttgaacccgggaggtggaggttgcagtgagcagagatcgcgccactgcattccaggctgggcgacagagcgagactcaatctcaaaaaaaacaagagtgttctggcattcagtgattaactagtgagactttttggaggccgctgcaatattttctaagtaatgatgaatggacttggagaaggaaaaatgaagataaatgccctgctttatctactttgcttaaaataagtcaaaggcacattaggcatttcatatttgcagttaggggacatcaagtcacatagtgtgaaacgttgtttggaccgctgaattcagtattgtgtgtatgtgtgttgaggaggaagttggagttgtaaaggaatcgtccaggtagcccccatgtcccacagctaaaggagaaagcattgtgctgttgatttggggacaggggactgttcaccgaattaggaaatgtgagttctcgttcagctctgtggcctggggcaagtcctgaacctagctggccttcagaatccttagctggaagtctggaattaaaaattaggtgatatcccttgaggtcaggagtttgaggccaggctaaccaacatggtaaaactcagtctctactaaaaatacaaaaattagccaggcatggttgtgcacacctgtagccccagctacttgggaggctgaggcaggagaatcgcttgaacccgggaggcggaggttgcagtgaactgagatcacgccacagccctcactccagcctgggtgacagagcaagactctgtctcaaaaaaaaaaaaaaaaaaatttagatgatctctaatgccttacattgaattttttgccagctctcactcttttactatagcgtcattgttttaaaccagtcaaagtagaccacctgcatcagtgattcttgtaggtggtggggaatgtcagaaatgccatcacttggcccccatcccagaactgcagaatgatctcctggcagcatgttcctgggaatctgcattttagccaatgtcacaggtgattcttatgaagaatagaactcagagcagttttagggcttgttattcgttctttttcttcatattgcctcaaaatacaatcaacacttaagctgcttttcttctaagaatctaagagatttcagagctttactttgaaagggataaagttgtgatcacctgacattgtgagtagatttaaatgtttaatttttgttagtaatttataaagtataatttaggaaatactagagacaaaaagaaaaaagttatagtagcctgtgactctttagccttagcaaagcagtgttaaatgggtttcctgtatatccttccatgatttttctaatacatacatatgtaaatataattatttactaatgccagtaggcagcaatgagaacaaaacctcttttgtatttttttttcccatgagtcaaacaaaagacttcagattcagatcaattctggtgtgctagggcaggcctttcctacaaggggtggagaggccagcctttcttctcttggtgggaatggcctgagctgtgttgtggggcaggccgctgatttgtgtgatgtatcattagagggaataagcccattgatcttttctagtttccgttaaacttgaactgagaggccaggcacggttgctcacgcctctaaccccagcactttgggaggctgaggcgggtggatcacctgaggtcaggagttcgagtccaacctggccaacatggtgaaaccgagtctctactaaaaatacaaaaattagctaggcatggtggcacttgcctgtagccccagctactcgggaggctgaggcaggagaatcgcttaaaccgggaaggcgcaggttgcagtgagccaagatcgcaccactgcactgtagcctagcaacagagtaagactctgtctcgaaagaagaaaacttgaacggagacaaaaattaaaaataaggccaggcgtggtggctcatgcctataatcccaacgctttgggaggtcaaggcgggcagatttcctgaggtcacaagttcaagaccagcctggccaacatggtaaaaccccgtctctactaacaatacaaaaattagccaggcatggtggcaggtgcccataatcccagctactcgggaggctgaggcacaagaatctcttgaaccaagaaggcagaggttgcagtgagccaggattgctccactgcactccagcctgggcaacagcacaagacaagacactctctcaattaaaataaaaaattatttaccaaagtaggtttattttctccgtattattgtatgacctatttttaatacacatcatgctcatctatgttaatattctcctatatcaagatttgtaatggccatatagaattcctctgtataaatataccagtgcttatatggttgtttcttacaagcagactgtctgcctctttttactgttttaaacatggaaacaatagccttctgtgtctttttgtacatccttaggataaaacttttagacaattaagtgaaataatttttcatttttaaaagtgattttgaacacagttaacccatattcactatagaaaaaatggcaaatccaaggaaatttttttttttttattagagtctcgctctgccgcccaggctggagtgcagtgggacgatcttggctcactgcaacctctgcctcccgggttcaagtgattctcctacctcagcctcccgagcagctctggattacaggcactcaccaccatgcccagctaatttttgtatttttgtagagatggagtttcaccatgttggccaggctggtctcaaactcctgacctcaagtaatctacctgcctcagcctcccaaagtgctggaattacaggcatgagccaccacgcccaggctaatccagggaaaaattaaaactaccatagctgtttcatttagcacagagtcagataacttttcatgtgtgtgtgtgtgtgtgtgtgtgtgtgtgtgtgtgtatgtgtgtgtgtggtaatgtattttaataggatcacacaatacatggaattttattatctgcttttttcaattaaccatatattacaaacatttttccacatcacccacattgaaaattctacaatatatctgtaaaccaaaaataaaattctaagccccctaaccaacggaatagatccctcctgtcagccaggggattccatagtaaacctgaaaaactagttcaggccatgatgggaaggaagtgtcaaacatgcctcattataccctcctccctttggaattcaggcacaactgaccagcattaacattaaaacagagatcttaggagtgacaaacagactctttataccaataagataacaaattccaacctgactctcctatagcatcacatgacagcagaccctaaaagaaaatgaagtattttaccctaaaatatatttcttcgatgtattttgtctttttttgttttgtttcttttgttttcttgagatggagtctccctctgtcactctgtcacccaggctggagtgcaatggcacgatctaggcactacaacctccacctccgggttcgagccattctcctgcctcagcctcccaagtagctgggactacaggcaccccccaccatgcgtggctaatttttgtatttttagtagagacggggtttcaccgtgttgaccaggctggtctcggactcttgacctcaggtgatccacctgccttggcctcccaaagtgctggggttaacaggcatgagccactgctcccggcctcttcgatgtatattgaaatggccctgcaaggctgtctcttgtggggaatatctacattatgtagtgaatccccttacctgtccaggccttttcctgatccaggagagattcagagtctggtacctatttaggtctgaaaagagacatttaccatctatatagaggtctgaaaagtgacgtttaccatctatgtagatgaagcctgctacctggaggcttcatctacataataagaaccttggtcttcacaaccccttatcttaacccagacactcctttctgttgattgcaggcctttagataataagttaactttttcaaccatttgccaatcagagtatctttgaatctaccgaagacctggaagcccacccttatttgagttcttccacctttctaaactagtgtataccttacatgcattgatttgtgtttgcctgtaacttctagtccactaaaatgtataaaattaagctgtaacccagccaccttgggcacatgttgtcaggacctcgtgagattgtgcttttggccttggtcattcatacttggctcagagtaaacctcttttttacagagtttgactcttttcattgacatatctgtatacattaattacaaaatattatttaatccaaattgcttcggtcagtatacagattttaagtggctaacatatacaaaagcactctagtagatttgttaagagaaagttgatcagaactgtttgatgccctcaaaatatttaccatctacaagggagtctaaaaccatcatacaagtcatcttgtacattgtatcacagatccccaggagaaggtacaaaagatgggctgtgagagttcagggcaagaacattgttagtgaaggagatcagggaagggtctgaagaggcagtgatgggagggtgcggctgtgtgaagatgggggaagaaaggtattccaggtagtagaagggcataagctgaggcatgctgccaggaaacaagagacccgcatctctatacagcgagtcctggcacttaatgggatgcagtccctgtcccagtaaggacgacaggaggagtgggaaatgaagttgcgggggtcagccagtaccaggttatggatagtttagaatctctggctctgcagtgtggactacatttcctgagcagtgggtgctttttaggcgttgtcacattttgttttagctggaataatgatggcattggagctggctgggagtaatgctctgaagcattgtgccagagtggaagtagtaatggaagaggggcagtaaaatgctacttccatgactagaaaccaaggctatgacggtagcagccaaaacagagaaaagaagaggtgctgtggagttagaatgacgaggcccggcagtctgcctacgctaatgaaatcaggaaagctggagcgtcaaaggggcttctgagttttggtggctgggataatagtcccattttaaattatgagtggcaagaattgtttttgttgaagcctgctttttcagtcctagcatcacacactctgtacctttctttttcctgataggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatggtaacttttctcactcacagtcattggcatcaggattctagggccagcattgccagcattccaatttaatgtcaatgtaccttttaaattgacctggaagaaagttaatatcgttatttggaaggtaggcccagaatatctttaaataaggttaccaaagaggccgggcatggtggctcacacctgtgatcccagcactttgggaggccaaggcaggcagatcatttgaggccaggagttcgagaccagcctggccaacatggtgaaaccccatctctactaaaaaatacaaaaattagccaggcatggtggtgcacacctgtagtcccagctactccggcggctgaggtgggagaatcacttgaacctgggaggtggaggttgcagtgagctgagatcacgccactgcactccagcctgggtgacagaaagaggccctgtctcaaaattacgaaagaaagctgtacaagaaagcttacctgatattacaaattatgaaatattttaaatagcattttattcacgttctggcaggcataagttttttcaggttatctcagctgaagaagaataataatccctgtttagtacgtaaatggtccttgaggctcgtgagacacgacatcactttataagcagtaaagccggatacaaatgtcagttttcactggctttgttatgtctggaaggactaattgatttttttcccatgtgaagaatgttattaatggaactttgaattattttctttgcatgcacacactttcccattgaattttgtggaaacttctcacatatatatgccaagatctacatttacatgcatgagaaaagaactgtacaggaaaaaagatcatttaacatgtatgggtgtgagttttcatttttattgccttgactttttcacagcatgtacaaacaatgaaagtacactgaagtccatcatgaagaagaaagatggtaacaaagattcaaatggcgcaaaaaagaatcttcagtttgttggcattaatggagggtaaggaaagatggtggttctagaggctaatgctgtcagtctcctttacctcctgcctaagtcacatttcaaggcgcctagtcggggaagcggccacagcgcagtgatgaaagattccctcctcagaaaggcagaaaggtgcatttgggctttgctttcctcctctggtgctgtctttaaggatttgtcactctcttaaggatacctgatgaagctgagcggtttacatctcctcacctctgatctgaaagaaatagtcttcagcgaacgcagcagggttcctgcactgtgttggacaacttgtacttacctatacgagaactcacaattgagcagaaaaagactgagagcatcactctctgggccaacgatcgtcatcttttccttcaaaatgggtccttttgcttagctctccatgtttacgacccaaattgtagggcctttcacaattgataaccacatcaccagtttgctttctaaatagaatggttattgtttgttccttctctttgcattggcccacgtacatagttaagcccctttgttgtcctacaattgaatcaaatcaatgaattgatacatggcccccacaagaaagaaataatacaaagtgtaccattagggtttaaccttatggtgcctgttttccaaatctagaagttttattcagtgataatggccaggagattttggagggcatacaccagaaaaactatcgattgcctatgtaatctattccccttgatactgggagaattaataggatgaaataggaagacatggggtgggggggggacaaaaagcacctaccgatctgttttccataaagtatgttttctcatgatttatgctaagccggagatgccattattttctttaacaagtgttacatgataccaattggttatatgataccgataaccagtttaagttagagtccattcaaaaccaccaggcatttaaatagaccttactttgaacttctaagtgcaggatctaaaaccactagtgaaatttctggagtcaattagcaaatcccttcatagaaatttctatcactgggtcttcgtgagcacaccttgcatctcctgaaatcccaattgccacctaggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtgtggtacattccccttccctcccttgcccctcccacatttaatgtactttggcaatagagttggccagttcagagcttttgtaattaaatgtttgcttttatctgttcctcagaggtatacacatcttgagatactaatatatacaagtgcagagtattacaactcttagatctcttatggtagaatggcctggtacctaatcacccttgttttctgaaaccttaactctgctatataatttaacatatggaaccacaatccactaaaacttgcattgtttgaacaccttaccttatatttaaagacattttaattttttggtggccagcctactttaagatttcagattttatgtttagccatttatcttgatacaggtgtatcattattacaggatcattgtgtggatgaggcctcagccaaagatcacatatactgtaaagatgatgcatatcacttacatgtttgtattttgttacacattgaatgatcaggaataccacaagaatggatttgggtatatcataaatagtagctgaaaaacactctggttggctgaaatatgtgcctcagaatgtaagttttcaagaccattagataaggatttgatgctcataaaatagagagtagaaaaggtggaaacttcagtatggtttttcagtatgtgaaatataaatagaacatttcagaaaacttacctctatttaatttggcaaatgaaagtttaactgcattaaaacaaggtaagtgtttttagtttatatttccaagtgtttcacatggctttttaacagctttgagatgtaatttatataccatatgtcatttttttacttttcatatgggttaaacacttgagtcaccaaatgtgggttcagatgtgtggtttactggtcagcacgatggatatatggtaatttgtggaaagtcaaggcaagaggatcgcttgagcacaggagtttgagactagcctggacaatatagtaagacctcatccctacaaaaatatcaattacctgggcatggtgtcacatgccagctgctctggaggataaggtgggaggatcacttgaaccctggaggttgaggctgcagtgagccagtgcactccagtctgggtgacagagcaagaccctgtctcagaaaaaaagtaatttgggtctccttcaacccccttaaaattaaaaatattttttaaaaacttagaacaggttgggcacagtggctcacacccataatgccaatactttgggaggctgaggcaggcaggcagatagcttgagcccaagagttcgagaccagcctgggcaacatggtgaaaccctgtctctacaaatacaaagccgggtgtggtggcacacacgtgtaatcccagttacttgggaagctgaggtaggaagattgcttgagcctgggacagcaaaactacagtgagccgtgattgcaccactgcactccagcctgggcaacagagtgagaccttgtctcaaaaaaaaaaaaaaaaaaaaaaaaacttaaaaatggcaaaaaaaaatctctaaatgttattccagaatgtcataaaggccaattggtgaagccgaatgtcaccctcccaaacaaggcctcaatctctggctggaggtgttggctctgcacagtggacgtaacccttagacccctaaggatttctgtgctgcctctgcccaagcaccttgtgccataatgacctgcctgggctggcttggggccacttgccttttaaaaatatatttttaaaagttgaagctgcgcagtgtcccacccctgtaatcccagcactgtgggaggccgaggcaggtggatcacctgaggtcaggagttcaaaaccagcctggccaacatagtgaaaccccgtctccactaaaaatacaaaaattagctgggcctggtggtgcacacctgtagtcccagctactagggaggctgaggcaggaggattgcttgaatccaggaggcggaggttgcagtgagccaagatcatgccactgcactccagcctgggcgacagagcatgaccctgtctcaaaaaaaaaattagatatttgggttgaaataaaaatgattttcttcttgtgaccaatcgtaacttgttttttctcctttcaggtatgaattaagtgaaaagatgttgtctgcatgcaacttactgaaaaatactataaatgaccccaaagctttgaccagcaaagatatggtgagtctgacctgcaaacaccatccccagtgtgtacaaagtgcatgagtgggttcattgtcaaggccagctgtaggctgcccgagctgttgcttgcatgcttttctcctgaactgtttccagcatgagtgggctgggtaaacatcatgtggtcttgctccctggatcacactgccagcgtttccttgaggcccaacttcggacatcctttacccaccctggacttttcctggggtggaggcatctgtgaggcgtacacttgcagacagaaagcagggctaattgcagtcagtcgtcatctttctacatatttcatttctatttatagaacagtaagatccagggagcagcatccaagaattttttttttaagttagcatatgtttttaaaagaaacctatctgagccaaggtcagcattcctttcagttatgaaactgtatgttatgctctgatgtggaatgcaggcggccactatttttaaacataaaaataaccgcacttgtcatctcgcagtctaagaaattcagagcaaacagcaaagagtttgtggttgccttagtgatcatgaatggtacaacataggacacaagtatttctatggcaatggttaatgtgacaccatggccaagaatgacatattctcatgtgtcgaagttatgtgcacattctttcataggccagactaaccccctggttgacagctgtcttttttattagtgcattgagaaaatgtaggatcccctaaggataccgaaatgcacagatactcaagtcccttatgtaaaatggtgtagtatttgcatataaactatgcatctactttaaattctgccatatattttaaatcatttctatatcataatacctaatacagggccaggtgcagtggctgacacctatgatcccaacacttcgggaggccgatgcaggtggatcacatgaggtctggagttcgagacgagcttagccaacatggtgaaaccctttctctactaaaaatacaaaaagttagccaggcatggtggtacacccgtgtaatcccagttactcgggagtctgaggctggagaattgcttgcacccgggaggtggtggttgcagtgagccaagattgcacctctgcactcaagcctgggtgacagagtgagactccatctgaaaaaaagcctggagtgcagtggcgtgatctcggctcactgcaagctccgcctcccgggttcgggccattctcctgcctcaccctccccagtagctgggactaccggcgtccaccacaacgcccggctaatttttttgtatttttagtagagaccgggtttcaccgtgttagtcaggatggtctcgatctcctgacctcgtggtccgcccatcttggcctcccaaagtgctgggatttacaggcatgacccaccgcgcctggcctcaaaaacttaacacaatgtaaatgctatataaatagttgttatactgtattgttttgtattacatattttttaaatattttcactctgccagtggttgaatctatggaaatggaacctgtagatacagagggccagctgtactaaataaaattgctggtcaagtccaggcacagtggctcacacctgtaatcccagcactttgagaggccaaggcagtggatcacttgagcccaggagttcagtttgagaccagcctgggcaacatggcaaaaccctgtctctacaaaaattagccaggtatgatggcatgtacccatggtcctagctacttgggaggctgaggcaagaagatagctggaggcccaggaagttcaggctgcagtgctccatcatcatgccactgcactccagcctgggagacagagtgacaccctctcaaaaaaaaaaaaaattcctagtcaaggggaaacatagaactacatattgaaattcttggatttgtattcatgaaaatacctggctataccctggtcactagtaaaaccataaaatctcactgcagggtcagtatttcccatcaggtttaacctaaacttaaaactggtgccttacaaccccagattttatagccatagtacacttttctttcactgttctcaaaatactaggttacgtggcctttgggaaggattctgttttcctgcatcctccaaattgccgagcatggtgtcatccacacacactgtgatgggtacatctttttaactgaattttcatttggtgtgaaagtgtttaaagtattgtgttgtgaaaagtagtggacgagtaaacacaatgccagggctagataatcatgtcaggacaccagttatttagcagtaatagaattagaatgaccagaagacataatttcccttctttcagtgtgacaactccagagaaacaggaatgtgaatatatacagaaaaaaaaggacactcttcaagtgacccaaaatgtgattgaaatggttaaaactaaataatcagtagcaggatgataaagagatggaagctctataatcccaactctaccttttctacagaaagaggacttcttgggttctggtgcttctgacataggctgtctttctttgatatatttttaaacttttaaagagtaagcacagcagaaatgaatattaaactcatatgaaggcccattgaaaagacactgtagtcatcctcatcaccagtactgactgctcagtctccactgagcttcatgtgacccagggttgagttgatcatccacaaagcaagtgccttcttcatgtgtccacagcctaaggaagtcagagtggagctgatgagagaatgaaattagttccagacggggttcccttttattttccctttccgtggttgaacagttgtatttgggattggggtgggaattgggttggctatacacgtacggtctcccaacctagtgctgtgctgaggagttgaaggaggtgagtttggtctggataggaaggaagcagcataattcagtgtaggctagttaatttcttcctaatttctatgaaaattgtttgcaaggccagtatgattacatcatattaatagcttaataaatggagccaagcctgagtgtttattctcatcacagaaactatgaaagcatggtattatccagtttttcagatgaggaaacggaagcagaataacttccctcgggtcataaagcttttaggtagcagagcctgcatttgaaactcagtggtctggctccagagcctctgcttctgcatggtgctgtctggtctcctttatagacattagaatctacacgtcatttaaaatcaggagaaatgtcccagtttggtgtttgaagcttctcttagggctgttggtttttgagagcagattctaactgcatatatatactttgactataaaaggacaggttacttgtgctttcaactaggtctcagaaagtctataaatagaagaactaacgaccacttggtgttttggcagaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccggtatgttggctgcccttccaccctctcttctctaacagtacttgggttgtgactcatctcagagaacctggttgagccactcctgaattctctgaccatgctaaaatcctttttattgcttttccacatgacatggcaagaattttcttgagtcattcataagaggcttgaagtttaaacaaaactgggtgacacagattctagatctgtttttgaaaggaggttttgaggatcttcttgctgcagttcagctgcattcaaaagtgagaggtgtatgcctggtaagaagcatgtctcacgttccctcctgagctgaatcatgcgggcttggccggtttgcactcaggaggcagagtgctgcttacaggcccagggtcacagccttggtgcgtgtggaccacttgatttgaccttactccatgactgctgtccttgcagaagtgtgtggttagtcaagatggggactaagcaaagccaccttaacagatggtcaaatgatcaccattctcaccaaaatatactgttattggggaaacagcatagagcaaagggcatgttattcttgtctctcaaccataatagaatagtagaaacttgttatcccagaatagagccagtggacatcttagacatgaagtgagggaggggcacatacacagatggtaccctcaagaaactgtgagctttcaacttcttgttcaaatggagcagcctgatgccacatagaccccaagtcttttaatttttgtaatacatatttttatttctagtatgtgacagagaagtcagagtatctcagtctgattaatgaggatgtagtgtgaaccttagaatatgcaatcatactgtccaattttctgaaattctgtcttcatccactgtccaatctcttctgctctgttttgggaacttggaattgatgcagagaagaaagccaagcagatttatccttcctttctcttataagtgtgtttgttccctctttttggagccatgttagggtataactgcttccatcttacaggaaggaatttcaagcccctcctcttcaggctttctagactataaacagagctggtgatacagtcagccagagtgattgtttaaacagaagtagataatatccagggaagctgaaaacaagatttcactatcactcctgacaggaacagcttagtatacccttagaagttgataaaacatcttggcaaattaaataattttaattccattgctggatggtttgggttaatcacttatcttaatggttactgctcccccttctaggctgagattctggctccataaggtgtagatctaggatgcttcagcatctatgcagagcagagtccgcaaagtccgaggtgctaaggagccccgaagcgcacacgaattcacctgcttctcctccacagggccttttattttctgcattaaaaacacccacttttaaaaacatgtccttagtatggagttgtttgggatcttaaggtaaatgttcatggtaccttttattttcctttatgatagaaacattctgaacattttaacttcatatttggtcccacataaaagctgctttctaacactcaccattccggtcatttcagagaaagtgccgaaggaacttttaaatgcccgaaggataattttatccctgaagactccttaagaattacaagaatagaaaaggtctggttcatcgattctgttaaggggacttaactgcatttgttctcgaccataaattctggagctggatgttatatgattggaattctgcttttcaggacccccgacaggccagagtagtaaattcagagtctcagaatgagtaatgtttggataagtaggtaccaccctgtccaacgttccatacgtaagcgtttgcaaacacttcgttcatgaatagctcactacctgcttcactttcctaaacacagctgagtgcctagattccaaaaatcgtttattctcaagagcaaccagtagaacaaccaccctgacttccaagccattgcatttcagccaccagttgcaaacaagatacgctgtggaagcttaccgttgtttctcttgcttcaggtgtcgtgaaatagggggaaaaaaagtttttggtttagtatgaaaacatctctcacatttccttctaagtcactcttggtctccagccacctggtaccatttcactgggctcctgtaaacaccatcccttcagtggcttcgtaagcggctgctattagaaggggctgcttcctaagagacttttttttttttttttttacagatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggttagtgcgcctggttcctgtgctcaggaatgcacccgtaaccagcagacaggactgcggtggccattctggcagagcaggcatagatgccacgcttccaccacagtgcacttgtttgcaggcctgccctgagtccatacactgcctggcactccttgctgaccaaacataccagggaaatatgggcttaaatttcacactggaaacttctccctcctttgccttgccttttgtccatttgcatagtttgcatggaaatactgttagttcccctacatataaatgattgcgcatccccatcagatgctcagtgactgttgcttcctgtctctgtgttgtactgtcttcatagcaaacagtgtcccaggtccagatgtgttcacagcttgacttttttttttttaagagacggtcttgctctgtcccccaggctggagtgcagtggcgggatcttggctcactgcaaccacccccggctccctggttgcagtgattctcctgccttagcctcccgagtagcagggactaacaggcacacaccaccacacctggcttttttttttttttttttgagactaagtctcattctgtcacccaggctggagtgcagtggtgcgatcttggctcactggaagctctgcctcccgggttcacaccattctcctgcctcagcctcccaagtagctgggactacaggcgcccacccccacgtccggcttattttttgtatttttagtagagacaaggtttcaccgtgttagccaggatggtcttgatctcctgacctcatgatccacctgactcagcctcctgaagtgctgggattacaggcgtgagctactgcgccagcccctggcttttttttaagtagagatggggtttcagtgttgcccaagctgctcttgaactcctgagctcagacaatctgcctgcctcagcctcccaaagtgctagggttacaggcgtgacccaccactccaggcccacagcttgacttttaaccaccacctgaacttccagccccttactctactgagacatcctccacgctaaaatgaagttggctccttactttatgcccttcctttgctcatagctcatgggaagctggtttctccctgcttgccaccacctgccccaagtagttccatcgccagttctttcccttctgtcaccacactcttccccctttccctagcacagccccactagaggccaccactgccagctcagtacgtacttctgaagtccttgtcatctcttcccataggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgtaagctgtctccattgggcctcctggccaggggtctgggggactctggacgggagctctgggagtgccttttggccaggagcgaccaaatcctcctctattctcctctgggatttgtgtcgccatctaggtgcctcccttcacagccaagcttggctacacttactgtgtgtgtgcaaactaacacgctcataaactagtacccaaagcagaataaataggccctaccccaaaaattcatgaaatgaaaaagtgatttaacgggcatgtccaagagcccctctactaaagggaaatcaatggatttgcactgcagaatcaaattcagtgtaggtgacttctgacaggtgcacttggaaatctggattatcattagaggctggggttacacggtgactaaaaccagttcctactatagtgaaccttttccacccaaagtgaacacactgacccatcaaagtgagtagcttgtgacacaacatatgccagagcctgcagagtagcttgacttcttgaagcgttttcccatttctgcttagtctgtcccatcaacaccactctgctctcttctcccagttcccaggctgtccacatttccagataactccttgaccgggaaactcaaccaaagggggtacttttgcgtgtctctaggccaaaggacaggagtggtgataggtagaaggtaggaactggcatgtaggcagtgagatggtgtaaaggtcacagaggtcgggttggcttggttccgtttttgaaagtttatctctgtggatcacaggtttggatcagagcttctttagctcaaaacaccaaaaagttaggaaaatatcctttgtaggtcagattcttctgggcccaagccagtagggagaaaaaccagcggagtttttcactggtatgagggactgactagcttcacactcagccatctccacaggagcacatggaagctgcagctgtagcagattcccttcttcccctctgtgggagggagagcttctgaccgacttctttcttccagaagagtttgttagctgtgctgtggtttttgtttgattttacttctattatctttcaaagcttttgaggggaaggatcataagattaaaccaaagagaactgtgtcctgctgctgctgctgaccagagggaaatccgtatttcaagactagataggctgggcacagtgggtcactcctgtaattccagcaccttgggaggctgagacaggaggatcgctcgagcccaggagttcaagaccagcctgggcaacatagtgagactcccatctctacaaaaaaaaaattatctaggtgtggtggtatgcacctgtagtctcagataccgtggtggttgaggcaggagaatcacttgagccctggaggtcaaggctaccgtgatctgtgatcgtgccactgcactgcagcctgggagacaaaccctgtctcaaaaaacacactagacagaagacaagttgtgttgttctttcccttgatactcctttatatccatttaaatccctgaaatttaatggaaatcaagcagttaagtgaagcttttttcacccatatgtagtgtttcccctcttatttccagaagttggatctgtgcaacccactgggattgcgtgcttacacacagatgttacttgtagccttaaaccgaggtggtttagggttttaggatcacagtgccctctctaagaggaaaggtaaaagatctttggcaaattgcagagtctctaaacacacactactgctgcttgcctggtcattcataattaattagaagaaaaaaaaactttctatccccatcttctgcttccccctcctggtgggcagaatggttgagtaagataatcctcttaactgggacctctggagggtggaggcttgcctcattcatcttcacatcctcaggccttcacccttagaggtcccaaaaaagtttcccagaagaccgaacgagtagggatatttggggaaccttgccaattattggagggtgttttgttctgttacctttcggttgtctggaggtttgagaaacccaacatggcttgttctttccatcttatcttaaggatggcagcactgcgctctcaatcgccctggaagcaggacacaaggacatcgctgttcttctgtatgcccatgtcaactttgcaaaagcccagtctccggtcagtgttgtgcatttggcatttgtaaataggctgaaatccaccagactggtggacccccttcctccaggaattgacgggagacagattttatgttgattcagaaaatggaagttttagtctggagcttaagagttcatcctttccgcctccaccccgcaaaaagcaggagaactaatgttttagcagaggctggaccttgcttgtccttgcaagacatatgctcacagcttcccatagaggttttgattctgtgcagaattatccagatagcagcccctgagcccatggggatatttcgccatggttctggcattgttcctgaagcagatggcaggcagcctgtagtccacagttcactctgagtgggaaggtgacttcccaggacagccggacatagcactgctgagcccagctggccttggagctgtggacacctgttccctgttctcagccagagctctcctggctcgggctcacagctgcttgttgcctgtggtgggccaagatcctatgtcacagggtacacatctgcctgaggtcacttattaacccccagtttttttcctttcctggtctctagggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctctttt

SEQ ID NO: 258 - DNA, 137630 bp, Homo sapiens
  source 1..137630: mol_type = genomic DNA
attctcccgcctcagtctcctgagtagccgggactacaggcacccgctacaacgcccggctaattttttttgtatttccccttccttctttgctttcaaaatccaggcttaggggtacaaaaacctatattgtctgagacaggaagcactccgaagtttgaagaagagggcagcagcccaactcagaagaactggactccccagcactataaggagagagggtggtggttccaccagaggtgaggacttgctttctgctctctacagcaccccaaagagggatgcctagagaatccatactgagtaccacagccctgtcccaggggcttaatgggacagagagagagtgtgtgcctggtacagaggtaagtttatttttgatggacctggtatatcacaggaactgccactatggccttaacccaccctgtggattgagcaagtaggagtttgtgtatgatctaccgggaggagcaggggataaaggcccagaaaattaagtggcattttatgacctcccagtgctggttggggcaggctgtggaaaaaacaagccataattaatttgatttagaaaaattaagaagtttgttcttgtgcactcaagggttatggaacagctcaagccattctcaaaaaaccattgtccagtgttgcttgacccagttaaaatcaccaggtgtgtctaaaagtttctgactagtttcaatccaatgatatacggatttcttttctgtggtgcacaggttacattatgaacctggactaaaagggaatgagttgacccattatagagtattaacagaatgttaattctgtggcacttactcagacatcctcctggaagaaaagaactttttgaacgtagacttctcaatccacatgtcttaaaaacttgggctaggtgtgaaggagatcagctataattaagaaaaaatctgaattgtattgtgatgtacaagatagaatatttgttatttaaaatttgcatcaaagaaacataattcatttggtctaaagtatttccaagtcaagattcatctaagtctgctttatttgtagaaactacgccttattggttaagatccctaacttatacttaaaaagtaataccacaaaaacgtaaaatacagacaattatcctaagtaaattgatcctaagtaaactgctgatcttgaatattaatttaacaaaatgagaaacttgtacaaatgtaaatcataactcaacaaggttgagctgctgaaaaagggggagatgcaaatgagcagatcttccacagatgagagcaatagttactattttcatatgccaaggttttacctacaacataatagtaagagacaataactattgggctgggtgtggtggctcacgcctgtaatcccagcactttgggaggccgaggtgagctgatcacctgaggttgggagttcgagaccagcctgaccaacatggagaaacccgtctctactaaaagtacaaaaaattagctggctgtgatggtgcatgcctgtaatcccagctactcgggaggctgaggcaggagaatcacttgaacctgggagggggaggttgcggtgagccgagatcatgccattgcactccagcctgggcaacaagaatgaaactgtctcaaaaaaaaaaaatttatgaaatatgttccttattttgttctgtgtttcctatataagcatcaagtcaaagtagattacaaagcaccttacaatgcctactgaccacatgccacatggctaaatgactctacacctctatgaagtttccccagccttttttttttttttttgagatggagtcttgctctgttacccactggagtgcagtggcacaatctcggctcactgcaacctccgcctcctgggttcaagcaattctcctgcctcagccttccgagtaggtaggactacaggtgtgcgccaccatgcccagctaatttttgtatttttagtagagacggagtttcactacgttggttggccaggatggtctccatctcttgacctcgtgatccacctgcctcggcctcccaaagtgctgggattacaggcgtgagccaccgcgcccggcctccccaggttttctatcctcaatgatctctgatttttcagaacccttatcttatatagaactaaaaatatattcatatcgttatttatttatttatttatttttattatactttaagttctagggtacatgtgcacaacgtgcaggtttgttacatatgtatacatgtgccatgttggtgtgctgcacccattaactcatcatttacattaggtatatctcctaatgctatccctcccccctcccaccaccccacgacaggccccagtgtgtgatgttccccatcctgtgtccaagtgttctcattgttcaatttcccacctatgagtgagaacatgcagtgtttggttttctgtccttgagatagtttgctcagaatgatggtttccagcttcatccttgtccctacaaaggacatgaactcatcatttttatggctgcatagtattccattgtgtatatgtgccacattttcttaatctagtctatcattcacatcattatttgttttatgagtatatgacttgtttaattaaatggactctggactctatccagagtctgtaggaatttttcacttcacaaagaaataaagaaaataagacagaatattaaggttttaaaaaaggtttaattaattcaacctttgatttttttcctgagtgtatgtctttttttaatgttaaaatgacctttataaaatgataatttgagaaatacagaacaatctctctctttctccccatctcccaatgaagagactgaattcagagaggtgaagtaatgttgccaagggtaagctcaaactcaagtgcatcagtcagccatatgcaatagggtggctttgatttcaaggtggtagtcatggttctagatatcacaaggagacatgccagtgtttaacaacataagaagagatgctctctttctgtgttcaccttttgtaaaagtgaggaaatctttcccagaggacatccagtggacttctccctcatctcactggttaaaatgtgtcacatgttgagaaccagcccaatcactgtggcaaaatgaatggggcatccacctcccaattggcgaggaggtaccactgagttgggtgatagttactttctttgagggatagctaatggaacaaaagtgggttctgcaagcacaaaagaatggaggatttggttgtcaataaacagtcactgaggtcagctactccgggataattctaggggtctttgtactggacaaaatattggttgaatgaataaatagaagtatatatgtaggcgaaagatattaagaatataaattcaggccaggcgcggtggctcacgcctgtaatcccagcactttgggaggctgaggcgggcggatcatgaggtcaggagatcaagaccatcctggctaacatggtgaaaccccgtctccactaaaaatacaaaaaattaggcgggcatggtggcaggcgcctgtagtcccagctactcgggaggctgaggcaggagaatggcgtgaacccgggaggcggagcttgcagtgagctgagatcgcaccactgcactccagcctgggcgacagagcaagagactccacctcaaaaaaaaaaaaaaaaaaaaaaaagaatgtaaattcaggcattcaaagaaagaaaattaattccttacgtctttctttagaaccactaaataccttgataatttatggtaatgtccactcaaatgtactgtataaaaatttcttcctcattcatacttacagtgctataaaggcaagcgaactctaaagtcacactataaatatgtttttatcacgatattgattatttcaactctatctctaaagagttgtggaaatttaatagaaaagaaaaataaagctctaggagatgcatagaaaagccaaacaattgcacagatttttaaccagcatttttccccaaaatatgtgagagcagtataaatacatgaaaaaaatgttcagtttcatcagtaatcacagaaatgcaaattaccctgagaaacattttcatccatcaaactggcaattttttttcttatgtttagtattaaagttgatgagcatgtaaagaaataggcacgctcatatactgatggtgagaatgcacttcctgtggtctttctggttttcattttaacattgcatgacaaaggattgcttactttctgtctgctttcctacgcctcaggatcatttagtacagggactgtatttgtcccacttgagtattcctagtgccaagaccactgataattcaataaatgtataattaagttttacatatttattgaatggtcactaaatattaatgaaattgataagcaaatgattaaaaaagaaaacatagtctttaacccagcattaaggtttctaggaatataaataaaaaatatgagttatatgccaaaaattatctataaagatgttatcctatggtaagttgtaatatcaactaggaaaaaaaatgtcagtggaggaaataatgtttaggaataaaggattagctttctaaatgttagcatatttgggccaggcgcagcggctcacacctgcaatcccagcacttcaggaggccgaggggggcagattccatgagctcaggagtttgagaccagcctggccaacatggcaaaaccacatctctactaaaaatacaaaaattagctggatgtggtggctcacgcctgtagtcctagctagtcaggagtctgagtgggaggatcacttagggaggtcgaggctacagtgagctgtgatcgggccactgctcttaagcctggatgacagagtgagaccctgtctcaaaaaaaatttcaaaattatcccttttgctaaatacatggatatgtgtaaatgtttggaaaaaatgctgaaagaatatataacaaaatatgaacaatcattatttcactataatgagaaggtagctgatttttaagatgtttttctattcttaacgtgttgttttggggataagaaagagaataaattttcttttaagtgagtgatttggaaaaaaattcttttcatttgattactcctaatcaaatgtcattatttattttggtaaataatgatggcttgagcaagatatacactttatcaaacaaagtaagcacagagaaccaattagtcatattttttatgagagaccatgggatgtttttcctctgtgacttctgcagaaaagatatacgttttgaaataatattttaaagattattaaaaagagtcacatttctgtgtaaattgtggaaccacatctcttagagctgaccttcaaaatataatctattgtatctaaagttaatctttaaccttgtatagcccataagcaagaagaggaacttaatgtgtttcaaagctgcttgcctgcttctctctccttgccagtgctatttaaagatcagtgtaagtgcacttatcaataggatttatgagtcatatcaataattacaaactacagcaataattttcccaaagagatgcagcattcttttttttttttttgagatagagtctccctctgtcacctaggctagagtgtggtggcacgatctcggctcactgcaacctctgcctcctgggttcaagcgattctcctgccttggcctccccaagtagctgggactacaggcttgcactaccacgcccagctaatttttaaaaaatatttttagcagagacaagctttcaccatgttggccaggctgttctcaaactcttgacctcagttgatccgcccgcctcagcctcccaaagtgctgggattacaggcatgagccactgcacctgtccacagcattcttttaaaactctaagaaaaatggcatttgtcatgtgacaatgaaatcaggagtcgtttagaagcagtggggtcttttcttgttttctttggtcaatccatatcactgcaggtaagaaataaatcaagtgatttagtaagcataaaatgtgacattgttaacatgcttactatgttaacatttgatgcacatgatccaacttctctaacatgttttataaggccatgtgctctccgtggtagatatttaaatttttctactcatatcaagcctatgcttccaccacctaccctttaacacatgacttcaacacttcagcatcattcgggaaacagaaggcagcaggcagaaaatgactctactttgcaccaccgaccctgcaaacttaccaacctcagcactcaccaatccactcttctttctagggttaatttctctacttgtgctctggatctcatcttcccctgccttcttggggactttactccattaatgagtcccctctcctttatcttcaggttcttacttcaaccacaggcgtttcaataccctctcgagaagcatataaatagcattaataaaatggcaactcccattcactaagcatttagttcgtaccaaacatggtaggtactgaagcctcttaaatatattatttttctcaacctctttttacggttgatgttgttttctacattatgcacatgagggaaatgaaactccaaaaggataagcaccaaccaagattatgcaacatgcgtgtggcaaagcagggattcaaaccaaactctgtctgagcataagattctatcttggctgggcgcagtggctcacacctgtagtcccagcactttgggaagccaaagcgggtggatcacctgaggtcaggagttcaagaccagcctggccaacatggtgaatcccgtctctactaaaaatacaaaaattagctgggcgtggtggcaggcgcctgtaatcccagctactcgggaggctgaggcaggagaatcacttgaacccaggaggcggaggttgcagtgagctgagatcgcgccattgcactccagcctgggtgacaagagcgaaagtcagcctcaaaacaagaaaaaaagattctgtcttaatcattgtgttattctgcccttgtttgtctccaaaaagctccctctttaacccaatcattatctctctgcctcatcatagacaaacttcctgaaagacttgtatacacttgctatctccactgtactttgcacatctcaacgcatggaagcttggcatacacccagtgacatcactgaaactgctcttggcaacatcaccaattaccttcttgtttctaacgtcaaagaatctgagtccctttaataacttgacttagagcagccactgactctgttgacagccctctccttgaaacattgacttccatggactttcatgaaataccactttgctagtttttctcctattttataaatctctggggttgaagtttgcttctttttcactgtctaccccttatgtgttgagatagatcagacctgccttagatctcctcttctgattacaagtactgtcctgggatttcatccactcatacaactttacttccatttgctgatcaagcccacaattctacctggagcccaggtctctatcctgactttcagacatgagaatcttctgcctaattgacatctgattttacgtttctcacaggcatgggggcagagcagtgaaatgttgagagcatcttatttagactcagattgctgggctcaattcttggcatgagcagctagaactatgcatctctgggctctgggcattcatctctttgaaccttcctttcctcaactgtaagatggggaaaataatcattattatttgataggggcattctaagcattaaatgaaagaatacttggaaagtacttggcagaatgtcttgcacatagaaagttctctgttaaatgcagcctattattaatattgtaactctgcaactttatggaacggagagttaacgtatgtaatggaacacactatgtacacaagattactctttgtcttcctcttgcacttctttatctcttattttcattgcttttggaaaaaatgtatacatttacacacacacacacacacacacacacacacagacacctgagagaaacaaaagagtttataatgggatcaagagtaatcctttccatccaactttacagtctttctttttcactgatgacaatggaatcaggtgcctcccccatgtcttcaagattatccagcctttctatcatttcccttttttgtagtggccaccttccagaacctttactgtcctgctccaaggataagctctgcccagcaggtgggagtggggagaagaatccactttgacattttgggagatgtccatgacctttcagaactcttcttgaaaagcttttaaattctagaatttatgttttctaatcattattttctttgactgtgtattcatattttaagaaggcaccttctcgatctcaccaaagcagtatttataaattttttagaagttctcttttgttccctaattacttatctttcttcaaggcagttattcttcttgcttatctccccatgatcgagaatacttcccactctcagagctgtttgttttcttttttcttcccttttttttttttttttgagaccgagtcttgctctgttgcccaggctggagtgcagtggcgcgatctcggctcactgcaagctccgcctcccaggttcacgccattctcctgcctcagcctcccaaatagctgggactacaggcacccgccaccacacctggctaattttttgtatttttagtagagacatggtttcaccgtgttagccaggagggtcttgatctcctgaccttgtgatccgcctgccttggcctctcaaagtgctgggatgacaggcgtaagccaccatgcccggccttttttttttttttttttttttgagacagaatttcgctcttgttgcccaggctggagtgcaatggcgtgatctcagctcactgcagcctccatctcccgggttcaagcgattctcctgcctcagcctcccgagtagttgggaatacaggcatgcaccaccacgcccagctaattttgtatttttagtagagacaggatttctccatgttggtcaggctggtctcgaactctcgacctcaagtgatccacctgccttggctttccaaagtgctgggattataggtgtgagccactgcacccaacccagagctgttttacttgcttttccctgtgctgttgtgaaatagaacttgtgcagtttctaaataaatataatgaaacaaagaattcatttaattaaatttaatttagttaaaattgcatcaagcaattgttttgcgtgaaaaactctgattaagtagaagaggtccaaagacagtgagaagccagtgaggatacatttaaaaattgaaggctgtgctgccattaggtgagtggaacacttgagagtattgtaccatagttttgcagagaggaaaacaaggaccaagatctactaggacataccaaaaaggccaacctctagcaacaggaaaaaagaagagaaaacatggaaaagaaaagaacttttccaggctatatagtggaaaccacctatgccctttacctctttatttgtatcagccatggcaccttccttgtagctacaagagctattaacagcagtatcaaagaaagcaaagtgttaaatatcagagaagtttctgttgcaccacattttataacatagaagacactttataaattgcaaacgcctcagtattttatgtgtcaccaagaaagcaaaaaatgctgctactcaaactataatatgccattgatcataatttacactcagatttcagtgatgttaaaatgtgagacatatgtctttagaaccaatgagaaccagtggaatttagtatctgctctgtttgtcttgattgtggagaaatcaccaataatatgtagaaaaaagggctttaatttttaaaagagtgttgagaagtcttggtggaaagcacctagatgttggcacctgtcaaacaggctgccttcctagttacattagttacaaggtgtatgacatccactaaataagctccttgaaggagttttctttttttttaatttctaaaatgaagacagtgttgcttagtatgttgttatatgatggaggtggctaatgggttatgggaataatcagcctggctaatttttgtatttttagtagagatggggtttcaccatggtggtcaggctggtctcgaactcctgaccttgtgatccacccgcctcggcctcccaaagtgctgagattacaggcttgagccatcgcgcctggccctggtgatcagtcttatttggaaaccactggtgagcagggttttaacctccaaaatcataaaacagtgattaccttctttaaaacaaatgaatactatttttagggctgccgatattttatgtttgaatcctggatgatttgggagagaggactcaaaggattctttattaatggcattgatctagataaagactacatttaccagtctcctttgcagtgaggtgtggccatgtgcctaagttctgaccaaatggatgagagtggaaatgaagtgtgcaaactgcagtcttgcctttgaagcactggtttctggtggcttctgttccgtgggcttctttggcagcctggagaggccagagaaggatccttccttccttcattccttcctttcttccttccttccttcctttactccctccctccctccctcccttccttcctctctctctctctctttctttttctttgacaggatctcgctctgtcactcaggttggagtgcagtggcacgatcacgacacactgcaaccttgacctccccaggctcaagtgatcctcccgcctcagactcccaaagtgctgggattacaggcatgagccactgtgcttggctgattctttcttaaaaataacattttataggcataaaataaaatcatgtacttagaattaaaaatgacgccaactatatgatatattgttatcaaaatattaaaacaataaattaatgatatagtggtatcaatatttaccagcccattcaacaacaagatttagcagcaggtcaatggcagaattgtggggcactttggtttctctagcttctaaaattgaatgagtcttttccccatgttttctagaccctggaaagttctaactttgtccccatccaccccaatgtcctgatcctcccagttatttataaggaaaatatattatataatattacatagtagatatggcttttctatgattttggaaggtaaacgacaggttcaggaaatttgtttgtttgtttgtttgtttgagacagagtctcgctctgttgcccaggctggagtgcagtgccatgatctcggctcactgcaacctctgcctcctgggttcaagtgattctcctgcctcggcctcctgagtagctaggactagaggcatgtgccactacacccggctaattttttgtatttttagtacagacggggtttcaccatgttggccaggctggtctcgaactcctgacctcaggcaatccaaagtgatgggattacggacgtgagccactgcacctggccaggaatgtttttaaataaaggcagaccccttggagtattctgatctggctaaacacgatattttctttattatagttccaagtacttagtttgttcgtttatctgtccatgtattcatccacccatccaacagacattttttgagcatctgctatacaccagagactgtgccggtttagctaataaaggttaacaactcacagacttgccagatgttgagtagcagccatgaactgtagtgatagacacgtggcatctcagctttaaatctgattcacatgtgcttgccaactggaacaagataggaattataggaactaggatgacaacaagaactgtaaagggagactgagaacctggttagtcttttttttttttttttttgagacagggtctcattctgtcacctaggctggagtgcagcggcgcgatctcggctcactgcaacctctgcctcccggggtcaagtgattctcctacctcagcctcccaagtagctgggactacaggcacctgccaccaggcccagctaatttttgtaattttagtagagacggggtttcatcatgttggccaggctggtcttgagcgcctgacctcaggtgatccacctgactcagtctccgaaagtgttgggattacatgcgtgagccaccacacccggcagaacctggttagttttttctccctattcagatttgtcctttgactgcctgaccttttctgagagtatctggtgccatccttgagcaaattactagccgcgatagatcagctcagagagagaagacacagccattcctaggttacttcccagattaaaatattctccatgaccctcttgctccaaacttaccatctatctggctcaaaattattgggaagcctgttgcatcctagatttgtaattacttatgtcagagttggcatgatcttgttcacacagcatgacacttgctatatgtaatggactactaaacggagtagagtagaaattatattctgtttttaaaaataagtatttgaactaggttgaatcaaaaccagttttaaaaaaattaaatgggttgatgggaaaatagatctcttctgacatgaagaaacaaataaacaaaccaaaacagaaccaaaaggatctgaaagaaaatccttcctgggctgggcgcggtggctcacacctgtaatcccagcactttggaaggcggaggtgggcggatcatgaggtcaagcgattgagacaatcctggccaacatggtgaaaccctgtctctactaaaaagacaaaaattagttaggtgtggtggtgtgcgtctgtagtcccagctactcaggaggctgaggcaggagaatcgcttgaacccaggaggtggaggttgcagtgagccaagatcactccactgcactccagcctgggcgacagagagagactctgtctcaaaaaaaaaaaaaaaagaaagaaaatcagaaaatcttttctgggagaatcaacagtatgtctgtgggtttagttggtctttcctttcaagctagttcttggatattctctgatgttatctgtcttgtcgtgaggatcaaatgaaataatgcatgagactgggcactggctctactcttctatgcaaaaataaggtgttgtcactatgaactgatgacctaggaagttgtttcctccaaaagagattagattgttttccacattcagtttttatgtatctgtttatcttttacttttggccagtttgttctttttcttatctgttggaggctgtaaaccatttattagagaggactttgaagtctaccttaatcacctattttgcttagtggtttcatttgaaccagacttccaggttttcctgtttactggattttgttgttagttatccacgtcctcacagagaaagggcttatgataaatggcaaattatttcatatcaggatgagattaatacaagtggcaaaaaagtaaacattaaattagggttgtgttgctgcttccagacctattactatcatatttataaagctacctccatatcttagtgaaagtggcaagtgtgtttattcgttattctgtgttctcttctatactcacctcatatttcaagtaagtgattcaaataatggagtgatagagtgtggtggggtgggagtgtgttgggcagctttcttatcattcttctgaaaaattttctttacattggcaatatctttgctagttataatagtaataatgataatgattttaaaataactactatcatttttgagcacttgccacatgctaggcattttatagccattacctttgcaataataatggaagatagatactattattcacttcccaatgttgatatatatatgtaacatatatataatatcatgtaataaacatataatgtctgtgtaactagagtgaattatttgtattaagattttgacagctccttcagggagttctttgccagtcttcaagccagcacgaaaccatcacagtagtcctgtgagacaggctggcagccagcatctttatataagcagggcttgagcctgattcacttttctgactagcacctagcttatttttagaatgcaatacgtggtaataaaaataaaatagtgaatagcaatacaatcaaaaatatacaaatacacttctcagattgggtggagtctcactggagttttttttttagggtgtctgaagttatgtccttgcctggcaatgagagatggaataaaattactccaattttttctttcttttctttttttttttgacagagtttcgctgttttgcccaggctgaagtgaagtggcctgatctgggctcactgcaacctctgccccctgggttcaagtgattctcctgcctcagcctcctgaatagctgagattacaggcatgcgccaccacatcccgctaatttttgtatttttagtacagatggggttttgccatgttgactaggctggtcttgaaatcctgacctcaggttatccacctgccttggcctcccaaagtgctaggattacaggcgtgagccactgtgcccagtctctttcttttgattaaaaaaaatattcaaactttcaacagaatagaccagcagcctctctccatgagtaaaccagagaatgagccaggcacggctgcgttctccacgggctgtgcttcactcctcttggcatgttggccatggcatcctgagtttgctcgcctcactccacctccagacccgtggacatcctccaactgtttctacagtccaagttaggactcaatgggtgttgaatcacacataggataaggctggggagtcattcaagaaaaattacttgttgggacccacacagggttcatagtatctattgcagagtactttcacatcccatattctggccttcaatcttatagttccacagatgcagtattgccagggtcccaggatttcccaggtaaagggagaccgatgatgttcactttgctcacaacagattccatggaaagcccaaactgctagggtatttagctgaccacgagaaatgtaactgccccaatgactctctattagtgccatctatatgagaagctaaacattaaccagagggttgcttggtaagcatgaaggaagggcaggggagttaacagaatgagttgtgtatttaaagtcccaggttaggtcagacccgggccaggacactcaatcttgccaacaagatgagataagaccaacctttgagccagagaatttcatcccctggaagtttcccatcctggagatgacttgtgcttgccagacgttgttggatgggcattggaaatatttcccctggcctctgtcacctgcccccagcacaatgcactgagcagtcactgagagaaagttagacaataaacactcatagcctggagacacagaatcccttattctaaccctgcattcacattaggaggtcatcacctttctgaaataagatgccatgtggttttcctttattcatcatgaaggaatacaggtgaaagtaagccaaaaataaaaactaaaaagtgggcctctgttccaaatatctttcaatatcatttagtggcttatttatgtagttaagagctgttttacaaaacagatactaccaggaggtgtaagcccacctaatactcataacttagtgcatgtaaatgaagaagtttttggtgagatctaatgcttggcttacaaaaaagtgaccattaagaacattacataagaagcagctgagtcctactgagtctcaacatcttgctgaagtccacaccactggttagtggaagaggcaaagtctattcttgttctccttaacacttttataatgtattagtggccaaactccacttccacatgtatgtctgaggttgaaaaccactggtgtattgaaatagacatatgtgagcagatgcttagtgtgttgttatatgattgaggtggctaaagagttacaggaataacaaggcaggcaaccaatccagtctaaggcttggaaagggtccatgaagactttagagtgaaattgattcttgtgtgagctgagttgtgaagggtaagtttagagtttaattaggtaaaggatatggggaaaataatccaggcagataagagtccctggacaaacactcaggggtttccaattttttcatctgctatcttcacctcctatccttattcacaattttgccttaacccataacctccttccattggatgtacaccctgggatgtatacccatggaagaggatgcactagcagctgccatgtgtcaggcatttgagaaataagggagcaatagtcatcacaaggacagtgcaattggttggctgtggttaagttccactgatgccctaggaaaaggtagcaaagagctgagattgattaatcagccattaaataaattctaagtgggaaggccagagggcctccctggaaacacaccaagagactctcatctcttaatttggaaggggaaaggggttcaaataggaagatccaggccagaatttaattgtaagagtagctgaagtaggtctgctatgccaaaagcattgggaaaaatgggcacggacacagggaagggcacatctgtgttgacgcccctccctgccaagaatcttgagtctccagattgcccttgcattagaccattcttttgtagctatagagaaataccaaaggcagcgaactgaatgagcaagaacttatcaccaagggaatggtgctgagccatttatgagcatccacccccacgatccagtcacctcccaccaggccccatctccaacactgggaattacatttcaacatgagatttggaagggacaattacccaaattatatcagccctgaaccctctgagcctgcacaaatggcccacttctctttatggagggctagaaacacaccacgtgcacagacacacacacacacaaacacacacacatcaattccaaggcctctctacaagacatcatgtactctcttcagggtgtcacccatcttccctcctcactgctaggtcaataactagggttaagtcataaagtaactgtgtcaagaaaatgctcgactgctatgggaggaaaagaactatacccctttatattagtctgttttcatgctgctgataaagacatacccaagcctggaaagaaaaagatgtttaatggaattacgtttccacatggctgagaaggcttcacaatcatgacggaaggcaagaaggagcaagtcatatcttacatggatggtggcaggcaaagagacagagtttctgcacgggaactgctccttttaaaaccatcagatcttatgagactcattcactatcatgagaacagtgcaggaaatacctgcccctataatttaatcacctcccactgggttcctcctgtgacacatgggaattgtgcaagttacaattcaaaatgagatttgggtgggaacaaagccaaaccatgtctcacccttctaggtccaatttcaggattaactaactgggagaatatgcctgagagtggattctgagggtgcccaaccacggtggggtgcccaaccatggtgagtacaagaaagtttgaatacaaaagaatttaccaatatgagaacactctcccatgtcacaggatataataataccctggcagggacctgagggagggtgagtgcacactgtaggatggctcctaggaccatggaaaaaacaatgcctcataccagtgacaaaattgctgtgacagacagtagtacacagtgaagagagggaagacttgtttggcatgtcttctgtcctgcccaatttgatggtaaatgacaagtgcagatatcttagcctattttttaaatcatgtcatcactctgaagatttccaaatcagtcaagaggatgctgttggtgtcaagacctgtacccccaaaaatgccccataaagcactgctatggttgtccagaaacactgagagactcccagactattgaggttttactggaccctaagtagttatagtttctggagttccctcacctcccactactccaacactaatcagaacaatatccctgtacccgactaagttgtaagatttgtgactctggcttatgagacccccttatgctgggcagtttggatatttgcacttgactatgagatgggttccattaccgccaaggacaaagtgaaaccagggaagaaaaagaggcagttgggtatcccctgtgtaataatcaatttcaggtgaactattattcttctctggtaacaagaaataattttagttggccaggtgcagtggctcacacctataattccagcactttgggaggccgaggtgggtggatcacgaggtcaggagatcaagaccatcccggccaacatcgtgaaactctgtctctactaaaatacaaaaaaattagccagccatggtagtgcatgcctgtagtcccagctacttgggaggctgaggcaggggaatcgcttgaatccaggaggcggaggttgtagtgaaccgagatagcgccactgcactccagccaggtgacaaagcaagactctgtctaaaaaaaaaaaaaaaaaaaaaaataataataataataataataattttagcttaggaagcagtctctgagctttatttttcagtacttaatctatattatctattgatttgcaggttctagcaggtcagctattttattacatgaattcttttccattttaaaaatcagcaatgtgaatggttttgacactacttggacttccttgatctatgtgaactttgttctttgggaatgtcgagctggcaaggctcgattttagatcagcagagtgaccttagcccacatagcaattattccctgatcatttgttgcaaaatgccacagccttccatcattctgatttctcctgggcagagtagatgttcactctggttacaatgtaaggagaattgggaaagccctcttatttcttctcacataaactggcttcttagaaatattctcccaaacaatgctagaaattccactgtcatagaatactgctgtgaccctatgaatggggtcctctgtatgatgcagtgctgctttagtgcaaggttcaagatgtgagctgggagaacccactgtgcggactgaaacctatccccagtcctattatattggaatttgagctatcacaggagtgtgctatcatcaggttccaaggtttagcaatctgatcatctgggttacacattgaactctccctgtgtttctcatgtagtgtgtaagaacctatcagattctctacttcttgtgtaaagagtgaaaatcattggtgggacaaacatcgggaggatcatgaataagtgaattagtggagggagtagggaaagggaaggggcttggcaaatagggatgaacgccagttttgggctgaagtagtttcatcaaataaaagaccaaatagtgccatgaaatgggccttgaactacttgtcaaaggcccaagaaccttagagagctagtgtcatcttaaacatgacatttaatgtttatcacaattccttcatctgtaaaatgcaaggtactatgcctgctctaactagctccctgactgagggtgaaacctaaatttgtatttctgaaaactctccataaaacctactgtgctccaggaaggcctcccccgccaactttttttttttttcttagacagagttttgcacttgtcacccaggctggagtgcagtggtgtgatctcggctcactgcaacctctgcctcctgggttcaagagattctcctgccccagccacatgagtagctgggattacaggcgcccaccaccatgcccagctatttttttttatttttagtagagattggggtttcaccatgttggtcaggctggcctggaactcctgacctcaggtgatccacctgcctcagcctcccaaagtgctgggattacaggcgtgagccactgcacctggccggcacttgttttttatggtgttgtaagcctgcacagattctgcctcaaaatttattgggaaagaagttgggtaaaaaagagtacatagaattgaattaatacttgtgagccatatgaagaagtagaagagcttccacttgacaattttgcctggtggcagtcctggaactgttagtacagagctgactccagtcaaccaagctcctttgggcaaatcatggtactgggaaaagaagtggttggacatattggtcaatgatatgcaattaactcttcagtttcttcttggttacttccctgttgtgcaatattcctgtggaaccacaaggttctatagatcagggaagacaatgttagccaaatatagcctactccactcatttttttctctacatcaatatccacagttagctatttattggcgagatcaattcatttttacattcttacaaataagtacttttttttttaaccaaagatgaattaaagtatgattctgaacatcatggcctacgtacgtgtgtgtgtgtgtgtgtgtgtgcgttttcaatttcagtcaacgaaagtaatcacatgatcaaataataaaaaatagcaataatattttgagcacattttatattctagctactatgccaagaattatatgtgtactattttacttaattctaacagtgaaataaagtagccatttgtattctcatgctgagaaagtgggatttaagatgatgccacatgacaagatcacatagtcataagtagcagatccaggacccaaattcagctttgtctgattccaaatcccaggctcttattcgctttcctctcctatcttcacctaacggcatctattacgaggaaggtgtgctgcttactggagatagaagtatgaacaaagtagtatttctgtcctcgatcaagctcttgtgactttaagaatagttggcctggcgcggtgactcacgcctgtaatccagcactttgggaggccgaggtgggcagatcaggaggtcaggagatcaagatcatcctgggtagctgggattataggcaccccccactatgcctagctaattttcgtgtcttcagtggagacggggttttaccatgttggccgggctgctcttgaactcctgacgtcaggtgattgaccctccttggcctcccaaagtgctgggattacaggcatgagccaccacgcggggcctgcttgattctatgaccatagtttgacatttatttctctaacttcgggtattacaaatggcacctacattgatttagttctatctgtaaatctgtattgcaattaacttttttctttaaatcccatttttcagacttaaactcaattatttaagtagaaaactttacataaagccataaataagaaactagctataccaaatctataaaaggccagcaactcttactataaatagaagaaaaccatgaacataaatgtattatgaacaaaataatgttattgaattctagctagatactgtggcctatagaaagttctaactctgaggtctcttgtctcttttaaaaagataaattaacaaggctacagaaatgttaaatattttttataccaaactgagcctgtgtcctagatttaagaaggattaaaaattcaaatgcaaacaatgttctcattatgtgattatgtgaaattcaatattgcttaatgcagtgcctgggagatcagtcctgaagtacctgtcatctcacactttatcagttgttcatatagaatattttctagtatacactgtactattcttctaaattgccttaaaaaatagtagaatgatgaatctgatggggaaaaagagtcttagggcaatcaccaccattttcaaatcctggaagattgacatgtgagagaatactggtttattcttgtttgccccagaaagtgctacctagcacaaacagtgacattttcaaatgcaacttttggctcattaaaatatacatatgaggctgggcacggtggcttatgcctgtaatcccaggactttggtaggccgaggtgggcggatcacgaggtcaggagattgacaccatcctggctaacacagtgaaaccccatctctagtaaaaatacaaaaaattagccgggcatggtggcaggtgcctgtagtcccagctacccgggaggctgaggcaggagaatggcgtgaacccaggaggcggaacttgcagtgagtggagattgcgccattgcactccagccttggtccttggcagacagggtgagactccgtctcaaaaagaaaacaacaacaacaacaacaacaaaaacatacatatgaatattaaaactaacaaaggaaatgatcatcactcaaagaactaaactttctgcctctgaaaattaatagcagaccatcttccaagaataatacaaatgatttcattggggaattggagtgaaatttaagatcctttaaaatttaggatccttaaaaattaaaaaataaataaataaattaaaaaaaaaaaaaattaggatccttttctttttttctttttttttttttttttttttgagacggagtctcactctgtctgcccaggctggagtgcagtggtgccatctcagctcactgcaagctccacctcccgggttcacaccattctcctgcctcagcctcccgagtagctgggactacagtctcctgccaccacgcccggctaatttttttgtatttttagtagagatgggtttcactgtgttagccaggatggtctcgatctcctgaccttgtgatgtgcccgcctcagccttccaaagtgctgggattacaagcgtgagccaccgtgcctggccctaagatcctttttaactctacaattttctaagactctgtggtgcttctagaagctcaaagatcactgaacatttaagatcctataactgaggatcttaccccacactaaggttttcaatctcagcactattgacattttggactgaataactttgtggtgggaggctgtgctgctaaacatcttagatccctgtttttttcttattagatgccagtcataacccacccccccaccttcaactgttacaaccaaaattattttcagacattgccaagtgctccctggggagtgtaagaattaaataaagaggagagaaacacgaagggtggctctacagtcaacagagacaggtttattttaaacaagcctgagaaaggcttctggccgagttaggtcaacgccacactctcttacagactgagtttttaaggattcagggtgggagagtttatcagaggctgagactgcttctgtgtctctttgttgtgcttatatgggagggagagttgtgtatctgttcccatacatctgtctgcagctgcaggcatacccccgagtctgcttttggcttccctatcttagtgcacctgaaggagaaggaatgtgcttattaaggaccactgttttactggggcccattgtatgagggtgaagtttggcagttacccaagagacttcccaccacctccctctgtgcccaagctgttttatctgtgttttactgtctgctctttctggcggcttgtagttagaagagaagtgattgccttgaaacgcatgaggctagaaagggagctggaacttaaagtggtggtgtttgtccaagatgatggtgctcctgctctctcagggagcagaaccgctcttagttgaaaatcactgccccagaccaacttctctgtatgcatctactcttcttatgaggcaggaatcaatatttcttgcatacttctactgttgcacttaacacatctaacaatcatctattgagtgtctacagcatgccaggtactgcattaaacgctgtttccatagcagtaaaggagacagatctgctcctcacagagccccatgatgggtcgatggagtatgcaggagttgaagggggaagagacacctgcagacagtttatcacagccacatgtgtgcctgtcggtttctgccattatcttataagcttcttaaggataagagtcatgactttttaaaatctttcaatttctagggcttaacagaatacctggcatatacaaggcgctcaacaaatgttcatagactaaatgaatgagaaagtaagagattggggaaaggcgagaactggtaacagcacattaaacaacagtgacaacagcaacatcaatcatatttaattgactagggaaagagaataatttatgtaattaagtttttattgcatttatgaaacatctgtatcgttgtatctttccatgcatttcgtgttatattgtttttatggtcatagtccatcatcctaacacatctaagaatatctaaaaatatggacaaggcatgggctgctattcctctttcaagcactttaccttaaggttagcaagtaaaaatttgatgaacagaaatgatcaaagtagggctttttttatatgacttgttcgaaccaagcattttggtgtagttggtcaaatgcagctttactggattttgtaatcaattttaggatgacatgaggaatgggtaaaaattatacacattaatgataaaattgacattgttatattatatgttctgggccattaaaatatttctccattgaaatacatatatcaaaatgtcccatactgggaaatgaccgtaattagctaaaaggaagtacattccttatggcaccaaaatgttaaatgcctttcttctaagtcatggtgaccacacctctaacctgaatccatgtagtctgtagtctgagatctaagggaagagaagtctctaaataaaaatgggaagagtcattccaggccaagtgcagtagcttacacctgtaatcccagggctttgggaagttgaggcaggaggatcacttgaggacaagagttcgggaccagattgcatgcagtatagggagaccctcgcctctaataaaaaaaaatgctccattattcatttcatctttttacccttcctcctgtgattcttagtgtgagggcagggaatctcagttttatatcctacacaatgcatagcatcttactcataagaggcacaaaataaggttttgttttgagaggaaaatgaaagcatcttgcaataactatttaacttacatcatgtattctactatattttatcaatatttatgcgggttatatttctaattatatctgtgcctatcagttagttgtaggtaacttttaatcaaaagcctgtacctaccacaccctaataaaaacctgctgtttttgctgcccagcacccattcaccttcttctggacactatattccaagttctctagggaaccccgcgttccctaccctgagtgcctgtacttcctcacctacctgctccttaactaacagatggggcatgagacccagatcagagtgtcacatgtcaccttgccccggctataatgcttttgttattgttgttagggctgggcatatcagcctattgtggcaaataagatgatgagtttggtttttgtatttttctgaaacttttgggaaaggtcgcttcgctttttcttcacctgaatttgagagtataaagtctagagctgttgtcatcaccttgtgatcatgaggagggagacgtcagagaatggagtctgtgtggaagagagaaggagaagggaagagcgggaaaagaggaggaaagagggcagagagagaagttgggtgctgtagacagtgattgaacctacaacaaagctgcgctgccagaaagagtgtgaccatagatttttcattgttgttgttgttatgcaaaacaatatattcccattcccatttagactgcagagttttagctggtttttgattgattttgtaatcaatcttaggatgacatgaggaatgggtaaaaattatacatattaatgataaaattgatgttgtcatattatgtgttccgggccattaaaatatttctccattgaaataagtatagcaaaatgtcccatatctggaaatgactgtaattaactaaaaggaagtacatacctcacggcaccaaaatgttaaatgccattcttctaagtcatggtgaccacacctctgacctgaatccatgtagtctgtagtctgagatctaagggaagcaaagtctgtaaataaaagtgagaagagtcattccaggccaaacagtagcttacacctgtaatcccagggctttgggaagtcgaggcaggaggatcgcttgaggttttctgtcactttcagccttgtctgaacttacacatgctccaaatcccaatcacatgtttttcatttcatagcatattttggtaatatggacactatggcaattttaatgctccatgggggagaatgagtgattctgaactggagttttattatatataacttagcattaatttgtctaatattaatatttactgattccctattatatgccattccacaaagaattccaaaaacacaaaccacacttctaaaagcaataacaaaaattgcttctcagagatggtttcttccttcttattagggctggattcttctcacaactatagttagtgggttttgcattttatatggaagagtgttacataaatggtaaatttcatttatatataatattaaaaatcatccctttagaaatatacacaaaggaaggaagttttgacactcatttatagtttttcaaataagtttaattttacctatttaaataatattgtgagaattccttagaatttttttttccttaaaatcattgttatgacaatttaacttgagcttcagttggtttttactttctgtatgaaatttacacctatctaaagaggcactaattgtgtagcatctgtagggatgataatgtttggctttctgctagagtggagtccaatctcattatggtttccaggaacatggagtctaggaacatgcatgcaatgactctcagcacctcggctagcatgcattgttagctgaggtaagcgtcttttcactttagatccacggtcagctcaaaccagttaagctgcacattaataaccttgggaaaaaccaatccttctctgagatccccagaatgagagcctaataggattcatttcatgccctaggtctcagttatcaatgtggcacattagagatgtatagattcttctatctcaaagcagaaaagtggcaaagtagctcccaaaaatgtgtgaaatcatttcagtggcttcccgactctacttcaatattgatcaacttggagtcccaggatgcttaggaggattgttcaacaaattcaagctgtttcttgagtctctaacttttcacaaaggtttaacagaatttgtccaacttgagataggttgcatgggctaagtaaaatgttagacctgcatttgatttgaattatgtgaactcgacatgctagatagttcatgttcatcagaagttctgattggtagttattttggtctttgatgaatgagaagtggggaaatctttcatttaacagcttttattgagtttctgtcttgtactagttttcttgatacaatgtaaaacttaaggtatgtaagtagcaggaataaggaaatgaatccttgggaataaagaagtatggaaactggccgggtgcggtagctcatacctgtaatcctagcactttgggaggctgaggtgggcggatcatgaggtcaggagatcgagaccatcctgttagccaggtgtggtggtgggaacctgtagtcccagctactcgggaggctgaggcaggagaatggtgtgaactcgggaggcagagcttgcagtgagccgagatcgtgccactgaactccagcctgggcaacagagcaagactccatctcaaaaaaaaaaaagaagtacggaaccagtgatagcaggtgacctttcatcttgcagatgaagaaaccaaggcccaaagtagaatgactttgccaagatatcattggcttgtgactgagctggaataggaacctatagatattgattgtatgtattgcttatcccttgatagtaaaagtggaataccttttattttatttatttatttatttattgagacggagttttgctcttgttgcccaggctggagtgcaatggcgcgatcttggctcactgcaacctctgcctcctgggttcaagcgattctcctgcctcagccttcctgagtagctgggattacaggcatgtgccaccactcctgcataattttgtatgtttagtagagacagggtttctccatgttggtcaggctggtctcgaactcccgacctcagatgatccacctgcctcggcctcccaaagtgctggaattacaggcatgagccactgtacctggctagaatacctttataatccatgttggagcataaatgtacacaaaataacacaggtcaagaattttttttttttttttttgaggtggattttccctcttgttgcccaggctggagtgcaatggcgcgatctcggctcactgcaacctccgcctcccaggttcaagcgattctcctgcctcagcctcccgagtagctgggattacaggcatgcaccaccatgcccggctaattttgtatttttagtagagacagggtttctccatgttggccagcctggtctcgaactcctgacctcaggtgatacacctgcctaggcctcccaaagtgctgtgattacaggcatgagccaccacacccggcccaagaatatttgctttgagcttgctgtcatggtaggaagccggcatcagctaaattttactaacgtgctacctgatttgagggatcagcagtatgagtaggtgatggaaacagctgcctacatactacttaaaaccttccagccagaaaaatatctccctgcacctgtctggcataaaacctaagtcaagttgcaactcattcctctcgttctgttttccctttttctataaaattcaggtaaaatgtatgcatttctccaaacttaattgctattctaaaaagaagaggtagctttcctcttccctacttttctcatctacaaacttctaggctactatcttttgtcttttctatatttgaacttttctaaacaaaccacaagggtgctaatggtgataatatatctggatagtgagatacggtatttttaaatgttcaaatcttataaaataaacatatgccgatttttcaagagtaatataggagctatttaaaaataatagacttctggccagacgcagtggctcatgtctgtaatcccagcactttgggaggctgaggagaatggatcacttgaggccagaagttcgagaccagcctggttaccatggtgaaaccccatctctactaaaaacacaaacattacccgggtatggtagcaggtgcctgcagtctcagctactgggaaggctgaggcagaagaatcccttgagcctgggaggcagaggttgcagtgtgctgagatggtgtcaatgcactccagcctgggcaacagagtgagactctacctcaaaatactaataatattaacaatagacttctttaaaacaagtaatatcaaatagcatactagagcattgttatcaatgtgtcacttcagcatcaattgttaagtgccttgtattatattcgtatcacttaagatttgacatgtagtatatataataatacgacattcactaattatgctagggaaatgttacagtaatactatgaaagctattaatttctactcctagaggtggcagagagaaaatatattagttccatataggtaagacaatatctgtttcatacagtcatacccacagtgcttagcatggtgcctatcataatatagatgtccaataaatatttgttaagtgaacaaactgttaaagaatatttatagggactagcactatattctcataaaaatggacaaaatatgaattgagccatctctctattgtcagtaaatacagaggtgggatactcactggcataactacactatacagataaagtagttttggggggccgagggtgctgcctctatggataggcaaacctgggttctcacctaagaactggaaaatggagatcattatgatttgctatccattaaggcctcccactcagaagaacacacagttttaaaaggaacgcatttatcccatctcaaatttttggtgtatcttttttttttttttctctaaagcataacaagcttgtcagagtttccatggtgagcacagggcaccatggaaactgatagatttagctacatgaaaagaataaataaaataggcaggcatttatttcactgtacaatgacaacttctctcctagataagagaggaaaagtggcctctcatttaaactgcttccctgcactctctgtacctcatgaaaacctgagttattttcgatagcccattctactgacctacgctgattggattcctgtttttctcaaggcccattattccctttagttttactgcaggctagatctgagtgtcaccagcaactgttggaaaaccatgtacaatgtgaaagttgtagatgacagcccacagtgcagtggccaagtgagtcatggcaaaactgaatgaacaattcctgggagtttactgtgatgagacaatgtatgagaacaactggactcaagatccaagtccatcctatattaactgcacaggcaagccaacctccctgaaccccagtttccccatctgtggaatgtttaaaatacatcctcttcctattttatagggttgttgagaggctcaaaattagataatagaggagaaagccttttcaaacagtcaggttctatctagcaaaaaggactgactgactaagctacaggtataattacattcatgagatgagcaaaatgtcaaagctaatcatgctatggtctaggttttggcctcaggcaattggaggtttagaacacgatgatcccaccccagtagttggggaatttgggggctacttggctccatctgaaatagagaaaattgagattgtaagaaatgaagctttaaaatttttctctatgtctgaacattctcataaaatgttggaaaactaaataaatgaaataaaactcatccttaagttctagtcccaatgaattgttcaccattagcagacacccactatagcctcttaatttttatgactaaaatataggcactagagccatctcctgcaattcaatattcatataaatctattgagcacctcctagtgaccagggactgtgttaaggggatggatacacagaaagaaagaggacatggtccttcagaaaaacacatcttctttggggtatagatgagtaatggaacaattacagcacacccacaaactcaggggaggaacacttaacactctagagcagaaatgtaaagatatcctggataaaggtgagggggggttgggggttgggggagtgggtgggacaatgaggcagacatggtgtaaggtggtaaaagggcaccacaggcagagagaagagtgtgagcaaagcggattcatagcatatgggagagtggaggtagccaagcctgaagaagcagccagggaatattccatgccaaggcggggctctttttttctgaaggaagtgatatgtgggggtggagcactaatgatgcttgggctgtattttgagggtgaatatgaaagctctgtactccctctttcctccaaacctctgtagccaggagaatatttccctggggataccagaatgggagtcaaaattgcaggaggaccagcaatttaaaggagttgccacctccgagagtggagtctcaccctgttgcccacgctggagtgcagtggttcaatcctggctcactgcaatctctgcctcccgggttcaagcgattctcctgcttcagcctccctagtagctgggactacaggtgtgcgccaccacacttggataattttttatatttttggtagagacggggtttcaccatgttgactaggctggtctcgaactcctcacctcaagtgatccgccctcctcagcctcccaaagtgctgggattacagtcatgagccaccatgcctggctgggaagccaagacttctggcatgtggctgagccatgctgcctggcagtatagcacccagggcttctggatcctgggcccaggtacctacaacttgactgggaatggaagtggaactatgcattgctcaaaagagctaaaatttacctgaggagcactaatgccatgtcacctggaggttcatggccaatccttctgcttaagacgattaatttctttaaaagcatcataatgattattcatcctataaaccacatagtaacaacattaaaaaaatcaaaacaaaattctctacctagcaattccattatctcaacagaacaacacacattgtttgatgtaccttttcaattccagcaaatatgcttatagcttttcatggttttcatcgtagcatagaagctgttttttgtttgtttgttttgttttgtttttttgagaccgagtcttggtctgtcaccaggctggaatgcagtggcgtgatctcagctcactgcaacctccgcctccggggttcaagcaattttcctgcctcaccctcctgagtagctgggactacaggcacgcatcaccacacccagctaatttttgtatttttagtagagatggggtttcaccatgttggccaggatagtctcaatctcgacctcgtgatccacccgcctcggcctcccaaagtgttgggattacaggcgtgagccatcgtgcccagccagaagccatttttgaaagcttaacattgtggctatatatttctcctgttgtttttaataactgtataatgttctatcaagtagatatattctagttcataaaactagtctctattttttttttttgacatttaggttttcattaaaacctaatcatcaaaaaaattattaaccgtatctgttttaggaaagtaatacatctgttggaaacatctgattgaatcctatctcaaaagccattttcttcacctttctgtctgaggtttttgtgtatacaagggaatgttttcagtgtgctggctgtcggtactgccaggagggagtgcagttggcagaatcaggagaaagtgacaaggagcagggacaagtgtaatgacctcagctgcagagattcctaattctggatccctggtagggtgatcaaccatctgtgtgcatggttctgacggttttcctgaacggcctttcagtgctaaaaccaggaaagtgcctggtaaaccaggatttgttggtcaccttagacattggttatgggggagctgaaggaactgagaagggaacgaatcatttctataagccagccctgtgtcttaaaagcagcaattcagagaaaaactgctcacacactgcaatgaaaccctcaccctttatgtagttgtcaaaatagttatttgtctcaggttatggctctgctcacagaaaaaccatccattcatttattcaataaacatgtatggaacaccggcattgttctaggcataagacacattccctgctcctgtggtgcttctgttattggtgtgtgtatgtgtgtgtgtgtgtgtgtgtgtgtgtgtgtgtgtgtgtgtgtattggtgagagggaaacaggagtaaactaaaaaacacaaaataaagaagaatggacacaataaatgcaatggcagaaacaagatggattagtggagtagaaactgctgggagtccggtgccacttggtggtcaggaaaggtgactccgaagagcctgacatttgagacaaatcagtggtgagaagagctgccaagtaaagcgccacaagagggattaggggcagaaggaacagcacgttagagggccctgaatggaagccagctgggtttcatggaggaacttagtgaaggaccctgtggtcattgtgtagggtgggaacgctgaccctagttatgacccagtccaagctccattttcataagtggggatgataagcacactgaggcccacgtgtcttgtccacagtctcttgattcccaattcagcacccatggtaccattgctgcctatttgacttgagaacttaattttctccctttgtacaactggaagtaaataaaagagattcattcattttacacgagaaaaattggtattggaattgtttgcggacaaacacaagaaccaaaaacattagcctcaaggtgaagagaggaaccttggcgtccacaatgacacccagtttaggggtccccagagatgttcggtaagacatgcttccagaaccttccaggtgaggaccaatactaattctgcagtctacataaactaaaaatgaaactggtcataaggtaggcagccccagctgacctttcacctgtgcctgaactaatgcaagtacaggacctgagtgctacaggttgaagaagtaagtgatcctaggagttgaagggtcagaggagccaggctgacacaactcatagaaggtggaggaagctgatcttctgagcctcagctgtggttgatcttgataactcaaagagttaacacaaccaaaactaacgcaagggtggagagaaagaccacaccccacgggagcgcggagccaactcgcgggagaaaaatcctattggcattgaggaggtagggagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaagtaagcaggcgcggggtcgagcgcactccgacgggcgggaggataggtgcaaggaacctggcgcggtgcttcgcgtagcccggggttcgctcggtgcgcagtgagcgccgcggctccggagttgaacttgagtctttggctcttgggcaacgcagagagaaccctggcgctaggttcgtgggctggctggggagttcccagaagtcgggagcagtggcgtgctaacgccacaactggctcgacagcagtccgggctgcggtagagccgggagcaaggatgtcaccccccgctcccccgccccccgttccaatcctaagataccggcaataatcttcaatcttgcttaaatcatctttgtttccaacacctagcactgtgcctggcacaggaggctctccataaatgtggttgaatttattgtgaaagaaataagaggagggggtcatttgattgatgttgtttagcgtgtccagaacatagaataaatagaactgattacattcaccctatcattcaacagagataatatactaacgatgaaggttccacaacttgtaatactagaagggatggtccgaaagaaataattcatccatctcttttccttcctctctctctcttatacacacacgcgtacacacacacacacacacgcacgcacacacacacacacaccatagccatttgcatcaaagcaagcagttccattttaaggttcaaaatgtcttctttgaatgtatcttttacacttccttttccaaaatcaggatttctacaaatgacacaggtaacttgatgtctactatttactgttccatacacacatatagtgactatatcagccatggcctggcaagtttgataagtgaagccattccattttttagaacaaaaaaatgataaaataaatatggagatgggattttttgagctgttttccaactactggtttggttagcaaaagtacacatacttgtgatttgtcaagttgaagatactattcttgactaagatgctaccgagtcggtgacagttttgaatcgtgactcttacatttgggggtaactaaacactgttttctcatggtgctttaaaaaatactctttctatgcacgttcagggagcctgctgttgtgtttccaaggtgataaaactctcagagctctcccagggagattccggtaaaccctgagactgatgaacccatgcttggggacttggtcctcaagtttcagggaactcaggtttggggcaagtcccaggaagcaaaggaacggagattgctaaactggtgtaagattagaggtgttattttaatcacaagaagctgttcaactcttgggtttcttttttaaaaattaatttcccatatccagaattgtaattggtagggtaacaggcaactggttttaccagtggagaggaataagaaaaggaagtaataaaaataccttttctggtgcttgtacagaagaagaataaaagagtttcccaaacacacaattagtagttgagtcagggagtctattcctcactaaaaatcatactgaagttataaatttagaaaacatgcccttcccccacaagacaaaatgacttaggaattgaatacaaaggtgagttagtcagtggctggaatgtatggtacagagctcctgaaccagtggattgctaactgttgctctcctctcctcctaggtgcaaggcagttgatacctggctgtgtttaaagagagagcatgccatacatatttcaaaacttgacatcccccatttcaaaatggagagtatcttacttttagagttgctgggataaatatattatttatttaaacatttcaaggttcaaaaaagaaaataatacgcctttggaatacagaaatatgttgaattattatgatctgtaattttttttttggtttttttttgtttgtttttttttgagatggagtctcgctctgtcacccaggctggagtgtagtggcttgatcttggctcactgcaagctctgcctcccgggttcatgccattctcctgcctcagcctcccgagtagctgggactacaggcgccaccacgccccactgatttttttgtattttaagtagagttggggtttcaatgtgttaacaggatggtcttgatctcctgacctcgtgatccccctgcctcggcctcccaaagtgctgggattacaggcgtgagccaccgcgccggccaatgatctgtaaatttttactcctaaatttttaggagctcaaaccttgcaatgaatcagaaatatctaggggtgcttgataatatgctgatttctgggcatcatcctcagagactctgaatctatagacctggggtaggccccagaaagtggcattccaacaagcatcccaggagattcagacgcaggtagcgggtggattatagcagcgggtggattacattttgaataactgtaacacatagtttctgtgatgggacaagctgtgtgaagtatcaggagcttatttctccattgcaagtttagatctggggtagaatctcagcgagagggcacaaagcttactctgtccttctggtctcgcttttaaactttattccttattttgtataacttcgtttaggcccagagaatgccaatgactaactgctcttaatacattaaattaaagctcattcaaaagcaggttaattaaaagaaattatctagccaactttttggtataaagcaaaatacagagttatactttctgctcaagtagcatgtagcttttaagaatatagactctaatgattgccattctaactggtgtgagctgatatctcattgtggttttgatttgcatttctctgatggccagtgatgatgagcattttttcatgtgtcttttggctacataaatgtcttcttttgagaagtgtctgttcatatcctttgcccactttttgatggggttgtttgtttttttcttgtaaatttgtttgagttcattgtggattcttgatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccatggcttttggtgttttagacatgaagtccttgcccatgcctatgtcctgaatggtaatgcctaggttttcttctagggtttttatggttttaggtctaacgtttaagtctttaatccatcttgaattaatttttgcataaggtgtaaggaagggatccagtttcagctttctacatatggctagccagttttcctagcaccatttattaaatagggaatcctttccccattgcttgtttttctcaggtttgtcaaagatcagatagttgtagataggcggcattatttctgagggctctgttctgttccattgatgtatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgaagaaagtcattggtagcttgatggggagaaataggaatacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccatcaatgatagactggattaagaaaatgtggcacatatacaccatggaatactatgcagccataaaaaatgatgagttcatgtcctttgtagggacatggatgaaattggaaactgtcgcaaggacaaaaaaccaaacactgcatgttctcactcatagatggaaattgaacaatgagaacacatggacacaggaaggggaacatcatactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataaaaaaaaaatatagactctaacatgtttaattcatttgcaaatatttaatcttgaggtaatgcatgctcaaatattactaagttgcctgattcttcccacatacatcagggtcaggttgacagtaaagatgcataaacatgccttgggccttttaatgcacacttacccagaaacaagagtgaggaagagattcattttgaggttgtgtcctggggtggcaggagcaagtccaatggaggaatagagacttgggttcaggtcagagtctctaccacttacctgtgctgagaccacaggtgagacctaacctgcctgagcctccgtttcctcatttgtagagtcagatttccttttgctatttattaaatgagataatgtatgaaaatgcctggcacttagtggatacttaacatgtaccatgttcattctattccctttgcctcctagcaaatccttaacctcttgctcactgtgatattttgcatgttttcacatggtgacatgccaagtggtagagaaggaagccacggcctgtgatgaactgtatggggtggtcacagaaccttagctttttattctcactgcttatgtcattgatcccctgggacccaaagatgcaccctggaagaaagatcaagaagcatttggtgctagattcactagcaagctatctttagtatctcttttagacttgacaatgtcattatttccactaacagatgaggaagttgagacttgagaagtcatgcattcagatacggtggtggtgtagctggattttgaattagtatggggcaaaggccatgttctctttactgtcgctgactgcttctctagggcacagtcctggacctcaaagaatctgcactttggcacgggagctaagacttgtagctgtaataaaagtgactcattcctgagccaaacactggggttttcaccggagataaattgatgaacaaagtatgcaaatactgccctgccctcttgaaactgatgatctagtaataaattaacagaatctgccatgacctatcagaacttgaactagttaggggaaggctttccctagcgtgaagtgacatcaaacttgcgatgtgaacaatgagaagttaagtaggtatattagtcaattttcacattggtgacaaaaacaacctgagactgggaagaaaaagaggtttaattggacttacagttccacatgactggggagcctcagaatcatggcaggaggtgaaagacacttcttacatggcggcagcaagagagaatgaggaagatgaaaaagcggaaactcctgataaacccatcagatctcgtgagacttattcactaccatgagaacagtatgggggaaactgcccccatgattcaagttatcgcccactgggttcctcccacaacatgtgggaattaggggagtacaattcaagatgagatttggatggaggcacatccaaaccataccaataggtaaggtggacagcattggaagtaaagaagagccttctaggttgagagaactgcctgtgactgcctgtgcaaaggtcctggggtaggaaggaatgaaacagtcaaggtagtcagagtccaaaggttgaggagaaggctaacacaggataaggcaggacaggtaggcagggctatgttatggagggcatcggggatggtgggattgtgtcatgattatattttgtggttataaaggtctaacttcaggataaatgcattgaagagaagttgagtgcaggcaaggaggtcagataggagcctgttgcagtatttaggtaaaatggaatgtggtttagatgagagaggcagtgtagttatcaactgagatatgaactcctaagagtacctctatcacttattacctatgtgaatttgatcaagttccttaccatttgtatctccaaatttctttatgcataaaataattactatggtctacctaatagggttgttgaaaggataaaatggattagtaagtgtaaaatatatagaataatgcctggcatgtagtacatgtccattagacttcagcggttattgtcagtaatgcagatggagaggtggatagaatcagtagctatttagatcaagttgactggatttgatgatagcttacatatgtaaggttggaaggtaagtgcatcaagagtgatcgcaaaatgtatgtaaatgtgtgtaaatagtacagtggggcacaagttgaccagtgataggaaaagcttcttgaaggaagtagtagctgaattggaccttttaggactggaacatgcaaaagaggattatatagccctggtgaaaagagtgacccaatgttcttcagttctgaagactgctgggaggaggaagagttctttctcacctgaggctactttaccagaagttctctcagtctaaatcacaaatcctagtgattgtgtatcatcctttcctccacttcctgccaagctcagcaactcaaaatatgctgttggtcctgagaaaggaaactgggctaatcccttccttctgaggctgctgaataggagcttggctttcatcagaaagatgctttcactcccaattattacaagatcatcttgcaaattcccattttctagaaggctgattgcttgttcagaatgctcatggcaaacactgttggttacccactcagcagtcatgacctctttttccttattaacacctgaatttgatcagtccatggtagactcagcctgtggatacatcatggtgtaagccagtcatggtaatcctatctccatttatcagatacttattcttccagcttcctggtagctgagggtgactagtgataatattctgacatacaggaagtttgctcagaagcttctaggatgtgggaagagaagccctgccttttttggatactctcatatgaagaaaagatacttggaactgctgctgccaccatgtgagactgtgaggaaaaggttaaggggatttcagagacaccatcccattttctaacatcactgagcagttgaactacccctacctggaactgtctactatcagacttctagacttccttttttttttttttttttttttttttgagatggagtttcactcttgttgcctaggctggggtgcagtggcgcgatcttagctcactgcaacatccgcctcctgggttcaagcgattctcctgcctcagcctcccgaggaggtgggattacgggcactcaccaccatggccagctaattttttgtatttttagtagagatggggtttcgccatgttgggcaggctggtcttgaactcctgacctcaggtgatccacccaccttggcctcccaaagtgttgggattacaggcgtgagccacggtagccagcccagacttcttttgtgagatatgaaatgtctttattgtctaaatctctgttagttgggtactgttcattgcagcccaatgcaccctcattactacactgcttttcaatgaacaatattttacactttacaagaataactaccttctccttcttctccttactggcctttccaggcacccatatcaatagtcaagcccagccaattttcctctgggatttctgtgtgcatattcacttccattgcccccatctaccctttagtgtctctgagctaaaatataacaggagacccttaactgttttctctcattctagtatttcccccacattactgaaaactcttttcttggaccatgggtagtatcatgtatctactcttctataaccatctatggctcactattgcctctaagtttcaaatgtcctggaagatgttctaggcatgacattatttggccccaacctgttctctaattctttctgttgcttcatttatctgtctggcaagtgggaataggattaccatgactgatttacaccatattgtatccatgagccaagggatgtctatccatgcaaatttctccctgttttccagcacatcatgtccttttatgcctccacattgttggcaccaatttctttgcctggaatagtcctcctttttatatccccatttccattttacttctatcaaaatgaaatcttgctcttcctttaaggcccagctctgatcttctctttttcacaaaggctttcacaaaggctttattcccaagttgaaataaattgccccttcctctgttcttccataaaatttttcatatatttcaaatcagtattttacaggtagttaagaacatggtttctagagtcagattatgtgaattcaaatcaaaactctgctacttactaggacaaattttctgacatagctgaacctcagcatcctcatttaaaaatgtggattaaggctgggtacagtggcccgcacctgtaatcctagcactttgggaggccgaggtgggctcatcacgaggtcaggagatcgagaccatcctggctaacatggtgaaactccatctctactaaaaatacaaaaaattagctgggtgtggtggcaggcgcctatagtcccagctactcgggaggctgaggcaggagaatcccttgaacccgggaggcagagcttgcagtgagctgagatcatgccactgcactccagcctgggcaacaagagcgaaactccgtctccaaaaaaaaaaaaaatgtggattaatagcaccttgatagagttgtgaggcaagtgagatagtgtgttgttattatttttctttctctgaagtagttattccaatttgcctttgattatacttagctttatagaatgttctcactcactgaaatgatttaaagtttttggaaaaagagagatgaactggagaaaaggtaacacttactaagtcatactgtatttcagacagtctgccaaatcccttacaaatcaacaaccttgagacaaggtaaggacaccatcatcatcatcatcatcatcatcatcatcatctctactttacaaatgaggaaacggaggctcggagagttacttggctgcagtcacagcaaataagtggcaaaggcaagactcagagccatgcctgtctgatgtccaaggtccgtgctctccaggagtctctgctgtcttctgtcatggagagggccaaaactctattgtcctaaggccccttcaacatttcatgttgttttagcacaaagtaggtggtcagtaaagtgtgttgaatgtgatgtgtaatacaaaaacgaggcaggcagatcacaagctcaggagttcaagaccagcctggccaacatggtgaaaccccgtctctactaaaaatacaaaaattagccaggcatgatggcaggtgcctgtaatcccagctactcaggaggctgagggggaagaactgcttgaaaccaggaggtggaggttgcagtgagccgaaattgtgccactgcactccagcctgggtgacagagtgagactccgtctcaaaaaaagaaaaagagaaaaaaaaatgagtgatagaacaaacctttctcagcaaaccccaccttaaaacccaactgtgtcaatatgagtttatttacagcccattgattcatgaattaaaaaaaaattgaaggccaaagcaatcacaaggtaattataatttaaagtgagttattctaaacttacatataatgatataagaattttaaaattccaagattctccagaagcttaaatggaaaaataaagtgcatcataatcatacattccccaccctcacacatgcacacccttatacactcatcaacaaaacacagttctggaagaagatattaaaataaaaacttaaataattacttttgtagattgggaatggagatttggagctatggaggataatttttatttttgtattgctagtttttaaaatttttgtcttgcttttataatttaaaaccaatttattttattttaaaatttgtattctttttcttaattgcagtaaaaaatgcataacttaaaattcaccattttaaagtatatgattcagtggcatttattgtattcagaatattgtacaactaccaccacactgaccatgatctagttcaagaatatattcatcagccgggcgcggtggctcatgcctataatcccagcactttcggaggccgaggcgggcggatcatgaggtcaggagatcgagaccatcctggccaacacggtaaaaccccgtctctactaaaaacaagaaaatatgaaaaaaaattagctgggcatggtggcgggcgcctgtagtcctagctactcggaagctgaggcaggagaatggccgaaacccgggaggcggagcttgcagtgagccgagatagcgctactgcactccagcctgggcaacagaacgagactctgtctcaaacaaaataaaacaaaacaaatatatatatatattcatcaccccaaagggaaactcattgcccattaagcagtcactccttatttcctctcttcacctctgcaacaatcactaatctgctttctctatccacttgcctattctggatatttcggatagatggacacatataatacataaccttttgtgtctggctttttagacttagcataatgtttttaaagctcatccatgttgtggcatgtgtcacaattcattcctttttatggctgaataatagtccattgtgtagatataccacattttgtttatcctttcatcagttgatggacatttgagttgtttctgccctttggctatttgtcagcagtgctgctataaatatttcatgcacatgtttaaaaaagcagctggttaaaaaaaatctttgtatggtttcccattgcctaaccgtgtgataaacccaggcctggccttgctgactgtttgcccaaccttccacgttgttaaattcctttgtgtctttgtccatgctcctttttcaccttccattcgctggatggatacacatttcaagactaaatttaggtgttacctcctcaatgaggtcattgctgacatagcttcctgccttccttccacaggcagagtgcagtggtacaatcttggctcactgcaatctccgcttcccaagttcaagcaattctccacccgccacctctcaagtagctgggactacaggtgtttgccactaattttttttttttttttgtatttttagtagagacaggatttcaccatgttggccaggccagtctcaaactcctgacctcaggtgatctgcccacctcggcctcccaaagtgctgggattataggcgtgagccaccgccccggcctgtgtcctactttctactcagtgcctccttacaactcttacttgatctcatgagtctccccaaaacctgagcttgaaggcaggttcacaactttatcacctttgtgttgacagcacttaacacatggtgggcactctgatgaatatttcttcaataactggtgcttggatttttttcaccacaggataaccaggttatcttccaaataaccagttgtttgaataagaactctggttttttctaatctagatgccaatgtatgtggttactgggagctgtaattagttttatgtcctggtgagtaattaagaaccctagaagagtacattttaattagaattctgagacctcatgaagttctcaaaggcctttaactctgactatgttaaggacttgcaataatgtagattataaaggcctgcttgcttcttttggttttgtattatggtttattaagtgtttgctttttcataagatggtaatttacttgaaatgttgcttgtaaatgccacttacaatttacagtcctggaacatggtagaccctccataagcaatagctcttgttatccatcgcctatccatcatagtactttacacagagcttttgcacaaaattagcattcaatgcatgcttttaaatgaaagaatgaatagaatgggtatatgctcttcacagagtagacaagaaatagttaatcaacattctcagatggttgtagccaatgtgcttgaagatgcaacacaagaagtaacatcgttggtgacttccacacactgatgcagagtttttctcctgagctatttaacctataaattgtttcctttcagcctgtgtagagtggtctcaggtaccctttaaccctttttggaaatgcaaaacacagaagccattcctggttcctagatgagtggggacacttgtgcctcctcaccttcctgcagagcgtggactcaatggtctgtggtgctactatgcttggagctcatgagagctgacaatagctgatggagagcaaggatctcaaggtcttagggataaaatggtaagcaaaagagatgcggttcctgccttatttgcactcggagtcaataatcaaattagtatggatcagtatacagtttctaaaaggaaaaaatgcagagtgctctggagatgcaaatcagaggacttggcttattttgaggagatgcttcaagaatgtaaccccaaagaagtcatgttggagctgagtctgaaggttaaatgggaattaactaggcagagagagggaggggaaaggcctatgcaaagacccagaggggaggaggaaccaggaaccaggtggcaaagaatggaggaggaggaggtggtggaactagatgagggcagagagaaacatagtcattcccgttagcccaagagccatggaaagcctacgaagggtgtcagaggaagataggtcagatttacaatttttttttttttttgagacagaatcttgctctgttgcccaggctggagtgcggtggcgtggtctcggcttactgcaagctccgcctcccgggttcacgccattctcctgcctcagcctccccagtagctgggactacaggcgcccgccaccacaaccagctaattttttgtatttttagtagagacagggtttcaccgtgctagccaggatggtctcgatctcctgacctcgtgatccgcccgcctcggcctcccaaagtgctgggattacaggcgtgagccaatgcgccctgacataggtcagatttacttctaaagaatatattaaaaataatttcagagtaaggagcagaatggagcagagcaagacttgctggaagagatgagttagaaaatgactgcagtggaccacaaaagagacaggtagatggtgatagacatggagagaaacagggagctctgtgagatgagaaggaggtaaatcaatgggatttgatgacaaaaatgggtacagaggaaagggaagagctttcctgggttttaggcttgtacaactggatggatatggtggctgtcactgagtttttgaagtcaaataaaacatagagacaaatctctgaaatgaaaacattttatttgggaagaaaaattgcaatttggggggcatgcacacagaccgactggccttcagtatgtcccatgaacaaagagaaagaagttttataaaaaagagaaatgttacatattgctctttgagaaagttcattggcattagtaaggtttgagggagctggcaagttttgattggtaagtgacagtaacaggtaaaattattcttttttttttttttggactgagtcttgctctgttgctcaggctggagtgcagtggcacgatctcggctcactgcaagctccacctcccgggttcacgccattctcctgcctcagcctccccagtagctgggactacaggtgcccgccaccatgcctggctaattttttgtatttttggtagagatggggtttcaccgtattagccaggatggtctccatctcctgaccttgtgatccacctgtgtgggcctcccaaagtgctgggattacaggcgtgagccaccatgcccggccaactattcttaaagtcacaggagattgtttcagcagctgttagataaaactgtttcaggtgcaggaggcagtttcaggtgcaggaggcagtttcagcagccaggcttgcatagaattacgttcttggagcaatgttttgttccctgagtgcttttactcctgacctctctgttttagttgggtatgacaagaatgacacatttgttgattaactttcacatagggaagagaagaagaggtccagccagggagggtggatccagaggtctgctttggtcatgctgagttgagatgcttttgtgacatctacatggagatttgaagcagatgttgacttgctggtctggagctcagaggagatatctgaacgggcgatataaaatgtagagtaaaggttgagaagacaacaggaactagactaattcctcttgttgagtttagagttaaagagaatgagtaggatgaggacaatccaaatatcagaggaagacaacgggagggtattgtcatagaaggcaagagatggggatacttcaagatggagggagcagtgcaggtgtcatgttactgagacataagaacaacactggaaaaatgtccagtggatttagaaacctcaggcaactgttgaccctaggaagcttatttcagcacagggagagggtggcaatcagcttgggttaggttttggaatgattggaagataaggacatgcagacagtaatcacagacaactcttttgagattaaaaaaatgtgtagtgttttatcatatgagaaaaataattgcttccaacagcaataaaatgtaaataagttacatacctgttattcccactgcttaagttatcagaggacttttatacaaacatttgcatttgtagcattctgaggaaaaaatgctctggctgggccgggcacagtggctcacgcctgtaatcccagcactttgggaggctgagtcaggcagatcatgaggtcaggagatcgagaccatcctggctaacatggtgaaaccctgtctctactaaaaatacaaaaaaaaaaaaattagctgggcgtggtggcgggcgcctgtagtcccagctactttggaggctgaggcaggagaatggcgtgaaaccgggaggcggagcttgcagtgagccaagatccagccactgcactccagcctgggctacagagcaagactccatctcaaaaaaaaaaaaaaaatgctctggctgtcctctggtcttcaaatactttgcttaggtttctgtgaatctttaaatttcaggtgacttaagtgcacattcaatctactgaatcacaattcacttgtgctcatattcctgtatttgtatgatttttcccagccttcctgtattgtatggtgaataacttctttccaaggacgtttcaaaagttaagaaagcatgctgctgttgcccatttacaaatatttaatttcaaaggatgccaaagcattggcaaatatatgtgtcagagcttagagttagttgcagccttcttaataatcattttactattttatttcagaaatataatctagcatttcagcgtcactggaaatcttggtaggtagtcagtatttttgtttggaagtacaggataccagcagtgaaacacttcattttattaacgtcaagcaagtaaggcattattttcctataaatgtgaggttgtttgaaatgaaaacaaacaaaaccaggtaagacgatagaagcagatgttttctctgtttaaaaatgcggttggtatgtgaggtatgtgtagggaatggctaaaaagaaaataaaaataaaatttaaaatgcaatttgggttgggcatggtgtctgatgcctgtaatcccagcactgtgggaggccgaggtgggcggatcatcggagatcaggagttcaagaccagcctggccaacatggtgaaaccccgtctctactaaaaatacaaaaattagccgggcatgatggcaggtgcctgtaatcccagctacttgggaggctgaggggggagaactgctcgaatccgggaggtggaggttgcagtgagctgagatcatgccattgcactccagcctgggtgacagagcaagactctgtctcaaaaaaaaaaaaaacaacaaaaaatgcggcttgttcctagttaagcattttaagatttcccccttccccaagggaagagagaaaatcttacccctccttctgttcttcccttctgggtgaatgactgtacaatgaagatttaatctagttgagaaaaacaacacataggtgactcacatacaacctttgtatgtatgaatggaggcttgtataatcatttgtttttcactgtcctgacaatcaagtgggaatgagaaaaataagatttatgctagatttatttcagttgcaattagaaggaaaactatccctgtgatctagacaggattggatgtttcaaaagtgccaaatcattgagcagatagagaaagtgagaagacaataagggaacaagatttggaaaggaaatgatttaacagttacgccagtgtcctcactcatatgcaggagttgaaaaagttgatcttatggagatagaaagcagaatgatagataccagagactgggaaggatgtgtgggtggggtgggggtgggggaatgaagagaggttagtcagtgggtagaagggcagctagatagaagttatcaacaacgtattctacatttcaaagtagctagaagacagaacttgaaatgttcccaacacatagaaataataaatactcaagatgagggatcaaataccctgacttgatcattacatattctatgcatgtaacaaatatcacatgtaccctataaatatgtaatatattatttataagtaaagaaacttaaaaatgtaattgtgccaatataaacttatgtatcaatttatatttgttcatgtcttttgacttctccacctttttgttcacactcttaatgcccttactctcttttctcgcctatatttaccatactcatcatttcctctagaaacaccttggttattctgtcctcaccaatttcctttttctcagagttttcatagatcagtccataatgccaatttggtgcttagaaacatatcattgtgcattgttctcgatttttcataggcagtaaattttattttctctaccagaaactaaattcttgacaggcaaagatgattttgaaactgacccaatagttccatagacaggtttttgttgttgttgttgttctgtttgtttgtttgtttttggataaacatagaaattgacgcttttggtcttaaagcctgaaacttacatttgttttatttgagttccttgtttaggaaatgacccccaggcctctcaaaagtatcaaagaactgaaactaaccagatattgcatccagacaatgaaatgccaggcctctcattcatcatgattgcttccttaacccctctggagttcctgttttctcatacctttcttccctgctatataaacccctcattttagtccatcagggagatagatttgagactgatctcccatctccttagctgcagcacctgattaaagccttcttccttgccaataatcgttgtctcagtggtgtttcggtaacaacttcttatatatttacctgaacccttagcagtttgatgagcatacatttaagaaataaaggattccttgaattgttatcagttgaaatgctgcatttctgaacatggcaaaaagtggtctaagaagcatagcttaagcaactttctgtccaccactggtttttctgcgcccagcctctgcctgcaatgtgtgattggcatacagcctctcacaggccctcagaatgtacaggtctaactttcacaaatgaacctggaagataatttgtaattttgtggaggtgtgtgttcaagagcagcacattggtgtgctaatcagtatcccttcaccagccagtgagccttgctgctcatcagcatcaatacctcagtgtaatgtcttgcccttatcatacatgcagaaactctcaagaagtagttgaaaaacaatcaaagcttagcattttagtaaaatgttacagtggttttgagaaaattgctgaccaaaggaagatgtgcacctatcaaagtagtaaatttttactagtgttgctgctgccataggctataagctccctgagagcagggattaggtcttactcacatcattccctagtgctggggtacatcacctgggagatagaatgtgctcagcatatatttgaggaatggctaaataaggaaatgattatttctaataaaaggaaaagattgggcagggtgaggtagcttgtgtctgtaatcccagcagattgggaggccaaagcaggaggatcacttgagcccaggagtttgagaccagcctgggcaacacagggagatccctctgtacaaaacaaacaaaaaaacacgagctgggcatagtggtgcgtgcctgtggtcccagctacgcaggaggcttaggtagagtacagcttgagcccaggaagctgcagtgaattgtgattgcaccactgcactccaaactgggcaacacactgagactttgtcttttttttttttttttttttttgagatagagtctcgctctcttgctgaggctggagtgcagtgatacgatctcagctcactgcaacctcttccttccaggttcaaatgattcttgtgtctcaaccacccaagtagctgggattacaggcatgcaccaccatgcccagctaatttttgtatttttagtagagttggttttgccatgttggccaggctggtctcagtctcctggctttaagtgatctgcccaccttggcctcccaaagtgctgataccctgtcttcaaacaaacaaatgaagaatgtatagcacttactatgtgccaggcactgctctaaatcttttacatatattaactcatttaatcattgcaacaaccctataaattaactattctttatctctatttttcagatgaggaaactgtgtcaccaacagtttgagtgccttgttgaaggtcacatagctggttactggtagagttatgatttataatccacatggtctgactttacatttaacagctctcatatggaataaattaaatgctatactgctattcagatatgtgggaagacatgaaagcctcaagatatagtcaccagcctctgttacaagcttgttgtttgtttttgcttttggctttttgtcttgccacggcaaactcctaagggattctggtaatttgttagcaaactttctaaacccttccaagactgccaaattgctaattcttaagcagttttcattgacactattacattgtttcatgtcagggctttagaagcaggtgaaatagatattggttttgggaagtgggggaaagctgactagtaattgatgaatggctagcatctttatacaggagaggaatttgcaaggcaagtaggtgggcttgttctgagtttcttttgttagtttcaggagttaggcttgttgaattaagtaaataaagctcacaatgtgctgatcatgtgaaacctaatgccaagtctatttctgagccactgtgaagaggacatagataaacaaggagggaggagtgtcaagtcacacaaaatatttcttactggacttggattttattttttaaatctattcttttggaaatagagccatgatctaacttaatgtggctactctgaatgcatgctttctccatgtccactctaatttctttgcaggttcgtataaattttgtaagtaggctttgtaaatcaaactgtggactaaatatcctggtgcgactctcaaattgctctctcaaattgcaggcacaaagtcttggaagttctgttgggcagaaacaaactggaccaacattttgcgtttctgttatcatccaacttcctatatgcagtcaatctgataacaaacaagctaatgagctcacactagaattagaaattataaaacatttggttttccaggggaactgggaatggttttgtaattaatgtgtcagaaggaaaactgaagcaaagaagttttcaattgcaccatatatgacagacaaaaaatgaaattaaatgcatccttcagctctgaggacagataatggtcctctgtatctaagcgtccaggaggaggtgttctctctattccatacatctgtgtcccagtgaccaaatgcaatgaagagagacaacttgtaaattaaacaaacacaatggggcataaagatttttcccctttaatattacgggatatgacaaagaagatcattttctggttgccgtaaaaatacaacagtaaagttgaattagacccgcagatttgattaatgaatgctgtgcttatgaaaacacataattattcctgagctcttggaatgaaccaagtgcggtagcttctggggcacttgtgcatattacttttaaagatagaatcctgcttggcaaaaatggctctcccagttctatataaaagatacagcaagaagcagtgaatgtatatatagacaaagagaaaaataaagctcatagctgtcttcataccagtatagatctttcttagcacataactagatttttgtggattttacaagttaaataatgtgaaaaatatatttgggcacaagccgggatcgctgagctatataaaagggattctatcactcagagagttgtgtgatcatgggctagtcagtatcctttgtcagtgggcctgtctccctcattcgtaaaatggatatggggaggcttactatttccttaccagccatttcaaatatatgtctcctgataacctttgcattttagagctcttcttttgttttcccatgagcaaatcagcaagagctacaagttagcaaacttttaaggagtgcttgctgtgtaccggcccatgataggtgataggggccacaaagatgaaggcgccttttctctctacccatgagatccagtgaggccaatgaattactattattgttgttgttgttgagataggccctcgctctgtcaccttggctgtagtgcagtggcgcgatcatagttcactgcagcctcaatcccctggggcacaagtgatcctcccacctcagcctcccaagtacctgggactacaggcgtgcaccaccatgcctagctaatttttgtatattttttagtgactgggttttgccacattgcccaggctggtctcaaacacctgagctctggcagtcctcccgcttcagcctcccaaagtgctgggattacaggcgtgagccaccatccaccgtgctctgggtcatttttttcagctctcttatagttcatatatactttctccggctattgtatattccatctgttaatcttgtcaaatctattgtatattccatctgttgaccttgctatagcaacaactataattttaattccttaagttccacttagttctttttcaaatttgcctgatcatttttgattgtctcttgttgcttattccattttatgattccattctttatttctttaagcataccatgtatatttgtgtatacttcgtatcagatcatctagactccttgagattctaaatctggactttgtagcttctgctagcctttacctgggatggtttgttccttttgattttggtgacctattttttatgggttcaattttggttaatcttaacctgggaaaatttggaggctgaaattaaagatgtgatcctccagaaaacattttttttttcctgttcagagatagtgaccattggggccaccatgcattttgtgtgggtttattgttcacggctcccatttcagcttagaatctctttttttcttcctcttttttcccctttaaccttcatattctcccttaggtcctgcaaagtgctacctaaaaggtcttgtacattataatgttattttataacttaaaggcccctcagggtatcttgcccaccatatttctaaaagtgaaattgctgatgttattgaatgcttaccctgtgccaagcattcttttgagcattttacttgtgttagctcatttaacactcacaacaacttcatgaggaaaagtaacattttttattctcatttcacaggtgaagaaattgaggtgcaatgcgattaagtaacaggttgccaatgttacacagctgatacatgctacatgagttgataatgttacacggcaaatagagctgggattgtaagaaacacctaaaaaatttatgcacatgataggaaattcaaagtgtacaaaaggctatatagtgaatagtaagtccttttctgttcctgtgccctagacatgccattgcccctcccaggaggcaattattaccagtttcttacgtatttttctaggggttgtgtacaaaacatacaatctaatatatatatatatataatagtatatcatatttattatacattatgtgtctgattttgctagaaaaatagaaataacaaaaagtaacatttcttgaatacttactctatgcttgttacttttcattcattatctcatttgttcttctgaggaattattagttttactttgtaagtgagaaattgagtattacaaaagttaagtaacttgcccaagaatttgcagatagtaagaagcagagctaggattcaaacctaggtcttcgtggttcttgggcctgcacactttggcttttcacagggagctgactaggggttgacatctttaactcctctgtagtggattaggacaagagttagagtaaaggctggggtttagggtttgcgctaggacctcctctctaacccctacaccatacctggatgtggcctgtgcaagtgtgttttaggattgctgcttcctggggaatgagatggagaacacaaaactcaaccttgcccatcttctctgcatctatatttgttagtttcatatgtttaaggataggcttttgttaaccaattactctattttgaaactccctcttctcttttcttctttttctaatttcttccttccttccaaccctcctgtaaacatttatttgagtgcctttatatgtctagcattctgtttggtgctggaaataccaagatacaagaacataactgtcttttgagaaggttgtactttagtggggagacaaataccctaactgcaaattataacacagtgagttaagtgtttgtactttcctatggctgccataacaaattattacaaacttggtggcttaagcaacacacgcagattctctcacatttctagaaatcagaaatttgaaatctgtttcactggtccaaaatcaaggtgtcaacagggctacagtctcctggaagctctagaggggaatctctagattctcctttgcttttccagtttctagagccacattccttttatgctgagttccaggaacttccctccatctccaaagccatgaatgcagcatcttgcgtaagtgatcacattgccttcttctggtgaaatactgctctgacttccccttcttttttttttttttttagatggagtctcgctgttgcccagcctggggtgcaatggtgcgatctcagctcactgcagcctctgcctcctgggttcaagtgattctccagcttcagcctcctgagtagctgggaatacaggcgtgtgccaccacgcccggctaatttttatatttttcggaggggcaggatttcaccatgttggctaggctggtctcaaactcctgacctcaagtgatccaaccgcctcagcctcccaaagtgctaggattacagacgtgagccaccaagcctagccctgacttccccttctaaggacacttgtgattgtatttagggtccaccctgctaatctgagataatcttcccatagccagatccataatttagctatgtctgcaaagtctcttttgccatataaggtaacattcacagatccctgacttttatagttctgttcttttgtcctcattttctcattctgtgagtgtgtgtgtgtgtatcctcaacagtttcctccagacctggtgtactagcaagttgtgtgggttcttcctcaaaataccacccatggggtatttctttttcttctctctctctgctcctctctacactggttgatgcccttattcagataaacattcaaatggtcagctaagggttctccctgtctctaagctctcctcccaacttaccttacaaccattgttccattaattgttctatgtgacccttgtttaaaaacttctagagaataaattctgaactccttagcatgacacttcaaggttctctggagttcaagacctatatcaacttcatttatttattcagcaggtgctcattaggatttctcatgtgttaagactgtgccaggcactgagagtatgatagtgggtaaaagtaggcatgtccacccttggggattttgctgtctaataggaaagacagatatgaataaaataataattatgaagaaatgtgaaattgcaactacaataaaacagcagctcagacttatgtaatgcctgccatccatctagcatcatcctaagaattttacatatactgtctcttgtaatcttcacagcttgttcataactgctacttcctactttatggatgagataacaggtgcagaaagtttaagtgattcaaattcacacagctggaaaggatttaagccaggtagcttggttctggattttgtgtatggaaccactgtcatattttgataaaagagaagtgcctggtgctatgaggatcgttaattgggagtgggaccagggtagaaagaagcacagagagaagcaaaactgcttcatgaatgatgtgttgaggaggtacacagcttgatggtaggccgggtctgttgggaactgttgaggttatatattgggaactgttgaggttatatatatatatatatagagagagagagagagagacagacagacagacagagacagagagacagagacagagtggggatggggaattggaaaagcttcctaaggaagggacagctaaactgaagttggaaatataccttggcattaattggacaggaagaaaggaaaagtgttccatccagagggaagatcatgtgtcaaggccgtatggaggcaaggagcagagtgcttagggggtctgaaatgggaccaggtggagccgagagagcaaaggcagagggaggagcaaggtataggatggctgcagtgggattaggctggggaggcaggtaggtgccaaatcacccaggaccctataggacatattataaaccattttctttatcctaaatgcaatgggaaaccattgccattgagtttttgttttgtttcatttttctgagatagggtctcactctgtcacccaggctggagtgcagtggtatgatcatagctcactgcagccttgaactcctgagctcaagcgatcttcctgcatcagccttccaaagtgctgggatcacaggggtgaaccaccacacccagccccattgaggttctattcagggggtacgacagagatgtgtcagaggtttctggattgtgccctgaattgatgtggtctcattctctggaacggaacccaggaaagagaacatgttcaggaataagatcatggactctgttttggacctgttgactttgagaaacacaaatgagatgtgaaggaaattttcaaatatttggatccagagttcatagaagatgtctgggctgggcctttaagtccagcccttgtgtcactgacttttggcaattgaaagatgaaccttttgaaggacttctatggtgctaaggagaattttaaattctacttgtgagactgcattaatcttttgttgtagatttgaatgtggggtgaaaatcagtcagagtgggaagaattaattttagagtccttccccactttctacttttacaacagaatacctttggataatcatttatccttcaataataggaactagtttttggaaattgtggtttgagtctgctataaggaaaccggcaagacaaaaaacaaataaccaaaaagctgtgtgagaaggcttcttaagactgcaatgtaacctcagtgttcaaggcaaaagggagtgtatttgttagctattgctgtataacaaattaccccaaaacttaggggcttgaaacaacaataaaaatgtattgtcctcacagtttctgtgcatccaggaatctgtgagcagtttagctgagtggcttgagctcaggaggtaagaggtcccaggcaagatgtcagtgagttcttcagtcattggaaagcttgactgaggttgtaggatccacttctgaggttaaaggtcattcacatgactgcaagctagtgttagctgttggcaggaatccttggtttcttgccacaagagcttctctcagagctacttgagtgttcttaccctatgactagaaagctccccctagacaacctaacagtgagagggccagatggaagccatcctttttatgagcgagtcttaaaagtcacacggtgtggtgaatgcttcattccaagcaagtcactatgtttggcccacctcaagggtgaaggagggaactcggctccaccttctgaagggaagagtgtcgaagattttgtgggcgtattttagaacaccacatgggtgtttgaaatctgagctgtggatagggcctcccctctcaccctgtgtaggaattaatttcgggtacagcatccctgacagatggtcattcagccctctgcttgccacttccaactacgaggagttcactacactgtgagtcagtgaattccacttatatccagtgttaattgttagaagctttttctgttcatgaaattgaaagctctattgtggatattccattattaaagctagttctgctactctagaatggcacttttacatgatggcttttccaatatttgcaactgtggtaatcttaacttttctcttctccagatgaaattttgtctgttccattcagagcttcctctcgtgttttaattccaggcttcttccacattctggtcacctccttgtgaaaacattctgattcagtttatccttccagaactgaaaacacactactaattctgtagcccgcgctaagtataaagggacacagcaagggtttcctcactttgcgtaatagtggaggactgaaaaatgactgtgaaacctgaaataatgcaaagtgatcctagtgggaaaaatgatgatcattctgagacctttataaactgcttttttttttttttttttttttttgagatggagtcttgcactgttgcctgggctggagtgcagtggcacgattgttgctcactgcaacctccacctcccgggttcacttcattcttctgcctcagcctcccaagtagctgggattacaggcacataccaccgcatggctaactttttgtatttttagtagagatggggtttcactatgttggccagactggtctcaaactcctgaccttgtgatccacccgcctcggcctcccaaagtgctgggattacaggcgtgagccaccgtgcctggacaaaacatctgtttttaaaactttaaaacttgttaaaattaaaaattttatttcaaatttaaatgcaaaaattagtaaaactagtgttcatttagtattcattagtattctgtaattaaaatattacatattacattaaagatatagagaatttaaaatacagaggattaaaatacttttgcaaaagaaaaaaaaacaaaaacatcaatagtagattgaacagtgcttgccaactccttcttcttgtataactaataatacagagtgagtatttttgcttcggcaaattgtcatcctgcttttaaaatttgtatcagctttcaacattatatcctttgagctttcagtattataaaacatctctgagagttcctttaatgtgaagttgtttttgctggtatcatttccttggagatacctttaatcactatccacatttatgttgacaagttcatctttgctaagttcctctggctgtagactttagagtctctgacagtggcagtgaccacattgctatggttagctgtataattacatttaggtccgattcccacctcgctactctgttgtcacttttcacttctttgctgtactttcatgtttcttgaccaattcactctcttcattatccattcttataaaatgccacatgggtttactgctgggaagcaaggaagcaacacagctacatgctttgatgtcaatgtgtgacctgaataatagatgcacagtgactagccacacatactttggaataaggagtgtggttggttactgatcatgatgcacgtctgttatgtatgtaatgatttgtggactacagaactagaaactaagtttgcactttattcaattactcacagttaatataccatggtaattgatatttgaaccatgttgttaggggactggtattatttaactaaatcatggtattggaaatttatgtacatcagattcatgcaaagcaaagtctgcctgtaggcttacgaattggtctggagttggaatcgatatttttttttttttttttttttgagatggagtttcactcttgttgcccaggctggagtgcaatggtgcaatctcggctcactgcaacctccacctcccgggttcaagcaattctcctgccctagcctcccgagtagctgggattacaggcatgtatcaccacgcctagctaatttttgtatttttagtagaggcagggtttcaccatgttggtcaggctggtctcgaactcctgacctcaggtgttctgcccgccttggcctcccaaagtgctgggattacaggcgtgagccaccgtacccagcctggaatcgatttttatgggcgactgttctgtgctgcttattttaagctcctggtcctcgctgtaatcaagtctcatatgtctttacctatgcatttgaattgtgtaaaatgtaagtgtaggattttacatacattccatttagcttgtggctgtatttttgacattttaaaaattttctgatacataatatttgtacatatatatggggtctctgcctttttaaagctggattgtgctatctagtaaacaaactgtcttctccaaattgttatccttttcacagtaagccattagcaagaacatggctggggccgagctcaatgatatgtttccagagttctctaagagctctccagccatacttccctcatcctattaatcaaccttttaagtaggaatatatagcagctatgaatttctccaactctgctgtcatccagcctgacgttttcgagcttgtccaacaaagttatctgtctggtgccatcagatgcctttctgaaatcaaagcatattgtatcagtagtggtgtcctgaaatgccactctggttaccctaccaaaaattaacactatgggtaataccttatgtttacagagaacttttacagttcactggagtgtttggcatatctctattttaaaatattttgtctatatagagttgaagggagatatggcagatatcattactttattttcaaaaatggtaaatcagagaggttaagggattggctcttgttcacagagctagtaaatagcagaatcttgatccttcagtaaatccagtgtgtttgaccatttcaaactatctcagatgaagtgactacaggcaagaaaaagggagtttctgcagtgttttcctgtcgatttattaggacagatcagtcttatgaccctcctcctatagggtctgtgctggtttcccagggctgctgtaatgaagtaccacaaacagggaggcttaaacaacagtaatttattgtcttagaattttgaagtccaagatcaaggaatcagcagagttggtttcttctgaggactttgagagaaggatctgttccaggcctgtcttctttgctcatagatggttgtcttccctctatgtctcttcaactcattttctttctatatgtgttcctgtgtccaaaaggacaccagtcatactgaattagggcctatcctaatgatttcattttaacttgattacctctgtaaagatgttatctctaaataaggtcacattctgaattactggcggggggggttaggactgtaacatattaaattggggtgggaggggaggttcaactcataccaggtcttcaaggcagatttcaagtttttttaaaaatggccatccgggcgcggtggctcacacctgtaatcccagcactttgggaggccaagaggagcggatcatgaggtcaggagtttgagaccagcctggtcaacatggtgaaaccccatctctactaaaaatacaaaaattttccaggcatggtggtgggtgcctgtaatcccagccactgaggaggctgaggcaagagaatcgcttgaacccgggaggcagaggttgcagtgagacaagactacgccactgcactccagcctgggcaacagagcaagagtccctctcaaaaaaaataaaaataacaaaggcccaaaggaataggcttgtgtagggagtacttttgtgtgtgcctgcatttttaaatcaatgtctgtgtatctgatacagtctattgagatcaactttatggtcaattgatactgcctttcagtttttcaaaagagagagagagtgagtgcttttcctaaattaattcttagttgtctacttgctgaatgtagtctctgaagatgtcttttgtgaggcagctgctgaaattatttgcttgtttgatgatttcaggattcaaatgtgtcatttaactttagagctgagatttatggtgaatttcactccgagcttggtgttaattttacacacatctaagcagtttccttcttccacaagttggttaagcatcagaggattctgaatttaggaaaaaaaaataaattaggcagtaacaatttgcatcccaaagtgattcacaagttttcaagtatattcaagggttgtttagcatattaccgactacttatcaaaacacgggactgattatgaccttgttttagattgctggtgttgaggtgctacaaatgtgagatctgtattattgtgtttcctcattgccttcgcttcttctgtggttttttccttttggtcactttgggtgttccacagattaccaatgtgtgcatttcacatgaaatagattttgattttttaaaaatagcatttattgtgagtagaaaatttggtttcactcatacatttttctggtgatctttgtgcattttacttatttttttgaagtgattcttctttttaattaactcattgggtaaagaaagtacagttctaatgtctatgtaaggtgtaatgaataaggatgtgatgaactgtggttatctttgaagctctatgtgttctcaatatccgttcccttcccttatcaccattatactaaattttatgcttatcatgtccttacttttacttatactttcacaattttttttgtgtgtgtcacttgttgcttaggctggagtgcagtggcgcgatcttggctcactgaaacctccacctcctgggttcaagcaattctctgcctcagcctccggagtaactgggattacaagcgcccgccaccatgcccagctaagttttgtatttttagtagagacggggtttcaccatcttggccaggcttgtcttgaacttctgacctcaggtgatccacccgccttggcctcccaaagtgctgggattacaggcgtgagccaccgcgcctggcctcactatcttttttcactttcttttttttcttttagtcagagtcttgctctgtcacctgggatggagcacagtggcgtgatggtagctcactgcaaccttgaactcccgggctcaagcaatcctcacatttcagcctcccaaagtgtgggattacaggtgtaagccactgcacccagcctatactttcactttttatatttgcgtttccaaataatatactgtttagtttttcagttaaaattttttatttttaattcattaaaaaatgattcaaaaagttacaagaatatacaaaataatgctgctatagacttcacccggattctcagtgctaatattttacaaaatttgcttcattattctctactctctctacatatataggtagacacacacatgcacgcacacacacacatttttctggactgagagtaagttatagacatgctgttggagtctaaatactttattttttttccctaaaaaataaggacactgccttacataatcatgaattattatctgggtcaggaaattaacataggtataattctaccacatgatctgtagacccattcaaactttgcccactggcccaataatgcccttggtggctatttcccctcctcttattcagaatccactccagaaccacaggctccatttatgtatcacattcctttagttgcctttcatctgtaatgggtctttagtgtttctttgtctttcatgctctggataattttcaagaatatagaagagtttctccttttttcaaactgtcccttaatttgggtttgtctgatgtttcctcatgattagattcaggtcgtgcatttttggcagggacatcggagaaatgatgctgtgctctcagtacatcatatcaggaggcacaggatgtggaattgtcccgttattggtgatgttaactttggtcactcggctgaggtggtgtgggccagctttctgcacttctctttgtaaaataaactttgtggggagatactttgataattatataaatatcctgtttctcaacaaattttcacccactagttttagtgttcattgatgatttttgcatgaatcatttttttatgatgatggatgccaaatgctcattttctaattgtgtaatttcttccacatatattagttggtattccactggaagaaagaactctccattctcactcatgtactcattcatttacttatcattgtggactcatggattcccatattattctttggattttaatttgttagtatttttatttattttgatgctcaaattggcccagatttacctagtgggagtttgtttagagtggcttctttgtccttttgactactttctgactatattctagcacttccttacttttggcacaaaattatgttctagattcatcttgtattttccttaccagagccctggaatgagccctggagtcacttggttctgttttgtggagaatggtatttagaaaccaagatctgagaactaggggtgctgattgcatctgggtttcattgtctctaggcctctcagcagataaagctagtatgtgtgtgcatgtaatgtatatgtatgtatgtaaatatatgtaaatatatattactcctatatgtaatcaatctcctgaccctggggactgtctcctcggctacagccttgcccattccacctgcctccttgacactgcacttctccaaccccagttcccctgaccctattagcattctcagccttgactgctcccttagccccaactacctctgcattcctggatccaccaggcccacctgctggggctatatgaatggaaggaaaaggaaaggaaaggcacaaagaaatagtttataaagaaaaaaagaaaaggaaaaggctgtttggtttttaaaatattacatgaaaaaatacataacgtagtgtctaatggccgttagcctgtaggcaactggggttcaaattcaggatttattacctgccagatgcgtaattttgggcaaggtacttaacatctctgtgcctcaattttatcctctgcaaaatggggctagtaatagtgcctcatagggttcttgtgaggtttaaacaagttaacacatgtaaagtatgtaggatggtgtttggcacataggaaatatattttaatctctttattattatcagacatcccatcattttagaatatgttgctttatatttctaataaaaatgtgttaaataccaatgatttattagtggtgtcttctacagagatcagaagagttattaaagttaccgtttttccttccatgagtattattttctttattcagatttgactgtctataccttataccactttgcaacataagcattacattaaattactattacaaatcttgaatctttgcacttatcttttaaaaatttaatttttagagaagttttaggttcacagcaaagttgagagaaaggttcagagctttcccatgtatcccctgccgggacacatgcacagccccctcattatcaatatcccccaccagaatgctacatttgcaacaactgataaacctacattgtcacatcattatcaaccaaagtccacagtttatactagggctcactcttggatttgtacattatgtggttttggacacttgtataatgatgtattgaccattatagtatcatagagagtgttttcactgtcctaaaattcttctgctctgcctattcatccttccccctccaacccttgacaactactgattttttattgtctccatagtttgccttttccagaatgtcatatagttgggatcatataatatgaagctctttcagatttgtgtctttcacttagtaatatgcatgtaagattctctatgtattttcgtggcttaatagctcatttatttttattactgaataatattccgttttctggatgtaccgcagtttatttatccattcttctactgaaggacatcttggttgcttcctaaaggtacatccttcatctatcaaggagtgtttgttttctactacagaatgatacttgtaagccaccagagtctgtactctgatcaaataccaagggcatttgatcagtccctgacgttaaagaaaaatgttaaatgttatttccatttggaagctaatcataaataaatataaagtttcagagaaatgctagtgaaagccactgggatggttttcaagttatataattttaatttacatgcatctttttaggagttcatatcagagcttggcaactataggccacaggccaaatccagctccctgactgagttatatggcctgtgagctaagtatggttttaaaatgattgaaaaaaagtgaagaagaagaggaagaagaagaagattttataacaaatgaaaattacataaaatgcaagtttcagttcctgtaaataaacttatattggaatatagccatagccatttgctactatattgtctatggttgattttgcaattcagcgacagatttaagtagttcaatagacacaatatggcccgcaaagcctaaaatatttactgtctcaccctttagggaaactgtgctgatccttggtttatactattacagaagcaatcataaagttttggaagaatctcggaagacatgtctagtttaggagatatggcttcccctgcaccttaggcatttaaaataacctggcctgtttctttctgaaatgagaatattggatctgaagatctaagtccctcatgcctcatgctattctttgatgcctttgtaacattattcgccccattgtactagtccgacggggttttttcccccactttggtttttattttaaggcaatctcacttcatctctcttttccattaatctgtttgacatgaactgagctaatacggcaatttttgtctctgttcaaaaacttcaagaaattttgagacctcatatttttatctggttttatttcccctcacagtgacgtaagagtggattttgtataatagattgaaatatgttcttttattttgttggatggctgagctatttcacagtggctcaaagagcagtttactttgttccatagcaacaagcctcttgcccaaatttgccatctggtgtttgaagcctgtatcttgcagcagtttttttcattagctgacagccattactcatctgcttttggctttagtattcccgacattctcattattgctcatcctaaatagtcccagtttcaagtaagaaagcacttggagttgtttgcttagcagaagggaatcaatttcatctggaaaacaaggggccagttgagaagatacctgccagctgggaccatgactttattatttgtgaaacttggtttttaatgacttgtgtatatgcttaacagcccacctagagtgtggcctgtgaaggggaagaccaattggccatggtgggtacccactagatggtgaatgagtgaacgggtttcctgcataaatccaggaaaccttgggatgaaaaagcagtagccccatgaagaaagcatcaatcatactttgtaattttgccacatttgctttccaaattttttttagagattacctgaaaataaatctcagggctgatccctggctacctctgatctgatcttctatcagtctttcttgtagtccttgtactgtatccccactagcctctctggtgtttcagaacctgccaagcacactcccattttggggtccttgctagatattccctctgcctggaatgctcttccccaaatgtctaagtggttcactctctccttttatgcaagtctctgcttaaacctcattcttcagagaaaccatcacactccacattttagtctatttacctctctttattttcaccataaccctcactatgaagtatatcttcatcaatttattgttcccagtctctggaataatcctgagcatacaggaagcactcaggaagtactttctgagtgaaaacatgaacaaaagcaagacaaaaatctattaaatacttgatttgtgaattaaggttttccccaacccaacacttccgtgttatttacagaatactcctgtctatttcacatcttgtagctttttgcctctttgctgctcctgttgttaccccttccatcccttttcccacaaccctggatacttaccaagtaccaagtcctaccaaccactgtccaagttctgccttttctttgaaatcttcgctgatcacacttattatctctccattggaacccacagggccattgcacttcctcatcctcccttctcatgtctaattcattttctacctctgcctgtcttaactcctaaaccttaagctctatgagtagagactatgcatatatattcctatttttcatactttgcattttcatatacacttaatgcatatttttagtacattggctagaataagacatttattattaacaactttgtatctaaaaaggagtaaagatgaaagtggagtcactctcaacttctttcctaaagagataagcactgtcattatttagacacctgctatggtttgaatgtttgtcctctcagaaactcatgttgaaactcaattgccattgtaatactattaagaggtggggcctttcagaagtgattaggccgtgaggacagagctctcataaatggattaatcttgttaccatagtagtggttatcttgacagtgagttgttataaaatgactctggcctcgagtgcttccctctttcacatgctcttgcctgcccttccacctttctgctgtatgatgactctggctagatgctggtgccatgctcttggaattcctagcctccaaaacggtgagccaaacccattttgctctttatacattaccaatctgtggtattctgttgtagcaggagaaaatgtactaagacagaaaattggtaccaacaccagggttgttggaataatagatacctgaaaatatgcaagtggctttggaactgggcaatgagtaaaggctggaagaatttggagaagcaggctagaaaaagcctagattgctgtaaatggagcattgaaagtgattctggtgaaggctcagaagaagagaagactggggaaagttttgaacttcttaaagattacctaagtggtcatgaccagaatgttgatagaaatatggacagtaaaggctgttctgatgagatctcagatggaactgagaaacaaggtattggaaactggggcaaaggccatccttgttataaagtagcaaagaacttggctgaaatgtgtctataactgagggctttgtgaaaggtggaatttaaaagtgatgaaataggatatctagctgaagacatatttaagcagcaaagcattcaggctgatgcatggttacttttaaccgcttatagtaagatgctagaggaaaggaatgatttaaagatggaatttataatgaaaaaggaagctatgtgaaaagatttggaaaatttgcagcctggccatgtaaacaacaaaaaagcattctagtgtggaaccaagagaccatttactgacgagattaacacagacagaagagagccaccatcaatacaatgggagatagaccctgaaagcatttcagagatctttgaggctgccctgctcatcacaggcccagagttctaagagggcagaatagtttgaggggttgggctaggagcaacctacacaggctccctgcccagaccgacctcacatctctgcttcctgcattccagcagagagctctttcactgctcccaccatggctcaagcaggtccatgtgtggctcaggccacaacttcagaagatgcaagtggcaaatcttggttgcatccatgtggtgttaagtttgcaggcatgcagaatgcaagatctatgggggcatggcttcatccacctagatttcaaagtatgttgcaaatagcctggagccccaggcagagacttgtcacagaagcagagccactgcagagagccccaactatggcaatactgcacaaaaatgtggggttggggttagtgccagagctgccacagagagtcctcactggggtaatgcctagtggagccctgggagcaggactggcactgagactccaggatcgtggagctactagcatgcaacctcagcctgggagagcagcaggcaggagactccaacctatgaagcatgggctgggtctaggaaagccataggagtggggctgccgaagacctgtgtgcccaggatgcagaaaatggagtcaaagattattctctaaattgagggcttaaagtgttttttcccattgggttttggacttaattggagtctgttactcttctctttttgcctatttttcccttttggtccaggactgtcaatcctatgcttgccccaccattgtattctggaagtagataacttatttgatttcacaggctcacagctgtaggaatatgcctatggatgaatcctgtctggtgtctcacccacatctgatacagaggagactctagacttttttttttttttttttttttttttttttggagacagggtttcactttgtcacacaggctggaactacagtggtgtgatgacagcttactgcagccttgacctcccaggcttaagtgatcctcccaccttagcctcctgaatagctggggttacaggcatgcatccccatacctggctaatttttttgatttttttagtagagatggggtcttgctatgctactggtctcaaactcctgggcgcaattgatcctcccacctcagcctcccaaagtgctgggattacaggcgtaagccaccacgcctgacctgagactctggacttttgaattgatgctggaacaaccacttaagacttttgggactactggaatgagatgaatctattttaggccaaatacagtggctcatgcctgtaattctagcactttgggaagccaaggcaggaagatcagttgagctcaggagttcgataccagcctgggcaacgtggtgaaaccccttctctaccaaaaatacaaaagttagccaggcgtggtggcacatacctgtggtcccagctactctggagacttagatgggaggatcatttgagcctgggaggtggaagttgcactgagccaaaatcatgcccactgcactccagcctgggtgacagagtaagaccccatctgaaaacaaaacaaaaaaaagaaatgaatatgttttgtacttgaaaaggacatgagttttgtaggaccagggcagaatgctatggtttgaatgtttgttttctctgaaactcatgttaatatttaattgccattgtaacagtattaagaggtagggcctttaaaaagtgactgggtcatagggatgaagctctaatcagtggattaatgccattatgaagggagtgggttagttattgtgagagtaggttgttaatgttttctttccttttcttgtttttttgtttgtttgtttttgttttgtttgagacaaagtctctgctgtgttgtgcaggctggagtgcagtggcatgatcttggctcactgcaacctccgcctcccaggtcaagcaattctcctgcctcagcctcccaagtagctgggactacaggcacctgccaccacgcctggctaatttttgtatttttagtagagatggggtttcaccatgttggccaggctggtctcgaattcctgacctcaagcaatctgctcgccttggcctcccaaagtgctgggattacaggcatgagccacttcaccccgccatgttttcttttctctagcttactttagtgaagaatacagtatataatacatataatatagaaaatatgtgttagttaactttatgttgattatgtcgattatgttattggtaagtctttggccaacagtaggctattagtagttaagtttctgggaagtcaaaagttatcgctcattttagactacggtgctcctaacccctgcattattcaaggggcaactgtaatccccttttcttcttgaattactaattctattctacttccctcacagactttttactaatgcaatatatttttatacttgaaagccttctgttgatcaaccattgtagtaaaatatctgtacatagatttaagcatttacagtggcccgggaatataagaaaattaaaaaaaaaaattgtattacacgttttgaaagtaatttgttaagtgtaaaaagtttttttcatccagtttgataatatatctatgaatgattgttagttgttggtagaataaaataaggggcagcatcaattttttcttattttccatttttatagatgtgagttttaggaataattttaacataaatcgagtagatgcgaatggaaaaagtttcattgtagcaatatcattcaattctttgaacttgttatgtgataaatttacatattaatcaatcaaaaatatctttaatgatctgtcaattgataagcaatgaggacttctatcattttattgacagttaaagaccacaatgctagagaaatatcgtagggtgccaggcagaagccttggtaggggcacatttgagcttggtgactatggctattccatctactgtgctgcgtgccttgttccagtactgcatggctactcaggtgcagcccagaaaaagggaaagtgggactcagttatttttaccagctgtatgttaagtaaaagacaatggaaatatgaaataatagatagtgaaatctaacctcgacaaggaaaatggaggaagaagatggctggtggactgggcaaaagtacagggagaaagtaaagggaaggctcttttttttttttttttgagacggagtcttgctcttttgcccaggccagactgcagtggtgctatcttggctcactgcaagctccgcctcccgggttcacgccattctcctgcctcagcctctggagtagcttgattcttttcgcttttgttgcccaggctggagtgcaatggcgcaatctcggctcactgcaacctccacctcctgggttcaagtgattcttttgcctcagcctcccagatagctgggattacaggtgtccaccaccacacccagctgattttttgtattttttagtagagatggggtttcaccatgttgaccaggctggccttgaactcctaacctcaggtgatccacccacctcggcctcccaaagtgctgggatgacaggcatgagccaccatgcctagccatgtttctttcctcttgctgcttttaggattctttctttatccttgatctttgagagtttgattactaaatgccttgaggtactcttctttcgattaagtgtgcttggtattctgttaccttcttgtacttggatattggtatctttctctaggtttggaatgttctttattatccctttgaataaactttccatccctatctcttttcctacctcctctttagaagcaaatctatgagttattgaatttgtgggtttttagatcctataggcttgcttcattgttttttattctttttatttttgtctcctctgactgtgtattttcaaatagccttttttttttttttttttttttttttttgagaacgagtctcactctgttgcccaggctggagtgcagtgtcgcgatctcggctcactgcaacttctgcctcccgggttcaaacaactctctgctcagcctcctgagtagctgggattacaggtgcccaccaccacgcccagctaatttttgtagttttagtagagacgggttttcaccaagttggccaggctggtcttgaactcctgacctcgtgattcacctgcctcggcctcccaaagtgctgggattacaggcatgagccactgtgcctggcctcaaatagcctattttcaagctcacaaattttttcttctgcttgatcaattctactattaaaacactctgggccgggcacattgcctcacacctgtaatcccagcactttgggaagccaaggcaggcagatcactaggtcaggagatcgagaccatcctggccaacattgtgaaaccccgtctctactaaaaatacaaaaattagctgggtgtggtggtgcaggcttgttatctcagctactcaggaggctgaggcacaggaatcacttgaacccacgaggtggaggttgcagtgagccgagatggtgccactgcactgtagcctggtgacagagtgagactccttctcaaaacaacaacaacaacaacaacaacaaacaacagtctgatgcattcttcattatgccaattgtatttttcagcttcaggatttttccttgattctttttaattatttcaatctctgttaaatttgtctgatagaattctgaattatttctctgtgttatcttgagtttctttgagtttcctcaaaacaagtattttaaagtctctttctgaaagattacatatctttctctctcctggattaatccctggtactttatttagttcatttggttaggtcattttttttttcctggaatgtcttgatacttgtagatgtttgtgcctgggcattgaagagttaggtatttattatacttgtcactatctgggcttgtttgtacctgtctttcttgggaaggctttccaggtatttgaaaggactttggtgttgtgatctaagctatatctgctttagggggcaccccaagcccagtaatagtgtggttcttgcagactcgtaaaggtagtgccttgatggtcctgaacaagatctggaagaattctctggtttaccaggcaaaaagactcttgttctcttcccttactatctcccaaacagtctctctctctgttcttaaccacctgaagctcggggtagagtgacacaagcacccttgtggccacaatcacccttatggccacaatcactatgactgtgctgggtcagacttgaagccagcacagcactgggtgttgtccacagctttctgtaatcactccctggctactgtctatgttcactcaaggccctggggctctacaatcagcaggtggtgaagccagccaggcttgtatccttcccttcaggatagtaagtcaccgcagttccctggcagttctagaggtgccgtcagggagctagcgattagagtcgaaagacttagaaagccacctggtgttctattgtactgtggctgggctgaactcaaaccacaagatacagtccttcccactcttccttcccctttttgaaggtggaggagccttaccttgtgtccactgccaccacaggtcccctggaagtcctgccagactactgcctatgttcccttaaagcccaaggattcttagtcaacttgtgaattctgcctggcctgggataaactcttcagagcagtgggcttccctttggcccagggcagatccataaatgctgtgtaagagccaagttctggaactggggactccaggagcctgcttgatgttttattcttctgtggccgaactggtacctaaagtgtaagacaaagtaccgtttaccctctgctttcctcaagcagaaggagtcttgccccatagccaccacagcttgggtgaatgtgctgagtttcacccaaggccctcaacatagtacctggtattgctgctggttattcagggcccaagggctcttcagttagcaggtgacgaatcctaccaggactgagtcttttccttcaaggcatcaggttcccttttggcccaaaatatgtctagaaatgctgtcaaggagctagggcctggaaagacagtctcacacccctgacaggtgccctatcctgctgtggctgacccggtatccaagatgcaagaaaaagtcctccccacccttccctctcctctcctcgagtggaaggaaggagtctcttttggagccatgagctgtgtggcctggagttaggggaggggtgatgccagcactcctgcagccaccccaatttgtgtctcaggaggttgtgttcccccccttcccggcccagtctattgtctctgggcccagttcagcactaggactcacacaaaagttgtagtccttgggacctagactggcttttaagtttattagggcctctgggcactttagcccactgtagtctgtggctaggcttgtggaaactcaagtcccaactgctgggatcagcaattcccctctggccaaggctggtttgaatgttccctctgtgggcagacatcagctaagtttggtccagttttctttctgctataacagaacagcactgagttcggtggctcataattgctatgctctccttccaccagtgcccagaaatgctctccacaccacatcaccacgccctggggggtagggaaggggtagcatatgcaattcaagactggtttttgtatctcttcagtgcctctttcagcaagataaagttaaaaccaagtaccatgactgctcacctgatttgtagttcttatgaaggtgctttttaatatagttgtcaaattggtgtccttgcagggggtgattggtgaagccttctattctgccatcttgctccgcctctccaattagccatttttaataccttgtatcttcaattgagaatttttgaagtctcagattgatattatggcagaaaaggaggaatcacacacagcttgtctttggatgaccaaaagcaaacacctgtcttttttttttttttttttgcctctaaactcaattccatttggtatcaaataccttttaactcagctatagtctcttttaagaatatttacatatttaataaaaaacaaatgactgtgactcactaatatgtgtttcttttcttttctttctttcttttaaagatagtgtttttagaagaagcatctcaacaggaaaaactggccaaagaatggtgcttcaagccgtgtgaaataagagaactgagccaccagtaagttgttacttcttcccttttactgggtgccactaataagcttaaattatagaaaacctgccttgagagacagagagactttaaaaaataatattaatttaacaataattattttgtattaattatttgttaagggaggagatgggaaggagaaggtatacaggaagctgaaggatggaaacttagagagctagaggctgccatcattcatcaatttctttagcatatatttgttgagcatgctatgtgcagtactggagggtctggaggtgaaaaagatcttcaaagtccttgtcctcacagggtttacagtccatggaggacaaagacagtaaacaagcaaacagatacctgcgcatgaccatagtagattgtgatagcttctataaggaaggaaacaaggtggggaggggtatgatagaggttaactattaagaagtagggaggaaagaaaatttgagaatcaattggttggggaagttcagaagcacacttgagctgtgatattatatttcatctacttttagtggtttttaatattcgttatatttcatatataatatatatttaatatatgttatacagttcttaaagaaatgattgggccagccaggcatggtgtctcatacctgtaatcctagcactttgggaggccgaggcgggtggatcacctgagatcaggagttcaagaccagcctggccaacgtggtgaaaccccgtctctactaaaaatacaaaaattagcctggcatggtggcgcatatgatgcctgtaatcccagctacctgggtggctgaggcaggagaatctcttgaagcccggggggcagaggttgcagtgagccaagatcatgccacttcactctagcctgggtgaaagagcaagactctgttaaaaaaaaaaaaaaaaagctcagtttcctcatagcctggttgatatgctttatggaaatgggaaaactttttttgattataatttttattttattttttgtttattttactttaagttctgggatacatgtgcagaacgtgcaggtttgttacacaggtatacatgtgccatggtggtttgctgcacctatcaacccgtcatctaggttttaagccccacatgcattagatatttgtcctaatgctctccctccccttgccccccaccccccaacagaccccggtgtgtgatgttcccttccctgtgtccatttgttattattgttcaactcccacttacgaatgagaacatgcggtgtttggttttctgttcctgtgttagtttgctgaaagtcatggcttctggcatcatctatgtccctgcaaaggacatgaatgggaagacttttttaaagctaaaatattttatcttgtttcaggccaagtaagttccaaggccaataaaattggtaccatttatattctgaaaacactttgataacttgggaattgactttcacgtaatatagagaaacactgtttcacgtaatagaggaacattgaactaggaatgaaaatacctggtttgaatccacagactgtactgtagctttgcagatgttaaaagtcaagcaagccactttccctctttgaggtcatctagactatgaagctcatccctggtcatagtccagagagacagagtgactatttataatgtttcactccacctgcagttttactcacatcccttgcctccttccctctccctgctgcctctctatgggcttggaagtgtgtgggcgctgggcatggaaatgaatatagtagcttctgctgttaccatctacttcctcttgctagattttcatgtaagaatctatgatgaggagcaactgacatttatagtctcctgcttgcgtgtctttgtgatgcaggattagaagaaggcttggaagcagttgaagtagaggctgagatgggatgagagaatggtggaaacggttggaggatggagaggagggtaaacataactgtgggtcttcacttccttttcttcctctttatgaggttgcttttgaaattaaatccatcagaaatgcagattctgggggtcgtatgtaagtactgcacacaaggaagtagtaaggtaagaaataatttaaattttagtagaagactgaagtctttgaagaaagattatatttaaaatgcagagattcttatatcaagcacacaagttatgtgcggttgaatttaagtcatgattaaaataccataaagggatgtctcagacagtttttaatagacttggcccaatacacagtgtatctacaggtctatctcagtactgtctggatttttagaaaagggaaatcacaactggagtaccatgggcagtgctgtggtaggagtgaatcagatggtggccatggaccctggacaggtttgcagggccaggattagggtgaggggagtgaggcattcacctcaggcacaaaatttaaaagcagcgggggaggggcaaaaactcagtaatcaagataaatacttttaagacaatattttaaaatataaaaagtaatgcatggctgggcgcggtggctcaccctgtaatcccagcactttgggaggccgaggcaggcggatcacttgaggtcaggagttcaagaccagcctggccaacatggtgaaacctgtctctactaaaaatacaaaaattagccaggtgtgggccgggtgcggtggctcacacctgtaatcccagcactttgggaggccgaggcaggcgcatcacgaggtcaggagatcgagactgtcctggctaacacggtgaaaccccatctctactaaaaatacaaaacattagccgggcatggtggtgggcccctgtagtcccagctactcgggaggctgatgcaggagaatggcttgaacctgggaggcagaggttgcagtgagccgagatcgcaccactgcactacagcctgagtgagactccatctcaaaaaaaaaaaaaaaattaatgcaaaaactcatgatgaacaaaataccaacattttaaataaagacaagatgttgtttgttttacagccatgcattttttttgtgcaatggaacagtcactttcaaataacatggattctcaggcccatgatgccattgcattactggtagggcaggctgatgatggtgatgatggtttgggtaatacacacatgtattgatatatacctgtattgttttctgattataaaactttattaatgtgttccatttggtgaaaagataggtggatgttctgataagcatatatagggggatatatatatatataaaattttttttgctcaggttatgatacagcttggccaacactgcagatttggaatacctgggggaagttgagattctctgaggaaattatgatgctgattaagtaaagtgagaagaggaaagctgaaaagaagggagaaaggagagcttttttaccttctgctgctgccttcagatctcttctctgctttgcctgcagctgggcttgtagtagctacaatttagccataagtgatgttgtgagtggagaaccgagtttgaatcctagctgagccaccaacaaattgcaagtcaaaaataaacttgcaatcccagaccttccttttgttctctctataaaatgagcaggtgggctcactgacctctaatctcatgtgcactctcacattccatgcttctgtgtgtaccaatattatctgtaattaatcctggactgtaaccttgattctgggaatctttttattaataatcatttcacgatgcttactatttccttaaaaggattgtaacttttctgggtaaaaaaatcacacttcagatgcaataaatccttgcgcttctgttgcctctgaagactttgtactctgaatcatctttcactctctcatctcagctacaatgaacatgctcatttctcctacatgaaaaacataaagtgacttgaactcttcttcatcctaactttcactaccaaatattttaaaagggcgctctccatctgcacaggactttctcaaacactctctttttagcacttagtgcagtaacaaaaacattctagagactcagtgactactttttaaaggaagagctaaatctttccaaaattgggggtcttaggattattcctgaggccatgcatttttgacccttgcagtttttggcactagtcactgccctgctccttcttgaatgtctcttctttactgtccctgacacctctctgtcctgggttccctctaccctcctgacaataactctgccaagattgatcctgatcttttctttctcagtcttactcctgaagtcgaaggtgctgcttaagatgttggtttgttcttccttccacagagaactctggcatcgccaacttctagagttacctatataagaccctcaaatctgaatcctttctttttttttttttttttttttgagatggagtctcgctctgtcacccaggctggagtgcagtggcatgatctctgctcacctcaagctccgcctcccgtgttcacgccattctcctgcctcagccgcccgagtagctgggactacaggcgcctgccaccacgcctggctaatttttgtatttttagtagagatggggtttcaccgtgttagccaggatggtctcgatctcctgacctcgtgatctgcccgccttggcctcccaaagtgctgggattacaggcgtgagccaccgtgcccagcctcctctccttcttttcttctgcctcttctcccttctccttcttcttccttttcttgctcttcttcttccctcctcctcttcctcctcctcctctttttctccttctcctcctcctttctcgtccttttcctcttctcctcctctcctttttctttctcctcatttttcttcctcctcctctctgtctccctcattcacccgtaacctcctcaactagattataaagtctttgacgacaatatgccttatttttctctggactctccacagggcttggcggtttcctaaatatagtagacattgggaaatattatttggttaaacaatttaactgcatgaggaagttacactgctattccgttttatgacgggagagaaagcaaagacccaaaggactgacattgtagagagatcagtgactgatacctgagagaaatccatattccaccctccctttcagagtgcttcccacattataggcccacttaatgctgccttcttgacgtccttaaaaatttgtcacagttctttatttccatagtcagtgaattaacaattccatcacgtggaacgtagtgaccgagagtactgaacctacagacaaactgcctgggtttgaatctcagcgccaaagctgactagttaacagttactttttttcaagctacataaattccctgagctttagcttacccttatgtaaaggagggtaacagtactctcatacttactaagtttcttgtgaacattacatcatcatcatcatcatccataacatttattgatgctttccattatctaggcattgttcttacacacactaaatacatcctcatgacagccctatgatgctactactatctccattttacataaggggaaactgagtcacacagaatttttttttttttttaatatgtcaaatatctaactgctgatttatggtcaaacctgatttcagatcttagcaggccaaaaccagaatgtatacactttaactcaactgctgcccacagatgagatgatgtatgtagaacgctgtgccagtgcctagtgaatgtacatattcaggaaacattagctgctgtcaccatcattattataataactgactacaaaaaagctagtcttttccatgcgatgtagaggctttcttgtagtcagacaagatcaagatgaccactgagtctgccattccttgctcttgttttaaaataaagcatttagagttactcatggctttatttggcttacagttaggtggtatgtatacatttgatttgatagcatgaggaattatttgtaatgttaggtttcaagttcaagttgcttatgtgattgaatacttacctaggataatggtggcagtagagggtcccatcttttggcaaatatctgtttggatgaggttggatacttaatagtgactgtggtgaactgcattagctctttagaaaagcatgaagtgtctgttagcaccatactgcctcaattctgtgggtagtgcctctgaacactttccaggactttctaattataagaattaatagaaatatgaatattaattggtggatcatggtggtagcattagtgatcacaagcatcctgagcatggttgtcacagcatcatatgtaactccctcttcgcttcactacttacaccactgcccgtttgtggtccatctcctgagatcgcctgtccctaaccagcttgctcttgctgcttctatttcagaactcagtttctgtaacacgtgggaaaagactaggtttcttgtagtcagacaagatcaagatgactgctgagtctaaaattgcagccagtctgtttctcacctttagttgcccttagtgactggtgtgcacattgctcagcacggctctagaagttttaaaggcctcctcttccattcttgatctctgacctacaactatcagttgtgagaacaaagtcatgggattaaatcagagttcccgtcctttcttgtgccaccactgctttgcttctgctcaatgctgtgtttttccctcccttcgtcatcactggttaaccccgaccagccattccaacctagaagctatatctctcctagcagagcttcatttttatgtcctgacctctaaataattggagaatttacagttgtctgattgcattacctataaacctgtgtgggtgaacagtgaaatcatgcttgggaaaaaatgtgatttaaaaatatgggaaatgactgaagatattattaaatacttttattctcatcttaatttccagtgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcgtaagtatcttgtgtgtgagtgtggtattctgtttggtcatctatagaaatatcagtttcctaggacagatttaaattataaagcataagcagttaagcctaagatgggccatagagaatttttaagtttctttttcacagtccagtgagtttgtgaccacctcacctacacagctagtcagtggcaaagagagaatttgaatccaagtttccaaaaccccaatctggtgggtttacgttactcttttactttctgtgttttactttaccaaatctgggtttaatgaatatgtgtatttccctactcctgctaatccataatgctgttctgaggaccatatggattcattatgtgacctttgcaaagttatgtgactcacttttcccatctgtaaaaaatagagatcatgatagtacctatttcacaggattctcatgataattaagcaagttaatatttgtgaagttcttagaatagtgcctagcacatggtgggagctctatttgtttgctttaaaaatgcccaaggaaatttaaaattaaatatttaaattactgttagaaggaatatcatgttattctgggagctttgcaaggaaggaaaataggatggtcccatattgcatggcacgtggtaatgtgacttgagcactgacaccactagagggaactctggggctagtacagtcattgaacagtggcagtagtgtgtaccagccatatgttgaaggctctgaaagtgtccttccttctcctctttcaggaaaatcagttcctttcttactccaatcctgtgcccagaaccagaatctactcaggaattagaaacagtttctgcagtaaaggagctaaagcgcaaatgctgccttgtctgatcattatgtcctggtgttcagcgcacttggtctgaacactcatggatttttgtgggacccattgattcctcctaaggtgttcactacatgtggtggtggcagtattataagccttccacatcaactgacctaaccatcttgccagtttttttggtcttgcatcattccagtcttagagagtaaaagcaagtgctttttttttttcttcttttttttggagacagagtctcactttgtcacccaagctggagtgcagtggcatgatctcggctcactgcaacctctgctgcccagattcaagtgattctcctgcctcagcctcccaagtagctgagattacaggcacctgccaccacacccagctaatttttctatttttagtagagacggggtttcaccatattgctcaggctggtcttgaactcctgacctcatgatccacccacctcggcctcccaaagtgtcaggattacaggcatgagccaccgcgcccggccgagcaagtgctaacatttatacacttgcctcacgtaattataaattcagtgcaattgtggatcttacatatttagcatgcaccacatgacactagaaaagctgagaaggactaaagctatgtataaagtagctggtgcattgtgttaatgaatggtgttaaccacaccaaatctttattctcaaaatttatttatgcctcacattgttctaaaaaagatgtgagatagctgaaaattgcgtagtatacaacaaaagaaaatgagtcatgatatcaaggcaaagaaaaaaaagggggaaggaaaagtaaaataaaaccaagaaaacaatgtctactgtgggggtccatgcatttgttagtttgtcatgaatttggctttagatttctagaacctgacccaaagagggaaatcagttctgaaatttacactgcttttatgattaaaaaacacatttgttaaggtaaagcatatctatgcttcatactgaaacttaagaaaattaatctcaatattccttagtgtggatagacactatgctgccaaaatatatattgtaaagattctatactatcaagaagtccagatagatcattcttttatgtttagagaggtagagtatcaaagactatatatttttcaggcagtactccatataaattatttctgacatcagagatttgtttaagtatttgatgtcaggccgagtgtgatggtggtttaagtatttgatgtcaggcctgtaatcctagcactttgggagaccaaggtgggtggatcacctgaagtcaggagtttgagaccagcctggccaacatggcaaaaccctgtctctactaaaaatacaaaaattagctgggtgtggtggcatgtgcctgtaatctcagctactcaggaggctgaggcatgagaatcgcctgaacccggaggaggaggttgtagtgagccaagatcaggccactacactctagcctgggtgacagagtgagactctgtctcaaaaaaaaaaaaaaaaaaaaaattgcggagcacatatcctatgttctttcttatgtgtctgataatgaatgagtgtgggcccacaaacttttaagttggaggcactgagggtatggctgacatctgtttaagggtgtggagatgtgttaactagccacgtagcctactcagtgggatgagctcagtgggaataaacagtagtagctttgggtttccttcctcccttccttcttccctttctcaggggtctccctgtcctgtccctttactgtaattagggcacttcctgaactttctagtgttttcagttcattctagttgtggaaagaaaaacttcacacaaattaaatttaacagagtaaattgagcaaagaacgattccagaatcaggcagctctcagaaccaggaaaggttcagaggactctgcccagcaaggtgggcaggcagcatttaagacagaaaatggaagtgaggtatagcaacagcttgattgttacagctctgggtttgccttattcaaacttgttctaatcacttggcacctgtgactggctagagctcagctgctgtgattggctgagactcagctatttgttacaaaagcatattactaatcaggctttcagtgagttgataaactaagttaggttgcagttccttataaactcaaagttgagaagcatgctcaggccaaatttagcttgctttaacacagtccaatttgaagtttcaatttctcattcactaaaatcttctcccatataagccctgtacctcctggtttgggcctgacactgaggaaggggcttactatcagtgtttgtgtagtgcttctaaataaccccagctttccgtttcaatttcatctttaagtcaagattgtagaaaggtgcttaaaattttgaaaatttagaaaaatttagattacatatccgttttaattttgagttttattttagtttggttagtaaatgtaatgtgtcatttttcttggggatagctgagatttatgacctaataaaaggttaatttttatgattattctgcgattttttaaaagaagactgcattttctctgttgatttgacatttttttctatctctatgagatgaagttgttaaaagtcttgaacacttctattcttttgctgcatattctcccatatggtaagacaagaacattttcattctgttcccttcttcatccctaccttttttgctacgtcctatgttatatcatctgagattttagttccatttttttttgccgtgtatactatatttaagataatatttaacttttaagtttaatttaaaaaaattatctcaatttaattccagttttttattttaacatctgcacttaatttaacaatgagggccgggcacggtggctcatgcctgtaatcccagcactttgagaggcctaggcggacggatcacctgaggtcaggagttcaagaccagcctggccaacatggtgagaccccgcctctactaaaaatacaaaaattagccaggcatggtggcgggtgcctgtaatcccagctactcaggaggctgaggtgggagaatctcttgaacccaggaggtggaggttgcagtgagccaaggtgcaccattgcactctagtctgggtgacagagtgagactccatctcaataataataattattataattataatttaacaatgagctttgctttttattttgctacttggatccctgtcttcattcatttttgttggaatatatcctctgacaattctttccaatcaggtgagtgataaacattctaaaacctagaattatcaaaaatggctttactttttttttttgactcttgaacaatgccttagctgtagagagaattctatttgaaattatttatctatcagcatccaatgtgctgacatcaatgtgattctcatttctttctagttaattttctggcctttgagatttttttcttcattcctgatattctgaaattgtaattgttgatcatcccaattcattctcagtttaattcttcaattcattctctttaatacatagttctttcaataagagaacttctgtcttccttctgtttctaggaattctgttatttctctttctctttctctctctttctgagtatattcctctcttcaatctattcttccttttgataattactattagaaaaatattgaaacttctgttctgttttcatgtctctaaacttttctttcacactacattcttaggaaatggtatgggccagttttgtaaatcattaactcactcttactatttataataacctgttcctctttcaagatatgacatcctgtcctattcatcaaaggatgctatttttcattcattttatgtctcttgttgttttagtaattctgcttcctcaggtgttcattcagtaaatatttactgagcacatcctagaacccatacacttttctagttgctggagattaaatttgatacctttgtcatggtattggctttccacctggatttgtgatggagagctcatccttgtctgtaattgacaggttctaaacatcctctgctggtggccagatctttttgttttacatgaaaattatcttaatatttggaaaaattgacaggtttccaaattcttttgacttttggggctaaccaatattactgagttctcatttgcttttttgaaacaattgactgggccaggtgtggtggctcatgcctataatcccaacaactttgggagtctgagggcaagaggatcacttggggccatgagttcaagaccagcctgggcaacatagcaagggcttgtcttaaaaaaaaaatagctaggcatggtggcatgcatctgtagtccctgctacttgggaggctgaggtggaaggctctcttgatccctagaattcaaggttacagtgagctgtgatgtgtgatggcacctctgcactccagagcaagaccctgtctcaaaaaacaaaacccaaaataacaacaacaacaaaaaatggaacacactggatctaattagaggctactgtctaaggtacggcatgttcatttctattatcctaactccaaactatttcaatcctgcagacacttgagcttctgatgtctgtactagtcaagaaaaccctgttttttcacaaaggaggaaacatggaatgtaagcaaccttctcaaggtcacgtagctaataacaggcaaaacgtaagcaagagccactgtctggagggttttcctctgcatttaaaagcttctgctaaagatatgccccaaagtattcaatccactagtcctttttccaagtgctcagacaggtcaggcaatatccgttccattttctttcttgaagatcttctcacctcctcccattctcttgtttctggtcagcattctctgtagcactactgtaatcttggcattctctttgcctctttcctgcgtttaatgcccactccctggatccaggaattactttggattactcttgtgttttactaaaagacagtttctaaaagcttcctaagaaagagttcatggagagtaaaattttcaagtccttcggtacttaatcatatttctatgctaccttcacacttgattgataatttaccaaggtataaaattatatgttaaaaataactcctgttgtgacaaacaacttatatgtacttgtgggaagacctcctttttaattgctagaacatgagcattgcattttttgcaagtacttaattgtctgtgtatcactgtggcccttagaaaattttctaaagtacttagaaaatagaaacctatataatagagcgttttctattttctaagtactttaattatttacttaggatttttggttacagaatgatatatatgagttgaatttgaaggcattgttctgcttccagcattgttagtgagaaatccaatgtcgttgtgagtcctgtcatttatctgtgaccagtttttttttttttcctggagtttttagcatcttttctgtacttacgaacttaatatctcacaattatatgccttactttgggttctctttttattccctgtgctgacaattctatgaggattttaattttggagatgaatattatttttcatatttttgtcccttccatttatttaaaaaaatttagatttcttattctaaatgttggattgcctagattgagcctaattttcttatgttctcacctttgattttcatcttttccttttcctgagcaattctcttgtaatttatcctacaaccctcctactggcttccacatttcatttataatatttttacttttggagagctcctgcattctgattttcatagcattctgttcttgttttgtgggtgcaatagtgtgttttatttctttgaggatgtgagtcatagttgttttttttaactgagcttttttctgaccttatagattatgtttcctctaagattttttccagattctttctccccctccttatctttttgataatagattccctccaatgcctatcaaaccctggacatacattcatactgtgatgctataaggtgctgactggaatttctgggtggaggtatcacttgttgatggtaacttcattataggatgagtagtgaaggcagtgaatttgggtcccaaacgtcactgtgaagacatctttcttttagagccattcattttctctagaaaataatcgtttagtcccctgccaggagttgtgggagtagtacacgtggtattctggggaaaatgactgagtgcccttgaggtcagccagattttcacttaaacctctgctttaccttctcttttggagcttgtaccctctaaatactatccaggttctataaagagtaaatctctcttataaggaagaagttaagggtggttggctgatttcaacaaggttcctgccagggtttaatcatacctgcatagacttccagccagtcccctgctaaaacccacacacttctctccttctttccaagttgcttccaggttctcgtccatgttttttgtcttccaagaagatattgaaatgttttctctgctcatgtctctcctctcatgttcttcttgtgggttaataacgtttgtactcctttactgtcatgtttgttgtagtttgcgaaggaaaggagatagatatatgtgattaaccttccaggttgagctaaagtctggctgaatatttttattctgtagtagaagaaaaacttatttatgtactcccagatgcaataaaatttggatatccttaaacaatcctaagaaagaaggaattcattagtatcacattttaatgaattctgaagcacagaactgtgtgaatcgagaaaaaatcagaagtatcagcttctcctccagctaacttttggaatataaataccttttgccatttacctaactgtactctacatcaagatggcatacctttaaataaaaacattttaaaattaaaaactaaaattctgttttcctctggatgtaccatgtgacttttctgagcacacgtgattcgcggtttttgtgatttatttttagaggagaacactaaagaatggaacaaccacagcttgttactttgcaacaattcacactgactcatctctgctccttgccgacattacaggtgagcaaatgaagcatgatttatgggcacctcaagcaaagacagccagaccatcgtggcaaacaacttatatgtacttttgggcagacctgccttttaattgctagaacatgagcattacattttttgcaagtaattacgtgtctatatgtcactgtggcccttaggaaattttctaaagtacttagaaaatagaaaactgtatcatagagtgttttctattttctaagtactctgattatttacttacaatttttggttacagaatgatatatatgagtctgaattttgtgtattaatttagggctttttagggaaactttactaattctagttgtggtaatagtttcttatatcagcagatacatggtggctattggctagagtcagggcactgtgctagatgctggaaacgcaatgagataaaaaatagtctctgcccttgagaagccagacagaatacctacaccattgatcactaaccttagtaacaactatggtgctgttactagacgtctagcattgtgcaaagcactctggaagaattagttcagcagcaaacagccttctgaagtggttactgatgtcctcatgttacagatggttagactgacgctcagagaggataagtaacatgcccagggttgcacagctagtaagaagagctgattctggattcgggttgatgattccaaaacttgtacccagcacagtacctggcacatagcaggtgctcagtaaatactgttggctgatacactgatgccactgtttgcttatgcaaaagacctgacctaatgggtgactctgaaaatagatactacagtcttcagagaaggcaaagagaacccagaactacgacatctgggaaggctttatgaaagggtcctttaaactgggctttgaagtaaagacaagatgaggagaggacaaactgtcttctagataggggaaggacacaggtatgggaacaggagtgtcaatagtggatgcagggaccacagtagtttaactagaggagtggattcatcgcctgggggcagtgggagaagagggtaggcagatgggagggttcacattgtagaagagctcaaatatgcaccaaagactcaaaaaaggttctgagtccaggtgtgagtgatgtgatgaaagtggtattttaaggaagattaatctaatggccagttatctaaatgaattacaggggaaggagagaggcagaaaggtttttaaaaatctcttatgacagagatggagacactgtaaaaacaattaccattgtcccatatagcctcagctttcttgctgaaatagaattcttccagcacctttgatgaggactaggttctagtgctgagagctgctagtaagactgcgtaaaattcctcacagataatattggcattgtttcagttaagaatagtatggccaggcgcggtggttaatgcctgtaatcctggcactttcggaggccgaggcgggcggatcatgaggtcgggagattgagaccatcctggctaacatggtgaaaccctgtctctactaaaaatacaaaaaattaaccaagcgtagtggtgggcgcctgtagtcccagctactcaggaggctgaggcaggagaatgacgtgaacccaggaggcagagctttcagtgagctgagattgtgccactgcactccagcctgggcgacagagtgagacgccaccttaaaaaaaaaaaagaatagtagcagtatgttgcctagataaccacatgcctgacaccttatatatattattgcatgtattcctcacaaccctacacatagcagagaacactgtacatatataggtttagaccttaaccaaataatatccaccacctggagtaatcagaggaataaggaatcagtccaaatctttccaattccagtgctcatgttcttatccctcagccattctgtgttttgtctagaagaggaccatgatagagagagggagagagagagatccaagggatggtggtagagtaggagacaggagggagattgtaagttggggtagaagaagctgagtgtaggtatgccaatgactaagagagtctttctttaggacctgagactgtttgctcctttaccatgtgataaaatgagagcaaagatagttacatatttaatgaaaatatagacacactggataagcaaagggaaaaactgaataataacttaaaaacacccagccaagcacagtggctcacgcctgcaatcccagcactttgggaggcccaggcaggcagatcacaaggtcaggagatcgaaccatcctggccaacatggtgaaacactgtctctactaaaaatacaaaaattagctgggcacagtggtgcgtgcctgtaatccaagctactcaggaggctgaagcaggagaatcacttgaaccagggagttggaggttgcagtgagcccagatcacgccactgcactccaggctggtgacagagtgagactccgtctcaaaaacaaaacaaacaaacaaacaaaaaaaccaaaaaacccacctgacagcctgagaatggggatgggggaggtagtgggttaaagtgatgaatagaaaaacttttactgtttactgaatatagtagggaatttgtggtggttcttgttcttaagtggtgtgatggtggatgatcttttacattttcatttatgttttccatatatgattttaatttaaaaattactgttgaaagcttagaaaaagtactgttttggccgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcggtggcgggcgcctgtagtcccagctactcgggaggctgaggcaggagaatggcatgaacctgggaggcggagcttgcagtgagccgagattgcgccactgcaatctggcctgggctaaacagcgggactccgtctcaaaaaaaaaaaaaaaaagaaaaagaaaaagtactgtttcagaaacaaacatgccttcatattctttttgtgtatactttacagataaatttggacagcgggcatttgtgggcaaagtttgcatggatttgaatgacacttttccagaatacaaggagaccactgaggaatcgatcaaggaaactgagaggtaaaaggcccatttgtcttgatttgtcttacaggtgaattcctgtgctgcactgatggagttagagatggaaaaaggaaacaggatactgttatcacccagttgggatgtgcacatagtgactcagaatgttctgtttaatgcaatgggtcggttagtctacagtgaatttgatcaaacactcgataatcattaatgatttacaaagagctttcctttgtagtgccacacttgatcctcatagaaatctccatgaagcatctgtctttttatttattttttatttatttttattttttttttttgagacggagtctcactctgtcatccaggctggagtgcaatggcgtggtctcagctcactgcaaccttcagctcactgcaacctctgcctcctgggttcaagcgattcttccacctcagcctcctgagtagctgggactataggtgcatgccaccacactcagctaatttttgtatttttagtagagacggggtttcactatgttggctgggctggtctcgaactcctgacctcgtgatctgcccgcctcggcctcccaaagtgctgagattacaggcgtgagccaccacgcccagcccacatctgtcttttatgataaggaagctgagtctgacataggctaagaggcttgctcacagtcatacagcttttaagtagtggagccagaattcaaaaccagggtctatgactctaaattcaaagttcttttttttttttcttttcttttctttttttgagacagactgtcactctgtcacccaggctggagtgcaatggcgcgatctcagctcactgaaacctccacctcctgtgttcaagagattctcctgcctcagcctcccgagtagctgggattacaggcacgtgccaccacacccagctaatttttgtatttttagtagagacgtggtttcaccaggttggccaggctggtcttgaactcctgacctcaggtgatccacctgccttggccacccaaagcactgggattacaggcatgagccactgtgcccggctcaaagttctttctctcatgatatagatcacacctcatattcaatgtaagtaaagagaataaaagagagagaaacagagggtatgcaagaatacttgctatggcatgtgttaatttaaaaatgatgatggaagtgaataattatttgtgaaataaaatagtatacaagaagttaggaaaaatgagttatagttacaggttaatgaaagactttcactacaaaaggatttttttaaaagataccaaagtaatatgtgtttccatggtccagaacttagagaaacacaaaaaggtataaagaagaatttttttttgtaatgaaaccaccaaaagttaccataatagggtatcttttattgttttctcaaggtggtatatgcatccttcactactatttcgtcctaccttgggaacaggaaagttgttctggatgtatgctgtaatggccataacaggctaatatagggatctagaatatcccctctccacaaaggtgacctgaaagaacatctctgcaagctgaaatgcaggcatacaggagggaagatgtggttcctttttctgctttggttctacatctgtgctcctagggaatagggcctcactctactacctgtaataaaagctctgaggatgttatgtggtgacacaggctagagagagaccatgggagggaccaaggcccactctgctgctgctggacattgagctggattcccaaagattgtggacagcctactttggaaagatttccacctcaaagaataggataccatatgcagatagaatcataaaaagtaaagatgtgcaaggaaaatgaaaacatgtttccacgtaaagacttgcaggtaaatgttcatagtgacatcatttatagaagacaaatgcagagcaggttcactgcacataggtatcaatcccaggggaggactctaaacacctcaccaatactgcacaccacttgcatgaatctggtgagacagcacacttatacaacaagttaagcaaagcaagtttattatgcacagataggtagcaagggacaatagaagccttggtgaactgatcctccacggctcaggaaagttgcccaagagtctcatatgtgcatgccccacatcacatcatagctgagggaccctgtgagcatgctctacctgtggttttatacccagatgaaactggtctcactgagctaaaacattgcagaacatcctgttctaggagaaatgggaacagaacccaggctgttctgaccagtttctccatatctcagggtggttgcatttccagcacattctacagttattctgataactacaagtaagaaaaggggaaaaactgggtcaccaaggccatatgagaacttgtcctgcaccaaatagtggaaacaaccaaaatgttcataactggtgaatggataaacaaaatgtggtatacaatggaatattattcagccataaaaaggaatgaagcactgatacatactacaacatggatggtttttaaaaacactgtgctaagacaaagaaaccaaacacaaaaggccacacattgtatgatttaattgatatgaaatgtatagaaaatgcaaattcatggagacagaacaccagcgattgcctggggctggaagtaggaaaaactattttttttttttttgagacggaatcttgctttgttgcccaggctggagtgcagtggcacattcttggctcactgcaagctctgcctcacaggttcatgccattctcctgcctcagcctcccaagtagctgcgactacaggcgcccgccaccacgcccagctaattttttgtatttttagtagagacagggtttcactgtgttagccaggatgctctcgatctcctgacctcgtgatccacccacctcagcctcccaaagtgctgggattacaggtgtgagccaccgtgcccggcccaggaatagctattaactaaatgggcccaaggaatctaactggggtgatgagaatgttcaaaaactaggttatgatggtggttgtaaaacgcaataaatctactaaaaatcatggatttgtgcacttaaatcaggtgaattttatggtatgtaaattatacttcaatataaatagtttttaaaaatagcagtatgtgggtgagattgtgttcatgtacatttgtgttttctagttcacatccactttagataagagttgagtagaaagtgattagatttttttaaaaggaagattttgtacagaataaatagctgtgagcatatttgcagagactccagctctctgtgattttctcctgtggtacagtagtgcttctcttgatgcttctagcattcttcccctcacttttctcccttaatcacacattgttgaagccaaaaccaaaaaacgcctgagaagctcaagatgtattaacacactgcgtcgaattaaagttgaaagatgattaatgcactgaggcattcttcctatttgccaaggtcactgtgtgggtttgtccaacttgaatgtcaatattatttttgtgtaacaaattatatttaaagcctgcaggaacttgctataggagtcctagggtaaatcctcttgtaaaatgaagtaaatcatttaccctctccctaccctttattatagaccagggcttctcctgtagattggatttgcttttaagtacatatggcctgctcattaaattacttttggttgtgggtcatactatggcttgagattatgaattttcattatgttctttttcatacaacattgggagattctactgaccatataaatacttttcttatattttaaaatggcatttctatagtaccttaaggatttgacaagaaattgtattggtttatttatttatttttattttctattttttattttttttttagatggagtcttcttctgtagcccaggctggagtgcagtggcacggtctcagctcactgcagcctcccactcccgggtttaaacaattatcatatctcagcctccctagtagctcggattacaggcccctgccaccatgcccagctaatttttatgtttttagtagagatgaggttttgctacattggccaggctgatcttgaactcctgacctcaagtgagccgcctgcttcagcctcccaaagtgctgagattacaggcgtgagccactgcacctggccaaaatgtaattttattctgttcaacatctaagagatacagaagaaaatgctttagatacaaatctttgccaagaccaaacatattctgatgcaggttttagaagttcagctttttttctgttccccagacccctttccccttaaaagtgtcctctgaaaagggagcagaggggctgcttacatgctcacagagaggaggaagtacccgccttcctttagcatcagcctatcccagcttatctattaatccatttttgtggtgatagtaaaccttaattctcattttgttctgaaacaaaggaatgccagaaggcagaaaactacagctgcctagggagggcagaaagagccatttcatagtctttacagttgccaccatccctgcaggcataaactggtgggatcactaccatcccattccccatgcacctcacaaccaactctcgccttttccttctgctttactccaaggttcatccccaagagaactctacccttgtaaataaatggtgatgttgtgggaacaagtagcttccactttaggagaattcgaagtaaagagcttcatggcttctaaaagcctccaagtgcataggacttcatgactctaacaaccgtagagcataatatattgcaacatttctccaaacggagcttgagctagtagaacagcttgagtgctgtgggaatatttgagaacagcccgaccgatgctagatgataacattacgtttccctgtgattttgcactccatctctggctgcaagtaaaaaagcagagtaattactacttgttaatctttaattagtggtggtggaacatgtgcagcattagaaatgtttgcatgaaaatcaggatatgtaagaatcatgtttttatctttttaaaatgtttatttgaaaatggtcggccggtcgcggtggttcacgcctgtaatcccagcactttgggaagccgaggagggcggatcaccaggtcaggagatcaagaccatcctggctaacacgctgaaaccccgtctctactaaaaatacaaaaattagctggacgtggtggcgggtgcctgtagtcccagctactcgggaggctgaggcaggagaacggcgtgaacccgggaggcggagcttgcagtgagccgagatcgcaccacttcactccagcctgggcgacagagccagactctgtctgaagaaaaaaataataataaagaaaagaaaaaaagaaaatgctcaagttttctaacccatttgttgctttatttcagatttgtgtcagaaatgctccaaaagaacgtgagtaactttgttcagagctcgcttttagattgcctttgcattagctgtaggattcataaagttgcttgatagtgattagtctgtgtacgactggcttatctcatgcatgtagaagtatttacctagagcctgatgtgtcactgtggactgtcactgtcagctcagtgaagtcagacatttttaaaaaattatcttaaaatatttaattgacaaaaattgaatccactcaaggtgtacaatgtgatgatttgatatatttatacattgtttattgattattagaatcaaatttgttaacacatctattcccacacacgctgtacactagatcctcagaacttgttcatgttataactgaaaatttgtaccctttgaccatcatctccccacataagccagcaatcccacttttgggtgtatatccaaaagatgcaaaataagcatcttgaaaagatatctgcacttctatattcattgcagtatcattcagaatagccaagatatggaaacaacttaagtgtctgtagacagacaaataaagaaaatgcagtgtatatgtctatatacaaacacaatggaatattattcaaccataaaaaggaaggaaatcatgccatttgtgacaatgtggatgaacctacagcccattacaataagtgaaataagccagccccagaaagacaatactgcatgatctcacttatttgtgaaatctaaaaaaagtcaaacttatagaaacagaggtcaggcattttttgctttcttgggggcagctctgtacctagccctctgtgttttgttttaaatacattttgaaataatgaaatattaatgattttagtggatttgtttagatatcgttcacatatgtacaaacatcaaacttgctttattcttaaaattgtgtgtacttttcttggctcccaaaccccatgcctacatgcaacagaaaaactaaatttcgtcaggcaggtaaacttcgtcttaagttcactaagcttttagttgatccaatttttattaggacaatctcagtcactgctcaggttagagttaccgtctcagggtaggtttttcttcctcagtggttttccttacccccctctgggatcttctgatttcacaggattggtttctggcaagcagggacagggcttgatgggcgtgggctgactggtggcacctggaagttggggactgcttggtggccacctcaacattggctctggccacttgtgcccttggtctgctctgtaacacaggcagtgtctagtcctatgcccctgccactggctgtcttggtccctatgtgtgtgacacctcacatggcctgcaggcatgcagcaggcaccccctattgtggtcccctggtgttggtgagcctgtggagacaatgctgtttcctgcctccacccctaacaggctggcatgtggctctgtcaagcaatctcttagactggcaagcctgacccttccctgatcatcttttggggcctgataggaaatcataagaaatctcaaaatttctttccatctaactttgggagatttagatgaaactttgtagatccttatcctcactacccctctatgagtccttctctcctgcctggccactcacctcaggtgccaccagagccaatcctacaactgaatagtgctcaggaaggctgtaaccagcacacctggacaagatgtattcccaaaatggaatcggctatcacctcacttttagtctccccagcactcttttaaaacttcagcctccacttttcttcataaaggctacccagtctagccttcatcagagccttaatgtggtggcagaggagcatctgtcatttgggataggatcttttgttgaacttgggtgctgaagaagataccctcctttattctccactttgagctgttttcatgaaaccccgtacttccaccgactgttagaatggaggactgctccccaaaatgaagacacaaaatcatcttgctgtatgatatgcattttggggtacccttcacattcatgatatccatagtttcctttttttgaaaaaacttttaagttcaggggtacatatgcaggtttgtttacacaagtaaatgtgtgtcataggggtttgttgtgcagattatttcatcacccaggtattaagcctactacccattagttatttttcctgatgctctccctccttccatcctctacctgccgataggccccagtgtttgttgttcccctctatgggtccatgtgttctcatcagttagctcctacttataagtgagaacatgcaatatttgactttcccttcctgcgttagtttgctaagaataatggccttcagcttcatccatgtccctgcaaatggcatgatctcattctctttttatggctgcatagtattccatggtgtatatgtaccacattttctttatccagtctatcattgatgggcatttaggttgattccatgcctttgctattgtgaatagtgctacagtgagtgtatgtgtgcatgtgtctttataacagaatgatttatttccttttggtatataccctgtaatgggattgttgagtcaaatggtatttctgtctctaggtatttgcagaatcaccacattgtctttcacaatggttgaagtaatttacactcttaccaacagtctataagcatttctttttctccacaacctcaccagtatctgctatttttctgactttttaataatatccattctgactggtatgagatggtatcttattacagttttgatttgtatttctctaatgatcagtgatgttgagcttttttttcatgtgattgttggctgcatcaatcatatgtaaaacagtgaaaagtgtctgttcatgtgctttgcccactttttaattgggttgtttttttcttataaatttgtctaagttccttatagatgctggatattagacttttgtcagatgcatagtttgcagaaactttctcccattctgttggttgtctgtttactctgttggtggtttcacttgctgtgcagaagctctttagtttaattacatcccatttatcaatttttacttttgttgcaattgcttctggtgtctttgtcatgaaatcttttcccatgcctatgtcctgaatggtattgcctaggttgtcttccaaggttgtttttttgttgttgtttggttggttttttgtttttttttgagactgagtttctcttttgttgtctagactggagtgcaatggtgagatctcggctcaccacaacctccgcctcctaggttcaagcagttcccttgcctcagcctcccgagtagctgggattacaggcatgcgccaccacgcccagctaattttgtattttttagcagagacagggtttctccatgttggtcaggctggtctcgaactcccggccctcaggtgatccacctgccttggcctctcaaagtgctgggattacaggtgtgagccaccacacctggcccttccagggtttttatagttttcggttttacatttatgtctttaatccatcttgagttaatttttgtatatgatgtaaggaagaggtatcaattgtttttaattatctccagtattctagagtgaagcccatagtgacaccacgtttttccctctcctgctctgagactttgatgggtgaactgggcaacattgctaaaacccgtgatttgcacattcaggtgggtattcttcttctctttatgcctctatgcagacctgcaagatttctcagcacccttaaatcatcatttccaataatctgtagttgttttactgagtaatctgtttcttcaactgagatatcctagagtcacagcataacaggagagaaaggacccctgtagatatcacctaatccaattctttcattttgcagataagaaacctgaagttccttataccctcaatgttttctgatcagtcttctaaagacaagaaaatcgttttaagtagtggcaagatcaataacagactgtgatctgttctctgtaggatacatttaatgcatttatttcctacttctctttcacttgatactttctcagtgtgttctgtaccttcattcttagagaaaccagctattatttgaaaagcaaaaagagcctaatttccaccttacaaaatagcatttaaaatcccttttgttctgagtttcttaatttaaaatcagaacaaaaaagtataccttgctttgtcattaaattgttgcaatttaggaataaaacacttttttaaagcttatatctgggttaaaattgagagttccccttctcccatccaagcttaattacatactgtactaaaatttctcctcttaggagttgacggtcttataagaaaggtcagatcagggcagagacaacacattgattctttaccatttgtaaatcagtgtttttttggtttttgtttcccaaatctattttcttaggaaccattaaccgctctcaccttccctattattgttattattatttgcagcctataatttttgaatttttaattcagtcccacacatttctctgctggagataaaattcaaaacttacctgatgtttctgctttgcaaacaaaatgcttctgtcgccgacaaaataaaatacacatgaacatttaaaaatacatgaaaaataagatgagaagaacacacaacaaaatcaagtttatccttgctagagagatgcatgtggatgtatgcacatttactcacatttatccaaatgactcgaatcatcagattgtcctttcttctgttgctgtccatgcatttcatcggtggtctgggacttcctcaaggccagggatggagttcattgtctgagtaaaacacgtgttttcagaacattgctatttttttcttttaaaaatttagctacgcatattctaaatggcattgccattcttggaagtattaattatgccctcttagattttgtggtgccctagagaaaggtcttaggggcctttttcagtgtgggggcataggacttattgttttgcttgcatgtggattcttatgggctgtttcttgatgaccgtggaattttctagctcagctattttcaaactcttttttggagaactcattctggaaactaacaaagggcacagaatggagacagggtcccagagtctcaatcctgctgcatccggaggggcagtgcttttatgccttctatatattgggtttctgtgaatttttatatgaataatatattcagtgccgagagaatttggaaaatcactcatctagcccaacccttttttttttttttttttgaaagatgggaaaattgctgtccaaagaaaagaatgactttctctaggacacatagctgtcagaacttgggccaaacccagctctctttactcaaattccagtgttcatataagtgaaccccactgtctgcttttttatgaacactgagctcttttcttaaacggccagtatggccagtcacggtggctcacgcctgtaatcccagcactttgagaggctgagcccggcagattacttgaggtcaggagtttgagaccagcctggccaacatggtgaaaccccatctctactaaatatacaaaattagccaggcatggtgacacatgcctgtaatcccagctactcaggaggctaagacaggagactcacttgaacctgggaggcagaggttgcagtgagtggagattgtgccactacactccagcctgggcgacagagccagaccctatctcaaaacaaaagaaaggccagcaccagaagaggcaggttgctagggtcctgactatcttcaaggaggacttcatatttgttccagctggaggtcagaatttgaaaagactttgttggaaaaatttgtcttgatattatacatacacatacacacccacacccacatccacacacacacactacatgttcataatattcagtttctttgtcatatacattatattatctatgatgaatataattgtttctaacaaaatgcatgtgtaatcttcattgcctttctatgtggtcccttaaataggcaagtagaaaaccattcacaccattttgaggtaggaagtgtaatttctaatggtattttacagaagaaaaatgaaaatattatttttttcttgtagagccatataagtgaaaatcgtgatgaagttgaagctgtgaaaaacttataccccagttataaaaactacacatctgtgtatgataaaaacaatcttttgacaaataaggtaagttttatatcatgacataatctgtttaaaggagggcatatttatctcaattttaaaatctcaatagtaatcttcagatttctgatatgaatacatttctttaaaaattttttttaaagttttaatttttgtgggtacacagaaagtttatatatctatggggtacatgtgtatacatttcttaaattagagtaaagcctagtgtgtgtgtgtgtgtgtgtgtgtgtgcgtgtgtgtgtgtgtgtgtagttaaaaatggacccgaagtttcatcttagtgaattaaatgtaaaggcttcattgaagatgggaatgtcatttggtccaaggacattttaacagtatctattagaatgtaaacctacatttctttgagtcagcagatgcatttctaagaattcactctaagtaatatgaatagggatgctaattttatattaaagtttaaaaattgttatcggtgagggattaaattacagagcatacataggattttatccagcattcacaaagaaagaggtatgcaggcttacaaggaagaatgtttgtgtaatattatttgatgtgtatgtacatatgtatagatgcatgcttacttagaaaaaaactgtctgaaagacacaacttgagtattaaaaatgactcttcctgagggacaaaccagaaggactttctgctttttatttttaaatactctgagagtgcttttaaaaaatgagtatgcattactcctataattaaaattaatatgtgtgaagagacctcattacaataatgtactacttggccttggccttcaatgaaatgtacaaaccgcatggagagtttaccatagcaaataatttcttagtgactgtgtgaatggagatatgaatataactgatttaaaaggttaatactttgcataaatcatgtaaaagctacaccatagttttcattctttatatattttccatatgattaataaattaaccttccatttgcatgttaattttatttgaacagagattgggaaagttatattttaataataattctgtagtcactgggccgggcctggtggctcatgtctgtaatcccagcactttgggaggcagaggcaggcagatcacgaggtcaggagatcgagaccatcctggctaacacggtgaaaccccgtctctactaaaaatacaaaaaaattagccaggcgtggtggcaggcgcctgtagtcccagctactcgggaagctgagataggagaatggcgtgaacccaggaggcggagcttgcagagagtcgagattgcgccactgcactccagcctgggcgacagagtgagactctgtctcagaaaaataataattctgtagtcactgaaccgtgcctctcaaaggggaaagcaagttgggtacaggttttgtactgagagaaaaataattttgaaagagtaaagtcttatttaagaaaatctacaaataaatactaccaacattaaaaatttagagaggtctcatgtgtgtgcagtgcctgctttcttggatcaattttactttctgaattaatgattataagatgttaaatttcctagtttttatgaaaatataaacgtaggtgagttaaaagtttatttagttgaaaatatcaaggccattggcacttacattgaagctaggagcagaaataaagaacagcgctttgcaggattactctcacagctttcacatactgagaagggacttttagttctagaaagtttttttagaattggagcaagcacaacactaccagttgcttcccatataaacttagaaaagaaagtaacttgacagtcttctaaagtagagatgagaaaatcatgttatcttccatctggatggatattctgtgctgtagatcacctggaccaaaccctcattactttatagatcaacaaaaagaatctaagtaaactccacaaatttcctgagactttcgtaagacaatgtgtttacaggccttttctaaggtataacttgtacctagcaactttgtacatatagatcatcataaatgttcttgtgaagatgctaacagccaagctacagcttcggtctctctctaaaataccttgtgagtgagtacccacttaatcatttgtgagcggtaaactccacgtagggcactcttctctccagacagtgatggcacacggctgctacctctctgcagaagaactgaacgtattccatgaacgaggagcatccatcgcacactgtcccaattctaatttatcgtaagtagacaatgattgtttggtagattacgaatgattgggttgcagattagcagccaaatgcctttgtttcctctgtcattcctccaggatctcccctctattctgtgtttggcaggacccagatagatagacatttactcgtgctgttgaggagtaaaagagaacacgtaagaggacatttatctcagaggacacgtgaagagcacagcatcttctgaaatctctgagtttgtacaaaaaaaggacaatagggaatacaacataaaaaatttacagtgaaagtactgaaagaacccatatgtcagccaggaaatccagaagagggtagtcactcccattactgtttgtgctgtagtgtgagaaggaaacacagcaataccaaagcaaatgcactatgatgtatgttaccctgttggacctgacggaatgccagcccacacaggcaagcccaggaggaccttgtcctattataattccccagaatacagaggtgttatttattaactggttcttaaccttttgaaaggtgatggatccgtaaatgaataaaatgaaagttattgcctgggcgcagtggctcacatctgtaatcctagcactttgggaagcagaggcaggcagatcacttgaggtcaggagttcaagaccaccctgaccaacatggtgaaaccccatcagtattaaacatataaaaattagctgggcatggtggcaggcacctgtaatcccaaccactcaggaggctgaggcaagagaatcgtttgaacccgggaggcggaggttgcagtgagccaagattgcaccactgcactccagcctgggtgacagagtgagactctgtctcagaaaaataaataagttatagcctgtaatttcaggggaaaaaagcccatggatattacaagtgttgcatctaatttcagggaattcatagatctcatgatgccagtccatggatgctaggttaaaaacccatgcttgtggctgtaatctcagaaaacaacttcaggggtcgggcgtggtggctcacacctctaatcccagcactttgggaggccaaggtgggcggatcacgaggtcaggagatcgagaccatcccggctaacacggtgaaacccagtctctactaaaaaaaaaaaaaaaaaaaaaaaaaaaatattagccgggcatggtggcgggcgcctgtagtcccagctactcgtgaggctgaggcaggagaatggcatgaacccgagaggcggagcttgcagtgagccgagatcgcgccactgcactccaacctgggcgacagagcaagactccatctcaaaaacaaaacaaaacaaacaaacaaacaaacaaaaccttcagggaagtaaaacagggaagggaaagaagtcagtgaagatcgtatcatcacggaagttaccactgtgggctcccggagtttaatccttctatttaatagaaaactcaggtaaccagtgtccaaaacagaactcaaagttatcctgcccaagaagtgagggagctggctgtgacagtaatacccaaatgcttatgggttgttgttgagggctcctgggcagagtggagaagagtattaattccctggaacttctggccgtccccaaacaagggcagagcaggctctagcacaggagagagctgagaaagctcctaggcaaagagctggaggcattcacagttggaaatctagggactttgcaaattacaaagatatatgtcagtgtcattatgggaagggtgctgagagccacagtgacatatttctggagtgctttagggaccccagaggttctgagttttcagacttaaaggagtgacacagggaatcttgtctatgtacagcttagtgactataattagggtctagttacttgatagtggaaggatttaacacccattgggtgttaatatcctctaaattaaagcataatctagctttgcaaattgagttttgaagttaaatttctttaggacacatttctgtttaaatggtcactgctgttctttctccagcaactgagagatttattatgtatgcaccagggctttcaaaattagagttatgtgcatcttccagcaaaccactttgacctttgcaactttttagaattctaaggatcaccttagttttcctttgtctctttagaaaggcagcacatggtgggcatggtggctcatgcctgcagtcccagcactttgggaggccaaagtgggaggatcacctgaggtcaagagttcgagaccagcctgaccaacatggcgaaaccctgtttctactaaaagtagagactggacatgctggcgggcacctgtaatcccagctactcgggaggctgatgtaggagaatcgcttgaacctaccttgaaggagatggttgcagtgagctgagattgtgccattgtactccagcctggatgacagagacagactctgtctcaaaaaaaaaaaatatatatatatatatatatggctggcacatctctttagctcagagtcacaaggtcccaaattcagcccaggaaccatctatcctactttctctgtcttcagaggcagcgtttgaacagtcaggtcctgactttttaggctgcacccctttttctagttgtactcccctttttcgatcttaaagtcactactcattcagggtaacaaattattccaggcagagagaataggtaatgctttataatttctgcttcctaacataaaaagatgtgttggttagaaaatattaaagacagataaaagacttttgtattaattgcaaagtttgatttcttcatttttttcccatacaaacgatcccctgcttttccttctggctcttgctgctttgtgcccacctgagattaaccttggcccaaggattaggctattttatgatcctgtttactccaggacttggatggtctgatttgactaatatgtttgtgtcaacattagagccgatatattgggaagcacaattttcagtggcatcaccgtcattgttattagtgttcatcttttattggaaccacatggatctccttgttctgacatctcctctctctacaggctcagcagtggatttctaaatgtgctagaagtcctgaaacatgaagtcaagatagggctgggtacaggttagtagttcaccatttggagctatggcaaagtggttgattactgtgtaattttctaatgtgactaatttgcaggtgactgttctgtttaaaaaaaaaaaaaattagttttgggccgggcacggtagctcacgtctgtaatcccagcactttgggaggctgaggcgggtggatcatgaggtcaggagttcaagaccagcctgggaaacctcgtctctactaaaatacaaaaaaatagccaggtgtggcagtgtgcgcctgtagtctcagctactcgggaggctgaggcaggagaatggtgtgaacccgggaggcggagcttgtagtgagctgagactgcgccactgcacttcagcgtgggtgacagagcgagactctgtctcaaaaaaaaaaaaaggaaattgtatgcaaagggagaagttttgatgatactgacctcctgaaagctgttatccctgtttattattcaaagattaggctataaaggatgattaattccttctgacgtgtttcagaggtattctaaaaagtccttgacttttgttttgttttgttcttctggctaggttttaatggtttggatttctatatttttagttttcaataactgtcattacaaatgctgtctcaaaagaaatttttttgtccttgccatagtgagcacagattcaatctatgacagaattgagaattcggatgtatgttaagaattggttttgcttttaagcaacgtttagccaaatgagacctctccatatccacaggcagtctgcttgtctactaggctgagggatgttctaagtgcatatgaattagtgacggattagtgatgtttcctttcttcacagtacattttaattgtgtttcttgagagtgtgcaagcgttgcttgcttcgaaagtgtgagtcaggcccaaatttctaggtgtcctctgtgaggcttcttttatgactgaatgactgaattaaaaatttttttaatgggtatggggcaggaggacgtgttttctgttcttgatgcctttatcttcctcatatttaagagcatcaggctgtatgcatgttgacactggtggttttcatcactttctgcaggaactcaagtctcagtttgttatagtgagacattttacaaagtaattaactggtaagacacaataatacgcataatgattttactgatattttgaaagaggtatatattagattagaagtttttccctattttatgggaatcaaagtaatcaagattttgaaaattctaatttaagcctgaaatcatcaagattgtgataattctacataaagtcacaggtgttaaaggaggaaaccagtgattttatgttcacaaaaaagcttcaagggataagaaaaaaatggccaagagttttggttacacactatagtcagttaatatgaaaaatttagcagacacataaaaatcagtcagatattgttttcagatattctaggattttggtctccataatttaagttcatcacatgacttccttttcttgactttggattgtttagtgatggtctataaagttcaagttgagttctagctgtcacttattatctgtaagaccttgagaaaattaattttctagtagtttttagtcaaggattcatttcctgatttctacaacaatagtaactagcaattacaactatgtctatcttacaagctgtttagagaattaaactttaaaatgcatgcaaattggttagcacagtgcctgcctggcacatgacacaaatcaatcaagattggcttaaaaaggaaagggcgaagttggtgtattgaccaaacgtttgaataaatatgacctattagcttatttactcagaggatggtgtttcatttttacctagtcctttttgcaatttagtcaccctctactctactatttcctaaacgtgacttttgtgtatcaatttacccttcaatttgtaaactttagaagattattatacctcatactatgaatagagagcaagtccaagagcaattcacacaccctgtctataacaagtgcaggcagatcttgacttgcacaaatattaggtagaagaaacccacatgaaatttaacagaaatatagcaaaacaagataaagtgatatcacaaacaataagaatgtgaacaaatatctgaaaatgatctgctttaggatccagaagaaaatttcagaaaattgccttcatccctggagtacaggaaatcatggttctatgaaaagattgtggtagaaattttagaaatcaaggaagaaaactgaaaaaaatcagattaaaaagcacatagactctcatacactgatggaaggagagtggatggtacaactactttggagaatgttttgggagtttcttctaaagttaaatatacgtctacatatgacccagcaattttactcttgggtatttaccctagagaaataaacatatatgtttgcagaaatagttgtatgaggcccaggtgcagtggctcatacctgtaatcccaccaccctggaaggccacggcaggaggattgcttgagctcaggtgtttgagatcagccttggcaacatggcaaaaccctgtctttacaaaaaatacaaaacttagctgggcatggtgacatgcacttgtaatcccagctacttgggtggctgaggcaggaggatcgcttgagcttgggaggtcaaggctgcagtgagccatgttcatgccactgcactccagtctgggtgacagagtgagaccctgtccctaaattaataaataaatgaaagaattgtatgaggatgtttatatcagctttatttataatagccccaaaccagaaacaatccaaacatctatcagcaggaggatggataagcaagttgaggtatattcatataatgaaatattatttagcagtaaaaaacacactacagatatatgcaaaatgtgggtaaatatatgccagtgtgtgggcttaaagagcacacactgcatgattccatctgtatgaaactcacagaccaacagaactaactgatattggtagaaatcagaaagtggttgccaaatgttgtaggtaagaatttggggaattgacaggaaaaggccatgagggaatttgctggggtgatggaaatgtttaatatcttagtttttttgcaaaatagttaatgctatataattgttaacattctccaaactgaacatctaagttatatatgtattatgatattttagttatacctcagttaaaaaaatgacaaacccaccaaccctgtaggaagctatgagaagcagaattattgttacagaaaatcaaatcagtgatgtgagaataaaatcaaccaaagatgatagaaggtgtttgaggatgatcgatgtgaagcccagaaaccacagagccaacacatggggtttttttctgatggagcacccagaacaaatgggacagatgcaatagtcagagctttgaagggtaaatcttttctgagcttaagaaagaactgccttgcaagtgcttaccctgttttacgctaaatcgtaactgaacatgttgtgacaaaatattttaattacaataaaaaaatttctacaatattgacacaaggaaaaaagtcaattatcaacaaaacaattaaaaaccagtttgctttcagatgtttttgttggcacacaaaataccaaaaggcaagaaaagagtttggagacaaagcagtgttagccaagaataatatatctggccaaattctcctttatgtaggaaggcaacaaaattctcagctatacaaaaacttggaaaatattttccttaggaaccctttgaaaaacttacttgaaaatctacatcattcaatgaaagatgaggcaaatgaagggccatggggggaaataatggcacaatatgatgtcatggaaagctaacatcaatcagaataagaagatcaaagaattgtaaaggagtttaaaaaatgaaagtaaaagccaaaaatatatctcaagagagaataggcacaatgttaaaaacctatcagaatggtaacataaatcaggaagatgtttccctcaggctggaaagaggttcctgggaccgaaatacatggcacttattttaaaaactgagtgttaggtccttgagttttggttttatgctttccttatgtcatttgaatgtcttcagtattttatcacaaaattttaaaaaataatatatgctctgccaaggaagaattttccaagtataatacataattctgtcttataattttattaacaaaacccaagaagttgtagtttatgtgtaaggctgagaggaggatgtatttggcaagtggccaacatggtgaaacacatttctactaaaaatacaaaaattagctgggtgtggtagcatgtgcctgtagtcccagctacatgggaggctgaggcagtagaattgcttgaacccaggaggtgaaggttgcagtgagccgagattgcaccactgcactccagcctgggtgacagagagagactcaaaaaaaaaaaaattccttgtctcagaaaaaagagaattgcacatattttacttttgacttttcagtataaaaatattagagataactacttgaagaattttaaagataggatacctcctatgtgaaatatgaaaaaaaccataaaaacaaagaaaacatagcaaataaccaaaaacactcatctgaaggaaaaatttaaacatatagaacaagtttactaaacaagacctataaactcattaaaacaagcaacatacatggagccagtgcctcacttttcagtgacaattccctatcctaacttacttcttccattattccaaaaacaacagctctttgatctcttgtagactctagtccaatgactccatgctttctcaaaatccattattctaattcgaattcttagatgtcagagtacatcactataatcatttccttggaaacattctcgcttttcatattcccctcattttctttgtattcacattgcaaaagctccacccttgattatctcaaaagtccccttctcagtgcctgcagtggagcatctggaggttgctggagaaaatcctccagtgggctttcattttaaattttgttctcaaatcccaaatggcccaccgcttggggattagagacagttattagtctgtaataagcgtatatctcctttttccaagacagcgttttctcatttcttcttaaactttctaccccaacttctagtttaaggcctccctcatatcataagttattgagaaatagaaacgaccagaaatccttccctcaatctcccaccacgaaattcacacacctttctgcatctgctgggattttctcttctttgccctgttgcagcaaaaacaacaacaacaaaacccttcttccaatcaaaggcaaaaataccaaaataccccgacgtgtgttctgtattctttccctctcccagcatctcaataaactaattcctttggccatagaccgtcctgtatcatcagtgtctccttcctgctggatcattcctgctggtacacaaacatctctagtatcttcttttaagcaaagaaacaaaaccactcctatttttttttttttttttttttgagatggagtatcattctgtctcccaagctggagtgcagtggcacgatctcagccctctgcaacctcagcctccagggttcaagtgattctcctgcctcagcctcccgagtagctgagattacaggcgtgcaccaccacatccagctaatttttgtatttttagtagagacagggtttcaacatgttggtcagtctggtcttgaactcctgacctcaggtaatccacctgccttggcctcccacagtgctgggattgcaggcataagccaccacgcctggcacaaaaccccttcttaatcagacatccccctcatgctcctgctccacctgtctgcctcccttcatggcaaagcttcttcaaagagtggggatccacactggcaccactttctaggcccttttcccttcctccaccaacttcagtctggattcttgccccaccctccgtgacaactgcttttgcttttttctcctgtgggtattaccactggaatttctgctgccaactccaaaggatgccattctgtcctcatccaatgggacttgtcagcagtatttgccatgattgactgttctctccattgtccaagtaatcttatcttgaatcctatgaagcaccttcgttcttcccttctttctcttctctgaaggctgattctcttcctctgggccatttgaaagcttgcttcaagggtcagtctttggcagtctctttgactttacacattcttcttaggaggtgccatccacaaccatggcttcatgtgatttaatatactcagatgacacacaggttcttatatccagcccagacttctctgaattctaaacctatgttttcaactgactacattctcccttctcttagacccctcctgaaggaacccccgaacttcattctatcccaaaacacatttaaacctagttctctaaaatagctctcctttttagagaattcatttttgctaactggaaacttgatcattatctttgggaccttcttctccctcacttcttccccagcacaatgcccaacctcatgactccttagtatctccttgaaccatcccctttcccctcattggtcactaccacctgatgcaagctgccatcgtttcctgctgaactgctgcaccagcttcctaatgggtctcataccatcctaggcccttccagtccattgtgatttacaaaagaatcacaatgaaaatctgatcatgtcacccccttgtgctcgtcacccttcaatgcgattttgagtgtgtaaggctcattacaaggcccacaaagctctgcaatggtttgacacccatccactgcccagcctcatctcacactactctctcctcctcaccctggctatcttttatgaatagatatggcttttatgaataacctgactatcctctctataaatcatactcccttctctcaaaagtcctgtatgcattgtttctctgtctgaatgcccttttggcctctgtttatatggctgagttcttctcatccttgttgtagtttaaatgtcattgccttaaagaggtcttccctcaccatcctatcaaaatgggcccttcatctccattttctttatcactaaagtgaaaacaacttattgttaatatatgtctgtttatatgattcttttctttctccccaacaagatagttaacttgctcatgtgggaagcccataggttttatttacaagtgcttaagtaaatcaagcacatgcaaggagtgtagtaaatgattgctgaataagtgaatgaatgcataggaaatgagcacatacctatgaaatcattttttaatctttccattgtcctctggcttaagtttttgctcttgcataattttgttagagtcttcttgtaaataatagtgtccaaatgttggctctgacgagcaagtaatgataccatcttcattgtgatggtcctgggggagtagtggggtaagggggcagatcttctgagaaaatgcttcaattttccttcctcctccacacagtttccaccctttggtcctcattcttcagcacttcagttatgtaactgaattttctctgcaattattaagatatgtgatgttatttctattttctgagaaaattgagattcacaggtcctaagtaactgatcaaaggtccgcaaagcaaaaagttccatgcgcacagtttaaaaccaggtctgtaaaatgtagatattcgtgatttctctttctatcctaccacagtgcctctagccatatgacaaagtagggattccacctacattaaatgtgttgtagatggaaggggaaaactacaaagctaatccagtcgggaagaatcggcaagttactgtcacagtggaaatccctggaaaaaaaggcttgactcttactaaataccatgaaattatgcagcccagagttctttctttgatgagcacaaaattgttttttggtttacagttattttactgacataacattggcaaccagaagaatataggatgattaaatcaacatcataaggcatctctcaatttttttccagtaaattgcatagcattatttcctaatttatacttattctttctgtaaggttaattttgagtaggtatttaggaaaatgctactttctgttatattttataccttatttttaaaactgcaggtatttaagtcttccatattcataccatcccaactgcattgctttcatttctctatgtttacttccagtcgttacccatatattataaaatatagttagtctttacatattttataccacatagtgatataatttttattccacctttatttatatttaacatttttgttgttttagcaataaagaaggaagcagcagacagactatttcaaagcttaatgtgtgtagttcccaaattgtatttgttttcttagtatttgttttcctagctatgataaaaatgaagatttaagggatggttactacatattaacacagactagtaacttaagtagatgtaatgaaattttttagagagctgggtgattctctaatttaaatacaagtttaaggacatgtaggatagttgaacataaaattgagctacaatctagaattactactaaataggcaattattttgttttggcaacatatatagaggcactaacaattacatatgtctacctagaaatgacagaaggaacacttgaaatatgaagcttactttattagctataagtgtgtttttctttaataaaacatactaacttacttgaaatttatttatacaaactcacttaactccatgttcattcttgttaaaggtagtatttcatttgattatgattagggactttatttaaatcactaaaatttcattcttcatttaatgatgcctaccaaaatatagagctgtctacattagcactgctcatttattacactaatttcccaaaatatacaagtttattctaaaagctcttcataaaaattacaaagaagtggctttttaatttcccaaagttctcatctggattagaacaaggttaggataaatttttagtgaatagaaccatgagcttattttaaaccacatattatctaaattatctttataactatgcaggcatatttcaacaatttctgtgagagttcatggactcttcagagataagagtttcttttggctctttaaaccatttgagtattgtggtgggttgaattgtgggtccctaaaagatgtctatcagaatctgtaaatgtgacctcatttggaataaaggtctttgtagatataattaaggaagagatctcaagatgagattattctaaaatagagtgggtcctaaatccagtgatcaatacccttagaagagacaggaaaagagagacaaatagaagacacagggagaagagaagaaggctatttgaggatggaggcagagattggagtgatgctgccacaagccaaagaatgccaggagccaccaggagccaccagaagctgggagaagcaaaggagaattctcccttagagctcttgtggggatcatggccctgccaacactttaatttcagacttctgacctccacattgtgagagaataaatttctgctgttttaagctagaaaatttgtgataattagttgcagcagctgtaggaaactaatacaagtatgcatttgacactaattacagattttgaattgctttaaatcttagtctacgactatcttgtgtttatagttaagagctttttaaaaaaagtatattaaggactgaatatctgtcataaaaacaatgttatatatgtattattccatttatcctcacaaggttactgttttggttttattttacctactgcagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaaggtaatgactcttacatttttctctcacacaatatacaaccatgctgatcggtgtctttggatgtagtatgaagatgcatgattggtattaggaaaatccaatatttgtgatgatcacatctcatgtaacatacccagaactcagccagtaaagtgaagttcactgaaggaggaatcattccttagtgaattcactgtctttggtagaatagatgtctgagacacagttatcatattaattgttttaatgggtattacattggttacatggatatgagtgctttaaaataatccattcttaggccaggtacctaagaatcacagtaacttacgtctgtaatcccagcactttgggaagctgaggcaggcagattgcttgagcccaggagtttgagaccagcctgggcaatgtgacaaaaccccgtctctacaaaaaaatacaaaaattagctgggcttggtgaagtgtccctgtagttctggctacttgggaggctgaggtgggaggatcatctgaacccggggaggtagaggctgcagtgagcagtgattgtgccactacacttcagcgtgggcaacagagtgagaccttgtctccaaataaataaattaaagaatccatttttccactaagtcaagtaacttgctctccagtggcctaagtgatgatcataatagtaaaatagtagccaaggcttacttaagctcttcccctgtgataagaatcataccacatactttatatgtgttgttatttaatcctcaccaccactgttattcatttcgttttacaaacaagaagcctgagtgaggcttacacagctgtcaagccacagtgtgctatgatttgaatccacctaatctgatgccagcatgcagatttcttaccttctgcccttccactacagtatcttcctgtataaatccctgccaagaccatgcatttggttcatatacttaagtacactaattactctttaaaaggataaagatgtaaaaatttagttggttgatatgcaaatattgctcatcaacttttcccaattctcacgtgtaactgtattgttacggaaaaaaataaaaattggtcactgtatttctttaagtcactttagaattatacatgtaatcagaatggatgatagtgaaacacagcatgaaaccataggtagctagtgagaaattaaaatgtagatatagatttagaaacatattgggtgtagatttatgatagataccctgagtcttacaaatgaaggatgaccgaagccaagattatcctgggaagagaaacttctcagatgttctctgagtgttggggactatgatgaacaccataagcacatttcaagaaaagcaaatacaatgttgttttttgtttttgttttgttttgttttgtgatttcccaaagtattatggttcattttccaaaatcccaagtttcaaatcacccactattttaataattgttacaacctttcacccacaccaccattgtcttttcacatctgaatctgagtttgagtagttattctaccatctatgtttgtggtacaaacgagttgtatttaaagagtgctttttgaattctagggctctctgtaagttacttcatcaggatcctgtttctttgatcaagtcagcatgggtgcctaccaaatcatttctactttgctgtgtagcttttaaatctattttctgggtcactgggcttactcatggaatttcttttccttagtttgtttctctactatagtcagagtaaaatgagatgaatggatctgtatttaaagtgtggcattttcccagaactgccatggcctttacattcattctcaagaagatcaagatgagcagaaatgatcttcacagaaccaacatttactccaaaggcatcaaaactctatttcctgaaatgcatttgagtcacttaccagcccagtgggatctctgtgcaacaatttgaatttatatcagtttacaaattcactgaaaagaattgtgtcttttttggttagttcattcctgaagtctccaggctctactgaataacccagttggtttatatataccatcaaacttgcctaaaccctagtcactgcacctggttatctggcctattaaatgcacagtcagtaattcagtttaattcagttgaattcagtcattaaaaactcatacttgacatgtttctttgtcaagggcaaaaagaagtcaagtaatcagtgaaggaggagagaatttccagtgattttctgttacattcagtcctttcccatacaattagtagaagtcacctggctccttttaacattttggattattttcatacccctgtcttgctaaagagagtactttagctaaaaagccatttttcttttctgagaataaaagagttgccctttaaagaatcttttaagaacaagtaagatttctgagtcagtgtttagagaaatgccacaacttctggatacctataggtagaaatataatgtattagatattgcctaacaaaggtagtcgattcaatattttcacatgaaactttatcttagcggtgatagaatgcaacaaatacatgtgaaaattgaaataaggctgagcacagtggctcacgcctgtaatcccagcactttgggagtccgaggtgggcagttcgcgaggttaggagatcgagaccatcctggctaacacggtgaaaccccatctctactaaaaatacacaaaaaattagccgggcgtggtggtgggtgcctgtagtcctagctactcgggaggctgaggcaggagaatggtgtgaacccaggaggcacagcttgcagtgagctgaaattgcgccactgcactccagcctaggcgacagagcaagactccgtctcaaaaaaaaaaaaaagaaagaaagaaaattgaaataaataatactgcactccagttaaccttccatgcttccatttgtgaccccagtttacaccttcctcagattacaggctttaaggaactttagagccaatacctctgttggcgaagaaagccaactacccccatctttctgaaactaaatcataataatgagagatgttcttccttgatatccaataatcttggaacatgaattgtagctatgagatgagccaagtcaatagatattattggcctgtgctctattttagaagaccattcttctctggtgaccagaaaacctttgaggttgcaaagagattggtctgttttcaaaagcattgagacttttgagttatgagaatctgttcattttgagaagtgaggttttttttccattcaaaggatttaaactaaggaatttctgatggatatgcctgcattgacaaatatgcaaaaggataattattttttatttattcaaggttcatttcactgccatgaaaataaatcttgtcagctatttcatggaacagaaagaacaaaaaaaagcaaggcaaggagttggagtgttgggggagaatagaagggaaaaagaataaaggtattatgttaatcatcatgttgcttagagggataaatgaaaagcatagaccagctgggctatgaagtgcactgatagagctgaaatagagacataccagagttatgatacagtaatgaagggaattgttttcattctcagattttgctttcctgtgcttactccactttatgtaagtagaagtcttgtgacctgttagaatgagagtgattttctgtctcactgttaagatactaatttttttttttctcctagcgacatgttggcaaaatctgtccttacaaactgagacattagtgtggtctgatggcttgcaatcctgactgtttattcacttgttctcaatagccctggggctggatggtgagattggaaactttgaagtgggcaaggaatttgatgccatcctgatcaaccccaaagcatccgactctcccattgacctgttttatggggacttttttggtgatatttctgaggtaagtaaaagaaagttaatcaaaaggcatttatttcataaagtcgtcataatagcttccctgtagaaaagaaaatagaaaccgaaactttttaatggaatgcaggaaaatcttaaaatggacgctagagccctttgataattattataattttatgacagcaatgttaagaataatggtgttaacaaaacttttatattttgaatgtgtttgtgtatttgaatgtatttggctacaaacagccataatgtaactagcactcattgaacacttgctatgtgctgggtaggcatgggattaggcacttccatacctaattttgttcgatcatcagagcaactctaagagagtaggtactattaatattgccatgttaatttataggggcagtgaggcttaaggaaggctaagtgatttacgtaaagactcatagccagtgattagtaggtagagtttggattcacacctgggactttctgactacgagaggcgaggctcttgagcactatgctatgtcaatgtttttaattttataagaaaatgaactttgtttctcttattataaaatgtttttctatggataaaataaactagttcatcttacctgaaaaataattccttgtaagatattgagttcttcctaaaaaaagaattaagtattgccatttctaaattgatctacttgtgagagtaattgcgataataaatatgttaaagattttaaaagaaaaattctgtattatatgaagtttgtaccatttgttattataaaagaggaaaaatatatttttctctacccatcttagggtcaaggctgaggtcactataacaagagacagatttaacaggagaaaggcatacacatttatttaatataaatttttttgagacggagttttgctcttgtcgcccaggctggagtgcaatggcatgatctcagctcactgcaaccactgcctcctgggttcaagcagctctcctgtctcagcctcccaggtagctgggattacaggcgcccaccaccacacccacctaatttttgtatttttggtagagacagggtttcaccatgttggccaagctggtcttgaactcctgacctcaggtaatccacctgccttggcctcccaaagtgttgggattataggcgtgagccactgtacccggcctatttaatataaattttatgtgacataggtgccttcataaggaagtgaagaacccaagaaacaggtaaacttggatatttttatgctaggtttgatgaagagtggaaagttgtagagaaatatgataggacaaagagtgtggtccagtggtaataagctagagagaacttagcaaggcctgcttgttcagattcttctctgtgatcctttagcttcagagatcaggtatagggagggcaccccttacgtgatggtcttatgacctgcattggggtaaggggtaaggggagggtcagagtgaccttcctgtgtttgatttgagggtagcgtgtcctgaccccctcattattttcatattgcttattcttttactctctgattagagtaaatttctaagaatagggctctagggaatagtcctagtgatttttcttatatcaggggtgtccaagggagttcttagtttctgtttcaggttgtgccagtaaagccccctccctcatccctcttttctgcttatcagtagagacagaaactaaaaaccatggcttcaggctgctaaaagcctaaaacaaaacataacaaaacagaacaacaacaacaaaataaggcaggttggatgagcttgtcttacatcatacccgtcttgaaatatttgaattattttactaaattaatttctttaatttatataataccttttctctgatgactcaaaattcacatacccagaactttcacacaataggtaaacttctgttaattgccagtgggttattttttgttctgggaggtttttataaagcacatagccacttcttttttaattaatagaagtagattttgccattgagaaacaaattcgtatttctgggctttgtcaaccactatcagctgtgaatttacttttctaaatgcacaaatgagtctttcttattacttttattttccattttaggctgttatccagaagttcctctatctaggtaggtagatgcatgtctctatgctaaatattaaatagaacctttccctgtctttttcttgggtatggctctatgtatttatcctaccatatattaaactctgtggatgataatttgctttgattcattatttttttaacagtctgaagcatcaagcccattggtggcacattatttaaaggttctatttgaaatgcacatgactccctctagtcataaattctaagctgaggaatggaaggccaaaggtgaagagatcttcatgttcaaccctcttgtactcattcggtatctgacatactgccctgccatgtttttgtgacaaatgtatagtagagtctcaccacacgtgctggtgatgtactcacattcaattccattcactgagagagagagaaacagtaatgcagaatattctacactgcctcccattctgttcagtgagcccaggactgagtgaactcaagatggaaagatgcatgtgttacttcttgtggagctgattctggagcgtaaagagtagtatttctttctcagtgggggcaaaatgtaaaccaaccacttcagctgagaaaggacagctatagggggttgattcaactttatgtgatttctgcctctggtgcagaattcagaccctaatcatcaaattagctatggcattttctactagtcatatcttcctgttcagattataaacaatctgagggttgggggaaagcagcttttagtatttcctctcctagaagtatctttaaaaaaaatctctcccaatggcaaggaagatacttattgacacaaaaggattttatacatgattccttgatttttctttcaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggtggagttagaaagtcaaaaaatagtaccttgttcttgggatgactatccctttctgtgtctagttacagtattcacttgacaaatagttcgaaggaagttgcactaattctcaactctggttgagagggttcataaatttcatgaaaatatctccctttggagctgctcagacttactttaagctcaaacagaagggaatgctattactggtggtgttcctacggtaagacttaagcaaagcctttttcatatttgaaaatgtggaaagaaaagatgttcctaaaaggttagatattttgagctaataattgcaaaaattagaagactgaaaatggacccatgagagtatatttttatgagggagcaaaagttagactgagaacaaacgttagaaaatcacttcagattgtgtttgaaaattatatactgagcatactaatttaaaaagagaacttgttgaaatttaaaacgtgtttctaggttgaccttgtgttttagaaatttgcacttaatggaatttgcatttcagagatgtgttagtgttgtgctttgccttctttggcgatgaatgtcagaaattgaatgccacatgctttcataatatagttttgtgcttcaaagtgtttgacagaagttgggtattaaagatttaaagtctcttaggaatattattcatgtaactccatggcataaatagttgtatttttgtgtactttaaaatcaacttataactgtgagatgttattgcttccattttattagaagagaaacaaattccatgctttatggaatttatgtagactggagtcttcgtgaactggggcaaatgctggcatccaggagccgccaatactaacaggacaggttccattgccatggcctattccacccaaacaatatgttgtagtttctggaaattccatactcagatatcagtctgctagaactttaaaatgaaggacaaatcctgttaaagaaatattgttaaaaatctttaaaccctgtgtattgaaagcactctattttctaattttatccagttttctgtttaactccttataatgtttaggatattaaaattttaggataatgaagagtacataatgtcctacttaatatttatgttaataggacttaattcttactagacatctaggaacattacaaagcaaagactatttttatgcttccataacctagaattaaaaccaaattatgaccttatgataaatctttaagtattggtgtgaatgttatttaaattctatatttttcttatttaattacaaatactataaatgagcaaggaaaaggaatagactttcttaatatattataacactcattcctagagcttaggggtgactctttaatattaccttatagtagaaactttatgtaatatagctaactccgtatttacagaacaaaaaaacacagttccccctcctgtagtataaattttattttcacatacttagctaatttagcagtaattggcccagttttttccctaatagaaatacttttagatttgattatgtatacatgacacctaaagagggaacaaaagttagttttatttttttaataaacaacagagtttgttttgtgagataagtatcttagtaaacccaatttccagtcttagtctgtatttccaatatttctaattcctgagccacgtcaaagatgccttgccaaatttctccccatttctctacggggctagcaaaaatcttcagctttatcactcaacccctgccaaaggaacttgattacatggtgtctaaccaaatgagcaggcttaggaatttagatgagatgtgtaagattcacttacaggcagtagctgcttctagcatttgcaagatcctacacttttaccttctttaagggtgtacattttgatgttgaacatcagttttcatgtagacttaggactcatgtgcagtaaatataaataagtgtagcatcagaagcagtaggaatggccgtatacaaccatcctgttaaacatttaaatttagctctgatagtgtgttaagacctgaatatctttcctagtaaaaataggatgtgttgaaatatttatatgtactttgatctctccacatcacttataacttatgtgttttatttctccaagtgcggtgttcctgaatgttatgtatgcttttttttctgtaccacaggcattatctatacctggggccagattttctgcactttgaaatgttgcctttgcctaatgtaggttgactttctgaattgtggagaggcacttttccaagccaatcttatttgtcactttttgttttaatatcttgctctctgacaggaaagaaacaattcacttaccagcctcctcaccccatcctccaccatttccttaatgttccatggtattttcaacggaatacactttgaaaggtaaaaacaattcaaaagtatcgattatcataaattcacaaaatatttttgcaaccagaacacaaaagcaggctagtcagctaaggtaaatttcattttcaaacgagagggaaacatgggaagtaaaagattaggatgtgaaaggttgtcctaaacagaccaaggagactgttccctaatttattctcttggctggttctctcattgaattatcagaccccaagaggagatattggaacaggctcccttcatgccaagggtctttctaagttaatactgtgagcattgagcccccattaaaactcttttttacttcagaaagaattttacaggttaaagggaaagaaatggtgggaaactctccccgtaatgcttagccaactttaaagtgtacccttcaatatccccattggcaactgcagctgagatcttagagaggaaatataaccggtgtgagatctagcaatgcattttgaatcttcactccctaccaggctcttcctatttttaatctcttcacctcagaactagacatatggagagctttaaaggcaagctggaaggcacattgtatcaattctaccttgtgctatacgtaggagagatccaaaatttggatgcttctggagactcttagacatcttttcattgttgtccatttttaaagttgatgattgctggaaacattcacacgcttaaaagcaatggtgtgagttattaatgggtaaactaagaagtgttataggcaatgacttgaaatggtttttaaattgtatggattgttaagaattgttgaaaaaaaattttttttttttggacagcttcaaggagatgttagcaatttcagatatactagccagtttaggtatgactttggaagtgcagaaacagaaggatactgttagaaaatcctaacattggtctccgtgcatgtgttcacacctggtctcactgcctttccttcccacagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta
